United States Patent 11,078,247 (RNA ENCODING A THERAPEUTIC PROTEIN) - sequence listing, part 25

SEQ ID NO: 43632 - RNA, 1401 nt, Artificial Sequence
  derived and/or modified sequence opt2 from GIPR__Homo_sapiens__NP_000155
augaccaccucccccauccuccagcuccuccuccgccucucccucugcggccuccuccuccagcgcgccgagaccggcuccaagggccagaccgccggcgagcucuaccagcgcugggagcgcuaccgccgcgagugccaggagacccucgccgccgccgagccccccuccggccucgccugcaacggcuccuucgacauguacgucugcugggacuacgccgcccccaacgccaccgcccgcgccuccugccccugguaccuccccuggcaccaccacgucgccgccggcuucguccuccgccagugcggcuccgacggccaguggggccucuggcgcgaccacacccagugcgagaaccccgagaagaacgaggccuuccucgaccagcgccucauccucgagcgccuccaggucauguacaccgucggcuacucccucucccucgccacccuccuccucgcccuccucauccucucccucuuccgccgccuccacugcacccgcaacuacauccacaucaaccucuucaccuccuucaugcuccgcgccgccgccauccucucccgcgaccgccuccucccccgccccggccccuaccucggcgaccaggcccucgcccucuggaaccaggcccucgccgccugccgcaccgcccagaucgucacccaguacugcgucggcgccaacuacaccuggcuccucgucgagggcgucuaccuccacucccuccucguccucgucggcggcuccgaggagggccacuuccgcuacuaccuccuccucggcuggggcgcccccgcccucuucgucauccccugggucaucguccgcuaccucuacgagaacacccagugcugggagcgcaacgaggucaaggccaucugguggaucauccgcacccccauccucaugaccauccucaucaacuuccucaucuucauccgcauccucggcauccuccucuccaagcuccgcacccgccagaugcgcugccgcgacuaccgccuccgccucgcccgcuccacccucacccucgucccccuccucggcguccacgaggucgucuucgcccccgucaccgaggagcaggcccgcggcgcccuccgcuucgccaagcucggcuucgagaucuuccucuccuccuuccagggcuuccucgucuccguccucuacugcuucaucaacaaggagguccaguccgagauccgccgcggcuggcaccacugccgccuccgccgcucccucggcgaggagcagcgccagcuccccgagcgcgccuuccgcgcccuccccuccggcuccggccccggcgagguccccaccucccgcggccucuccuccggcacccuccccggccccggcaacgaggccucccgcgagcucgaguccuacugcuga

SEQ ID NO: 43633 - RNA, 2313 nt, Artificial Sequence
  derived and/or modified sequence opt2 from GIT1__Homo_sapiens__NP_001078923
augucccgcaagggcccccgcgccgaggucugcgccgacugcuccgcccccgaccccggcugggccuccaucucccgcggcguccucgucugcgacgagugcugcuccguccaccgcucccucggccgccacaucuccaucgucaagcaccuccgccacuccgccuggccccccacccuccuccagaugguccacacccucgccuccaacggcgccaacuccaucugggagcacucccuccucgaccccgcccagguccaguccggccgccgcaaggccaacccccaggacaagguccaccccaucaaguccgaguucauccgcgccaaguaccagaugcucgccuucguccacaagcuccccugccgcgacgacgacggcgucaccgccaaggaccucuccaagcagcuccacuccuccguccgcaccggcaaccucgagaccugccuccgccuccucucccucggcgcccaggccaacuucuuccaccccgagaagggcaccaccccccuccacgucgccgccaaggccggccagacccuccaggccgagcuccucgucgucuacggcgccgaccccggcucccccgacgucaacggccgcacccccaucgacuacgcccgccaggccggccaccacgagcucgccgagcgccucgucgagugccaguacgagcucaccgaccgccucgccuucuaccucugcggccgcaagcccgaccacaagaacggccacuacaucaucccccagauggccgaccgcucccgccagaagugcaugucccagucccucgaccucuccgagcucgccaaggccgccaagaagaagcuccaggcccucuccaaccgccucuucgaggagcucgccauggacgucuacgacgaggucgaccgccgcgagaacgacgccgucuggcucgccacccagaaccacuccacccucgucaccgagcgcuccgccguccccuuccuccccgucaaccccgaguacuccgccacccgcaaccagggccgccagaagcucgcccgcuucaacgcccgcgaguucgccacccucaucaucgacauccucuccgaggccaagcgccgccagcagggcaagucccucuccucccccaccgacaaccucgagcucucccuccgcucccaguccgaccucgacgaccagcacgacuacgacuccgucgccuccgacgaggacaccgaccaggagccccuccgcuccaccggcgccacccgcuccaaccgcgcccgcuccauggacuccuccgaccucuccgacggcgccgucacccuccaggaguaccucgagcucaagaaggcccucgccaccuccgaggccaagguccagcagcucaugaaggucaacuccucccucuccgacgagcuccgccgccuccagcgcgagauccacaagcuccaggccgagaaccuccagcuccgccagccccccggccccguccccacccccccccuccccuccgagcgcgccgagcacacccccauggcccccggcggcuccacccaccgccgcgaccgccaggccuucuccauguacgagcccggcuccgcccucaagcccuucggcggcccccccggcgacgagcucaccacccgccuccagcccuuccacuccaccgagcucgaggacgacgccaucuacuccguccacguccccgccggccucuaccgcauccgcaagggcgucuccgccuccgccguccccuucacccccuccuccccccuccucuccugcucccaggagggcucccgccacaccuccaagcucucccgccacggcuccggcgccgacuccgacuacgagaacacccaguccggcgacccccuccucggccucgagggcaagcgcuuccucgagcucggcaaggaggaggacuuccaccccgagcucgagucccucgacggcgaccucgaccccggccuccccuccaccgaggacgucauccucaagaccgagcaggucaccaagaacauccaggagcuccuccgcgccgcccaggaguucaagcacgacuccuucguccccugcuccgagaagauccaccucgccgucaccgagauggccucccucuuccccaagcgccccgcccucgagcccguccgcuccucccuccgccuccucaacgccuccgccuaccgccuccaguccgagugccgcaagaccgucccccccgagcccggcgcccccgucgacuuccagcuccucacccagcaggucauccagugcgccuacgacaucgccaaggccgccaagcagcucgucaccaucaccacccgcgagaagaagcaguga

SEQ ID NO: 43634 - RNA, 2046 nt, Artificial Sequence
  derived and/or modified sequence opt2 from GIT2__Homo_sapiens__NP_001128685
auguccaagcgccuccgcuccuccgaggucugcgccgacugcuccggccccgaccccuccugggccuccgucaaccgcggcaccuuccucugcgacgagugcugcuccguccaccgcucccucggccgccacaucucccagguccgccaccucaagcacacccccuggccccccacccuccuccagauggucgagacccucuacaacaacggcgccaacuccaucugggagcacucccuccucgaccccgccuccaucauguccggccgccgcaaggccaacccccaggacaagguccaccccaacaaggccgaguucauccgcgccaaguaccagaugcucgccuucguccaccgccuccccugccgcgacgacgacuccgucaccgccaaggaccucuccaagcagcuccacuccuccguccgcaccggcaaccucgagaccugccuccgccuccucucccucggcgcccaggccaacuucuuccaccccgagaagggcaacaccccccuccacgucgccuccaaggccggccagauccuccaggccgagcuccucgccgucuacggcgccgaccccggcacccaggacuccuccggcaagacccccgucgacuacgcccgccagggcggccaccacgagcucgccgagcgccucgucgagauccaguacgagcucaccgaccgccucgccuucuaccucugcggccgcaagcccgaccacaagaacggccagcacuucaucaucccccagauggccgaccgccgccucucccucgaccucuccgagcucgccaaggccgccaagaagaagcuccagucccucuccaaccaccucuucgaggagcucgccauggacgucuacgacgaggucgaccgccgcgagaccgacgccgucuggcucgccacccagaaccacuccgcccucgucaccgagaccaccgucguccccuuccuccccgucaaccccgaguacuccuccacccgcaaccagggccgccagaagcucgcccgcuucaacgcccacgaguucgccacccucgucaucgacauccucuccgacgccaagcgccgccagcagggcuccucccucuccggcuccaaggacaacgucgagcucauccucaagaccaucaacaaccagcacuccgucgagucccaggacaacgaccagcccgacuacgacuccgucgccuccgacgaggacaccgaccucgagaccaccgccuccaagaccaaccgccagaagcuccagacccuccaguccgagaacuccaaccuccgcaagcaggccaccaccaacgucuaccagguccagaccggcuccgaguacaccgacaccuccaaccacuccucccucaagcgccgccccuccgcccgcggcucccgccccauguccauguacgagaccggcuccggccagaagcccuaccuccccaugggcgaggccucccgccccgaggagucccgcaugcgccuccagcccuuccccgcccacgccucccgccucgagaagcagaacuccacccccgaguccgacuacgacaacacccccaacgacauggagcccgacggcaugggcuccucccgcaagggccgccagcgcuccauggucuggcccggcgacggccucguccccgacaccgccgagccccacgucgcccccucccccacccuccccuccaccgaggacgucauccgcaagaccgagcagaucaccaagaacauccaggagcuccuccgcgccgcccaggagaacaagcacgacuccuacauccccugcuccgagcgcauccacgucgccgucaccgagauggccgcccucuuccccaagaagcccaaguccgacaugguccgcaccucccuccgccuccucaccuccuccgccuaccgccuccaguccgagugcaagaagacccuccccggcgaccccggcucccccaccgacguccagcucgucacccagcaggucauccagugcgccuacgacaucgccaaggccgccaagcagcucgucaccaucaccaccaaggagaacaacaacuga

SEQ ID NO: 43635 - RNA, 1149 nt, Artificial Sequence
  derived and/or modified sequence opt2 from GJA1__Homo_sapiens__NP_000156
augggcgacugguccgcccucggcaagcuccucgacaagguccaggccuacuccaccgccggcggcaaggucuggcucuccguccucuucaucuuccgcauccuccuccucggcaccgccgucgaguccgccuggggcgacgagcaguccgccuuccgcugcaacacccagcagcccggcugcgagaacgucugcuacgacaaguccuuccccaucucccacguccgcuucuggguccuccagaucaucuucgucuccguccccacccuccucuaccucgcccacgucuucuacgucaugcgcaaggaggagaagcucaacaagaaggaggaggagcucaaggucgcccagaccgacggcgucaacgucgacaugcaccucaagcagaucgagaucaagaaguucaaguacggcaucgaggagcacggcaaggucaagaugcgcggcggccuccuccgcaccuacaucaucuccauccucuucaaguccaucuucgaggucgccuuccuccucauccagugguacaucuacggcuucucccucuccgccgucuacaccugcaagcgcgaccccugcccccaccaggucgacugcuuccucucccgccccaccgagaagaccaucuucaucaucuucaugcucgucgucucccucgucucccucgcccucaacaucaucgagcucuucuacgucuucuucaagggcgucaaggaccgcgucaagggcaaguccgaccccuaccacgccaccuccggcgcccucucccccgccaaggacugcggcucccagaaguacgccuacuucaacggcugcuccucccccaccgccccccucucccccauguccccccccggcuacaagcucgucaccggcgaccgcaacaacuccuccugccgcaacuacaacaagcaggccuccgagcagaacugggccaacuacuccgccgagcagaaccgcaugggccaggccggcuccaccaucuccaacucccacgcccagcccuucgacuuccccgacgacaaccagaacuccaagaagcucgccgccggccacgagcuccagccccucgccaucgucgaccagcgccccuccucccgcgccuccucccgcgccuccucccgcccccgccccgacgaccucgagaucuga

SEQ ID NO: 43636 - RNA, 1308 nt, Artificial Sequence
  derived and/or modified sequence opt2 from GJA3__Homo_sapiens__NP_068773
augggcgacugguccuuccucggccgccuccucgagaacgcccaggagcacuccaccgucaucggcaaggucuggcucaccguccucuucaucuuccgcauccucguccucggcgccgccgccgaggacgucuggggcgacgagcaguccgacuucaccugcaacacccagcagcccggcugcgagaacgucugcuacgaccgcgccuuccccaucucccacauccgcuucugggcccuccagaucaucuucgucuccacccccacccucaucuaccucggccacguccuccacaucguccgcauggaggagaagaagaaggagcgcgaggaggaggagcagcucaagcgcgagucccccucccccaaggagcccccccaggacaaccccuccucccgcgacgaccgcggccgcguccgcauggccggcgcccuccuccgcaccuacgucuucaacaucaucuucaagacccucuucgaggucggcuucaucgccggccaguacuuccucuacggcuucgagcucaagccccucuaccgcugcgaccgcuggcccugccccaacaccgucgacugcuucaucucccgccccaccgagaagaccaucuucaucaucuucaugcucgccgucgccugcgccucccuccuccucaacaugcucgagaucuaccaccucggcuggaagaagcucaagcagggcgucaccucccgccucggccccgacgccuccgaggccccccucggcaccgccgacccccccccccucccccccuccucccgcccccccgccgucgccaucggcuucccccccuacuacgcccacaccgccgccccccucggccaggcccgcgccgucggcuaccccggcgcccccccccccgccgccgacuucaagcuccucgcccucaccgaggcccgcggcaagggccaguccgccaagcucuacaacggccaccaccaccuccucaugaccgagcagaacugggccaaccaggccgccgagcgccagccccccgcccucaaggccuaccccgccgccuccacccccgccgcccccucccccgucggcuccuccucccccccccucgcccacgaggccgaggccggcgccgccccccuccuccucgacggcuccggcuccucccucgagggcuccgcccucgccggcacccccgaggaggaggagcaggccgucaccaccgccgcccagaugcaccagcccccccucccccucggcgaccccggccgcgccuccaaggccucccgcgccuccuccggccgcgcccgccccgaggaccucgccaucuga

SEQ ID NO: 43637 - RNA, 1284 nt, Artificial Sequence
  derived and/or modified sequence opt2 from GJA8__Homo_sapiens__XP_011507719
augggcgacugguccuuccucggcaacauccucgaggaggucaacgagcacuccaccgucaucggccgcgucuggcucaccguccucuucaucuuccgcauccucauccucggcaccgccgccgaguucgucuggggcgacgagcaguccgacuucgucugcaacacccagcagcccggcugcgagaacgucugcuacgacgaggccuuccccaucucccacauccgccucuggguccuccagaucaucuucgucuccacccccucccucauguacgucggccacgccguccacuacguccgcauggaggagaagcgcaagucccgcgaggccgaggagcucggccagcaggccggcaccaacggcggccccgaccagggcuccgucaagaaguccuccggcuccaagggcaccaagaaguuccgccucgagggcacccuccuccgcaccuacaucugccacaucaucuucaagacccucuucgaggucggcuucaucgucggccacuacuuccucuacggcuuccgcauccucccccucuaccgcugcucccgcuggcccugccccaacgucgucgacugcuucgucucccgccccaccgagaagaccaucuucauccucuucaugcucuccgucgccuccgucucccucuuccucaacgucauggagcucggccaccucggccucaagggcauccgcuccgcccucaagcgccccgucgagcagccccucggcgagauccccgagaagucccuccacuccaucgccgucuccuccauccagaaggccaagggcuaccagcuccucgaggaggagaagaucgucucccacuacuucccccucaccgaggucggcauggucgagaccuccccccuccccgccaagcccuucaaccaguucgaggagaagaucuccaccggcccccucggcgaccucucccgcggcuaccaggagacccuccccuccuacgcccaggucggcgcccaggaggucgagggcgagggcccccccgccgaggagggcgccgagcccgaggucggcgagaagaaggaggaggccgagcgccucaccaccgaggagcaggagaaggucgccguccccgagggcgagaaggucgagacccccggcgucgacaaggagggcgagaaggaggagccccaguccgagaaggucuccaagcagggccuccccgccgagaagacccccucccucugccccgagcucaccaccgacgacgcccgcccccucucccgccucuccaaggccuccucccgcgcccgcuga

SEQ ID NO: 43638 - RNA, 852 nt, Artificial Sequence
  derived and/or modified sequence opt2 from GJB1__Homo_sapiens__NP_000157
augaacuggaccggccucuacacccuccucuccggcgucaaccgccacuccaccgccaucggccgcgucuggcucuccgucaucuucaucuuccgcaucaugguccucgucgucgccgccgaguccgucuggggcgacgagaaguccuccuucaucugcaacacccuccagcccggcugcaacuccgucugcuacgaccaguucuuccccaucucccacguccgccucuggucccuccagcucauccucgucuccacccccgcccuccucgucgccaugcacgucgcccaccagcagcacaucgagaagaagaugcuccgccucgagggccacggcgacccccuccaccucgaggaggucaagcgccacaagguccacaucuccggcacccucugguggaccuacgucaucuccgucgucuuccgccuccucuucgaggccgucuucauguacgucuucuaccuccucuaccccggcuacgccaugguccgccucgucaagugcgacgucuaccccugccccaacaccgucgacugcuucgucucccgccccaccgagaagaccgucuucaccgucuucaugcucgccgccuccggcaucugcaucauccucaacgucgccgaggucgucuaccucaucauccgcgccugcgcccgccgcgcccagcgccgcuccaacccccccucccgcaagggcuccggcuucggccaccgccucucccccgaguacaagcagaacgagaucaacaagcuccucuccgagcaggacggcucccucaaggacauccuccgccgcucccccggcaccggcgccggccucgccgagaaguccgaccgcugcuccgccugcuga

SEQ ID NO: 43639 - RNA, 681 nt, Artificial Sequence
  derived and/or modified sequence opt2 from GJB2__Homo_sapiens__NP_003995
auggacuggggcacccuccagaccauccucggcggcgucaacaagcacuccaccuccaucggcaagaucuggcucaccguccucuucaucuuccgcaucaugauccucgucgucgccgccaaggaggucuggggcgacgagcaggccgacuucgucugcaacacccuccagcccggcugcaagaacgucugcuacgaccacuacuuccccaucucccacauccgccucugggcccuccagcucaucuucgucuccacccccgcccuccucgucgccaugcacgucgccuaccgccgccacgagaagaagcgcaaguucaucaagggcgagaucaaguccgaguucaaggacaucgaggagaucaagacccagaagguccgcaucgagggcucccucugguggaccuacaccuccuccaucuucuuccgcgucaucuucgaggccgccuucauguacgucuucuacgucauguacgacggcuucuccaugcagcgccucgucaagugcaacgccuggcccugccccaacaccgucgacugcuucgucucccgccccaccgagaagaccgucuucaccgucuucaugaucgccgucuccggcaucugcauccuccucaacgucaccgagcucugcuaccuccucauccgcuacugcuccggcaaguccaagaagcccgucuga

SEQ ID NO: 43640 - RNA, 786 nt, Artificial Sequence
  derived and/or modified sequence opt2 from GJB6__Homo_sapiens__NP_001103691
auggacuggggcacccuccacaccuucaucggcggcgucaacaagcacuccaccuccaucggcaaggucuggaucaccgucaucuucaucuuccgcgucaugauccucgucgucgccgcccaggaggucuggggcgacgagcaggaggacuucgucugcaacacccuccagcccggcugcaagaacgucugcuacgaccacuucuuccccgucucccacauccgccucugggcccuccagcucaucuucgucuccacccccgcccuccucgucgccaugcacgucgccuacuaccgccacgagaccacccgcaaguuccgccgcggcgagaagcgcaacgacuucaaggacaucgaggacaucaagaagcagaagguccgcaucgagggcucccucugguggaccuacaccuccuccaucuucuuccgcaucaucuucgaggccgccuucauguacgucuucuacuuccucuacaacggcuaccaccuccccuggguccucaagugcggcaucgaccccugccccaaccucgucgacugcuucaucucccgccccaccgagaagaccgucuucaccaucuucaugaucuccgccuccgucaucugcaugcuccucaacgucgccgagcucugcuaccuccuccucaaggucugcuuccgccgcuccaagcgcgcccagacccagaagaaccaccccaaccacgcccucaaggaguccaagcagaacgagaugaacgagcucaucuccgacuccggccagaacgccaucaccggcuuccccuccuga

SEQ ID NO: 43641 - RNA, 1191 nt, Artificial Sequence
  derived and/or modified sequence opt2 from GJC1__Homo_sapiens__NP_001073852
auguccugguccuuccucacccgccuccucgaggagauccacaaccacuccaccuucgucggcaagaucuggcucaccguccucaucgucuuccgcaucguccucaccgccgucggcggcgaguccaucuacuacgacgagcaguccaaguucgucugcaacaccgagcagcccggcugcgagaacgucugcuacgacgccuucgccccccucucccacguccgcuucugggucuuccagaucauccucgucgccacccccuccgucauguaccucggcuacgccauccacaagaucgccaagauggagcacggcgaggccgacaagaaggccgcccgcuccaagcccuacgccaugcgcuggaagcagcaccgcgcccucgaggagaccgaggaggacaacgaggaggaccccaugauguaccccgagauggagcucgaguccgacaaggagaacaaggagcagucccagcccaagcccaagcacgacggccgccgccgcauccgcgaggacggccucaugaagaucuacguccuccagcuccucgcccgcaccgucuucgaggucggcuuccucaucggccaguacuuccucuacggcuuccagguccaccccuucuacgucugcucccgccuccccugcccccacaagaucgacugcuucaucucccgccccaccgagaagaccaucuuccuccucaucauguacggcgucaccggccucugccuccuccucaacaucugggagaugcuccaccucggcuucggcaccauccgcgacucccucaacuccaagcgccgcgagcucgaggaccccggcgccuacaacuaccccuucaccuggaacacccccuccgccccccccggcuacaacaucgccgucaagcccgaccagauccaguacaccgagcucuccaacgccaagaucgccuacaagcagaacaaggccaacaccgcccaggagcagcaguacggcucccacgaggagaaccuccccgccgaccucgaggcccuccagcgcgagauccgcauggcccaggagcgccucgaccucgccguccaggccuacucccaccagaacaacccccacggcccccgcgagaagaaggccaaggucggcuccaaggccggcuccaacaaguccaccgccuccuccaaguccggcgacggcaagaccuccgucuggaucuga

SEQ ID NO: 43642 - RNA, 1320 nt, Artificial Sequence
  derived and/or modified sequence opt2 from GJC2__Homo_sapiens__NP_065168
augaccaacauguccugguccuuccucacccgccuccucgaggagauccacaaccacuccaccuucgucggcaaggucuggcucaccguccucgucgucuuccgcaucguccucaccgccgucggcggcgaggccaucuacuccgacgagcaggccaaguucaccugcaacacccgccagcccggcugcgacaacgucugcuacgacgccuucgccccccucucccacguccgcuucugggucuuccagaucgucgucaucuccacccccuccgucauguaccucggcuacgccguccaccgccucgcccgcgccuccgagcaggagcgccgccgcgcccuccgccgccgccccggcccccgccgcgccccccgcgcccaccucccccccccccacgccggcuggcccgagcccgccgaccucggcgaggaggagcccaugcucggccucggcgaggaggaggaggaggaggagaccggcgccgccgagggcgccggcgaggaggccgaggaggccggcgccgaggaggccugcaccaaggccgucggcgccgacggcaaggccgccggcacccccggccccaccggccagcacgacggccgccgccgcauccagcgcgagggccucaugcgcgucuacgucgcccagcucgucgcccgcgccgccuucgaggucgccuuccucgucggccaguaccuccucuacggcuucgagguccgccccuucuuccccugcucccgccagcccugcccccacgucgucgacugcuucgucucccgccccaccgagaagaccgucuuccuccucgucauguacgucgucuccugccucugccuccuccucaaccucugcgagauggcccaccucggccucggcuccgcccaggacgccguccgcggccgccgcggcccccccgccuccgcccccgcccccgccccccgccccccccccugcgccuuccccgccgccgccgccggccucgccugcccccccgacuacucccucgucguccgcgccgccgagcgcgcccgcgcccacgaccagaaccucgccaaccucgcccuccaggcccuccgcgacggcgccgccgccggcgaccgcgaccgcgacuccucccccugcgucggccuccccgccgccucccgcggccccccccgcgccggcgcccccgccucccgcaccggcuccgccaccuccgccggcaccgucggcgagcagggccgccccggcacccacgagcgccccggcgccaagccccgcgccggcuccgagaagggcuccgccuccucccgcgacggcaagaccaccgucuggaucuga

SEQ ID NO: 43643 - RNA, 840 nt, Artificial Sequence
  derived and/or modified sequence opt2 from GJC3__Homo_sapiens__NP_853516
augugcggccgcuuccuccgccgccuccucgccgaggagucccgccgcuccacccccgucggccgccuccuccuccccguccuccucggcuuccgccucguccuccucgccgccuccggccccggcgucuacggcgacgagcaguccgaguucgucugccacacccagcagcccggcugcaaggccgccugcuucgacgccuuccacccccucuccccccuccgcuucugggucuuccaggucauccucgucgccguccccuccgcccucuacaugggcuucacccucuaccacgucaucuggcacugggagcucuccggcaagggcaaggaggaggagacccucauccagggccgcgagggcaacaccgacguccccggcgccggcucccuccgccuccucugggccuacgucgcccagcucggcgcccgccucguccucgagggcgccgcccucggccuccaguaccaccucuacggcuuccagaugcccuccuccuucgccugccgccgcgagcccugccucggcuccaucaccugcaaccucucccgccccuccgagaagaccaucuuccucaagaccauguucggcgucuccggcuucugccuccucuucaccuuccucgagcucguccuccucggccucggccgcugguggcgcaccuggaagcacaaguccuccuccuccaaguacuuccucaccuccgaguccacccgccgccacaagaaggccaccgacucccuccccgucgucgagaccaaggagcaguuccaggaggccguccccggccgcucccucgcccaggagaagcagcgccccgucggcccccgcgacgccuga

SEQ ID NO: 43644 - RNA, 966 nt, Artificial Sequence
  derived and/or modified sequence opt2 from GJD2__Homo_sapiens__NP_065711
augggcgaguggaccauccucgagcgccuccucgaggccgccguccagcagcacuccaccaugaucggccgcauccuccucaccgucgucgucaucuuccgcauccucaucgucgccaucgucggcgagaccgucuacgacgacgagcagaccauguucgucugcaacacccuccagcccggcugcaaccaggccugcuacgaccgcgccuuccccaucucccacauccgcuacugggucuuccagaucaucauggucugcacccccucccucugcuucaucaccuacuccguccaccaguccgccaagcagcgcgagcgccgcuacuccaccgucuuccucgcccucgaccgcgacccccccgaguccaucggcggccccggcggcaccggcggcggcggcuccggcggcggcaagcgcgaggacaagaagcuccagaacgccaucgucaacggcguccuccagaacaccgagaacaccuccaaggagaccgagcccgacugccucgaggucaaggagcucaccccccaccccuccggccuccgcaccgccuccaaguccaagcuccgccgccaggagggcaucucccgcuucuacaucauccaggucgucuuccgcaacgcccucgagaucggcuuccucgucggccaguacuuccucuacggcuucuccguccccggccucuacgagugcaaccgcuaccccugcaucaaggaggucgagugcuacgucucccgccccaccgagaagaccgucuuccucgucuucauguucgccgucuccggcaucugcgucguccucaaccucgccgagcucaaccaccucggcuggcgcaagaucaagcucgccguccgcggcgcccaggccaagcgcaaguccaucuacgagauccgcaacaaggaccucccccgcgucuccguccccaacuucggccgcacccaguccuccgacuccgccuacgucuga

SEQ ID NO: 43645 - RNA, 885 nt, Artificial Sequence
  derived and/or modified sequence opt2 from GJD3__Homo_sapiens__NP_689343
augggcgagugggccuuccucggcucccuccucgacgccguccagcuccaguccccccucgucggccgccucuggcucgucgucaugcucaucuuccgcauccucguccucgccaccgucggcggcgccgucuucgaggacgagcaggaggaguucgucugcaacacccuccagcccggcugccgccagaccugcuacgaccgcgccuuccccgucucccacuaccgcuucuggcucuuccacauccuccuccucuccgccccccccguccucuucgucgucuacuccaugcaccgcgccggcaaggaggccggcggcgccgaggccgccgcccagugcgcccccggccuccccgaggcccagugcgcccccugcgcccuccgcgcccgccgcgcccgccgcugcuaccuccucuccgucgcccuccgccuccucgccgagcucaccuuccucggcggccaggcccuccucuacggcuuccgcgucgccccccacuucgccugcgccggcccccccugcccccacaccgucgacugcuucgucucccgccccaccgagaagaccgucuucguccucuucuacuucgccgucggccuccucuccgcccuccucuccgucgccgagcucggccaccuccucuggaagggccgcccccgcgccggcgagcgcgacaaccgcugcaaccgcgcccacgaggaggcccagaagcuccucccccccccccccccccccccccccccccccgcccuccccucccgccgccccggccccgagcccugcgccccccccgccuacgcccaccccgcccccgccucccuccgcgagugcggcuccggccgcggcaaggccucccccgccaccggccgccgcgaccucgccaucuga

SEQ ID NO: 43646 - RNA, 1575 nt, Artificial Sequence
  derived and/or modified sequence opt2 from GK__Homo_sapiens__NP_000158
auggccgccuccaagaaggccguccucggcccccucgucggcgccgucgaccagggcaccuccuccacccgcuuccucgucuucaacuccaagaccgccgagcuccucucccaccaccaggucgagaucaagcaggaguucccccgcgagggcugggucgagcaggaccccaaggagauccuccacuccgucuacgagugcaucgagaagaccugcgagaagcucggccagcucaacaucgacaucuccaacaucaaggccaucggcgucuccaaccagcgcgagaccaccgucgucugggacaagaucaccggcgagccccucuacaacgccgucgucuggcucgaccuccgcacccaguccaccgucgagucccucuccaagcgcauccccggcaacaacaacuucgucaaguccaagaccggccucccccucuccaccuacuucuccgccgucaagcuccgcuggcuccucgacaacguccgcaagguccagaaggccgucgaggagaagcgcgcccucuucggcaccaucgacuccuggcucaucuggucccucaccggcggcgucaacggcggcguccacugcaccgacgucaccaacgccucccgcaccaugcucuucaacauccacucccucgagugggacaagcagcucugcgaguucuucggcauccccauggagauccuccccaacguccgcuccuccuccgagaucuacggccucaugaaggccggcgcccucgagggcguccccaucuccggcugccucggcgaccaguccgccgcccucgucggccagaugugcuuccagaucggccaggccaagaacaccuacggcaccggcugcuuccuccucugcaacaccggccacaagugcgucuucuccgaccacggccuccucaccaccgucgccuacaagcucggccgcgacaagcccgucuacuacgcccucgagggcuccgucgccaucgccggcgccgucauccgcuggcuccgcgacaaccucggcaucaucaagaccuccgaggagaucgagaagcucgccaaggaggucggcaccuccuacggcugcuacuucguccccgccuucuccggccucuacgcccccuacugggagcccuccgcccgcggcaucaucugcggccucacccaguucaccaacaagugccacaucgccuucgccgcccucgaggccgucugcuuccagacccgcgagauccucgacgccaugaaccgcgacugcggcaucccccucucccaccuccaggucgacggcggcaugaccuccaacaagauccucaugcagcuccaggccgacauccucuacauccccgucgucaagcccuccaugcccgagaccaccgcccucggcgccgccauggccgccggcgccgccgagggcgucggcgucuggucccucgagcccgaggaccucuccgccgucaccauggagcgcuucgagccccagaucaacgccgaggaguccgagauccgcuacuccaccuggaagaaggccgucaugaaguccaugggcugggucaccacccagucccccgaguccggcauccccuga

SEQ ID NO: 43647 - RNA, 600 nt, Artificial Sequence
  derived and/or modified sequence opt2 from GKN1__Homo_sapiens__NP_062563
augcucgccuacuccuccguccacugcuuccgcgaggacaagaugaaguucaccaucgucuucgccggccuccucggcgucuuccucgcccccgcccucgccaacuacaacaucaacgucaacgacgacaacaacaacgccggcuccggccagcaguccgucuccgucaacaacgagcacaacgucgccaacgucgacaacaacaacggcugggacuccuggaacuccaucugggacuacggcaacggcuucgccgccacccgccucuuccagaagaagaccugcaucguccacaagaugaacaaggaggucaugcccuccauccagucccucgacgcccucgucaaggagaagaagcuccagggcaagggccccggcggccccccccccaagggccucauguacuccgucaaccccaacaaggucgacgaccucuccaaguucggcaagaacaucgccaacaugugccgcggcauccccaccuacauggccgaggagaugcaggaggccucccucuucuucuacuccggcaccugcuacaccaccuccguccucuggaucgucgacaucuccuucugcggcgacaccgucgagaacuga

SEQ ID NO: 43648 - RNA, 555 nt, Artificial Sequence
  derived and/or modified sequence opt2 from GKN2__Homo_sapiens__NP_872342
augaagauccucgucgccuuccucgucguccucaccaucuucggcauccagucccacggcuacgaggucuucaacaucaucucccccuccaacaacggcggcaacguccaggagaccgucaccaucgacaacgagaagaacaccgccaucaucaacauccacgccggcuccugcuccuccaccaccaucuucgacuacaagcacggcuacaucgccucccgcguccucucccgccgcgccugcuucauccucaagauggaccaccagaacauccccccccucaacaaccuccagugguacaucuacgagaagcaggcccucgacaacauguucuccuccaaguacaccugggucaaguacaacccccucgagucccucaucaaggacgucgacugguuccuccucggcucccccaucgagaagcucugcaagcacaucccccucuacaagggcgaggucgucgagaacacccacaacgucggcgccggcggcugcgccaaggccggccuccucggcauccucggcaucuccaucugcgccgacauccacgucuga

SEQ ID NO: 43649 - RNA, 1290 nt, Artificial Sequence
  derived and/or modified sequence opt2 from GLA__Homo_sapiens__NP_000160
augcagcuccgcaaccccgagcuccaccucggcugcgcccucgcccuccgcuuccucgcccucgucuccugggacauccccggcgcccgcgcccucgacaacggccucgcccgcacccccaccaugggcuggcuccacugggagcgcuucaugugcaaccucgacugccaggaggagcccgacuccugcaucuccgagaagcucuucauggagauggccgagcucauggucuccgagggcuggaaggacgccggcuacgaguaccucugcaucgacgacugcuggauggccccccagcgcgacuccgagggccgccuccaggccgacccccagcgcuucccccacggcauccgccagcucgccaacuacguccacuccaagggccucaagcucggcaucuacgccgacgucggcaacaagaccugcgccggcuuccccggcuccuucggcuacuacgacaucgacgcccagaccuucgccgacuggggcgucgaccuccucaaguucgacggcugcuacugcgacucccucgagaaccucgccgacggcuacaagcacaugucccucgcccucaaccgcaccggccgcuccaucgucuacuccugcgaguggccccucuacauguggcccuuccagaagcccaacuacaccgagauccgccaguacugcaaccacuggcgcaacuucgccgacaucgacgacuccuggaaguccaucaaguccauccucgacuggaccuccuucaaccaggagcgcaucgucgacgucgccggccccggcggcuggaacgaccccgacaugcucgucaucggcaacuucggccucuccuggaaccagcaggucacccagauggcccucugggccaucauggccgccccccucuucauguccaacgaccuccgccacaucuccccccaggccaaggcccuccuccaggacaaggacgucaucgccaucaaccaggacccccucggcaagcagggcuaccagcuccgccagggcgacaacuucgaggucugggagcgcccccucuccggccucgccugggccgucgccaugaucaaccgccaggagaucggcggcccccgcuccuacaccaucgccgucgccucccucggcaagggcgucgccugcaaccccgccugcuucaucacccagcuccuccccgucaagcgcaagcucggcuucuacgaguggaccucccgccuccgcucccacaucaaccccaccggcaccguccuccuccagcucgagaacaccaugcagaugucccucaaggaccuccucuga

SEQ ID NO: 43650 - RNA, 2034 nt, Artificial Sequence
  derived and/or modified sequence opt2 from GLB1__Homo_sapiens__NP_000395
augcccggcuuccucguccgcauccucccccuccuccucguccuccuccuccucggccccacccgcggccuccgcaacgccacccagcgcauguucgagaucgacuacucccgcgacuccuuccucaaggacggccagcccuuccgcuacaucuccggcuccauccacuacucccgcgucccccgcuucuacuggaaggaccgccuccucaagaugaagauggccggccucaacgccauccagaccuacguccccuggaacuuccacgagcccuggcccggccaguaccaguucuccgaggaccacgacgucgaguacuuccuccgccucgcccacgagcucggccuccucgucauccuccgccccggccccuacaucugcgccgagugggagaugggcggccuccccgccuggcuccucgagaaggaguccauccuccuccgcuccuccgaccccgacuaccucgccgccgucgacaaguggcucggcguccuccuccccaagaugaagccccuccucuaccagaacggcggccccgucaucaccguccaggucgagaacgaguacggcuccuacuucgccugcgacuucgacuaccuccgcuuccuccagaagcgcuuccgccaccaccucggcgacgacgucguccucuucaccaccgacggcgcccacaagaccuuccucaagugcggcgcccuccagggccucuacaccaccgucgacuucggcaccggcuccaacaucaccgacgccuuccucucccagcgcaagugcgagcccaagggcccccucaucaacuccgaguucuacaccggcuggcucgaccacuggggccagccccacuccaccaucaagaccgaggccgucgccuccucccucuacgacauccucgcccgcggcgccuccgucaaccucuacauguucaucggcggcaccaacuucgccuacuggaacggcgccaacucccccuacgccgcccagcccaccuccuacgacuacgacgccccccucuccgaggccggcgaccucaccgagaaguacuucgcccuccgcaacaucauccagaaguucgagaagguccccgagggccccaucccccccuccacccccaaguucgccuacggcaaggucacccucgagaagcucaagaccgucggcgccgcccucgacauccucugccccuccggccccaucaagucccucuacccccucaccuucauccaggucaagcagcacuacggcuucguccucuaccgcaccacccucccccaggacugcuccaaccccgccccccucuccuccccccucaacggcguccacgaccgcgccuacgucgccgucgacggcaucccccagggcguccucgagcgcaacaacgucaucacccucaacaucaccggcaaggccggcgccacccucgaccuccucgucgagaacaugggccgcgucaacuacggcgccuacaucaacgacuucaagggccucgucuccaaccucacccucuccuccaacauccucaccgacuggaccaucuucccccucgacaccgaggacgccguccgcucccaccucggcggcuggggccaccgcgacuccggccaccacgacgaggccugggcccacaacuccuccaacuacacccuccccgccuucuacaugggcaacuucuccauccccuccggcauccccgaccucccccaggacaccuucauccaguuccccggcuggaccaagggccaggucuggaucaacggcuucaaccucggccgcuacuggcccgcccgcggcccccagcucacccucuucgucccccagcacauccucaugaccuccgcccccaacaccaucaccguccucgagcucgagugggcccccugcuccuccgacgaccccgagcucugcgccgucaccuucgucgaccgccccgucaucggcuccuccgucaccuacgaccaccccuccaagcccgucgagaagcgccucaugcccccccccccccagaagaacaaggacuccuggcucgaccacgucuga

SEQ ID NO: 43651 - RNA, 1644 nt, Artificial Sequence
  derived and/or modified sequence opt2 from GLCCI1__Homo_sapiens__NP_612435
auguccaccgccuccuccuccuccuccuccuccuccucccagaccccccacccccccucccagcgcaugcgccgcuccgccgccggcuccccccccgccgucgccgccgccggcuccggcaacggcgccggcggcggcggcggcgucggcugcgcccccgccgccggcgccggccgccuccuccagcccauccgcgccaccguccccuaccagcuccuccgcggcucccagcacucccccacccgcccccccgucgccgccgccgccgccucccucggcucccuccccggccccggcgccgcccgcggccccucccccuccucccccaccccccccgccgccgccgcccccgccgagcaggccccccgcgccaagggccgcccccgccgcucccccgagucccaccgccgcuccuccucccccgagcgccgcucccccggcucccccgucugccgcgccgacaaggccaagucccagcagguccgcaccuccuccaccauccgccgcaccuccucccucgacaccaucaccggccccuaccucaccggccaguggccccgcgacccccacguccacuaccccuccugcaugaaggacaaggccacccagacccccuccugcugggccgaggagggcgccgagaagcgcucccaccagcgcuccgccuccuggggcuccgccgaccagcucaaggagcagaucgccaagcuccgccagcagcuccagcgcuccaagcaguccucccgccacuccaaggagaaggaccgccaguccccccuccacggcaaccacaucaccaucucccacacccaggccaccggcucccgcuccguccccaugccccucuccaacaucuccguccccaaguccuccgucucccgcguccccugcaacgucgagggcaucucccccgagcucgagaaggucuucaucaaggagaacaacggcaaggaggaggucuccaagccccucgacauccccgacggccgccgcgccccccuccccgcccacuaccgcuccuccuccacccgcuccaucgacacccagacccccuccguccaggagcgcuccuccuccugcuccucccacucccccugcgucucccccuucugcccccccgagucccaggacggcucccccugcuccaccgaggaccuccucuacgaccgcgacaaggacuccggcuccuccuccccccuccccaaguacgccuccucccccaagcccaacaacuccuacauguucaagcgcgagccccccgagggcugcgagcgcgucaaggucuucgaggagauggccucccgccagcccaucuccgccccccucuucuccugccccgacaagaacaaggucaacuucauccccaccggcuccgccuucugccccgucaagcuccucggcccccuccuccccgccuccgaccucaugcucaagaacucccccaacuccggccaguccuccgcccucgccacccucaccgucgagcagcucuccucccgcgucuccuucaccucccucuccgacgacaccuccaccgccggcuccauggaggccuccguccagcagcccucccagcagcagcagcuccuccaggagcuccagggcgaggaccacaucuccgcccagaacuacgucaucaucuga

SEQ ID NO: 43652 - RNA, 1854 nt, Artificial Sequence
  derived and/or modified sequence opt2 from GLCE__Homo_sapiens__XP_005254355
augcgcugccucgccgcccgcgucaacuacaagacccucaucaucaucugcgcccucuucacccucgucaccguccuccucuggaacaagugcuccuccgacaaggccauccaguucccccgccgcuccuccuccggcuuccgcgucgacggcuucgagaagcgcgccgccgccuccgaguccaacaacuacaugaaccacgucgccaagcagcaguccgaggaggccuucccccaggagcagcagaaggccccccccgucgucggcggcuucaacuccaacgucggcuccaagguccucggccucaaguacgaggagaucgacugccucaucaacgacgagcacaccaucaagggccgccgcgagggcaacgaggucuuccuccccuucaccugggucgagaaguacuucgacgucuacggcaaggucguccaguacgacggcuacgaccgcuucgaguucucccacuccuacuccaaggucuacgcccagcgcgcccccuaccaccccgacggcgucuucauguccuucgagggcuacaacgucgagguccgcgaccgcgucaagugcaucuccggcgucgagggcgucccccucuccacccaguggggcccccagggcuacuucuaccccauccagaucgcccaguacggccucucccacuacuccaagaaccucaccgagaagcccccccacaucgaggucuacgagaccgccgaggaccgcgacaagaacaagcccaacgacuggaccguccccaagggcugcuucauggccaacgucgccgacaagucccgcuucaccaacgucaagcaguucaucgcccccgagaccuccgagggcgucucccuccagcucggcaacaccaaggacuucaucaucuccuucgaccucaaguuccucaccaacggcuccgucuccgucguccucgagaccaccgagaagaaccagcucuucaccauccacuacgucuccaacgcccagcucaucgccuucaaggagcgcgacaucuacuacggcaucggcccccgcaccuccugguccaccgucacccgcgaccucgucaccgaccuccgcaagggcgucggccucuccaacaccaaggccgucaagcccaccaagaucaugcccaagaaggucguccgccucaucgccaagggcaagggcuuccucgacaacaucaccaucuccaccaccgcccacauggccgccuucuucgccgccuccgacuggcucguccgcaaccaggacgagaagggcggcuggcccaucauggucacccgcaagcucggcgagggcuucaagucccucgagcccggcugguacuccgccauggcccagggccaggccaucuccacccucguccgcgccuaccuccucaccaaggaccacaucuuccucaacuccgcccuccgcgccaccgcccccuacaaguuccucuccgagcagcacggcgucaaggccgucuucaugaacaagcacgacugguacgaggaguaccccaccacccccuccuccuucguccucaacggcuucauguacucccucaucggccucuacgaccucaaggagaccgccggcgagaagcucggcaaggaggcccgcucccucuacgagcgcggcauggagucccucaaggccaugcucccccucuacgacaccggcuccggcaccaucuacgaccuccgccacuucaugcucggcaucgcccccaaccucgcccgcugggacuaccacaccacccacaucaaccagcuccagcuccucuccaccaucgacgagucccccgucuucaaggaguucgucaagcgcuggaaguccuaccucaagggcucccgcgccaagcacaacuga

SEQ ID NO: 43653 - RNA, 3063 nt, Artificial Sequence
  derived and/or modified sequence opt2 from GLDC__Homo_sapiens__NP_000161
augcaguccugcgcccgcgccuggggccuccgccucggccgcggcgucggcggcggccgccgccucgccggcggcuccggccccugcugggccccccgcucccgcgacuccuccuccggcggcggcgacuccgccgccgccggcgccucccgccuccucgagcgccuccucccccgccacgacgacuucgcccgccgccacaucggccccggcgacaaggaccagcgcgagaugcuccagacccucggccucgccuccaucgacgagcucaucgagaagaccguccccgccaacauccgccucaagcgcccccucaagauggaggaccccgucugcgagaacgagauccucgccacccuccacgccaucuccuccaagaaccagaucuggcgcuccuacaucggcaugggcuacuacaacugcuccgucccccagaccauccuccgcaaccuccucgagaacuccggcuggaucacccaguacacccccuaccagcccgaggucucccagggccgccucgagucccuccucaacuaccagaccauggucugcgacaucaccggccucgacauggccaacgccucccuccucgacgagggcaccgccgccgccgaggcccuccagcucugcuaccgccacaacaagcgccgcaaguuccucgucgacccccgcugccacccccagaccaucgccgucguccagacccgcgccaaguacaccggcguccucaccgagcucaagcuccccugcgagauggacuucuccggcaaggacgucuccggcguccucuuccaguaccccgacaccgagggcaaggucgaggacuucaccgagcucgucgagcgcgcccaccaguccggcucccucgccugcugcgccaccgaccuccucgcccucugcauccuccgcccccccggcgaguucggcgucgacaucgcccucggcuccucccagcgcuucggcgucccccucggcuacggcggcccccacgccgccuucuucgccguccgcgagucccucguccgcaugaugcccggccgcauggucggcgucacccgcgacgccaccggcaaggaggucuaccgccucgcccuccagacccgcgagcagcacauccgccgcgacaaggccaccuccaacaucugcaccgcccaggcccuccucgccaacauggccgccauguucgccaucuaccacggcucccacggccucgagcacaucgcccgccgcguccacaacgccacccucauccucuccgagggccucaagcgcgccggccaccagcuccagcacgaccucuucuucgacacccucaagauccagugcggcugcuccgucaaggagguccucggccgcgccgcccagcgccagaucaacuuccgccucuucgaggacggcacccucggcaucucccucgacgagaccgucaacgagaaggaccucgacgaccuccucuggaucuucggcugcgaguccuccgccgagcucgucgccgaguccaugggcgaggagugccgcggcauccccggcuccgucuucaagcgcaccucccccuuccucacccaccaggucuucaacuccuaccacuccgagaccaacaucguccgcuacaugaagaagcucgagaacaaggacaucucccucguccacuccaugaucccccucggcuccugcaccaugaagcucaacuccuccuccgagcucgcccccaucaccuggaaggaguucgccaacauccaccccuucgucccccucgaccaggcccagggcuaccagcagcucuuccgcgagcucgagaaggaccucugcgagcucaccggcuacgaccaggucugcuuccagcccaacuccggcgcccagggcgaguacgccggccucgccaccauccgcgccuaccucaaccagaagggcgagggccaccgcaccgucugccucauccccaaguccgcccacggcaccaaccccgccuccgcccacauggccggcaugaagauccagcccgucgaggucgacaaguacggcaacaucgacgccguccaccucaaggccauggucgacaagcacaaggagaaccucgccgccaucaugaucaccuaccccuccaccaacggcgucuucgaggagaacaucuccgacgucugcgaccucauccaccagcacggcggccaggucuaccucgacggcgccaacaugaacgcccaggucggcaucugccgccccggcgacuucggcuccgacgucucccaccucaaccuccacaagaccuucugcaucccccacggcggcggcggccccggcaugggccccaucggcgucaagaagcaccucgcccccuuccuccccaaccaccccgucaucucccucaagcgcaacgaggacgccugccccgucggcaccgucuccgccgcccccuggggcuccuccuccauccuccccaucuccugggccuacaucaagaugaugggcggcaagggccucaagcaggccaccgagaccgccauccucaacgccaacuacauggccaagcgccucgagacccacuaccgcauccucuuccgcggcgcccgcggcuacgucggccacgaguucauccucgacacccgccccuucaagaaguccgccaacaucgaggccgucgacgucgccaagcgccuccaggacuacggcuuccacgcccccaccauguccuggcccgucgccggcacccucauggucgagcccaccgaguccgaggacaaggccgagcucgaccgcuucugcgacgccaugaucuccauccgccaggagaucgccgacaucgaggagggccgcaucgacccccgcgucaacccccucaagauguccccccacucccucaccugcgucaccuccucccacugggaccgccccuacucccgcgaggucgccgccuucccccuccccuucgucaagcccgagaacaaguucuggcccaccaucgcccgcaucgacgacaucuacggcgaccagcaccucgucugcaccugcccccccauggaggucuacgagucccccuucuccgagcagaagcgcgccuccuccuga

SEQ ID NO: 43654 - RNA, 1656 nt, Artificial Sequence
  derived and/or modified sequence opt2 from GLDN__Homo_sapiens__NP_861454
auggcccgcggcgccgagggcggccgcggcgacgccggcuggggccuccgcggcgcccucgccgccgucgcccuccucuccgcccucaacgccgccggcaccgucuucgcccucugccaguggcgcggccucuccuccgcccuccgcgcccucgaggcccagcgcggccgcgagcagcgcgaggacuccgcccuccgcuccuuccucgccgagcucucccgcgccccccgcggcgccuccgcccccccccaggaccccgccuccuccgcccgcaacaagcgcucccacuccggcgagcccgccccccacauccgcgccgagucccacgacaugcucaugaugaugaccuacuccaugguccccauccgcgucauggucgaccucugcaacuccaccaagggcaucugccucaccggccccuccggcccccccggcccccccggcgccggcggccuccccggccacaacggccucgacggccagcccggcccccagggccccaagggcgagaagggcgccaacggcaagcgcggcaagaugggcauccccggcgccgccggcaaccccggcgagcgcggcgagaagggcgaccacggcgagcucggccuccagggcaacgagggcccccccggccagaagggcgagaagggcgacaagggcgacgucuccaacgacguccuccucgccggcgccaagggcgaccagggcccccccggcccccccggcccccccggcccccccggcccccccggcccccccggcucccgccgcgccaagggcccccgccagcccuccauguucaacggccagugccccggcgagaccugcgccauccccaacgacgacacccucgucggcaaggccgacgagaaggccuccgagcaccacuccccccaggccgaguccaugaucaccuccaucggcaaccccguccagguccucaaggucaccgagaccuucggcaccuggauccgcgaguccgccaacaaguccgacgaccgcaucugggucaccgagcacuucuccggcaucauggucaaggaguucaaggaccagcccucccuccucaacggcuccuacaccuucauccaccuccccuacuacuuccacggcugcggccacgucgucuacaacaacucccucuacuaccacaagggcggcuccaacacccucguccgcuucgaguucggccaggagaccucccagacccucaagcucgagaacgcccucuacuucgaccgcaaguaccucuucgccaacuccaagaccuacuucaaccucgccgucgacgagaagggccucuggaucaucuacgccuccuccgucgacggcuccuccauccucgucgcccagcucgacgagcgcaccuucuccgucguccagcacgucaacaccaccuaccccaaguccaaggccggcaacgccuucaucgcccgcggcauccucuacgucaccgacaccaaggacaugcgcgucaccuucgccuucgaccuccucggcggcaagcagaucaacgccaacuucgaccuccgcaccucccaguccguccucgccaugcucgccuacaacaugcgcgaccagcaccucuacuccugggaggacggccaccucaugcucuaccccguccaguuccucuccaccacccucaaccaguga

SEQ ID NO: 43655 - RNA, 2097 nt, Artificial Sequence
  derived and/or modified sequence opt2 from GLE1__Homo_sapiens__NP_001003722
augcccuccgagggccgcugcugggagacccucaaggcccuccgcuccuccgacaagggccgccucugcuacuaccgcgacuggcuccuccgccgcgaggacguccucgaggagugcaugucccuccccaagcucuccuccuacuccggcugggucgucgagcacguccucccccacaugcaggagaaccagccccucuccgagaccucccccuccuccaccuccgccuccgcccucgaccagcccuccuucguccccaagucccccgacgccuccuccgccuucucccccgccucccccgccacccccaacggcaccaagggcaaggacgagucccagcacaccgaguccaugguccuccaguccucccgcggcaucaaggucgagggcugcguccgcauguacgagcucguccaccgcaugaagggcaccgagggccuccgccucuggcaggaggagcaggagcgcaagguccaggcccucuccgagauggccuccgagcagcucaagcgcuucgacgaguggaaggagcucaagcagcacaaggaguuccaggaccuccgcgaggucauggagaaguccucccgcgaggcccucggccaccaggagaagcucaaggccgagcaccgccaccgcgccaagauccucaaccucaagcuccgcgaggccgagcagcagcgcgucaagcaggccgagcaggagcgccuccgcaaggaggagggccagauccgccuccgcgcccucuacgcccuccaggaggagaugcuccagcucucccagcagcucgacgccuccgagcagcacaaggcccuccucaaggucgaccucgccgccuuccagacccgcggcaaccagcucugcucccucaucuccggcaucauccgcgccuccuccgaguccuccuaccccaccgccgagucccaggccgaggccgagcgcgcccuccgcgagaugcgcgaccuccucaugaaccucggccaggagaucacccgcgccugcgaggacaagcgccgccaggacgaggaggaggcccaggucaagcuccaggaggcccagaugcagcagggccccgaggcccacaaggagccccccgcccccucccagggccccggcggcaagcagaacgaggaccuccaggucaagguccaggacaucaccaugcagugguaccagcagcuccaggacgccuccaugcagugcguccucaccuucgagggccucaccaacuccaaggacucccaggccaagaagaucaagauggaccuccagaaggccgccaccauccccgucucccagaucuccaccaucgccggcuccaagcucaaggagaucuucgacaagauccacucccuccucuccggcaagcccguccaguccggcggccgcuccgucuccgucacccucaacccccagggccucgacuucguccaguacaagcucgccgagaaguucgucaagcagggcgaggaggaggucgccucccaccacgaggccgccuuccccaucgccgucgucgccuccggcaucugggagcuccacccccgcgucggcgaccucauccucgcccaccuccacaagaagugccccuacuccguccccuucuaccccaccuucaaggagggcauggcccucgaggacuaccagcgcaugcucggcuaccaggucaaggacuccaaggucgagcagcaggacaacuuccucaagcgcauguccggcaugauccgccucuacgccgccaucauccagcuccgcuggcccuacggcaaccgccaggagauccacccccacggccucaaccacggcuggcgcuggcucgcccagauccucaacauggagccccucuccgacgucaccgccacccuccucuucgacuuccucgaggucugcggcaacgcccucaugaagcaguaccagguccaguucuggaagaugcucauccucaucaaggaggacuacuucccccgcaucgaggccaucaccuccuccggccagaugggcuccuucauccgccucaagcaguuccucgagaagugccuccagcacaaggacauccccguccccaagggcuuccucaccuccuccuucuggcgcuccuga

SEQ ID NO: 43656 - RNA, 3579 nt, Artificial Sequence
  derived and/or modified sequence opt2 from GLG1__Homo_sapiens__NP_001139138
auggccgccugcggccgcguccgccgcauguuccgccucuccgccgcccuccaccuccuccuccucuucgccgccggcgccgagaagcuccccggccagggcguccacucccagggccagggccccggcgccaacuucgucuccuucgucggccaggccggcggcggcggccccgccggccagcagcucccccagcucccccaguccucccagcuccagcagcagcagcagcagcagcagcagcagcagcagccccagcccccccagccccccuuccccgccggcggcccccccgcccgccgcggcggcgccggcgccggcggcggcuggaagcucgccgaggaggaguccugccgcgaggacgucacccgcgucugccccaagcacaccugguccaacaaccucgccguccucgagugccuccaggacguccgcgagcuccucuggaacuacaagcucaaccucaccaccgaccccaaguucgaguccgucgcccgcgaggucugcaaguccaccaucaccgagaucaaggagugcgccgacgagcccgucggcaagggcuacauggucuccugccucgucgaccaccgcggcaacaucaccgaguaccagugccaccaguacaucaccaagaugaccgccaucaucuucuccgacuaccgccucaucugcggcuucauggacgacugcaagaacgacaucaacauccucaagugcggcuccauccgccucggcgagaaggacgcccacucccagggcgaggucgucuccugccucgagaagggccucgucaaggaggccgaggagcgcgagcccaagauccaggucuccgagcucugcaagaaggccauccuccgcgucgccgagcucuccuccgacgacuuccaccucgaccgccaccucuacuucgccugccgcgacgaccgcgagcgcuucugcgagaacacccaggccggcgagggccgcgucuacaagugccucuucaaccacaaguucgaggaguccauguccgagaagugccgcgaggcccucaccacccgccagaagcucaucgcccaggacuacaaggucuccuacucccucgccaaguccugcaaguccgaccucaagaaguaccgcugcaacgucgagaaccucccccgcucccgcgaggcccgccucuccuaccuccucaugugccucgaguccgccguccaccgcggccgccaggucuccuccgagugccagggcgagaugcucgacuaccgccgcaugcucauggaggacuucucccucucccccgagaucauccucuccugccgcggcgagaucgagcaccacugcuccggccuccaccgcaagggccgcacccuccacugccucaugaaggucguccgcggcgagaagggcaaccucggcaugaacugccagcaggcccuccagacccucauccaggagaccgaccccggcgccgacuaccgcaucgaccgcgcccucaacgaggccugcgaguccgucauccagaccgccugcaagcacauccgcuccggcgaccccaugauccucuccugccucauggagcaccucuacaccgagaagauggucgaggacugcgagcaccgccuccucgagcuccaguacuucaucucccgcgacuggaagcucgaccccguccucuaccgcaagugccagggcgacgccucccgccucugccacacccacggcuggaacgagaccuccgaguucaugccccagggcgccgucuucuccugccucuaccgccacgccuaccgcaccgaggagcagggccgccgccucucccgcgagugccgcgccgagguccagcgcauccuccaccagcgcgccauggacgucaagcucgaccccgcccuccaggacaagugccucaucgaccucggcaaguggugcuccgagaagaccgagaccggccaggagcucgagugccuccaggaccaccucgacgaccucgucgucgagugccgcgacaucgucggcaaccucaccgagcucgaguccgaggacauccagaucgaggcccuccucaugcgcgccugcgagcccaucauccagaacuucugccacgacgucgccgacaaccagaucgacuccggcgaccucauggagugccucauccagaacaagcaccagaaggacaugaacgagaagugcgccaucggcgucacccacuuccagcucguccagaugaaggacuuccgcuucuccuacaaguucaagauggccugcaaggaggacguccucaagcucugccccaacaucaagaagaaggucgacgucgucaucugccucuccaccaccguccgcaacgacacccuccaggaggccaaggagcaccgcgucucccucaagugccgccgccagcuccgcgucgaggagcucgagaugaccgaggacauccgccucgagcccgaccucuacgaggccugcaaguccgacaucaagaacuucugcuccgccguccaguacggcaacgcccagaucaucgagugccucaaggagaacaagaagcagcucuccacccgcugccaccagaaggucuucaagcuccaggagaccgagaugauggaccccgagcucgacuacacccucaugcgcgucugcaagcagaugaucaagcgcuucugccccgaggccgacuccaagaccaugcuccagugccucaagcagaacaagaacuccgagcucauggaccccaagugcaagcagaugaucaccaagcgccagaucacccagaacaccgacuaccgccucaaccccaugcuccgcaaggccugcaaggccgacauccccaaguucugccacggcauccucaccaaggccaaggacgacuccgagcucgagggccaggucaucuccugccucaagcuccgcuacgccgaccagcgccucuccuccgacugcgaggaccagauccgcaucaucauccaggaguccgcccucgacuaccgccucgacccccagcuccagcuccacugcuccgacgagaucuccucccucugcgccgaggaggccgccgcccaggagcagaccggccaggucgaggagugccucaaggucaaccuccucaagaucaagaccgagcucugcaagaaggagguccucaacaugcucaaggaguccaaggccgacaucuucgucgaccccguccuccacaccgccugcgcccucgacaucaagcaccacugcgccgccaucacccccggccgcggccgccagauguccugccucauggaggcccucgaggacaagcgcguccgccuccagcccgagugcaagaagcgccucaacgaccgcaucgagaugugguccuacgccgccaaggucgcccccgccgacggcuucuccgaccucgccaugcaggucaugaccucccccuccaagaacuacauccucuccgucaucuccggcuccaucugcauccucuuccucaucggccucaugugcggccgcaucaccaagcgcgucacccgcgagcucaaggaccgccuccaguaccgcuccgagaccauggccuacaagggccucgucuggucccaggacgucaccggcucccccgccuga

SEQ ID NO: 43657 - RNA, 3198 nt, Artificial Sequence
  derived and/or modified sequence opt2 from GLI1__Homo_sapiens__NP_001161081
auguucaacuccaugacccccccccccaucuccuccuacggcgagcccugcugccuccgcccccuccccucccagggcgcccccuccgucggcaccgaggucaagcucaccaagaagcgcgcccucuccaucuccccccucuccgacgccucccucgaccuccagaccgucauccgcaccucccccuccucccucgucgccuucaucaacucccgcugcaccucccccggcggcuccuacggccaccucuccaucggcaccaugucccccucccucggcuuccccgcccagaugaaccaccagaagggccccucccccuccuucggcguccagcccugcggcccccacgacuccgcccgcggcggcaugaucccccacccccagucccgcggccccuuccccaccugccagcucaaguccgagcucgacaugcucgucggcaagugccgcgaggagccccucgagggcgacauguccucccccaacuccaccggcauccaggacccccuccucggcaugcucgacggccgcgaggaccucgagcgcgaggagaagcgcgagcccgaguccgucuacgagaccgacugccgcugggacggcugcucccaggaguucgacucccaggagcagcucguccaccacaucaacuccgagcacauccacggcgagcgcaaggaguucgucugccacuggggcggcugcucccgcgagcuccgccccuucaaggcccaguacaugcucgucguccacaugcgccgccacaccggcgagaagccccacaagugcaccuucgagggcugccgcaaguccuacucccgccucgagaaccucaagacccaccuccgcucccacaccggcgagaagcccuacaugugcgagcacgagggcugcuccaaggccuucuccaacgccuccgaccgcgccaagcaccagaaccgcacccacuccaacgagaagcccuacgucugcaagcuccccggcugcaccaagcgcuacaccgaccccuccucccuccgcaagcacgucaagaccguccacggccccgacgcccacgucaccaagcgccaccgcggcgacggcccccucccccgcgcccccuccaucuccaccgucgagcccaagcgcgagcgcgagggcggccccauccgcgaggagucccgccucaccguccccgagggcgccaugaagccccagcccucccccggcgcccaguccuccugcuccuccgaccacucccccgccggcuccgccgccaacaccgacuccggcgucgagaugaccggcaacgccggcggcuccaccgaggaccucuccucccucgacgagggccccugcaucgccggcaccggccucuccacccuccgccgccucgagaaccuccgccucgaccagcuccaccagcuccgccccaucggcacccgcggccucaagcuccccucccucucccacaccggcaccaccgucucccgccgcgucggcccccccgucucccucgagcgccgcuccuccuccuccuccuccaucuccuccgccuacaccgucucccgccgcuccucccucgccucccccuucccccccggcuccccccccgagaacggcgccuccucccuccccggccucaugcccgcccagcacuaccuccuccgcgcccgcuacgccuccgcccgcggcggcggcaccucccccaccgccgccuccucccucgaccgcaucggcggccuccccaugccccccuggcgcucccgcgccgaguaccccggcuacaaccccaacgccggcgucacccgccgcgccuccgaccccgcccaggccgccgaccgccccgcccccgcccgcguccagcgcuucaagucccucggcugcguccacaccccccccaccgucgccggcggcggccagaacuucgaccccuaccuccccaccuccgucuacuccccccagccccccuccaucaccgagaacgccgccauggacgcccgcggccuccaggaggagcccgaggucggcaccuccauggucggcuccggccucaaccccuacauggacuucccccccaccgacacccucggcuacggcggccccgagggcgccgccgccgagcccuacggcgcccgcggccccggcucccucccccucggccccggcccccccaccaacuacggccccaaccccugcccccagcaggccuccuaccccgaccccacccaggagaccuggggcgaguuccccucccacuccggccucuaccccggccccaaggcccucggcggcaccuacucccagugcccccgccucgagcacuacggccagguccaggucaagcccgagcagggcugccccgucggcuccgacuccaccggccucgcccccugccucaacgcccaccccuccgagggccccccccacccccagccccucuucucccacuacccccagcccucccccccccaguaccuccaguccggccccuacacccagcccccccccgacuaccuccccuccgagccccgccccugccucgacuucgacucccccacccacuccaccggccagcucaaggcccagcucgucugcaacuacguccagucccagcaggagcuccucugggagggcggcggccgcgaggacgcccccgcccaggagcccuccuaccagucccccaaguuccucggcggcucccaggucucccccucccgcgccaaggcccccgucaacaccuacggccccggcuucggccccaaccuccccaaccacaaguccggcuccuaccccacccccucccccugccacgagaacuucgucgucggcgccaaccgcgccucccaccgcgccgccgcccccccccgccuccuccccccccuccccaccugcuacggcccccucaaggucggcggcaccaaccccuccugcggccaccccgaggucggccgccucggcggcggccccgcccucuaccccccccccgagggccaggucugcaacccccucgacucccucgaccucgacaacacccagcucgacuucgucgccauccucgacgagccccagggccucucccccccccccucccacgaccagcgcggcuccuccggccacacccccccccccuccggcccccccaacauggccgucggcaacauguccguccuccuccgcucccuccccggcgagaccgaguuccucaacuccuccgccuga

SEQ ID NO: 43658 - RNA, 4761 nt, Artificial Sequence
  derived and/or modified sequence opt2 from GLI2__Homo_sapiens__NP_005261
auggagaccuccgccuccgccaccgccuccgagaagcaggaggccaaguccggcauccucgaggccgccggcuuccccgaccccggcaagaaggccuccccccucgucgucgccgccgccgccgccgccgccgucgccgcccagggcgucccccagcaccuccucccccccuuccacgccccccuccccaucgacaugcgccaccaggagggccgcuaccacuacgagccccacuccguccacggcguccacggcccccccgcccucuccggcucccccgucaucuccgacaucucccucauccgccucuccccccaccccgccggccccggcgagucccccuucaacgccccccaccccuacgucaacccccacauggagcacuaccuccgcuccguccacuccucccccacccucuccaugaucuccgccgcccgcggccucucccccgccgacgucgcccaggagcaccucaaggagcgcggccucuucggccuccccgcccccggcaccacccccuccgacuacuaccaccagaugacccucgucgccggccaccccgcccccuacggcgaccuccucaugcaguccggcggcgccgccuccgccccccaccuccacgacuaccucaaccccgucgacgucucccgcuucuccuccccccgcgucaccccccgccucucccgcaagcgcgcccucuccaucuccccccucuccgacgccucccucgaccuccagcgcaugauccgcaccucccccaacucccucgucgccuacaucaacaacucccgcuccuccuccgccgccuccggcuccuacggccaccucuccgccggcgcccucucccccgccuucaccuucccccaccccaucaaccccgucgccuaccagcagauccucucccagcagcgcggccucggcuccgccuucggccacacccccccccucauccagcccucccccaccuuccucgcccagcagcccauggcccucaccuccaucaacgccacccccacccagcucuccuccuccuccaacugccucuccgacaccaaccagaacaagcaguccuccgaguccgccgucuccuccaccgucaaccccgucgccauccacaagcgcuccaaggucaagaccgagcccgagggccuccgccccgccuccccccucgcccucacccagggccaggucuccggccacggcuccugcggcugcgcccucccccucucccaggagcagcucgccgaccucaaggaggaccucgaccgcgacgacugcaagcaggaggccgaggucgucaucuacgagaccaacugccacugggaggacugcaccaaggaguacgacacccaggagcagcucguccaccacaucaacaacgagcacauccacggcgagaagaaggaguucgucugccgcuggcaggccugcacccgcgagcagaagcccuucaaggcccaguacaugcucgucguccacaugcgccgccacaccggcgagaagccccacaagugcaccuucgagggcugcuccaaggccuacucccgccucgagaaccucaagacccaccuccgcucccacaccggcgagaagcccuacgucugcgagcacgagggcugcaacaaggccuucuccaacgccuccgaccgcgccaagcaccagaaccgcacccacuccaacgagaagcccuacaucugcaagauccccggcugcaccaagcgcuacaccgaccccuccucccuccgcaagcacgucaagaccguccacggccccgacgcccacgucaccaagaagcagcgcaacgacguccaccuccgcaccccccuccucaaggagaacggcgacuccgaggccggcaccgagcccggcggccccgaguccaccgaggccuccuccaccucccaggccgucgaggacugccuccacguccgcgccaucaagaccgaguccuccggccucugccaguccucccccggcgcccaguccuccugcuccuccgagcccuccccccucggcuccgcccccaacaacgacuccggcgucgagaugcccggcaccggccccggcucccucggcgaccucaccgcccucgacgacaccccccccggcgccgacaccuccgcccucgccgcccccuccgccggcggccuccagcuccgcaagcacaugaccaccaugcaccgcuucgagcagcucaagaaggagaagcucaagucccucaaggacuccugcuccugggccggccccaccccccacacccgcaacaccaagcuccccccccuccccggcuccggcuccauccucgagaacuucuccggcuccggcggcggcggccccgccggccuccuccccaacccccgccucuccgagcucuccgccuccgaggucaccaugcucucccagcuccaggagcgccgcgacuccuccaccuccaccgucuccuccgccuacaccgucucccgccgcuccuccggcaucucccccuacuucuccucccgccgcuccuccgaggccuccccccucggcgccggccgcccccacaacgccuccuccgccgacuccuacgaccccaucuccaccgacgccucccgccgcuccuccgaggccucccagugcuccggcggcuccggccuccucaaccucacccccgcccagcaguacucccuccgcgccaaguacgccgccgccaccggcggccccccccccaccccccuccccggccucgagcgcaugucccuccgcacccgccucgcccuccucgacgcccccgagcgcacccuccccgccggcugcccccgcccccucggcccccgccgcggcuccgacggccccaccuacggccacggccacgccggcgccgcccccgccuucccccacgaggcccccggcggcggcgcccgccgcgccuccgaccccguccgccgccccgacgcccucucccucccccgcguccagcgcuuccacuccacccacaacgucaaccccggcccccucccccccugcgccgaccgccgcggccuccgccuccagucccaccccuccaccgacggcggccucgcccgcggcgccuacuccccccgcccccccuccaucuccgagaacgucgccauggaggccgucgccgccggcgucgacggcgccggccccgaggccgaccucggccuccccgaggacgaccucguccuccccgacgacgucguccaguacaucaaggcccacgccuccggcgcccucgacgagggcaccggccaggucuaccccaccgaguccaccggcuucuccgacaacccccgccuccccucccccggccuccacggccagcgccgcauggucgccgccgacuccaacgucggccccuccgcccccaugcucggcggcugccagcucggcuucggcgcccccuccucccucaacaagaacaacaugcccguccaguggaacgaggucuccuccggcaccgucgacgcccucgccucccaggucaagcccccccccuucccccagggcaaccucgccgucguccagcagaagcccgccuucggccaguaccccggcuacuccccccagggccuccaggccucccccggcggccucgacuccacccagccccaccuccagccccgcuccggcgcccccucccagggcaucccccgcgucaacuacaugcagcagcuccgccagcccgucgccggcucccagugccccggcaugaccaccaccauguccccccacgccugcuacggccagguccacccccagcucucccccuccaccaucuccggcgcccucaaccaguucccccaguccugcuccaacaugcccgccaagcccggccaccucggccacccccagcagaccgaggucgcccccgaccccaccaccaugggcaaccgccaccgcgagcucggcguccccgacuccgcccucgccggcgucccccccccccaccccguccaguccuacccccagcagucccaccaccucgccgccuccaugucccaggagggcuaccaccagguccccucccuccuccccgcccgccagcccggcuucauggagccccagaccggccccaugggcgucgccaccgccggcuucggccucguccagccccgccccccccucgagcccucccccaccggccgccaccgcggcguccgcgccguccagcagcagcucgccuacgcccgcgccaccggccacgccauggccgccaugcccuccucccaggagaccgccgaggccguccccaagggcgccaugggcaacaugggcuccguccccccccagccccccccccaggacgccggcggcgcccccgaccacuccaugcucuacuacuacggccagauccacauguacgagcaggacggcggccucgagaaccucggcuccugccaggucaugcgcucccagcccccccagccccaggccugccaggacuccauccagccccagccccuccccucccccggcgucaaccaggucuccuccaccgucgacucccagcuccucgaggccccccagaucgacuucgacgccaucauggacgacggcgaccacuccucccucuucuccggcgcccucucccccucccuccuccacucccucucccagaacuccucccgccucaccaccccccgcaacucccucacccuccccuccauccccgccggcaucuccaacauggccgucggcgacauguccuccaugcucaccucccucgccgaggaguccaaguuccucaacaugaugaccuga

SEQ ID NO: 43659 - RNA, 4743 nt, Artificial Sequence
  derived and/or modified sequence opt2 from GLI3__Homo_sapiens__XP_011513575
auggaggcccagucccacuccuccaccaccaccgagaagaagaaggucgagaacuccaucgucaagugcuccacccgcaccgacgucuccgagaaggccgucgccuccuccaccaccuccaacgaggacgagucccccggccagaccuaccaccgcgagcgccgcaacgccaucaccaugcagccccagaacguccagggccucuccaaggucuccgaggagcccuccaccuccuccgacgagcgcgccucccucaucaagaaggagauccacggcucccucccccacgucgccgagcccuccguccccuaccgcggcaccgucuucgccauggacccccgcaacggcuacauggagccccacuaccaccccccccaccucuuccccgccuuccacccccccguccccaucgacgcccgccaccacgagggccgcuaccacuacgaccccucccccauccccccccuccacaugaccuccgcccucuccuccucccccaccuaccccgaccuccccuucauccgcaucuccccccaccgcaaccccaccgccgccuccgagucccccuucucccccccccaccccuacaucaaccccuacauggacuacauccgcucccuccacuccucccccucccucuccaugaucuccgccacccgcggccucucccccaccgacgccccccacgccggcgucucccccgccgaguacuaccaccagauggcccuccucaccggccagcgcucccccuacgccgacaucauccccuccgccgccaccgccggcaccggcgccauccacauggaguaccuccacgccauggacuccacccgcuucuccuccccccgccucuccgcccgccccucccgcaagcgcacccucuccaucuccccccucuccgaccacuccuucgaccuccagaccaugauccgcaccucccccaacucccucgucaccauccucaacaacucccgcuccuccuccuccgccuccggcuccuacggccaccucuccgccuccgccaucucccccgcccucuccuucaccuacuccuccgcccccgucucccuccacaugcaccagcagauccucucccgccagcagucccucggcuccgccuucggccacucccccccccucauccaccccgcccccaccuuccccacccagcgccccauccccggcauccccaccguccucaaccccguccaggucuccuccggccccuccgaguccucccagaacaagcccaccuccgaguccgccgucuccuccaccggcgaccccaugcacaacaagcgcuccaagaucaagcccgacgaggaccuccccucccccggcgcccgcggccagcaggagcagcccgagggcaccacccucgucaaggaggagggcgacaaggacgaguccaagcaggagcccgaggucaucuacgagaccaacugccacugggagggcugcgcccgcgaguucgacacccaggagcagcucguccaccacaucaacaacgaccacauccacggcgagaagaaggaguucgucugccgcuggcucgacugcucccgcgagcagaagcccuucaaggcccaguacaugcucgucguccacaugcgccgccacaccggcgagaagccccacaagugcaccuucgagggcugcaccaaggccuacucccgccucgagaaccucaagacccaccuccgcucccacaccggcgagaagcccuacgucugcgagcacgagggcugcaacaaggccuucuccaacgccuccgaccgcgccaagcaccagaaccgcacccacuccaacgagaagcccuacgucugcaagauccccggcugcaccaagcgcuacaccgaccccuccucccuccgcaagcacgucaagaccguccacggccccgaggcccacgucaccaagaagcagcgcggcgacauccacccccgccccccccccccccgcgacuccggcucccacucccagucccgcucccccggccgccccacccagggcgcccucggcgagcagcaggaccucuccaacaccaccuccaagcgcgaggagugccuccaggucaagaccgucaaggccgagaagcccaugaccucccagcccucccccggcggccaguccuccugcuccucccagcagucccccaucuccaacuacuccaacuccggccucgagcucccccucaccgacggcggcuccaucggcgaccucuccgccaucgacgagacccccaucauggacuccaccaucuccaccgccaccaccgcccucgcccuccaggcccgccgcaaccccgccggcaccaaguggauggagcacgucaagcucgagcgccucaagcaggucaacggcauguucccccgccucaaccccauccucccccccaaggcccccgccgucuccccccucaucggcaacggcacccaguccaacaacaccugcucccucggcggccccaugacccuccuccccggccgcuccgaccucuccggcgucgacgucaccaugcucaacaugcucaaccgccgcgacuccuccgccuccaccaucuccuccgccuaccucuccucccgccgcuccuccggcaucucccccugcuucuccucccgccgcuccuccgaggccucccaggccgagggccgcccccagaacgucuccgucgccgacuccuacgaccccaucuccaccgacgccucccgccgcuccuccgaggccucccaguccgacggccuccccucccuccucucccucacccccgcccagcaguaccgccucaaggccaaguacgccgccgccaccggcggccccccccccaccccccuccccaacauggagcgcaugucccucaagacccgccucgcccuccucggcgacgcccucgagcccggcgucgcccucccccccguccacgccccccgccgcugcuccgacggcggcgcccacggcuacggccgccgccaccuccagccccacgacgcccccggccacggcguccgccgcgccuccgaccccguccgcaccggcuccgagggccucgcccucccccgcgucccccgcuucuccucccucuccuccugcaacccccccgccauggccaccuccgccgagaagcgcucccucguccuccagaacuacacccgccccgagggcggccagucccgcaacuuccacuccucccccugcccccccuccaucaccgagaacgucacccucgagucccucaccauggacgccgacgccaaccucaacgacgaggacuuccuccccgacgacgucguccaguaccucaacucccagaaccaggccggcuacgagcagcacuuccccuccgcccuccccgacgacuccaaggucccccacggccccggcgacuucgacgcccccggccuccccgacucccacgccggccagcaguuccacgcccucgagcagcccugccccgagggcuccaagaccgaccuccccauccaguggaacgaggucuccuccggcuccgccgaccucuccuccuccaagcucaagugcggcccccgccccgccgucccccagacccgcgccuucggcuucugcaacggcauggucguccacccccagaacccccuccgcuccggccccgccggcggcuaccagacccucggcgagaacuccaaccccuacggcggccccgagcaccucaugcuccacaacucccccggcuccggcaccuccggcaacgccuuccacgagcagcccugcaaggccccccaguacggcaacugccucaaccgccagcccgucgcccccggcgcccucgacggcgccugcggcgccggcauccaggccuccaagcucaaguccacccccaugcagggcuccggcggccagcucaacuucggccuccccgucgcccccaacgaguccgccggcuccauggucaacggcaugcagaaccaggaccccgucggccagggcuaccucgcccaccagcuccucggcgacuccaugcagcaccccggcgccggccgccccggccagcagaugcucggccagaucuccgccaccucccacaucaacaucuaccagggccccgaguccugccuccccggcgcccacggcaugggcucccagcccuccucccucgccgucguccgcggcuaccagcccugcgccuccuucggcggcucccgccgccaggccaugccccgcgacucccucgcccuccaguccggccagcucuccgacaccucccagaccugccgcgucaacggcaucaagauggagaugaagggccagccccacccccucugcuccaaccuccagaacuacuccggccaguucuacgaccagaccgucggcuucucccagcaggacaccaaggccggcuccuucuccaucuccgacgccuccugccuccuccagggcaccuccgccaagaacuccgagcuccucucccccggcgccaaccaggucaccuccaccgucgacucccucgacucccacgaccucgagggcguccagaucgacuucgacgccaucaucgacgacggcgaccacuccucccucauguccggcgcccucucccccuccaucauccagaaccucucccacuccuccucccgccucaccaccccccgcgccucccuccccuuccccgcccucuccauguccaccaccaacauggccaucggcgacauguccucccuccucaccucccucgccgaggaguccaaguuccucgccgucaugcaguga

SEQ ID NO: 43660 - RNA, 801 nt, Artificial Sequence
  derived and/or modified sequence opt2 from GLIPR1__Homo_sapiens__NP_006842
augcgcgucacccucgccaccaucgccuggauggucuccuucgucuccaacuacucccacaccgccaacauccuccccgacaucgagaacgaggacuucaucaaggacugcguccgcauccacaacaaguuccgcuccgaggucaagcccaccgccuccgacaugcucuacaugaccugggaccccgcccucgcccagaucgccaaggccugggccuccaacugccaguucucccacaacacccgccucaagcccccccacaagcuccaccccaacuucaccucccucggcgagaacaucuggaccggcuccguccccaucuucuccgucuccuccgccaucaccaacugguacgacgagauccaggacuacgacuucaagacccgcaucugcaagaaggucugcggccacuacacccaggucgucugggccgacuccuacaaggucggcugcgccguccaguucugccccaaggucuccggcuucgacgcccucuccaacggcgcccacuucaucugcaacuacggccccggcggcaacuaccccaccuggcccuacaagcgcggcgccaccugcuccgccugccccaacaacgacaagugccucgacaaccucugcgucaaccgccagcgcgaccaggucaagcgcuacuacuccgucgucuaccccggcuggcccaucuacccccgcaaccgcuacaccucccucuuccucaucgucaacuccgucauccucauccucuccgucaucaucaccauccucguccagcacaaguaccccaaccucguccuccucgacuga

SEQ ID NO: 43661 - RNA, 387 nt, Artificial Sequence
  derived and/or modified sequence opt2 from GLIPR2__Homo_sapiens__NP_001273939
augggcaaguccgccuccaagcaguuccacaacgagguccucaaggcccacaacgaguaccgccagaagcacggcguccccccccucaagcucugcaagaaccucaaccgcgaggcccagcaguacuccgaggcccucgccuccacccgcauccucaagcacucccccgaguccucccgcggccagugcggcgagaaccucgccugggccuccuacgaccagaccggccacuucaccgccauggucuggaagaacaccaagaagaugggcgucggcaaggccuccgccuccgacggcuccuccuucgucgucgcccgcuacuuccccgccggcaacgucgucaacgagggcuucuucgaggagaacguccucccccccaagaaguga

SEQ ID NO: 43662 - RNA, 1575 nt, Artificial Sequence
  derived and/or modified sequence opt2 from GLIS2__Homo_sapiens__NP_001305847
augcacucccucgacgagccccucgaccucaagcucuccaucaccaagcuccgcgccgcccgcgagaagcgcgagcgcacccucggcgucguccgcccccgcgcccuccaccgcgagcucggccucgucgacgacucccccacccccggcucccccggcuccccccccuccggcuuccuccucaacuccaaguuccccgagaaggucgagggccgcuucuccgccgccccccucgucgaccucucccucuccccccccuccggccucgacucccccaacggcuccuccucccucucccccgagcgccagggcaacggcgaccucccccccguccccuccgccuccgacuuccagccccuccgcuaccucgacggcguccccuccuccuuccaguucuuccucccccucggcuccggcggcgcccuccaccuccccgccuccuccuuccucaccccccccaaggacaagugccucucccccgaccucccccuccccaagcagcucgucugccgcugggccaagugcaaccagcucuucgagcuccuccaggaccucgucgaccacgucaacgacuaccacgucaagcccgagaaggacgccggcuacugcugccacugggagggcugcgcccgccacggccgcggcuucaacgcccgcuacaagaugcucauccacauccgcacccacaccaacgagaagccccaccgcugccccaccugcuccaaguccuucucccgccucgagaaccucaagauccacaaccgcucccacaccggcgagaagcccuacgucugccccuacgagggcugcaacaagcgcuacuccaacuccuccgaccgcuucaagcacacccgcacccacuacgucgacaagcccuacuacugcaagaugcccggcugccacaagcgcuacaccgaccccuccucccuccgcaagcacaucaaggcccacggccacuucgucucccacgagcagcaggagcuccuccagcuccgccccccccccaagcccccccuccccgcccccgacggcggccccuacgucuccggcgcccagaucaucauccccaaccccgccgcccucuucggcggccccggccuccccggccucccccucccccucgcccccggcccccucgaccucuccgcccucgccugcggcaacggcggcggcuccggcggcggcggcggcaugggccccggccuccccggccccguccucccccucaaccucgccaagaacccccuccuccccucccccuucggcgccggcggccucggccuccccgucgucucccuccucgccggcgccgccggcggcaaggccgagggcgagaagggccgcggcuccguccccacccgcgcccucggcauggagggccacaagaccccccucgagcgcaccgaguccuccugcucccgccccucccccgacggccucccccuccuccccggcaccguccucgaccucuccaccggcgucaacuccgccgccuccucccccgaggcccucgcccccggcugggucgucaucccccccggcuccguccuccucaagcccgccgucgucaacuga

SEQ ID NO: 43663 - RNA, 1719 nt, Artificial Sequence
  derived and/or modified sequence opt2 from GLIS3__Homo_sapiens__XP_006716794
augaacggccgcuccugcuccaugucccuccaccgcaccuccggcaccccccagggcccccgcauggucuccggccaccacauccccgccauccgcgcccacuccggcacccccggccccucccccugcggcuccaccuccucccccaccauggccucccucgccaacaaccuccaccucaagaugcccuccggcggcggcauggccccccagaacaacgucgccgagucccgcauccaccuccccgcccucuccccccgccgccagaugcucaccaacggcaagccccgcuuccaggucacccaggccggcggcauguccggcucccacacccucaagcccaagcagcaggaguucggcucccccuucccccccaaccccggcaagggcgcccucggcuucggcccccagugcaaguccaucggcaagggcuccugcaacaaccucgucgucaccuccucccccaugaugguccagcgccucggccucaucuccccccccgccucccaggucuccaccgccugcaaccagaucucccccucccuccagcgcgccaugaacgccgccaaccucaacaucccccccuccgacacccgcucccucaucucccgcgagucccucgccuccaccacccucucccucaccgagucccaguccgccuccuccaugaagcaggaguggucccagggcuaccgcgcccuccccucccucuccaaccacggcucccagaacggccucgaccucggcgaccuccucucccucccccccggcaccuccauguccuccaacuccgucuccaacucccuccccuccuaccucuucggcaccgaguccucccacucccccuaccccuccccccgccacuccuccacccgcucccacuccgcccgcuccaagaagcgcgcccucucccucuccccccucuccgacggcaucggcaucgacuucaacaccaucauccgcaccucccccaccucccucgucgccuacaucaacggcucccgcgccucccccgccaaccucuccccccagcccgaggucuacggccacuuccucggcguccgcggcuccugcaucccccagccccgccccguccccggcucccagaagggcguccucgucgcccccggcggccucgcccuccccgccuacggcgaggacggcgcccucgagcacgagcgcaugcagcagcucgagcacggcggccuccagcccggccucgucaaccacauggucguccagcacggccuccccggccccgacucccaguccgccggccucuucaagaccgagcgccucgaggaguuccccggcuccaccgucgaccucccccccgcccccccccuccccccccucccccccccccccggcccccccccccccuaccacgcccacgcccaccuccaccaccccgagcucggcccccacgcccagcagcucgcccucccccaggccacccucgacgacgacggcgagauggacggcaucggcggcaagcacugcugccgcuggaucgacugcuccgcccucuacgaccagcaggaggagcucguccgccacaucgagaagguccacaucgaccagcgcaagggcgaggacuucaccugcuucugggccggcugcccccgccgcuacaagcccuucaacgcccgcuacaagcuccucauccacaugcgcguccacuccggcgagaagcccaacaagugcaccgccgccuga

SEQ ID NO: 43664 - RNA, 1785 nt, Artificial Sequence
  derived and/or modified sequence opt2 from GLMN__Homo_sapiens__XP_011538848
auggccgucgaggagcuccaguccaucaucaagcgcugccagauccucgaggagcaggacuucaaggaggaggacuucggccucuuccagcucgccggccagcgcugcaucgaggagggccacaccgaccagcuccucgagaucauccagaacgagaagaacaaggucaucaucaagaacaugggcuggaaccucgucggccccgucguccgcugccuccucugcaaggacaaggaggacuccaagcgcaaggucuacuuccucaucuucgaccuccucgucaagcucugcaaccccaaggagcuccuccucggccuccucgagcucaucgaggagcccuccggcaagcagaucucccaguccauccuccuccuccuccagccccuccagaccgucauccagaagcuccacaacaaggccuacuccaucggccucgcccucuccacccucuggaaccagcucucccuccuccccguccccuacuccaaggagcagauccagauggacgacuacggccucugccagugcugcaaggcccucaucgaguucaccaagcccuucgucgaggaggucaucgacaacaaggagaacucccucgagaacgagaagcucaaggacgagcuccucaaguucugcuucaagucccucaagugcccccuccucaccgcccaguucuucgagcaguccgaggagggcggcaacgaccccuuccgcuacuucgccuccgagaucaucggcuuccucuccgccaucggccaccccuuccccaagaugaucuucaaccacggccgcaagaagcgcaccuggaacuaccucgaguucgaggaggaggagaacaagcagcucgccgacuccauggccucccucgccuaccucgucuucguccagggcauccacaucgaccagcuccccaugguccucuccccccucuaccuccuccaguucaacaugggccacaucgaggucuuccuccagcgcaccgaggaguccgucaucuccaagggccucgagcuccucgagaacucccuccuccgcaucgaggacaacucccuccucuaccaguaccucgagaucaaguccuuccucaccgucccccagggccucgucaaggucaugacccucugccccaucgagacccuccgcaagaagucccucgccaugcuccagcucuacaucaacaagcucgacucccagggcaaguacacccucuuccgcugccuccucaacaccuccaaccacuccggcgucgaggccuucaucauccagaacaucaagaaccagaucgacaugucccucaagcgcacccgcaacaacaagugguucaccggcccccagcucaucucccuccucgaccucguccucuuccuccccgagggcgccgagaccgaccuccuccagaacuccgaccgcaucauggccucccucaaccuccuccgcuaccucgucaucaaggacaacgagaacgacaaccagaccggccucuggaccgagcucggcaacaucgagaacaacuuccucaagccccuccacaucggccucaacauguccaaggcccacuacgaggccgagaucaagaacucccaggaggcccagaaguccaaggaccucugcuccaucaccgucuccggcgaggagauccccaacaugccccccgagaugcagcucaagguccuccacuccgcccucuucaccuucgaccucaucgaguccguccucgcccgcgucgaggagcucaucgagaucaagaccaaguccaccuccgaggagaacaucggcaucaaguga

SEQ ID NO: 43665 - RNA, 555 nt, Artificial Sequence
  derived and/or modified sequence opt2 from GLO1__Homo_sapiens__NP_006699
auggccgagccccagccccccuccggcggccucaccgacgaggccgcccucuccugcugcuccgacgccgaccccuccaccaaggacuuccuccuccagcagaccaugcuccgcgucaaggaccccaagaagucccucgacuucuacacccgcguccucggcaugacccucauccagaagugcgacuuccccaucaugaaguucucccucuacuuccucgccuacgaggacaagaacgacauccccaaggagaaggacgagaagaucgccugggcccucucccgcaaggccacccucgagcucacccacaacuggggcaccgaggacgacgagacccaguccuaccacaacggcaacuccgacccccgcggcuucggccacaucggcaucgccguccccgacgucuacuccgccugcaagcgcuucgaggagcucggcgucaaguucgucaagaagcccgacgacggcaagaugaagggccucgccuucauccaggaccccgacggcuacuggaucgagauccucaaccccaacaagauggccacccucauguga

SEQ ID NO: 43666 - RNA, 897 nt, Artificial Sequence
  derived and/or modified sequence opt2 from GLOD4__Homo_sapiens__NP_057164
auggccgcccgccgcgcccuccacuucgucuucaaggucggcaaccgcuuccagaccgcccgcuucuaccgcgacguccucggcaugaagguccuccgccacgaggaguucgaggagggcugcaaggccgccugcaacggccccuacgacggcaagugguccaagaccauggucggcuucggccccgaggacgaccacuucgucgccgagcucaccuacaacuacggcgucggcgacuacaagcucggcaacgacuucaugggcaucacccucgccuccucccaggccgucuccaacgcccgcaagcucgaguggccccucaccgaggucgccgagggcgucuucgagaccgaggcccccggcggcuacaaguucuaccuccagaaccgcucccucccccaguccgaccccguccucaaggucacccucgccgucuccgaccuccagaagucccucaacuacuggugcaaccuccucggcaugaagaucuacgagaaggacgaggagaagcagcgcgcccuccucggcuacgccgacaaccagugcaagcucgagcuccagggcgucaagggcggcgucgaccacgccgccgccuucggccgcaucgccuucuccugcccccagaaggagcuccccgaccucgaggaccucaugaagcgcgagaaccagaagauccucaccccccucgucucccucgacacccccggcaaggccaccguccaggucgucauccucgccgaccccgacggccacgagaucugcuucgucggcgacgaggccuuccgcgagcucuccaagauggaccccgagggcuccaagcuccucgacgacgccauggccgccgacaaguccgacgagugguucgccaagcacaacaagcccaaggccuccggcuga

SEQ ID NO: 43667 - RNA, 1392 nt, Artificial Sequence
  derived and/or modified sequence opt2 from GLP1R__Homo_sapiens__NP_002053
auggccggcgcccccggcccccuccgccucgcccuccuccuccucggcauggucggccgcgccggcccccgcccccagggcgccaccgucucccucugggagaccguccagaaguggcgcgaguaccgccgccagugccagcgcucccucaccgaggaccccccccccgccaccgaccucuucugcaaccgcaccuucgacgaguacgccugcuggcccgacggcgagcccggcuccuucgucaacgucuccugccccugguaccuccccugggccuccuccgucccccagggccacgucuaccgcuucugcaccgccgagggccucuggcuccagaaggacaacuccucccuccccuggcgcgaccucuccgagugcgaggaguccaagcgcggcgagcgcuccucccccgaggagcagcuccucuuccucuacaucaucuacaccgucggcuacgcccucuccuucuccgcccucgucaucgccuccgccauccuccucggcuuccgccaccuccacugcacccgcaacuacauccaccucaaccucuucgccuccuucauccuccgcgcccucuccgucuucaucaaggacgccgcccucaaguggauguacuccaccgccgcccagcagcaccagugggacggccuccucuccuaccaggacucccucuccugccgccucgucuuccuccucaugcaguacugcgucgccgccaacuacuacuggcuccucgucgagggcgucuaccucuacacccuccucgccuucuccguccucuccgagcaguggaucuuccgccucuacgucuccaucggcuggggcgucccccuccucuucgucguccccuggggcaucgucaaguaccucuacgaggacgagggcugcuggacccgcaacuccaacaugaacuacuggcucaucauccgccuccccauccucuucgccaucggcgucaacuuccucaucuucguccgcgucaucugcaucgucgucuccaagcucaaggccaaccucaugugcaagaccgacaucaagugccgccucgccaaguccacccucacccucaucccccuccucggcacccacgaggucaucuucgccuucgucauggacgagcacgcccgcggcacccuccgcuucaucaagcucuucaccgagcucuccuucaccuccuuccagggccucauggucgccauccucuacugcuucgucaacaacgagguccagcucgaguuccgcaaguccugggagcgcuggcgccucgagcaccuccacauccagcgcgacuccuccaugaagccccucaagugccccaccuccucccucuccuccggcgccaccgccggcuccuccauguacaccgccaccugccaggccuccugcuccuga

SEQ ID NO: 43668 - RNA, 1662 nt, Artificial Sequence
  derived and/or modified sequence opt2 from GLP2R__Homo_sapiens__NP_004237
augaagcucggcuccucccgcgccggccccggccgcggcuccgccggccuccuccccggcguccacgagcuccccaugggcauccccgcccccuggggcaccuccccccucuccuuccaccgcaagugcucccucugggcccccggccgccccuuccucacccucguccuccucgucuccaucaagcaggucaccggcucccuccucgaggagaccacccgcaagugggcccaguacaagcaggccugccuccgcgaccuccucaaggagcccuccggcaucuucugcaacggcaccuucgaccaguacgucugcuggccccacuccucccccggcaacgucuccguccccugccccuccuaccuccccuggugguccgaggaguccuccggccgcgccuaccgccacugccucgcccagggcaccuggcagaccaucgagaacgccaccgacaucuggcaggacgacuccgagugcuccgagaaccacuccuucaagcagaacgucgaccgcuacgcccuccucuccacccuccagcucauguacaccgucggcuacuccuucucccucaucucccucuuccucgcccucacccuccuccucuuccuccgcaagcuccacugcacccgcaacuacauccacaugaaccucuucgccuccuucauccuccgcacccucgccguccucgucaaggacgucgucuucuacaacuccuacuccaagcgccccgacaacgagaacggcuggauguccuaccucuccgagauguccaccuccugccgcuccguccagguccuccuccacuacuucgucggcgccaacuaccucuggcuccucgucgagggccucuaccuccacacccuccucgagcccaccguccuccccgagcgccgccucuggccccgcuaccuccuccucggcugggccuuccccguccucuucgucguccccuggggcuucgcccgcgcccaccucgagaacaccggcugcuggaccaccaacggcaacaagaagaucugguggaucauccgcggccccaugaugcucugcgucaccgucaacuucuucaucuuccucaagauccucaagcuccucaucuccaagcucaaggcccaccagaugugcuuccgcgacuacaaguaccgccucgccaaguccacccucguccucaucccccuccucggcguccacgagauccucuucuccuucaucaccgacgaccaggucgagggcuucgccaagcucauccgccucuucauccagcucacccucuccuccuuccacggcuuccucgucgcccuccaguacggcuucgccaacggcgaggucaaggccgagcuccgcaaguacuggguccgcuuccuccucgcccgccacuccggcugccgcgccugcguccucggcaaggacuuccgcuuccucggcaagugccccaagaagcucuccgagggcgacggcgccgagaagcuccgcaagcuccagcccucccucaacuccggccgccuccuccaccucgccaugcgcggccucggcgagcucggcgcccagccccagcaggaccacgcccgcuggccccgcggcuccucccucuccgagugcuccgagggcgacgucaccauggccaacaccauggaggagauccucgaggaguccgagaucuga

SEQ ID NO: 43669 - RNA, 1350 nt, Artificial Sequence
  derived and/or modified sequence opt2 from GLRA1__Homo_sapiens__NP_000162
auguacuccuucaacacccuccgccucuaccucugggagaccaucgucuucuucucccucgccgccuccaaggaggccgaggccgcccgcuccgcccccaagcccaugucccccuccgacuuccucgacaagcucaugggccgcaccuccggcuacgacgcccgcauccgccccaacuucaagggcccccccgucaacgucuccugcaacaucuucaucaacuccuucggcuccaucgccgagaccaccauggacuaccgcgucaacaucuuccuccgccagcaguggaacgacccccgccucgccuacaacgaguaccccgacgacucccucgaccucgaccccuccaugcucgacuccaucuggaagcccgaccucuucuucgccaacgagaagggcgcccacuuccacgagaucaccaccgacaacaagcuccuccgcaucucccgcaacggcaacguccucuacuccauccgcaucacccucacccucgccugccccauggaccucaagaacuuccccauggacguccagaccugcaucaugcagcucgaguccuucggcuacaccaugaacgaccucaucuucgaguggcaggagcagggcgccguccaggucgccgacggccucacccucccccaguucauccucaaggaggagaaggaccuccgcuacugcaccaagcacuacaacaccggcaaguucaccugcaucgaggcccgcuuccaccucgagcgccagaugggcuacuaccucauccagauguacauccccucccuccucaucgucauccucuccuggaucuccuucuggaucaacauggacgccgcccccgcccgcgucggccucggcaucaccaccguccucaccaugaccacccaguccuccggcucccgcgccucccuccccaaggucuccuacgucaaggccaucgacaucuggauggccgucugccuccucuucgucuucuccgcccuccucgaguacgccgccgucaacuucgucucccgccagcacaaggagcuccuccgcuuccgccgcaagcgccgccaccacaaggaggacgaggccggcgagggccgcuucaacuucuccgccuacggcaugggccccgccugccuccaggccaaggacggcaucuccgucaagggcgccaacaacuccaacaccaccaaccccccccccgcccccuccaagucccccgaggagaugcgcaagcucuucauccagcgcgccaagaagaucgacaagaucucccgcaucggcuuccccauggccuuccucaucuucaacauguucuacuggaucaucuacaagaucguccgccgcgaggacguccacaaccaguga

SEQ ID NO: 43670 - RNA, 1359 nt, Artificial Sequence
  derived and/or modified sequence opt2 from GLRA2__Homo_sapiens__NP_001112357
augaaccgccagcucgucaacauccucaccgcccucuucgccuucuuccucgagaccaaccacuuccgcaccgccuucugcaaggaccacgacucccgcuccggcaagcagcccucccagacccucucccccuccgacuuccucgacaagcucaugggccgcaccuccggcuacgacgcccgcauccgccccaacuucaagggcccccccgucaacgucaccugcaacaucuucaucaacuccuucggcuccgucaccgagaccaccauggacuaccgcgucaacaucuuccuccgccagcaguggaacgacucccgccucgccuacuccgaguaccccgacgacucccucgaccucgaccccuccaugcucgacuccaucuggaagcccgaccucuucuucgccaacgagaagggcgccaacuuccacgacgucaccaccgacaacaagcuccuccgcaucuccaagaacggcaagguccucuacuccauccgccucacccucacccucuccugccccauggaccucaagaacuuccccauggacguccagaccugcaccaugcagcucgaguccuucggcuacaccaugaacgaccucaucuucgaguggcucuccgacggccccguccaggucgccgagggccucacccucccccaguucauccucaaggaggagaaggagcucggcuacugcaccaagcacuacaacaccggcaaguucaccugcaucgaggucaaguuccaccucgagcgccagaugggcuacuaccucauccagauguacauccccucccuccucaucgucauccucuccugggucuccuucuggaucaacauggacgccgcccccgcccgcgucgcccucggcaucaccaccguccucaccaugaccacccaguccuccggcucccgcgccucccuccccaaggucuccuacgucaaggccaucgacaucuggauggccgucugccuccucuucgucuucgccgcccuccucgaguacgccgccgucaacuucgucucccgccagcacaaggaguuccuccgccuccgccgccgccagaagcgccagaacaaggaggaggacgucacccgcgagucccgcuucaacuucuccggcuacggcaugggccacugccuccaggucaaggacggcaccgccgucaaggccacccccgccaacccccucccccagccccccaaggacggcgacgccaucaagaagaaguucgucgaccgcgccaagcgcaucgacaccaucucccgcgccgccuucccccucgccuuccucaucuucaacaucuucuacuggaucaccuacaagaucauccgccacgaggacguccacaagaaguga

SEQ ID NO: 43671 - RNA, 1350 nt, Artificial Sequence
  derived and/or modified sequence opt2 from GLRA3__Homo_sapiens__NP_001036008
auggcccacguccgccacuuccgcacccucgucuccggcuucuacuucugggaggccgcccuccuccucucccucgucgccaccaaggagaccgacuccgcccgcucccgcuccgcccccaugucccccuccgacuuccucgacaagcucaugggccgcaccuccggcuacgacgcccgcauccgccccaacuucaagggcccccccgucaacgucaccugcaacaucuucaucaacuccuucggcuccaucgccgagaccaccauggacuaccgcgucaacaucuuccuccgccagaaguggaacgacccccgccucgccuacuccgaguaccccgacgacucccucgaccucgaccccuccaugcucgacuccaucuggaagcccgaccucuucuucgccaacgagaagggcgccaacuuccacgaggucaccaccgacaacaagcuccuccgcaucuucaagaacggcaacguccucuacuccauccgccucacccucacccucuccugccccauggaccucaagaacuuccccauggacguccagaccugcaucaugcagcucgaguccuucggcuacaccaugaacgaccucaucuucgaguggcaggacgaggcccccguccaggucgccgagggccucacccucccccaguuccuccucaaggaggagaaggaccuccgcuacugcaccaagcacuacaacaccggcaaguucaccugcaucgagguccgcuuccaccucgagcgccagaugggcuacuaccucauccagauguacauccccucccuccucaucgucauccucuccugggucuccuucuggaucaacauggacgccgcccccgcccgcgucgcccucggcaucaccaccguccucaccaugaccacccaguccuccggcucccgcgccucccuccccaaggucuccuacgucaaggccaucgacaucuggauggccgucugccuccucuucgucuucuccgcccuccucgaguacgccgccgucaacuucgucucccgccagcacaaggagcuccuccgcuuccgccgcaagcgcaagaacaaggacgacgagguccgcgagucccgcuucuccuucaccgccuacggcaugggccccugccuccaggccaaggacggcaugacccccaagggccccaaccaccccguccaggucaugcccaagucccccgacgagaugcgcaaggucuucaucgaccgcgccaagaagaucgacaccaucucccgcgccugcuucccccucgccuuccucaucuucaacaucuucuacugggucaucuacaagauccuccgccacgaggacauccaccagcagcaggacuga

SEQ ID NO: 43672 - RNA, 1494 nt, Artificial Sequence
  derived and/or modified sequence opt2 from GLRB__Homo_sapiens__NP_001159532
augaaguuccuccucaccaccgccuuccucauccucaucucccucugggucgaggaggccuacuccaaggagaaguccuccaagaagggcaagggcaagaagaagcaguaccucugccccucccagcaguccgccgaggaccucgcccgcguccccgccaacuccaccuccaacauccucaaccgccuccucgucuccuacgacccccgcauccgccccaacuucaagggcauccccgucgacgucgucgucaacaucuucaucaacuccuucggcuccauccaggagaccaccauggacuaccgcgucaacaucuuccuccgccagaaguggaacgacccccgccucaagcuccccuccgacuuccgcggcuccgacgcccucaccgucgaccccaccauguacaagugccucuggaagcccgaccucuucuucgccaacgagaaguccgccaacuuccacgacgucacccaggagaacauccuccucuucaucuuccgcgacggcgacguccucgucuccaugcgccucuccaucacccucuccugcccccucgaccucacccucuuccccauggacacccagcgcugcaagaugcagcucgaguccuucggcuacaccaccgacgaccuccgcuucaucuggcaguccggcgaccccguccagcucgagaagaucgcccucccccaguucgacaucaagaaggaggacaucgaguacggcaacugcaccaaguacuacaagggcaccggcuacuacaccugcgucgaggucaucuucacccuccgccgccaggucggcuucuacaugaugggcgucuacgcccccacccuccucaucgucguccucuccuggcucuccuucuggaucaaccccgacgccuccgccgcccgcgucccccucggcaucuucuccguccucucccucgccuccgagugcaccacccucgccgccgagcuccccaaggucuccuacgucaaggcccucgacgucuggcucaucgccugccuccucuucggcuucgccucccucgucgaguacgccgucguccaggucaugcucaacaaccccaagcgcgucgaggccgagaaggcccgcaucgccaaggccgagcaggccgacggcaagggcggcaacgucgccaagaagaacaccgucaacggcaccggcacccccguccacaucuccacccuccaggucggcgagacccgcugcaagaaggucugcaccuccaaguccgaccuccgcuccaacgacuucuccaucgucggcucccucccccgcgacuucgagcucuccaacuacgacugcuacggcaagcccaucgaggucaacaacggccucggcaagucccaggccaagaacaacaagaagcccccccccgccaagcccgucauccccaccgccgccaagcgcaucgaccucuacgcccgcgcccucuuccccuucugcuuccucuucuucaacgucaucuacugguccaucuaccucuga

SEQ ID NO: 43673 - RNA, 498 nt, Artificial Sequence
  derived and/or modified sequence opt2 from GLRX2__Homo_sapiens__NP_057150
augaacccccgcgacaagcaggucucccgcuucuccccccucaaggacgucuacaccugggucgcccucgccggcauccagcgcuccggcucccccggccgcacccgcuccgccgcccgccgcauggaguccaacaccuccuccucccucgagaaccucgccaccgcccccgucaaccagauccaggagaccaucuccgacaacugcgucgucaucuucuccaagaccuccugcuccuacugcaccauggccaagaagcucuuccacgacaugaacgucaacuacaaggucgucgagcucgaccuccucgaguacggcaaccaguuccaggacgcccucuacaagaugaccggcgagcgcaccgucccccgcaucuucgucaacggcaccuucaucggcggcgccaccgacacccaccgccuccacaaggagggcaagcuccucccccucguccaccagugcuaccucaagaaguccaagcgcaaggaguuccaguga

SEQ ID NO: 43674 - RNA, 1008 nt, Artificial Sequence
  derived and/or modified sequence opt2 from GLRX3__Homo_sapiens__NP_006532
auggccgccggcgccgccgaggccgccgucgccgccgucgaggaggucggcuccgccggccaguucgaggagcuccuccgccucaaggccaagucccuccucgucguccacuucugggcccccugggccccccagugcgcccagaugaacgaggucauggccgagcucgccaaggagcucccccaggucuccuucgucaagcucgaggccgagggcguccccgaggucuccgagaaguacgagaucuccuccguccccaccuuccucuucuucaagaacucccagaagaucgaccgccucgacggcgcccacgcccccgagcucaccaagaagguccagcgccacgccuccuccggcuccuuccuccccuccgccaacgagcaccucaaggaggaccucaaccuccgccucaagaagcucacccacgccgcccccugcaugcucuucaugaagggcaccccccaggagccccgcugcggcuucuccaagcagauggucgagauccuccacaagcacaacauccaguucuccuccuucgacaucuucuccgacgaggagguccgccagggccucaaggccuacuccuccuggcccaccuacccccagcucuacgucuccggcgagcucaucggcggccucgacaucaucaaggagcucgaggccuccgaggagcucgacaccaucugccccaaggcccccaagcucgaggagcgccucaagguccucaccaacaaggccuccgucaugcucuucaugaagggcaacaagcaggaggccaagugcggcuucuccaagcagauccucgagauccucaacuccaccggcgucgaguacgagaccuucgacauccucgaggacgaggagguccgccagggccucaaggccuacuccaacuggcccaccuacccccagcucuacgucaagggcgagcucgucggcggccucgacaucgucaaggagcucaaggagaacggcgagcuccuccccauccuccgcggcgagaacuga

SEQ ID NO: 43675 - RNA, 474 nt, Artificial Sequence
  derived and/or modified sequence opt2 from GLRX5__Homo_sapiens__NP_057501
auguccggcucccucggccgcgccgccgccgcccuccuccgcuggggccgcggcgccggcggcggcggccucuggggccccggcguccgcgccgccggcuccggcgccggcggcggcggcuccgccgagcagcucgacgcccucgucaagaaggacaaggucgucgucuuccucaagggcacccccgagcagccccagugcggcuucuccaacgccgucguccagauccuccgccuccacggcguccgcgacuacgccgccuacaacguccucgacgaccccgagcuccgccagggcaucaaggacuacuccaacuggcccaccaucccccaggucuaccucaacggcgaguucgucggcggcugcgacauccuccuccagaugcaccagaacggcgaccucgucgaggagcucaagaagcucggcauccacuccgcccuccucgacgagaagaaggaccaggacuccaaguga

SEQ ID NO: 43676 - RNA, 321 nt, Artificial Sequence
  derived and/or modified sequence opt2 from GLRX__Homo_sapiens__NP_001230588
auggcccaggaguucgucaacugcaagauccagcccggcaaggucgucgucuucaucaagcccaccugccccuacugccgccgcgcccaggagauccucucccagcuccccaucaagcagggccuccucgaguucgucgacaucaccgccaccaaccacaccaacgagauccaggacuaccuccagcagcucaccggcgcccgcaccgucccccgcgucuucaucggcaaggacugcaucggcggcugcuccgaccucgucucccuccagcaguccggcgagcuccucacccgccucaagcagaucggcgcccuccaguga

SEQ ID NO: 43677 - RNA, 1809 nt, Artificial Sequence
  derived and/or modified sequence opt2 from GLS2__Homo_sapiens__NP_037399
augcgcuccaugaaggcccuccagaaggcccucucccgcgccggcucccacugcggccgcggcggcuggggccaccccucccgcuccccccuccucggcggcggcguccgccaccaccucuccgaggccgccgcccagggccgcgagaccccccacucccaccagccccagcaccaggaccacgacuccuccgaguccggcaugcucucccgccucggcgaccuccucuucuacaccaucgccgagggccaggagcgcauccccauccacaaguucaccaccgcccucaaggccaccggccuccagaccuccgacccccgccuccgcgacugcauguccgagaugcaccgcgucguccaggaguccuccuccggcggccuccucgaccgcgaccucuuccgcaagugcgucuccuccaacaucguccuccucacccaggccuuccgcaagaaguucgucauccccgacuucgaggaguucaccggccacgucgaccgcaucuucgaggacgucaaggagcucaccggcggcaaggucgccgccuacaucccccagcucgccaaguccaaccccgaccucuggggcgucucccucugcaccgucgacggccagcgccacuccgucggccacaccaagauccccuucugccuccaguccugcgucaagccccucaccuacgccaucuccaucuccacccucggcaccgacuacguccacaaguucgucggcaaggagcccuccggccuccgcuacaacaagcucucccucaacgaggagggcaucccccacaaccccauggucaacgccggcgccaucgucgucuccucccucaucaagauggacugcaacaaggccgagaaguucgacuucguccuccaguaccucaacaagauggccggcaacgaguacaugggcuucuccaacgccaccuuccaguccgagaaggagaccggcgaccgcaacuacgccaucggcuacuaccucaaggagaagaagugcuuccccaagggcgucgacaugauggccgcccucgaccucuacuuccagcucugcuccgucgaggucaccugcgaguccggcuccgucauggccgccacccucgccaacggcggcaucugccccaucaccggcgaguccguccucuccgccgaggccguccgcaacacccucucccucaugcacuccugcggcauguacgacuucuccggccaguucgccuuccacgucggccuccccgccaaguccgccgucuccggcgccauccuccucgucguccccaacgucaugggcaugaugugccucucccccccccucgacaagcucggcaacucccaccgcggcaccuccuucugccagaagcucgucucccucuucaacuuccacaacuacgacaaccuccgccacugcgcccgcaagcucgacccccgccgcgagggcgccgagauccgcaacaagaccgucgucaaccuccucuucgccgccuacuccggcgacgucuccgcccuccgccgcuucgcccucuccgccauggacauggagcagaaggacuacgacucccgcaccgcccuccacgucgccgccgccgagggccacaucgaggucgucaaguuccucaucgaggccugcaaggucaaccccuucgccaaggaccgcuggggcaacaucccccucgacgacgccguccaguucaaccaccucgaggucgucaagcuccuccaggacuaccaggacuccuacacccucuccgagacccaggccgaggccgccgccgaggcccucuccaaggagaaccucgaguccauggucuga

SEQ ID NO: 43678 - RNA, 1797 nt, Artificial Sequence
  derived and/or modified sequence opt2 from GLS__Homo_sapiens__NP_001243239
augaugcgccuccgcggcuccggcaugcuccgcgaccuccuccuccgcucccccgccggcgucuccgccacccuccgccgcgcccagccccucgucacccucugccgccgcccccgcggcggcggccgccccgccgccggccccgccgccgccgcccgccuccaccccugguggggcggcggcggcuggcccgccgagccccucgcccgcggccucuccuccucccccuccgagauccuccaggagcucggcaagggcuccacccacccccagcccggcgucuccccccccgccgcccccgccgcccccggccccaaggacggccccggcgagaccgacgccuucggcaacuccgagggcaaggagcucgucgccuccggcgagaacaagaucaagcagggccuccuccccucccucgaggaccuccucuucuacaccaucgccgagggccaggagaagauccccguccacaaguucaucaccgcccucaaguccaccggccuccgcaccuccgacccccgccucaaggagugcauggacaugcuccgccucacccuccagaccaccuccgacggcgucaugcucgacaaggaccucuucaagaagugcguccaguccaacaucguccuccucacccaggccuuccgccgcaaguucgucauccccgacuucauguccuucaccucccacaucgacgagcucuacgaguccgccaagaagcaguccggcggcaaggucgccgacuacaucccccagcucgccaaguucucccccgaccucuggggcgucuccgucugcaccgucgacggccagcgccacuccaccggcgacaccaagguccccuucugccuccaguccugcgucaagccccucaaguacgccaucgccgucaacgaccucggcaccgaguacguccaccgcuacgucggcaaggagcccuccggccuccgcuucaacaagcucuuccucaacgaggacgacaagccccacaaccccauggucaacgccggcgccaucgucgucaccucccucaucaagcagggcgucaacaacgccgagaaguucgacuacgucaugcaguuccucaacaagauggccggcaacgaguacgucggcuucuccaacgccaccuuccaguccgagcgcgaguccggcgaccgcaacuucgccaucggcuacuaccucaaggagaagaagugcuuccccgagggcaccgacauggucggcauccucgacuucuacuuccagcucugcuccaucgaggucaccugcgaguccgccuccgucauggccgccacccucgccaacggcggcuucugccccaucaccggcgagcgcguccucucccccgaggccguccgcaacacccucucccucaugcacuccugcggcauguacgacuucuccggccaguucgccuuccacgucggccuccccgccaaguccggcgucgccggcggcauccuccucgucguccccaacgucaugggcaugaugugcuggucccccccccucgacaagaugggcaacuccgucaagggcauccacuucugccacgaccucgucucccucugcaacuuccacaacuacgacaaccuccgccacuucgccaagaagcucgacccccgccgcgagggcggcgaccagcgccacuccuucggcccccucgacuacgagucccuccagcaggagcucgcccucaaggagaccgucuggaagaaggucucccccgaguccaacgaggacaucuccaccaccgucgucuaccgcauggagucccucggcgagaaguccuga

SEQ ID NO: 43679 - RNA, 801 nt, Artificial Sequence
  derived and/or modified sequence opt2 from GLT1D1__Homo_sapiens__NP_653270
augcgccuccucuuccucgccguccuccgcccccacaccggcaacgccgucaccgcccagcgcguccgcgcccaccucgaggccgccggccacgucugcguccucaaggacgccuucgacuucgagucccgcuccgagaucgccaaccucauccucgccgagaacugcgaggccgcccucgcccuccaccucuaccgcggcggccgccuccuccagggccaccgcauccccuucggcgucaucuucggcggcaccgacgucaacgaggacgccaaccaggccgagaagaacaccgucaugggccgcguccucgaggaggcccgcuucgccgucgccuucaccgaguccaugaaggagauggcccaggcccagugggucgaccccgucuucacccgcgaggucaaggccaaggucaagcgcgccgccggcguccgccucaucggcgagaugccccaggaggaccuccacgccgucgucaagaacugcuucgccgucgucaacuccuccgucuccgagggcauguccgccgccauccucgaggccauggaccucgagguccccguccucgcccgcaacauccccggcaacgccgccgucgucaagcacgaggucaccggccuccucuucuccaacccccaggaguucguccaccucgccaagcgccucgucuccgaccccgcccucgagaaggagaucgucgucaacggccgcgaguacguccgcauguaccacuccuggcaggucgagcgcgacaccuaccagcagcucauccgcaagcucgagggcuccaccgaggacuga

SEQ ID NO: 43680 - RNA, 831 nt, Artificial Sequence
  derived and/or modified sequence opt2 from GLT6D1__Homo_sapiens__XP_011516939
augaacuccaagcgcaugcuccuccucguccucuucgccuucucccucaugcucgucgagcgcuacuuccgcaaccaccaggucgaggagcuccgccucuccgacugguuccacccccgcaagcgccccgacgucaucaccaagaccgacuggcucgcccccguccucugggagggcaccuucgaccgccgcguccucgagaagcacuaccgccgccgcaacaucaccgucggccucgccgucuucgccaccggccgcuucgccgaggaguaccuccgccccuuccuccacuccgccaacaagcacuucaugaccggcuaccgcgucaucuucuacaucauggucgacgccuucuucaagcuccccgacaucgagcccuccccccuccgcaccuucaaggccuucaaggucggcaccgagcgcugguggcucgacggcccccucguccacgucaagucccucggcgagcacaucgccucccacauccaggacgaggucgacuuccucuucuccauggccgccaaccaggucuuccagaacgaguucggcgucgagacccucggcccccucgucgcccagcuccacgccuggugguacuuccgcaacaccaagaacuuccccuacgagcgccgccccaccuccgccgccugcauccccuucggccagggcgacuucuacuacggcaaccucauggucggcggcaccccccacaacauccucgacuucaucaaggaguaccucaacggcgucauccacgacaucaagaacggccucaacuccaccuacgagaagcaccucaacaaguacuucuaccucaacaagcccaccuga

SEQ ID NO: 43681 - RNA, 1116 nt, Artificial Sequence
  derived and/or modified sequence opt2 from GLT8D1__Homo_sapiens__NP_001010983
auguccuuccgcaaggucaacaucaucauccucguccucgccgucgcccucuuccuccucguccuccaccacaacuuccucucccucuccucccuccuccgcaacgaggucaccgacuccggcaucgucggcccccagcccaucgacuucguccccaacgcccuccgccacgccgucgacggccgccaggaggagauccccgucgucaucgccgccuccgaggaccgccucggcggcgccaucgccgccaucaacuccauccagcacaacacccgcuccaacgucaucuucuacaucgucacccucaacaacaccgccgaccaccuccgcuccuggcucaacuccgacucccucaaguccauccgcuacaagaucgucaacuucgaccccaagcuccucgagggcaaggucaaggaggaccccgaccagggcgaguccaugaagccccucaccuucgcccgcuucuaccuccccauccucguccccuccgccaagaaggccaucuacauggacgacgacgucaucguccagggcgacauccucgcccucuacaacaccgcccucaagcccggccacgccgccgccuucuccgaggacugcgacuccgccuccaccaaggucgucauccgcggcgccggcaaccaguacaacuacaucggcuaccucgacuacaagaaggagcgcauccgcaagcucuccaugaaggccuccaccugcuccuucaaccccggcgucuucgucgccaaccucaccgaguggaagcgccagaacaucaccaaccagcucgagaaguggaugaagcucaacgucgaggagggccucuacucccgcacccucgccggcuccaucaccacccccccccuccucaucgucuucuaccagcagcacuccaccaucgaccccauguggaacguccgccaccucggcuccuccgccggcaagcgcuacuccccccaguucgucaaggccgccaagcuccuccacuggaacggccaccucaagcccuggggccgcaccgccuccuacaccgacgucugggagaagugguacauccccgaccccaccggcaaguucaaccucauccgccgcuacaccgagaucuccaacaucaaguga

SEQ ID NO: 43682 - RNA, 4683 nt, Artificial Sequence
  derived and/or modified sequence opt2 from GLTSCR1__Homo_sapiens__XP_005258890
auggacgacgaggacggccgcugccuccucgacgucaucugcgacccccaggcccucaacgacuuccuccacggcuccgagaagcucgacuccgacgaccuccucgacaaccccggcgaggcccaguccgccuucuacgagggccccggccuccacguccaggaggccuccggcaaccaccucaaccccgagcccaaccagcccgcccccuccgucgaccucgacuuccucgaggacgacauccucggcucccccgccaccggcggcggcggcggcggcuccggcggcgccgaccagcccugcgacauccuccagcagucccuccaggaggccaacaucaccgagcagacccucgaggccgaggccgagcucgaccucggccccuuccagcuccccacccuccagcccgccgacggcggcgccggccccaccggcgccggcggcgccgccgccgucgccgccggcccccaggcccucuuccccggcuccaccgaccuccucggccuccagggcccccccaccguccucacccaccaggcccucguccccccccaggacgucgucaacaaggcccucuccguccagcccuuccuccagcccgucggccucggcaacgucacccuccagcccauccccggccuccagggccuccccaacggcucccccggcggcgccaccgccgccacccucggccucgcccccauccaggucgucggccagcccgucauggcccucaacacccccaccucccagcuccucgccaagcagguccccgucuccggcuaccucgccuccgccgccggccccuccgagcccgucacccucgccuccgccggcgucuccccccagggcgccggccucgucauccagaagaaccucuccgccgccgucgccaccacccucaacggcaacuccgucuucggcggcgccggcgccgccuccgcccccaccggcacccccuccggccagccccucgccgucgcccccggccucggcuccuccccccucguccccgcccccaacgucauccuccaccgcacccccacccccauccagcccaagcccgccggcguccucccccccaagcucuaccagcucacccccaagcccuucgcccccgccggcgccacccucaccauccagggcgagcccggcgcccucccccagcagcccaaggccccccagaaccucaccuucauggccgccggcaaggccggccagaacgucguccucuccggcuuccccgcccccgcccuccaggccaacgucuucaagcagccccccgccaccaccaccggcgccgcccccccccagccccccggcgcccucuccaagcccauguccguccaccuccucaaccagggcuccuccaucgucauccccgcccagcacaugcuccccggccagaaccaguuccuccuccccggcgcccccgccguccagcucccccagcagcucuccgcccuccccgccaacgucggcggccagauccucgccgccgccgccccccacaccggcggccagcucaucgccaaccccauccucaccaaccagaaccucgccggcccccucucccucggccccguccucgccccccacuccggcgcccacuccgcccacauccucuccgccgcccccauccaggucggccagcccgcccucuuccagaugcccgucucccucgccgccggcucccuccccacccagucccagcccgcccccgccggccccgccgccaccaccguccuccagggcgucacccucccccccuccgccgucgccaugcucaacacccccgacggccucguccagcccgccacccccgccgccgccaccggcgaggccgcccccguccucaccguccagcccgccccccaggccccccccgccgucuccaccccccucccccucggccuccagcagccccaggcccagcagcccccccaggcccccaccccccaggccgccgcccccccccaggccaccaccccccagcccucccccggccucgccuccucccccgagaagaucguccucggccagccccccuccgccacccccaccgccauccucacccaggacucccuccagauguuccucccccaggagcgcucccagcagccccucuccgccgagggcccccaccucuccguccccgccuccgucaucgucuccgcccccccccccgcccaggaccccgcccccgccacccccgucgccaagggcgccggccucggcccccaggcccccgacucccaggccucccccgcccccgccccccagauccccgccgccgccccccucaagggccccggccccuccuccucccccucccucccccaccaggccccccucggcgacuccccccaccuccccuccccccaccccacccgcccccccucccgcccccccucccgcccccaguccgucucccgcccccccuccgagcccccccuccaccccugcccccccccccaggccccccccacccuccccggcaucuucgucauccagaaccagcucggcguccccccccccgccuccaaccccgcccccaccgcccccggccccccccagcccccccuccgcccccagucccagccccccgagggcccccucccccccgccccccaccucccccccuccuccaccuccuccgccgucgccuccuccuccgagaccuccucccgccuccccgcccccacccccuccgacuuccagcuccaguucccccccucccagggcccccacaagucccccacccccccccccacccuccaccucguccccgagcccgccgcccccccccccccccccccccgcaccuuccagauggucaccacccccuuccccgcccucccccagcccaaggcccuccucgagcgcuuccaccagguccccuccggcaucauccuccagaacaaggccggcggcgcccccgccgccccccagaccuccaccucccucggcccccucaccucccccgccgccuccguccucgucuccggccaggcccccuccggcacccccaccgcccccucccacgcccccgcccccgcccccauggccgccaccggccuccccccccuccuccccgccgagaacaaggccuucgccuccaaccuccccacccucaacgucgccaaggccgccuccuccggccccggcaagcccuccggccuccaguacgaguccaagcucuccggccucaagaagccccccacccuccagcccuccaaggaggccugcuuccucgagcaccuccacaagcaccagggcuccguccuccaccccgacuacaagaccgccuuccccuccuucgaggacgcccuccaccgccuccuccccuaccacgucuaccagggcgcccuccccucccccuccgacuaccacaaggucgacgaggaguucgagaccgucuccacccagcuccucaagcgcacccaggccaugcucaacaaguaccgccuccuccuccucgaggagucccgccgcgucucccccuccgccgagauggucaugaucgaccgcauguucauccaggaggagaagaccacccucgcccucgacaagcagcucgccaaggagaagcccgacgaguacgucuccuccucccgcucccucggccuccccaucgccgccuccuccgagggccaccgccuccccggccacggcccccucuccuccuccgcccccggcgccuccacccagccccccccccaccuccccaccaagcucgucauccgccacggcggcgccggcggcucccccuccgucaccugggcccgcgccuccuccucccucuccuccuccuccuccuccuccuccgccgccuccucccucgacgccgacgaggacggccccaugcccucccgcaaccgcccccccaucaagaccuacgaggcccgcucccgcaucggccucaagcucaagaucaagcaggaggccggccucuccaaggucguccacaacaccgcccucgaccccguccaccagcccccccccccccccgccacccucaaggucgccgagccccccccccgccccccccccccccccccccccaccggccagaugaacggcaccgucgaccaccccccccccgccgcccccgagcgcaagccccucggcaccgccccccacugcccccgccucccccuccgcaagaccuaccgcgagaacgucggcggccccggcgcccccgagggcacccccgccggccgcgcccgcggcggcucccccgccccccuccccgccaaggucgacgaggccaccuccggccucauccgcgagcucgccgccgucgaggacgagcucuaccagcgcaugcucaagggccccccccccgagcccgccgccuccgccgcccagggcaccggcgaccccgacugggaggcccccggccucccccccgccaagcgccgcaaguccgagucccccgacgucgaccaggccuccuucuccuccgacuccccccaggacgacacccucaccgagcaccuccaguccgccaucgacuccauccucaaccuccagcaggcccccggccgcacccccgcccccuccuacccccacgccgccuccgccggcacccccgccuccccccccccccuccaccgccccgaggccuacccccccuccucccacaacggcggccucggcgcccgcacccucacccgcuga

SEQ ID NO: 43683 - RNA, 1437 nt, Artificial Sequence
  derived and/or modified sequence opt2 from GLTSCR2__Homo_sapiens__NP_056525
auggccgccggcggcuccggcgucggcggcaagcgcuccuccaaguccgacgccgacuccggcuuccucggccuccgccccaccuccgucgaccccgcccuccgccgccgccgccgcggcccccgcaacaagaagcgcggcuggcgccgccucgcccaggagccccucggccucgaggucgaccaguuccucgaggacguccgccuccaggagcgcaccuccggcggccuccucuccgaggcccccaacgagaagcucuucuucgucgacaccggcuccaaggagaagggccucaccaagaagcgcaccaagguccagaagaagucccuccuccucaagaagccccuccgcgucgaccucauccucgagaacaccuccaagguccccgcccccaaggacguccucgcccaccagguccccaacgccaagaagcuccgccgcaaggagcagcucugggagaagcucgccaagcagggcgagcucccccgcgagguccgccgcgcccaggcccgccuccucaaccccuccgccacccgcgccaagcccggcccccaggacaccgucgagcgccccuucuacgaccucugggccuccgacaacccccucgaccgcccccucgucggccaggacgaguucuuccucgagcagaccaagaagaagggcgucaagcgccccgcccgccuccacaccaagcccucccaggcccccgccgucgaggucgcccccgccggcgccuccuacaaccccuccuucgaggaccaccagacccuccucuccgccgcccacgaggucgagcuccagcgccagaaggaggccgagaagcucgagcgccagcucgcccuccccgccaccgagcaggccgccacccaggaguccaccuuccaggagcucugcgagggccuccucgaggaguccgacggcgagggcgagcccggccagggcgagggccccgaggccggcgacgccgaggucugccccacccccgcccgccucgccaccaccgagaagaagaccgagcagcagcgccgccgcgagaaggccguccaccgccuccgcguccagcaggccgcccuccgcgccgcccgccuccgccaccaggagcucuuccgccuccgcggcaucaaggcccaggucgcccuccgccucgccgagcucgcccgccgccagcgccgccgccaggcccgccgcgaggccgaggccgacaagccccgccgccucggccgccucaaguaccaggcccccgacaucgacguccagcucuccuccgagcucaccgacucccuccgcacccucaagcccgagggcaacauccuccgcgaccgcuucaaguccuuccagcgccgcaacaugaucgagccccgcgagcgcgccaaguucaagcgcaaguacaaggucaagcucgucgagaagcgcgccuuccgcgagauccagcucuga

SEQ ID NO: 43684 - RNA, 1677 nt, Artificial Sequence
  derived and/or modified sequence opt2 from GLUD1__Homo_sapiens__NP_005262
auguaccgcuaccucggcgaggcccuccuccucucccgcgccggccccgccgcccucggcuccgccuccgccgacuccgccgcccuccucggcugggcccgcggccagcccgccgccgccccccagcccggccucgcccucgccgcccgccgccacuacuccgaggccgucgccgaccgcgaggacgaccccaacuucuucaagauggucgagggcuucuucgaccgcggcgccuccaucgucgaggacaagcucgucgaggaccuccgcacccgcgaguccgaggagcagaagcgcaaccgcguccgcggcauccuccgcaucaucaagcccugcaaccacguccucucccucuccuuccccauccgccgcgacgacggcuccugggaggucaucgagggcuaccgcgcccagcacucccagcaccgcacccccugcaagggcggcauccgcuacuccaccgacgucuccgucgacgaggucaaggcccucgccucccucaugaccuacaagugcgccgucgucgacguccccuucggcggcgccaaggccggcgucaagaucaaccccaagaacuacaccgacaacgagcucgagaagaucacccgccgcuucaccauggagcucgccaagaagggcuucaucggccccggcaucgacguccccgcccccgacauguccaccggcgagcgcgagauguccuggaucgccgacaccuacgccuccaccaucggccacuacgacaucaacgcccacgccugcgucaccggcaagcccaucucccagggcggcauccacggccgcaucuccgccaccggccgcggcgucuuccacggcaucgagaacuucaucaacgaggccuccuacauguccauccucggcaugacccccggcuucggcgacaagaccuucgucguccagggcuucggcaacgucggccuccacuccaugcgcuaccuccaccgcuucggcgccaagugcaucgccgucggcgaguccgacggcuccaucuggaaccccgacggcaucgaccccaaggagcucgaggacuucaagcuccagcacggcuccauccucggcuuccccaaggccaagcccuacgagggcuccauccucgaggccgacugcgacauccucauccccgccgccuccgagaagcagcucaccaaguccaacgccccccgcgucaaggccaagaucaucgccgagggcgccaacggccccaccacccccgaggccgacaagaucuuccucgagcgcaacaucauggucauccccgaccucuaccucaacgccggcggcgucaccgucuccuacuucgaguggcucaagaaccucaaccacgucuccuacggccgccucaccuucaaguacgagcgcgacuccaacuaccaccuccucauguccguccaggagucccucgagcgcaaguucggcaagcacggcggcaccauccccaucguccccaccgccgaguuccaggaccgcaucuccggcgccuccgagaaggacaucguccacuccggccucgccuacaccauggagcgcuccgcccgccagaucaugcgcaccgccaugaaguacaaccucggccucgaccuccgcaccgccgccuacgucaacgccaucgagaaggucuucaaggucuacaacgaggccggcgucaccuucaccuga

SEQ ID NO: 43685 - RNA, 1677 nt, Artificial Sequence
  derived and/or modified sequence opt2 from GLUD2__Homo_sapiens__NP_036216
auguaccgcuaccucgccaaggcccuccuccccucccgcgccggccccgccgcccucggcuccgccgccaaccacuccgccgcccuccucggccgcggccgcggccagcccgccgccgccucccagcccggccucgcccucgccgcccgccgccacuacuccgagcucgucgccgaccgcgaggacgaccccaacuucuucaagauggucgagggcuucuucgaccgcggcgccuccaucgucgaggacaagcucgucaaggaccuccgcacccaggaguccgaggagcagaagcgcaaccgcguccgcggcauccuccgcaucaucaagcccugcaaccacguccucucccucuccuuccccauccgccgcgacgacggcuccugggaggucaucgagggcuaccgcgcccagcacucccagcaccgcacccccugcaagggcggcauccgcuacuccaccgacgucuccgucgacgaggucaaggcccucgccucccucaugaccuacaagugcgccgucgucgacguccccuucggcggcgccaaggccggcgucaagaucaaccccaagaacuacaccgagaacgagcucgagaagaucacccgccgcuucaccauggagcucgccaagaagggcuucaucggccccggcgucgacguccccgcccccgacaugaacaccggcgagcgcgagauguccuggaucgccgacaccuacgccuccaccaucggccacuacgacaucaacgcccacgccugcgucaccggcaagcccaucucccagggcggcauccacggccgcaucuccgccaccggccgcggcgucuuccacggcaucgagaacuucaucaacgaggccuccuacauguccauccucggcaugacccccggcuuccgcgacaagaccuucgucguccagggcuucggcaacgucggccuccacuccaugcgcuaccuccaccgcuucggcgccaagugcaucgccgucggcgaguccgacggcuccaucuggaaccccgacggcaucgaccccaaggagcucgaggacuucaagcuccagcacggcuccauccucggcuuccccaaggccaagcccuacgagggcuccauccucgaggucgacugcgacauccucauccccgccgccaccgagaagcagcucaccaaguccaacgccccccgcgucaaggccaagaucaucgccgagggcgccaacggccccaccacccccgaggccgacaagaucuuccucgagcgcaacauccucgucauccccgaccucuaccucaacgccggcggcgucaccgucuccuacuucgaguggcucaagaaccucaaccacgucuccuacggccgccucaccuucaaguacgagcgcgacuccaacuaccaccuccuccucuccguccaggagucccucgagcgcaaguucggcaagcacggcggcaccauccccaucguccccaccgccgaguuccaggacuccaucuccggcgccuccgagaaggacaucguccacuccgcccucgccuacaccauggagcgcuccgcccgccagaucaugcacaccgccaugaaguacaaccucggccucgaccuccgcaccgccgccuacgucaacgccaucgagaaggucuucaaggucuacuccgaggccggcgucaccuucaccuga

SEQ ID NO: 43686 - RNA, 1122 nt, Artificial Sequence
  derived and/or modified sequence opt2 from GLUL__Homo_sapiens__XP_006711341
augaccaccuccgccuccucccaccucaacaagggcaucaagcaggucuacaugucccucccccagggcgagaagguccaggccauguacaucuggaucgacggcaccggcgagggccuccgcugcaagacccgcacccucgacuccgagcccaagugcgucgaggagcuccccgaguggaacuucgacggcuccuccacccuccaguccgagggcuccaacuccgacauguaccucguccccgccgccauguuccgcgaccccuuccgcaaggaccccaacaagcucguccucugcgaggucuucaaguacaaccgccgccccgccgagaccaaccuccgccacaccugcaagcgcaucauggacauggucuccaaccagcaccccugguucggcauggagcaggaguacacccucaugggcaccgacggccaccccuucggcuggcccuccaacggcuuccccggcccccagggccccuacuacugcggcgucggcgccgaccgcgccuacggccgcgacaucgucgaggcccacuaccgcgccugccucuacgccggcgucaagaucgccggcaccaacgccgaggucaugcccgcccagugggaguuccagaucggccccugcgagggcaucuccaugggcgaccaccucugggucgcccgcuucauccuccaccgcgucugcgaggacuucggcgucaucgccaccuucgaccccaagcccauccccggcaacuggaacggcgccggcugccacaccaacuucuccaccaaggccaugcgcgaggagaacggccucaaguacaucgaggaggccaucgagaagcucuccaagcgccaccaguaccacauccgcgccuacgaccccaagggcggccucgacaacgcccgccgccucaccggcuuccacgagaccuccaacaucaacgacuucuccgccggcgucgccaaccgcuccgccuccauccgcaucccccgcaccgucggccaggagaagaagggcuacuucgaggaccgccgccccuccgccaacugcgaccccuucuccgucaccgaggcccucauccgcaccugccuccucaacgagaccggcgacgagcccuuccaguacaagaacuga

SEQ ID NO: 43687 - RNA, 492 nt, Artificial Sequence
  derived and/or modified sequence opt2 from GLYAT__Homo_sapiens__NP_005829
augaugcucccccuccagggcgcccagaugcuccagaugcucgagaagucccuccgcaagucccuccccgccucccucaaggucuacggcaccgucuuccacaucaaccacggcaaccccuucaaccucaaggccgucgucgacaaguggcccgacuucaacaccgucgucgucugcccccaggagcaggacaugaccgacgaccucgaccacuacaccaacaccuaccagaucuacuccaaggacccccagaacugccaggaguuccucggcucccccgagcucaucaacuggaagcagcaccuccagauccaguccucccagcccucccucaacgaggccauccagaaccucgccgccaucaaguccuucaaggucaagcagacccagcgcauccucuacauggccgccgagaccgccaaggagcucacccccuuccuccucaaguccaagauccucucccccaacggcggcaagcccaaggccauguga

SEQ ID NO: 43688 - RNA, 867 nt, Artificial Sequence
  derived and/or modified sequence opt2 from GLYATL3__Homo_sapiens__NP_001010904
augcucguccucaacugcuccaccaagcuccucauccucgagaagaugcucaaguccugcuuccccgagucccucaaggucuacggcgccgucaugaacaucaaccgcggcaaccccuuccagaaggaggucguccucgacuccuggcccgacuucaaggccgucaucacccgccgccagcgcgaggccgagaccgacaaccucgaccacuacaccaacgccuacgccgucuucuacaaggacguccgcgccuaccgccagcuccucgaggagugcgacgucuucaacugggaccaggucuuccagauccagggccuccaguccgagcucuacgacgucuccaaggccgucgccaacuccaagcagcucaacaucaagcucaccuccuucaaggccguccacuucucccccgucuccucccuccccgacaccuccuuccucaagggccccuccccccgccucaccuaccucuccgucgccaacgccgaccuccucaaccgcaccuggucccgcggcggcaacgagcagugccuccgcuacaucgccaaccucaucuccugcuuccccuccgucugcguccgcgacgagaagggcaaccccgucuccugguccaucaccgaccaguucgccaccaugugccacggcuacacccuccccgagcaccgccgcaagggcuacucccgccucgucgcccucacccucgcccgcaagcuccagucccgcggcuuccccucccagggcaacguccucgacgacaacaccgccuccaucucccuccucaagucccuccacgccgaguuccuccccugccgcuuccaccgccucauccucacccccgccaccuucuccggccucccccaccucuga

SEQ ID NO: 43689 - RNA, 705 nt, Artificial Sequence
  derived and/or modified sequence opt2 from GLYCTK__Homo_sapiens__NP_001138423
auggccgccgcccuccagguccucccccgccucgcccgcgccccccuccacccccuccucuggcgcggcuccgucgcccgccucgccuccuccauggcccucgccgagcaggcccgccagcucuucgaguccgccgucggcgccguccuccccggccccaugcuccaccgcgcccucucccucgaccccggcggccgccagcucaagguccgcgaccgcaacuuccagcuccgccagaaccucuaccucgucggcuucggcaaggccguccucggcauggccgccgccgccgaggagcuccucggccagcaccucguccagggcgucaucuccguccccaagggcauccgcgccgccauggagcgcgccggcaagcaggagaugcuccucaagccccacucccgcguccaggucuucgagggcgccgaggacaaccuccccgaccgcgacgcccuccgcgccgcccucgccauccagcagcucgccgagggccucaccgccgacgaccuccuccucguccucaucuccggcggcgagccccaccccguccgcugcggcggcggccccugcggcggcgacugccaguggccccaccgcggccaguucccccagugcgcccgccuccccgccuacccccagucccuccgcccccccugcucccccgccaccuucugcgaggacugcgccgucuccggccgccucuga

SEQ ID NO: 43690 - RNA, 582 nt, Artificial Sequence
  derived and/or modified sequence opt2 from GM2A__Homo_sapiens__NP_000396
augcagucccucaugcaggccccccuccucaucgcccucggccuccuccucgccgcccccgcccaggcccaccucaagaagcccucccagcucuccuccuucuccugggacaacugcgacgagggcaaggaccccgccgucauccgcucccucacccucgagcccgaccccaucaucguccccggcaacgucacccucuccgucaugggcuccaccuccgucccccucuccuccccccucaaggucgaccucguccucgagaaggaggucgccggccucuggaucaagauccccugcaccgacuacaucggcuccugcaccuucgagcacuucugcgacguccucgacaugcucauccccaccggcgagcccugccccgagccccuccgcaccuacggccuccccugccacugccccuucaaggagggcaccuacucccuccccaaguccgaguucgucguccccgaccucgagcuccccuccuggcucaccaccggcaacuaccgcaucgaguccguccucuccuccuccggcaagcgccucggcugcaucaagaucgccgccucccucaagggcaucuga

SEQ ID NO: 43691 - RNA, 1548 nt, Artificial Sequence
  derived and/or modified sequence opt2 from GMCL1__Homo_sapiens__NP_848526
augggcucccucuccucccgcguccuccgccagccccgccccgcccucgcccagcaggcccagggcgcccgcgccggcggcuccgcccgccgccccgacaccggcgacgacgccgccggccacggcuucugcuacugcgccggcucccacaagcgcaagcgcuccuccggcuccuucugcuacugccaccccgacuccgagaccgacgaggacgaggaggagggcgacgagcagcagcgccuccucaacaccccccgccgcaagaagcucaaguccaccuccaaguacaucuaccagacccucuuccucaacggcgagaacuccgacaucaagaucugcgcccucggcgaggaguggucccuccacaagaucuaccucugccaguccggcuacuucuccuccauguucuccggcuccuggaaggaguccuccaugaacaucaucgagcucgagauccccgaccagaacaucgacgucgaggcccuccaggucgccuucggcucccucuaccgcgacgacguccucaucaagcccucccgcgucgucgccauccucgccgccgccugccuccuccagcucgacggccucauccagcagugcggcgagaccaugaaggagaccgucaacgucaagaccgucugcggcuacuacaccuccgccggcaccuacggccucgacuccgucaagaagaagugccucgaguggcuccucaacaaccucaugacccaccagaacgucgagcucuucaaggagcucuccaucaacgucaugaagcagcucaucggcuccuccaaccucuucgucaugcaggucgagauggacaucuacaccgcccucaagaaguggauguuccuccagcucguccccuccuggaacggcucccucaagcagcuccucaccgagaccgacgucugguucuccaagcagcgcaaggacuucgagggcauggccuuccucgagaccgagcagggcaagcccuucgucuccgucuuccgccaccuccgccuccaguacaucaucuccgaccucgccuccgcccgcaucaucgagcaggacgccgucguccccuccgaguggcucuccuccgucuacaagcagcagugguucgccaugcuccgcgccgagcaggacuccgaggucggcccccaggagaucaacaaggaggagcucgagggcaacuccaugcgcugcggccgcaagcucgccaaggacggcgaguacugcuggcgcuggaccggcuucaacuucggcuucgaccuccucgucaccuacaccaaccgcuacaucaucuucaagcgcaacacccucaaccagcccugcuccggcuccgucucccuccagccccgccgcuccaucgccuuccgccuccgccucgccuccuucgacuccuccggcaagcucaucugcucccgcaccaccggcuaccagauccucacccucgagaaggaccaggagcaggucgucaugaaccucgacucccgccuccucaucuucccccucuacaucugcugcaacuuccucuacaucucccccgagaagaagaacuga

SEQ ID NO: 43692 - RNA, 1029 nt, Artificial Sequence
  derived and/or modified sequence opt2 from GMDS__Homo_sapiens__NP_001240775
augugcaagauggacggcuccuaccucgccgaguuccuccucgagaagggcuacgagguccacggcaucguccgccgcuccuccuccuucaacaccggccgcaucgagcaccucuacaagaacccccaggcccacaucgagggcaacaugaagcuccacuacggcgaccucaccgacuccaccugccucgucaagaucaucaacgaggucaagcccaccgagaucuacaaccucggcgcccagucccacgucaagaucuccuucgaccucgccgaguacaccgccgacgucgacggcgucggcacccuccgccuccucgacgccgucaagaccugcggccucaucaacuccgucaaguucuaccaggccuccaccuccgagcucuacggcaagguccaggagaucccccagaaggagaccacccccuucuacccccgcucccccuacggcgccgccaagcucuacgccuacuggaucgucgucaacuuccgcgaggccuacaaccucuucgccgucaacggcauccucuucaaccacgaguccccccgccgcggcgccaacuucgucacccgcaagaucucccgcuccgucgccaagaucuaccucggccagcucgagugcuucucccucggcaaccucgacgccaagcgcgacuggggccacgccaaggacuacgucgaggccauguggcucaugcuccagaacgacgagcccgaggacuucgucaucgccaccggcgagguccacuccguccgcgaguucgucgagaaguccuuccuccacaucggcaagaccaucgucugggagggcaagaacgagaacgaggucggccgcugcaaggagaccggcaagguccacgucaccgucgaccucaaguacuaccgccccaccgaggucgacuuccuccagggcgacugcaccaaggccaagcagaagcucaacuggaagccccgcgucgccuucgacgagcucguccgcgagaugguccacgccgacgucgagcucaugcgcaccaaccccaacgccuga

SEQ ID NO: 43693 - RNA, 429 nt, Artificial Sequence
  derived and/or modified sequence opt2 from GMFB__Homo_sapiens__NP_004115
auguccgagucccucgucgucugcgacgucgccgaggaccucgucgagaagcuccgcaaguuccgcuuccgcaaggagaccaacaacgccgccaucaucaugaagaucgacaaggacaagcgccucgucguccucgacgaggagcucgagggcaucucccccgacgagcucaaggacgagcuccccgagcgccagccccgcuucaucgucuacuccuacaaguaccagcacgacgacggccgcgucuccuacccccucugcuucaucuucuccucccccgucggcugcaagcccgagcagcagaugauguacgccggcuccaagaacaagcucguccagaccgccgagcucaccaaggucuucgagauccgcaacaccgaggaccucaccgaggaguggcuccgcgagaagcucggcuucuuccacuga

SEQ ID NO: 43694 - RNA, 429 nt, Artificial Sequence
  derived and/or modified sequence opt2 from GMFG__Homo_sapiens__NP_004868
auguccgacucccucgucgucugcgaggucgaccccgagcucaccgagaagcuccgcaaguuccgcuuccgcaaggagaccgacaacgccgccaucaucaugaaggucgacaaggaccgccagauggucguccucgaggaggaguuccagaacaucucccccgaggagcucaagauggagcuccccgagcgccagccccgcuucgucgucuacuccuacaaguacguccacgacgacggccgcgucuccuacccccucugcuucaucuucuccucccccgucggcugcaagcccgagcagcagaugauguacgccggcuccaagaaccgccucguccagaccgccgagcucaccaaggucuucgagauccgcaccaccgacgaccucaccgaggccuggcuccaggagaagcucuccuucuuccgcuga

SEQ ID NO: 43695 - RNA, 2826 nt, Artificial Sequence
  derived and/or modified sequence opt2 from GMIP__Homo_sapiens__NP_001275927
auggacgccgccgagcccggccucccccccggccccgagggccgcaagcgcuacuccgacaucuuccgcucccucgacaaccucgagaucucccucggcaacgucacccucgagaugcucgccggcgacccccuccucuccgaggaccccgagcccgacaagacccccaccgccaccgucaccaacgaggccuccugcugguccggccccucccccgagggccccgucccccucaccggcgaggagcucgaccuccgccucauccgcaccaagggcggcgucgacgccgcccucgaguacgccaagaccuggucccgcuacgccaaggagcuccucgccuggaccgagaagcgcgccuccuacgagcucgaguucgccaaguccaccaugaagaucgccgaggccggcaaggucuccauccagcagcagucccacaugccccuccaguacaucuacacccucuuccucgagcacgaccucucccucggcacccucgccauggagaccgucgcccagcagaagcgcgacuacuaccagccccucgccgccaagcgcaccgagaucgagaaguggcgcaaggaguucaaggagcaguggaugaaggagcagaagcgcaugaacgaggccguccaggcccuccgccgcgcccagcuccaguacguccagcgcuccgaggaccuccgcgcccgcucccagggcucccccgaggacuccgccccccaggccucccccggccccuccaagcagcaggagcgccgccgccgcucccgcgaggaggcccaggccaaggcccaggaggccgaggcccucuaccaggccugcguccgcgaggccaacgcccgccagcaggaccucgagaucgccaagcagcgcaucgucucccacguccgcaagcucgucuuccagggcgacgagguccuccgccgcgucacccucucccucuucggccuccgcggcgcccaggccgagcgcggcccccgcgccuucgccgcccucgccgagugcugcgcccccuucgagcccggccagcgcuaccaggaguucguccgcgcccuccgccccgaggccccccccccccccccccccgccuucuccuuccaggaguuccuccccucccucaacuccuccccccucgacauccgcaagaagcucuccggcccccuccccccccgccucgacgagaacuccgccgagcccggccccugggaggaccccggcaccggcuggcgcuggcagggccccacccccggcuccgacgucgacuccgucggcggcggcuccgagucccgcucccucgacucccccaccuccucccccgaccucggcgacggccucgagaacggccucggcucccccuucggcaaguggacccucuccuccgccgcccagacccaccagcuccgccgccuccgcggccccgccaagugccgcgagugcgaggccuucauggucuccggcaccgagugcgaggagugcuuccucaccugccacaagcgcugccucgagacccuccucauccucugcggccaccgccgccuccccgcccgcaccccccucuucggcgucgacuuccuccagcucccccgcgacuuccccgaggagguccccuucgucgucaccaagugcaccgccgagaucgagcaccgcgcccucgacguccagggcaucuaccgcgucuccggcucccgcguccgcgucgagcgccucugccaggccuucgagaacggccgcgcccucgucgagcucuccggcaacuccccccacgacgucuccuccguccucaagcgcuuccuccaggagcucaccgagcccgucauccccuuccaccucuacgacgccuucaucucccucgccaagacccuccacgccgaccccggcgacgaccccggcacccccucccccucccccgaggucauccgcucccucaagacccuccucguccagcuccccgacuccaacuacaacacccuccgccaccucgucgcccaccucuuccgcgucgccgcccgcuucauggagaacaagauguccgccaacaaccucggcaucgucuucggccccacccuccuccgcccccccgacggcccccgcgccgccuccgccauccccgucaccugccuccucgacuccggccaccaggcccagcucgucgaguuccucaucguccacuacgagcagaucuucggcauggacgagcucccccaggccaccgagccccccccccaggacuccucccccgcccccggcccccucaccaccuccucccagcccccccccccccaccucgaccccgacucccagccccccguccucgccuccgaccccggccccgacccccagcaccacuccacccucgagcagcaccccaccgccacccccaccgagauccccaccccccaguccgaccagcgcgaggacgucgccgaggacaccaaggacggcggcggcgaggucuccucccagggccccgaggacucccuccucggcacccagucccgcggccacuucucccgccagcccgucaaguacccccgcggcggcguccgccccgucacccaccagcucuccucccucgcccucgucgccuccaagcucugcgaggagacccccaucaccuccgucccccgcggcucccuccgcggccgcggccccucccccgccgccgccucccccgagggcuccccccuccgccgcaccccccuccccaagcacuucgagaucacccaggagaccgcccgccuccucuccaagcucgacuccgaggccgucccccgcgccaccugcugccccgacguccagcccgaggaggccgaggaccaccucuga

SEQ ID NO: 43696 - RNA, 510 nt, Artificial Sequence
  derived and/or modified sequence opt2 from GML__Homo_sapiens__XP_011515271
auggagcccggcucccgccuccuccgcgaggucaugcuccucuucgcccuccuccucgccauggagcucccccucgucgccgccuccgccaccaugcgcgcccaguggaccuacucccuccgcugccacgacugcgccgucaucaacgacuucaacugccccaacauccgcgucugccccuaccacauccgccgcugcaugaccaucuccauccgcaucaacucccgcgagcuccucgucuacaagaacugcaccaacaacugcaccuucgucuacgccgccgagcagccccccgaggcccccggcaagaucuucaagaccaacuccuucuacugggucugcugcugcaacuccauggucugcaacgccggcggccccaccaaccucgagcgcgacaugcuccccgacgaggucaccgaggaggagcuccccgagggcaccguccgccucggcgucuccaagcuccuccucuccuucgccuccaucaucgucuccaacauccuccccuga

SEQ ID NO: 43697 - RNA, 630 nt, Artificial Sequence
  derived and/or modified sequence opt2 from GMNN__Homo_sapiens__XP_005249216
augaaccccuccaugaagcagaagcaggaggagaucaaggagaacaucaagaacuccuccgucccccgccgcacccucaagaugauccagcccuccgccuccggcucccucgucggccgcgagaacgagcucuccgccggccucuccaagcgcaagcaccgcaacgaccaccucaccuccaccaccuccucccccggcgucaucguccccgaguccuccgagaacaagaaccucggcggcgucacccaggaguccuucgaccucaugaucaaggagaaccccuccucccaguacuggaaggaggucgccgagaagcgccgcaaggcccucuacgaggcccucaaggagaacgagaagcuccacaaggagaucgagcagaaggacaacgagaucgcccgccucaagaaggagaacaaggagcucgccgaggucgccgagcacguccaguacauggccgagcucaucgagcgccucaacggcgagccccucgacaacuucgagucccucgacaaccaggaguucgacuccgaggaggagaccgucgaggacucccucgucgaggacuccgagaucggcaccugcgccgagggcaccgucuccuccuccaccgacgccaagcccugcaucuga

SEQ ID NO: 43698 - RNA, 1263 nt, Artificial Sequence
  derived and/or modified sequence opt2 from GMPPA__Homo_sapiens__NP_995319
augcucaaggccgucauccucaucggcggcccccagaagggcacccgcuuccgcccccucuccuucgagguccccaagccccucuuccccgucgccggcguccccaugauccagcaccacaucgaggccugcgcccagguccccggcaugcaggagauccuccucaucggcuucuaccagcccgacgagccccucacccaguuccucgaggccgcccagcaggaguucaaccuccccguccgcuaccuccaggaguucgccccccucggcaccggcggcggccucuaccacuuccgcgaccagauccucgccggcucccccgaggccuucuucguccucaacgccgacgucugcuccgacuucccccucuccgccaugcucgaggcccaccgccgccagcgccaccccuuccuccuccucggcaccaccgccaaccgcacccagucccucaacuacggcugcaucgucgagaacccccagacccacgagguccuccacuacgucgagaagcccuccaccuucaucuccgacaucaucaacugcggcaucuaccucuucucccccgaggcccucaagccccuccgcgacgucuuccagcgcaaccagcaggacggccagcucgaggacucccccggccucuggcccggcgccggcaccauccgccucgagcaggacgucuucuccgcccucgccggccagggccagaucuacguccaccucaccgacggcaucuggucccagaucaaguccgccggcuccgcccucuacgccucccgccucuaccucucccgcuaccaggacacccaccccgagcgccucgccaagcacacccccggcggccccuggauccgcggcaacgucuacauccaccccaccgccaaggucgcccccuccgccguccucggccccaacgucuccaucggcaagggcgucaccgucggcgagggcguccgccuccgcgaguccaucguccuccacggcgccacccuccaggagcacaccugcguccuccacuccaucgucggcuggggcuccaccgucggccgcugggcccgcgucgagggcacccccuccgaccccaaccccaacgacccccgcgcccgcauggacuccgagucccucuucaaggacggcaagcuccuccccgccaucaccauccucggcugccgcguccgcauccccgccgagguccucauccucaacuccaucguccucccccacaaggagcucucccgcuccuucaccaaccagaucauccucuga

SEQ ID NO: 43699 - RNA, 1164 nt, Artificial Sequence
  derived and/or modified sequence opt2 from GMPPB__Homo_sapiens__NP_037466
augaaggcccucauccucgucggcggcuacggcacccgccuccgcccccucacccucuccacccccaagccccucgucgacuucugcaacaagcccauccuccuccaccaggucgaggcccucgccgccgccggcgucgaccacgucauccucgccgucuccuacaugucccagguccucgagaaggagaugaaggcccaggagcagcgccucggcauccgcaucuccaugucccacgaggaggagccccucggcaccgccggcccccucgcccucgcccgcgaccuccucuccgagaccgccgaccccuucuucguccucaacuccgacgucaucugcgacuuccccuuccaggccaugguccaguuccaccgccaccacggccaggagggcuccauccucgucaccaaggucgaggagcccuccaaguacggcgucgucgucugcgaggccgacaccggccgcauccaccgcuucgucgagaagccccaggucuucgucuccaacaagaucaacgccggcauguacauccucucccccgccguccuccgccgcauccagcuccagcccaccuccaucgagaaggaggucuuccccaucauggccaaggagggccagcucuacgccauggagcuccagggcuucuggauggacaucggccagcccaaggacuuccucaccggcaugugccucuuccuccagucccuccgccagaagcagcccgagcgccucugcuccggccccggcaucgucggcaacguccucgucgaccccuccgcccgcaucggccagaacugcuccaucggccccaacgucucccucggccccggcgucgucgucgaggacggcgucugcauccgccgcugcaccguccuccgcgacgcccgcauccgcucccacuccuggcucgaguccugcaucgucggcuggcgcugccgcgucggccagugggucucccucugggccggccucggcggcgagcgcggcggcgagugcgccugccuccccgacaaggccuacccccuccucgagguccgcauggagaacgucaccguccucggcgaggacgucaucgucaacgacgagcucuaccucaacggcgccuccguccucccccacaaguccaucggcgaguccguccccgagccccgcaucaucauguga

SEQ ID NO: 43700 - RNA, 1047 nt, Artificial Sequence
  derived and/or modified sequence opt2 from GMPR2__Homo_sapiens__NP_001002000
augccccacaucgacaacgacgucaagcucgacuucaaggacguccuccuccgccccaagcgcuccacccucaagucccgcuccgaggucgaccucacccgcuccuucuccuuccgcaacuccaagcagaccuacuccggcguccccaucaucgccgccaacauggacaccgucggcaccuucgagauggccaagguccucugcaaguucucccucuucaccgccguccacaagcacuacucccucguccaguggcaggaguucgccggccagaaccccgacugccucgagcaccucgccgccuccuccggcaccggcuccuccgacuucgagcagcucgagcagauccucgaggccaucccccaggucaaguacaucugccucgacgucgccaacggcuacuccgagcacuucgucgaguucgucaaggacguccgcaagcgcuucccccagcacaccaucauggccggcaacgucgucaccggcgagauggucgaggagcucauccucuccggcgccgacaucaucaaggucggcaucggccccggcuccgucugcaccacccgcaagaagaccggcgucggcuacccccagcucuccgccgucauggagugcgccgacgccgcccacggccucaagggccacaucaucuccgacggcggcugcuccugccccggcgacgucgccaaggccuucggcgccggcgccgacuucgucaugcucggcggcaugcucgccggccacuccgaguccggcggcgagcucaucgagcgcgacggcaagaaguacaagcucuucuacggcauguccuccgagauggccaugaagaaguacgccggcggcgucgccgaguaccgcgccuccgagggcaagaccgucgagguccccuucaagggcgacgucgagcacaccauccgcgacauccucggcggcauccgcuccaccugcaccuacgucggcgccgccaagcucaaggagcucucccgccgcaccaccuucauccgcgucacccagcaggucaaccccaucuucuccgaggccugcuga

SEQ ID NO: 43701 - RNA, 1038 nt, Artificial Sequence
  derived and/or modified sequence opt2 from GMPR__Homo_sapiens__NP_006868
augccccgcaucgacgccgaccucaagcucgacuucaaggacguccuccuccgccccaagcgcuccucccucaagucccgcgccgaggucgaccucgagcgcaccuucaccuuccgcaacuccaagcagaccuacuccggcauccccaucaucgucgccaacauggacaccgucggcaccuucgagauggccgccgucaugucccagcacuccauguucaccgccauccacaagcacuacucccucgacgacuggaagcucuucgccaccaaccaccccgagugccuccagaacgucgccgucuccuccggcuccggccagaacgaccucgagaagaugaccuccauccucgaggccgucccccaggucaaguucaucugccucgacgucgccaacggcuacuccgagcacuucgucgaguucgucaagcucguccgcgccaaguuccccgagcacaccaucauggccggcaacgucgucaccggcgagauggucgaggagcucauccucuccggcgccgacaucaucaaggucggcgucggccccggcuccgucugcaccacccgcaccaagaccggcgucggcuacccccagcucuccgccgucaucgagugcgccgacuccgcccacggccucaagggccacaucaucuccgacggcggcugcaccugccccggcgacgucgccaaggccuucggcgccggcgccgacuucgucaugcucggcggcauguucuccggccacaccgagugcgccggcgaggucuucgagcgcaacggccgcaagcucaagcucuucuacggcauguccuccgacaccgccaugaacaagcacgccggcggcgucgccgaguaccgcgccuccgagggcaagaccgucgagguccccuacaagggcgacgucgagaacaccauccucgacauccucggcggccuccgcuccaccugcaccuacgucggcgccgccaagcucaaggagcucucccgccgcgccaccuucauccgcgucacccagcagcacaacaccgucuucuccuga

SEQ ID NO: 43702 - RNA, 2082 nt, Artificial Sequence
  derived and/or modified sequence opt2 from GMPS__Homo_sapiens__NP_003866
auggcccucugcaacggcgacuccaagcucgagaacgccggcggcgaccucaaggacggccaccaccacuacgagggcgccgucgucauccucgacgccggcgcccaguacggcaaggucaucgaccgccgcguccgcgagcucuucguccaguccgagaucuucccccucgagacccccgccuucgccaucaaggagcagggcuuccgcgccaucaucaucuccggcggccccaacuccgucuacgccgaggacgcccccugguucgaccccgccaucuucaccaucggcaagcccguccucggcaucugcuacggcaugcagaugaugaacaaggucuucggcggcaccguccacaagaaguccguccgcgaggacggcgucuucaacaucuccgucgacaacaccugcucccucuuccgcggccuccagaaggaggaggucguccuccucacccacggcgacuccgucgacaaggucgccgacggcuucaaggucgucgcccgcuccggcaacaucgucgccggcaucgccaacgaguccaagaagcucuacggcgcccaguuccaccccgaggucggccucaccgagaacggcaaggucauccucaagaacuuccucuacgacaucgccggcugcuccggcaccuucaccguccagaaccgcgagcucgagugcauccgcgagaucaaggagcgcgucggcaccuccaagguccucguccuccucuccggcggcgucgacuccaccgucugcaccgcccuccucaaccgcgcccucaaccaggagcaggucaucgccguccacaucgacaacggcuucaugcgcaagcgcgagucccaguccgucgaggaggcccucaagaagcucggcauccaggucaaggucaucaacgccgcccacuccuucuacaacggcaccaccacccuccccaucuccgacgaggaccgcaccccccgcaagcgcaucuccaagacccucaacaugaccaccucccccgaggagaagcgcaagaucaucggcgacaccuucgucaagaucgccaacgaggucaucggcgagaugaaccucaagcccgaggaggucuuccucgcccagggcacccuccgccccgaccucaucgaguccgccucccucgucgccuccggcaaggccgagcucaucaagacccaccacaacgacaccgagcucauccgcaagcuccgcgaggagggcaaggucaucgagccccucaaggacuuccacaaggacgagguccgcauccucggccgcgagcucggccuccccgaggagcucgucucccgccaccccuuccccggccccggccucgccauccgcgucaucugcgccgaggagcccuacaucugcaaggacuuccccgagaccaacaacauccucaagaucgucgccgacuucuccgccuccgucaagaagccccacacccuccuccagcgcgucaaggccugcaccaccgaggaggaccaggagaagcucaugcagaucaccucccuccacucccucaacgccuuccuccuccccaucaagaccgucggcguccagggcgacugccgcuccuacuccuacgucugcggcaucuccuccaaggacgagcccgacugggagucccucaucuuccucgcccgccucaucccccgcaugugccacaacgucaaccgcgucgucuacaucuucggcccccccgucaaggagccccccaccgacgucacccccaccuuccucaccaccggcguccucuccacccuccgccaggccgacuucgaggcccacaacauccuccgcgaguccggcuacgccggcaagaucucccagaugcccgucauccucaccccccuccacuucgaccgcgacccccuccagaagcagcccuccugccagcgcuccgucgucauccgcaccuucaucaccuccgacuucaugaccggcauccccgccacccccggcaacgagauccccgucgaggucguccucaagauggucaccgagaucaagaagauccccggcaucucccgcaucauguacgaccucaccuccaagccccccggcaccaccgagugggaguga

SEQ ID NO: 43703 - RNA, 1080 nt, Artificial Sequence
  derived and/or modified sequence opt2 from GNA11__Homo_sapiens__NP_002058
augacccucgaguccaugauggccugcugccucuccgacgaggucaaggaguccaagcgcaucaacgccgagaucgagaagcagcuccgccgcgacaagcgcgacgcccgccgcgagcucaagcuccuccuccucggcaccggcgaguccggcaaguccaccuucaucaagcagaugcgcaucauccacggcgccggcuacuccgaggaggacaagcgcggcuucaccaagcucgucuaccagaacaucuucaccgccaugcaggccaugauccgcgccauggagacccucaagauccucuacaaguacgagcagaacaaggccaacgcccuccucauccgcgaggucgacgucgagaaggucaccaccuucgagcaccaguacgucuccgccaucaagacccucugggaggaccccggcauccaggagugcuacgaccgccgccgcgaguaccagcucuccgacuccgccaaguacuaccucaccgacgucgaccgcaucgccacccucggcuaccuccccacccagcaggacguccuccgcguccgcguccccaccaccggcaucaucgaguaccccuucgaccucgagaacaucaucuuccgcauggucgacgucggcggccagcgcuccgagcgccgcaaguggauccacugcuucgagaacgucaccuccaucauguuccucgucgcccucuccgaguacgaccagguccucgucgaguccgacaacgagaaccgcauggaggaguccaaggcccucuuccgcaccaucaucaccuaccccugguuccagaacuccuccgucauccucuuccucaacaagaaggaccuccucgaggacaagauccucuacucccaccucgucgacuacuuccccgaguucgacggcccccagcgcgacgcccaggccgcccgcgaguucauccucaagauguucgucgaccucaaccccgacuccgacaagaucaucuacucccacuucaccugcgccaccgacaccgagaacauccgcuucgucuucgccgccgucaaggacaccauccuccagcucaaccucaaggaguacaaccucgucuga

SEQ ID NO: 43704 - RNA, 918 nt, Artificial Sequence
  derived and/or modified sequence opt2 from GNA12__Homo_sapiens__NP_001269369
auggccccccgcgccggccucggcgccggcccccuccuccuccgcucccgcgccgacugggucugcggcggcugggaggccgcccucuccgcccccccccccuucugcaccgccugggucgagcgcaccggccucguccacuuccuccgcgagggcggccacggcgccugcuucccccucgcccuccuccaccccggcuccgucgucuccuuccagaugaucuacccccucaucguccucccccucugcgccuccuggcacuggggccucauccgcaagggcaucguccucuucuggggcgaguccgucaaguacuuccucgacaaccucgaccgcaucggccagcucaacuacuuccccuccaagcaggacauccuccucgcccgcaaggccaccaagggcaucgucgagcacgacuucgucaucaagaagauccccuucaagauggucgacgucggcggccagcgcucccagcgccagaagugguuccagugcuucgacggcaucaccuccauccucuucauggucuccuccuccgaguacgaccagguccucauggaggaccgccgcaccaaccgccucgucgaguccaugaacaucuucgagaccaucgucaacaacaagcucuucuucaacgucuccaucauccucuuccucaacaagauggaccuccucgucgagaaggucaagaccgucuccaucaagaagcacuuccccgacuuccgcggcgacccccaccgccucgaggacguccagcgcuaccucguccagugcuucgaccgcaagcgccgcaaccgcuccaagccccucuuccaccacuucaccaccgccaucgacaccgagaacguccgcuucgucuuccacgccgucaaggacaccauccuccaggagaaccucaaggacaucaugcuccaguga

SEQ ID NO: 43705 - RNA, 849 nt, Artificial Sequence
  derived and/or modified sequence opt2 from GNA13__Homo_sapiens__NP_001269354
augcgcguccucgucgacgcccgcgagaagcuccacauccccuggggcgacaacuccaaccagcagcacggcgacaagaugauguccuucgacacccgcgcccccauggccgcccagggcauggucgagacccgcgucuuccuccaguaccuccccgccauccgcgcccucugggccgacuccggcauccagaacgccuacgaccgccgccgcgaguuccagcucggcgaguccgucaaguacuuccucgacaaccucgacaagcucggcgagcccgacuacauccccucccagcaggacauccuccucgcccgccgccccaccaagggcauccacgaguacgacuucgagaucaagaacguccccuucaagauggucgacgucggcggccagcgcuccgagcgcaagcgcugguucgagugcuucgacuccgucaccuccauccucuuccucgucuccuccuccgaguucgaccagguccucauggaggaccgccucaccaaccgccucaccgagucccucaacaucuucgagaccaucgucaacaaccgcgucuucuccaacgucuccaucauccucuuccucaacaagaccgaccuccucgaggagaagguccagaucgucuccaucaaggacuacuuccucgaguucgagggcgacccccacugccuccgcgacguccagaaguuccucgucgagugcuuccgcaacaagcgccgcgaccagcagcagaagccccucuaccaccacuucaccaccgccaucaacaccgagaacauccgccucgucuuccgcgacgucaaggacaccauccuccacgacaaccucaagcagcucaugcuccaguga

SEQ ID NO: 43706 - RNA, 1068 nt, Artificial Sequence
  derived and/or modified sequence opt2 from GNA14__Homo_sapiens__NP_004288
auggccggcugcugcugccucuccgccgaggagaaggagucccagcgcaucuccgccgagaucgagcgccagcuccgccgcgacaagaaggacgcccgccgcgagcucaagcuccuccuccucggcaccggcgaguccggcaaguccaccuucaucaagcagaugcgcaucauccacggcuccggcuacuccgacgaggaccgcaagggcuucaccaagcucgucuaccagaacaucuucaccgccaugcaggccaugauccgcgccauggacacccuccgcauccaguacgucugcgagcagaacaaggagaacgcccagaucauccgcgaggucgaggucgacaaggucuccaugcucucccgcgagcaggucgaggccaucaagcagcucuggcaggaccccggcauccaggagugcuacgaccgccgccgcgaguaccagcucuccgacuccgccaaguacuaccucaccgacaucgaccgcaucgccacccccuccuucguccccacccagcaggacguccuccgcguccgcguccccaccaccggcaucaucgaguaccccuucgaccucgagaacaucaucuuccgcauggucgacgucggcggccagcgcuccgagcgccgcaaguggauccacugcuucgaguccgucaccuccaucaucuuccucgucgcccucuccgaguacgaccagguccucgccgagugcgacaacgagaaccgcauggaggaguccaaggcccucuucaagaccaucaucaccuaccccugguuccucaacuccuccgucauccucuuccucaacaagaaggaccuccucgaggagaagaucauguacucccaccucaucuccuacuuccccgaguacaccggccccaagcaggacguccgcgccgcccgcgacuucauccucaagcucuaccaggaccagaaccccgacaaggagaaggucaucuacucccacuucaccugcgccaccgacaccgacaacauccgcuucgucuucgccgccgucaaggacaccauccuccagcucaaccuccgcgaguucaaccucgucuga

SEQ ID NO: 43707 - RNA, 1125 nt, Artificial Sequence
  derived and/or modified sequence opt2 from GNA15__Homo_sapiens__NP_002059
auggcccgcucccucaccuggcgcugcugccccuggugccucaccgaggacgagaaggccgccgcccgcgucgaccaggagaucaaccgcauccuccucgagcagaagaagcaggaccgcggcgagcucaagcuccuccuccucggccccggcgaguccggcaaguccaccuucaucaagcagaugcgcaucauccacggcgccggcuacuccgaggaggagcgcaagggcuuccgcccccucgucuaccagaacaucuucgucuccaugcgcgccaugaucgaggccauggagcgccuccagauccccuucucccgccccgaguccaagcaccacgccucccucgucaugucccaggaccccuacaaggucaccaccuucgagaagcgcuacgccgccgccaugcaguggcucuggcgcgacgccggcauccgcgccugcuacgagcgccgccgcgaguuccaccuccucgacuccgccgucuacuaccucucccaccucgagcgcaucaccgaggagggcuacguccccaccgcccaggacguccuccgcucccgcaugcccaccaccggcaucaacgaguacugcuucuccguccagaagaccaaccuccgcaucgucgacgucggcggccagaaguccgagcgcaagaaguggauccacugcuucgagaacgucaucgcccucaucuaccucgccucccucuccgaguacgaccagugccucgaggagaacaaccaggagaaccgcaugaaggagucccucgcccucuucggcaccauccucgagcuccccugguucaaguccaccuccgucauccucuuccucaacaagaccgacauccucgaggagaagauccccaccucccaccucgccaccuacuuccccuccuuccagggccccaagcaggacgccgaggccgccaagcgcuucauccucgacauguacacccgcauguacaccggcugcgucgacggccccgagggcuccaagaagggcgcccgcucccgccgccucuucucccacuacaccugcgccaccgacacccagaacauccgcaaggucuucaaggacguccgcgacuccguccucgcccgcuaccucgacgagaucaaccuccucuga

SEQ ID NO: 43708 - RNA, 909 nt, Artificial Sequence
  derived and/or modified sequence opt2 from GNAI1__Homo_sapiens__NP_001243343
augaagaucauccacgaggccggcuacuccgaggaggagugcaagcaguacaaggccgucgucuacuccaacaccauccaguccaucaucgccaucauccgcgccaugggccgccucaagaucgacuucggcgacuccgcccgcgccgacgacgcccgccagcucuucguccucgccggcgccgccgaggagggcuucaugaccgccgagcucgccggcgucaucaagcgccucuggaaggacuccggcguccaggccugcuucaaccgcucccgcgaguaccagcucaacgacuccgccgccuacuaccucaacgaccucgaccgcaucgcccagcccaacuacauccccacccagcaggacguccuccgcacccgcgucaagaccaccggcaucgucgagacccacuucaccuucaaggaccuccacuucaagauguucgacgucggcggccagcgcuccgagcgcaagaaguggauccacugcuucgagggcgucaccgccaucaucuucugcgucgcccucuccgacuacgaccucguccucgccgaggacgaggagaugaaccgcaugcacgaguccaugaagcucuucgacuccaucugcaacaacaagugguucaccgacaccuccaucauccucuuccucaacaagaaggaccucuucgaggagaagaucaagaaguccccccucaccaucugcuaccccgaguacgccggcuccaacaccuacgaggaggccgccgccuacauccagugccaguucgaggaccucaacaagcgcaaggacaccaaggagaucuacacccacuucaccugcgccaccgacaccaagaacguccaguucgucuucgacgccgucaccgacgucaucaucaagaacaaccucaaggacugcggccucuucuga

SEQ ID NO: 43709 - RNA, 957 nt, Artificial Sequence
  derived and/or modified sequence opt2 from GNAI2__Homo_sapiens__NP_001159897
augcgcggcgccggcgaguccggcaaguccaccaucgucaagcagaugaagaucauccacgaggacggcuacuccgaggaggagugccgccaguaccgcgccgucgucuacuccaacaccauccaguccaucauggccaucgucaaggccaugggcaaccuccagaucgacuucgccgaccccucccgcgccgacgacgcccgccagcucuucgcccucuccugcaccgccgaggagcagggcguccuccccgacgaccucuccggcgucauccgccgccucugggccgaccacggcguccaggccugcuucggccgcucccgcgaguaccagcucaacgacuccgccgccuacuaccucaacgaccucgagcgcaucgcccaguccgacuacauccccacccagcaggacguccuccgcacccgcgucaagaccaccggcaucgucgagacccacuucaccuucaaggaccuccacuucaagauguucgacgucggcggccagcgcuccgagcgcaagaaguggauccacugcuucgagggcgucaccgccaucaucuucugcgucgcccucuccgccuacgaccucguccucgccgaggacgaggagaugaaccgcaugcacgaguccaugaagcucuucgacuccaucugcaacaacaagugguucaccgacaccuccaucauccucuuccucaacaagaaggaccucuucgaggagaagaucacccacuccccccucaccaucugcuuccccgaguacaccggcgccaacaaguacgacgaggccgccuccuacauccaguccaaguucgaggaccucaacaagcgcaaggacaccaaggagaucuacacccacuucaccugcgccaccgacaccaagaacguccaguucgucuucgacgccgucaccgacgucaucaucaagaacaaccucaaggacugcggccucuucuga

SEQ ID NO: 43710 - RNA, 525 nt, Artificial Sequence
  derived and/or modified sequence opt2 from GNAL__Homo_sapiens__NP_001248373
auguucgacgucggcggccagcgcgacgagcgccgcaaguggauccagugcuucaacgacgucaccgccaucaucuacgucgccgccugcuccuccuacaacauggucauccgcgaggacaacaacaccaaccgccuccgcgagucccucgaccucuucgaguccaucuggaacaaccgcuggcuccgcaccaucuccaucauccucuuccucaacaagcaggacaugcucgccgagaagguccucgccggcaaguccaagaucgaggacuacuuccccgaguacgccaacuacaccguccccgaggacgccacccccgacgccggcgaggaccccaaggucacccgcgccaaguucuucauccgcgaccucuuccuccgcaucuccaccgccaccggcgacggcaagcacuacugcuacccccacuucaccugcgccgucgacaccgagaacauccgccgcgucuucaacgacugccgcgacaucauccagcgcaugcaccucaagcaguacgagcuccucuga

SEQ ID NO: 43711 - RNA, 1065 nt, Artificial Sequence
  derived and/or modified sequence opt2 from GNAO1__Homo_sapiens__NP_066268
augggcugcacccucuccgccgaggagcgcgccgcccucgagcgcuccaaggccaucgagaagaaccucaaggaggacggcaucuccgccgccaaggacgucaagcuccuccuccucggcgccggcgaguccggcaaguccaccaucgucaagcagaugaagaucauccacgaggacggcuucuccggcgaggacgucaagcaguacaagcccgucgucuacuccaacaccauccagucccucgccgccaucguccgcgccauggacacccucggcaucgaguacggcgacaaggagcgcaaggccgacgccaagauggucugcgacgucgucucccgcauggaggacaccgagcccuucuccgccgagcuccucuccgccaugaugcgccucuggggcgacuccggcauccaggagugcuucaaccgcucccgcgaguaccagcucaacgacuccgccaaguacuaccucgacucccucgaccgcaucggcgccgccgacuaccagcccaccgagcaggacauccuccgcacccgcgucaagaccaccggcaucgucgagacccacuucaccuucaagaaccuccacuuccgccucuucgacgucggcggccagcgcuccgagcgcaagaaguggauccacugcuucgaggacgucaccgccaucaucuucugcgucgcccucuccggcuacgaccagguccuccacgaggacgagaccaccaaccgcaugcacgagucccucaugcucuucgacuccaucugcaacaacaaguucuucaucgacaccuccaucauccucuuccucaacaagaaggaccucuucggcgagaagaucaagaaguccccccucaccaucugcuuccccgaguacaccggccccaacaccuacgaggacgccgccgccuacauccaggcccaguucgaguccaagaaccgcucccccaacaaggagaucuacugccacaugaccugcgccaccgacaccaacaacauccaggucgucuucgacgccgucaccgacaucaucaucgccaacaaccuccgcggcugcggccucuacuga

SEQ ID NO: 43712 - RNA, 1080 nt, Artificial Sequence
  derived and/or modified sequence opt2 from GNAQ__Homo_sapiens__NP_002063
augacccucgaguccaucauggccugcugccucuccgaggaggccaaggaggcccgccgcaucaacgacgagaucgagcgccagcuccgccgcgacaagcgcgacgcccgccgcgagcucaagcuccuccuccucggcaccggcgaguccggcaaguccaccuucaucaagcagaugcgcaucauccacggcuccggcuacuccgacgaggacaagcgcggcuucaccaagcucgucuaccagaacaucuucaccgccaugcaggccaugauccgcgccauggacacccucaagauccccuacaaguacgagcacaacaaggcccacgcccagcucguccgcgaggucgacgucgagaaggucuccgccuucgagaaccccuacgucgacgccaucaagucccucuggaacgaccccggcauccaggagugcuacgaccgccgccgcgaguaccagcucuccgacuccaccaaguacuaccucaacgaccucgaccgcgucgccgaccccgccuaccuccccacccagcaggacguccuccgcguccgcguccccaccaccggcaucaucgaguaccccuucgaccuccaguccgucaucuuccgcauggucgacgucggcggccagcgcuccgagcgccgcaaguggauccacugcuucgagaacgucaccuccaucauguuccucgucgcccucuccgaguacgaccagguccucgucgaguccgacaacgagaaccgcauggaggaguccaaggcccucuuccgcaccaucaucaccuaccccugguuccagaacuccuccgucauccucuuccucaacaagaaggaccuccucgaggagaagaucauguacucccaccucgucgacuacuuccccgaguacgacggcccccagcgcgacgcccaggccgcccgcgaguucauccucaagauguucgucgaccucaaccccgacuccgacaagaucaucuacucccacuucaccugcgccaccgacaccgagaacauccgcuucgucuucgccgccgucaaggacaccauccuccagcucaaccucaaggaguacaaccucgucuga

SEQ ID NO: 43713 - RNA, 1185 nt, Artificial Sequence
  derived and/or modified sequence opt2 from GNAS__Homo_sapiens__NP_000507
augggcugccucggcaacuccaagaccgaggaccagcgcaacgaggagaaggcccagcgcgaggccaacaagaagaucgagaagcagcuccagaaggacaagcaggucuaccgcgccacccaccgccuccuccuccucggcgccggcgaguccggcaaguccaccaucgucaagcagaugcgcauccuccacgucaacggcuucaacggcgagggcggcgaggaggacccccaggccgcccgcuccaacuccgacggcgagaaggccaccaagguccaggacaucaagaacaaccucaaggaggccaucgagaccaucgucgccgccauguccaaccucgucccccccgucgagcucgccaaccccgagaaccaguuccgcgucgacuacauccucuccgucaugaacguccccgacuucgacuucccccccgaguucuacgagcacgccaaggcccucugggaggacgagggcguccgcgccugcuacgagcgcuccaacgaguaccagcucaucgacugcgcccaguacuuccucgacaagaucgacgucaucaagcaggccgacuacguccccuccgaccaggaccuccuccgcugccgcguccucaccuccggcaucuucgagaccaaguuccaggucgacaaggucaacuuccacauguucgacgucggcggccagcgcgacgagcgccgcaaguggauccagugcuucaacgacgucaccgccaucaucuucgucgucgccuccuccuccuacaacauggucauccgcgaggacaaccagaccaaccgccuccaggaggcccucaaccucuucaaguccaucuggaacaaccgcuggcuccgcaccaucuccgucauccucuuccucaacaagcaggaccuccucgccgagaagguccucgccggcaaguccaagaucgaggacuacuuccccgaguucgcccgcuacaccacccccgaggacgccacccccgagcccggcgaggacccccgcgucacccgcgccaaguacuucauccgcgacgaguuccuccgcaucuccaccgccuccggcgacggccgccacuacugcuacccccacuucaccugcgccgucgacaccgagaacauccgccgcgucuucaacgacugccgcgacaucauccagcgcaugcaccuccgccaguacgagcuccucuga

SEQ ID NO: 43714 - RNA, 1053 nt, Artificial Sequence
  derived and/or modified sequence opt2 from GNAT1__Homo_sapiens__NP_653082
augggcgccggcgccuccgccgaggagaagcacucccgcgagcucgagaagaagcucaaggaggacgccgagaaggacgcccgcaccgucaagcuccuccuccucggcgccggcgaguccggcaaguccaccaucgucaagcagaugaagaucauccaccaggacggcuacucccucgaggagugccucgaguucaucgccaucaucuacggcaacacccuccaguccauccucgccaucguccgcgccaugaccacccucaacauccaguacggcgacuccgcccgccaggacgacgcccgcaagcucaugcacauggccgacaccaucgaggagggcaccaugcccaaggagauguccgacaucauccagcgccucuggaaggacuccggcauccaggccugcuucgagcgcgccuccgaguaccagcucaacgacuccgccggcuacuaccucuccgaccucgagcgccucgucacccccggcuacguccccaccgagcaggacguccuccgcucccgcgucaagaccaccggcaucaucgagacccaguucuccuucaaggaccucaacuuccgcauguucgacgucggcggccagcgcuccgagcgcaagaaguggauccacugcuucgagggcgucaccugcaucaucuucaucgccgcccucuccgccuacgacaugguccucgucgaggacgacgaggucaaccgcaugcacgagucccuccaccucuucaacuccaucugcaaccaccgcuacuucgccaccaccuccaucguccucuuccucaacaagaaggacgucuucuucgagaagaucaagaaggcccaccucuccaucugcuuccccgacuacgacggccccaacaccuacgaggacgccggcaacuacaucaagguccaguuccucgagcucaacaugcgccgcgacgucaaggagaucuacucccacaugaccugcgccaccgacacccagaacgucaaguucgucuucgacgccgucaccgacaucaucaucaaggagaaccucaaggacugcggccucuucuga

SEQ ID NO: 43715 - RNA, 1065 nt, Artificial Sequence
  derived and/or modified sequence opt2 from GNAT3__Homo_sapiens__NP_001095856
augggcuccggcaucuccuccgaguccaaggaguccgccaagcgcuccaaggagcucgagaagaagcuccaggaggacgccgagcgcgacgcccgcaccgucaagcuccuccuccucggcgccggcgaguccggcaaguccaccaucgucaagcagaugaagaucauccacaagaacggcuacuccgagcaggagugcauggaguucaaggccgucaucuacuccaacacccuccaguccauccucgccaucgucaaggccaugaccacccucggcaucgacuacgucaacccccgcuccgccgaggaccagcgccagcucuacgccauggccaacacccucgaggacggcggcaugaccccccagcucgccgaggucaucaagcgccucuggcgcgaccccggcauccaggccugcuucgagcgcgccuccgaguaccagcucaacgacuccgccgccuacuaccucaacgaccucgaccgcaucaccgccuccggcuacguccccaacgagcaggacguccuccacucccgcgucaagaccaccggcaucaucgagacccaguucuccuucaaggaccuccacuuccgcauguucgacgucggcggccagcgcuccgagcgcaagaaguggauccacugcuucgagggcgucaccugcaucaucuucugcgccgcccucuccgccuacgacaugguccucgucgaggacgaggaggucaaccgcaugcacgagucccuccaccucuucaacuccaucugcaaccacaaguacuucuccaccaccuccaucguccucuuccucaacaagaaggacaucuuccaggagaaggucaccaagguccaccucuccaucugcuuccccgaguacaccggccccaacaccuucgaggacgccggcaacuacaucaagaaccaguuccucgaccucaaccucaagaaggaggacaaggagaucuacucccacaugaccugcgccaccgacacccagaacgucaaguucgucuucgacgccgucaccgacaucaucaucaaggagaaccucaaggacugcggccucuucuga

SEQ ID NO: 43716 - RNA, 1068 nt, Artificial Sequence
  derived and/or modified sequence opt2 from GNAZ__Homo_sapiens__NP_002064
augggcugccgccaguccuccgaggagaaggaggccgcccgccgcucccgccgcaucgaccgccaccuccgcuccgagucccagcgccagcgccgcgagaucaagcuccuccuccucggcaccuccaacuccggcaaguccaccaucgucaagcagaugaagaucauccacuccggcggcuucaaccucgaggccugcaaggaguacaagccccucaucaucuacaacgccaucgacucccucacccgcaucauccgcgcccucgccgcccuccgcaucgacuuccacaaccccgaccgcgccuacgacgccguccagcucuucgcccucaccggccccgccgaguccaagggcgagaucacccccgagcuccucggcgucaugcgccgccucugggccgaccccggcgcccaggccugcuucucccgcuccuccgaguaccaccucgaggacaacgccgccuacuaccucaacgaccucgagcgcaucgccgccgccgacuacauccccaccgucgaggacauccuccgcucccgcgacaugaccaccggcaucgucgagaacaaguucaccuucaaggagcucaccuucaagauggucgacgucggcggccagcgcuccgagcgcaagaaguggauccacugcuucgagggcgucaccgccaucaucuucugcgucgagcucuccggcuacgaccucaagcucuacgaggacaaccagaccucccgcauggccgagucccuccgccucuucgacuccaucugcaacaacaacugguucaucaacaccucccucauccucuuccucaacaagaaggaccuccucgccgagaagauccgccgcaucccccucaccaucugcuuccccgaguacaagggccagaacaccuacgaggaggccgccgucuacauccagcgccaguucgaggaccucaaccgcaacaaggagaccaaggagaucuacucccacuucaccugcgccaccgacaccuccaacauccaguucgucuucgacgccgucaccgacgucaucauccagaacaaccucaaguacaucggccucugcuga

SEQ ID NO: 43717 - RNA, 984 nt, Artificial Sequence
  derived and/or modified sequence opt2 from GNB1L__Homo_sapiens__NP_443730
augaccgcccccugccccccccccccccccgacccccaguucguccuccgcggcacccagucccccguccacgcccuccacuucugcgagggcgcccaggcccagggccgcccccuccucuucuccggcucccaguccggccucguccacaucuggucccuccagacccgccgcgccgucaccacccucgacggccacggcggccagugcgucaccuggcuccagacccucccccagggccgccagcuccucucccagggccgcgaccucaagcucugccucugggaccucgccgagggccgcuccgccgucgucgacuccgucugccucgaguccgucggcuucugccgcuccuccauccucgccggcggccagccccgcuggacccucgccguccccggccgcggcuccgacgagguccagauccucgagaugcccuccaagaccuccgucugcgcccucaagcccaaggccgacgccaagcucggcaugcccaugugccuccgccucuggcaggccgacugcuccucccgcccccuccuccucgccggcuacgaggacggcuccgucguccucugggacgucuccgagcagaaggucugcucccgcaucgccugccacgaggagcccgucauggaccucgacuucgacucccagaaggcccgcggcaucuccggcuccgccggcaaggcccucgccgucuggucccucgacuggcagcaggcccuccagguccgcggcacccacgagcucaccaaccccggcaucgccgaggucaccauccgccccgaccgcaagauccucgccaccgccggcugggaccaccgcauccgcgucuuccacuggcgcaccaugcagccccucgccguccucgccuuccacuccgccgccguccagugcgucgccuucaccgccgacggccuccucgccgccggcuccaaggaccagcgcaucucccucuggucccucuacccccgcgccuga

SEQ ID NO: 43718 - RNA, 954 nt, Artificial Sequence
  derived and/or modified sequence opt2 from GNB2L1__Homo_sapiens__NP_006089
augaccgagcagaugacccuccgcggcacccucaagggccacaacggcugggucacccagaucgccaccaccccccaguuccccgacaugauccucuccgccucccgcgacaagaccaucaucauguggaagcucacccgcgacgagaccaacuacggcaucccccagcgcgcccuccgcggccacucccacuucgucuccgacgucgucaucuccuccgacggccaguucgcccucuccggcuccugggacggcacccuccgccucugggaccucaccaccggcaccaccacccgccgcuucgucggccacaccaaggacguccucuccgucgccuucuccuccgacaaccgccagaucgucuccggcucccgcgacaagaccaucaagcucuggaacacccucggcgucugcaaguacaccguccaggacgagucccacuccgagugggucuccugcguccgcuucucccccaacuccuccaaccccaucaucgucuccugcggcugggacaagcucgucaaggucuggaaccucgccaacugcaagcucaagaccaaccacaucggccacaccggcuaccucaacaccgucaccgucucccccgacggcucccucugcgccuccggcggcaaggacggccaggccaugcucugggaccucaacgagggcaagcaccucuacacccucgacggcggcgacaucaucaacgcccucugcuucucccccaaccgcuacuggcucugcgccgccaccggccccuccaucaagaucugggaccucgagggcaagaucaucgucgacgagcucaagcaggaggucaucuccaccuccuccaaggccgagcccccccagugcaccucccucgccugguccgccgacggccagacccucuucgccggcuacaccgacaaccucguccgcgucuggcaggucaccaucggcacccgcuga

SEQ ID NO: 43719 - RNA, 1023 nt, Artificial Sequence
  derived and/or modified sequence opt2 from GNB3__Homo_sapiens__NP_002066
augggcgagauggagcagcuccgccaggaggccgagcagcucaagaagcagaucgccgacgcccgcaaggccugcgccgacgucacccucgccgagcucgucuccggccucgaggucgucggccgcguccagaugcgcacccgccgcacccuccgcggccaccucgccaagaucuacgccaugcacugggccaccgacuccaagcuccucgucuccgccucccaggacggcaagcucaucgucugggacuccuacaccaccaacaagguccacgccaucccccuccgcuccuccugggucaugaccugcgccuacgcccccuccggcaacuucgucgccugcggcggccucgacaacaugugcuccaucuacaaccucaagucccgcgagggcaacgucaaggucucccgcgagcucuccgcccacaccggcuaccucuccugcugccgcuuccucgacgacaacaacaucgucaccuccuccggcgacaccaccugcgcccucugggacaucgagaccggccagcagaagaccgucuucgucggccacaccggcgacugcaugucccucgccgucucccccgacuucaaccucuucaucuccggcgccugcgacgccuccgccaagcucugggacguccgcgagggcaccugccgccagaccuucaccggccacgaguccgacaucaacgccaucugcuucuuccccaacggcgaggccaucugcaccggcuccgacgacgccuccugccgccucuucgaccuccgcgccgaccaggagcucaucugcuucucccacgaguccaucaucugcggcaucaccuccgucgccuucucccucuccggccgccuccucuucgccggcuacgacgacuucaacugcaacgucugggacuccaugaaguccgagcgcgucggcauccucuccggccacgacaaccgcgucuccugccucggcgucaccgccgacggcauggccgucgccaccggcuccugggacuccuuccucaagaucuggaacuga

SEQ ID NO: 43720 - RNA, 1023 nt, Artificial Sequence
  derived and/or modified sequence opt2 from GNB4__Homo_sapiens__XP_006713784
auguccgagcucgagcagcuccgccaggaggccgagcagcuccgcaaccagauccaggacgcccgcaaggccugcaacgacgccacccucguccagaucaccuccaacauggacuccgucggccgcauccagaugcgcacccgccgcacccuccgcggccaccucgccaagaucuacgccaugcacuggggcuacgacucccgccuccucgucuccgccucccaggacggcaagcucaucaucugggacuccuacaccaccaacaagaugcacgccaucccccuccgcuccuccugggucaugaccugcgccuacgcccccuccggcaacuacgucgccugcggcggccucgacaacaucugcuccaucuacaaccucaagacccgcgagggcaacguccgcgucucccgcgagcuccccggccacaccggcuaccucuccugcugccgcuuccucgacgacucccagaucgucaccuccuccggcgacaccaccugcgcccucugggacaucgagaccgcccagcagaccaccaccuucaccggccacuccggcgacgucaugucccucucccucucccccgacaugcgcaccuucgucuccggcgccugcgacgccuccuccaagcucugggacauccgcgacggcaugugccgccaguccuucaccggccacgucuccgacaucaacgccgucuccuucuuccccaacggcuacgccuucgccaccggcuccgacgacgccaccugccgccucuucgaccuccgcgccgaccaggagcuccuccucuacucccacgacaacaucaucugcggcaucaccuccgucgccuucuccaaguccggccgccuccuccucgccggcuacgacgacuucaacugcaacgucugggacacccucaagggcgaccgcgccggcguccucgccggccacgacaaccgcgucuccugccucggcgucaccgacgacggcauggccgucgccaccggcuccugggacuccuuccuccgcaucuggaacuga

SEQ ID NO: 43721 - RNA, 1062 nt, Artificial Sequence
  derived and/or modified sequence opt2 from GNB5__Homo_sapiens__NP_006569
auggccaccgagggccuccacgagaacgagacccucgccucccucaaguccgaggccgagucccucaagggcaagcucgaggaggagcgcgccaagcuccacgacgucgagcuccaccaggucgccgagcgcgucgaggcccucggccaguucgucaugaagacccgccgcacccucaagggccacggcaacaagguccucugcauggacuggugcaaggacaagcgccgcaucgucuccuccucccaggacggcaaggucaucgucugggacuccuucaccaccaacaaggagcacgccgucaccaugcccugcaccugggucauggccugcgccuacgcccccuccggcugcgccaucgccugcggcggccucgacaacaagugcuccgucuacccccucaccuucgacaagaacgagaacauggccgccaagaagaaguccgucgccaugcacaccaacuaccucuccgccugcuccuucaccaacuccgacaugcagauccucaccgccuccggcgacggcaccugcgcccucugggacgucgaguccggccagcuccuccaguccuuccacggccacggcgccgacguccucugccucgaccucgcccccuccgagaccggcaacaccuucgucuccggcggcugcgacaagaaggccauggucugggacaugcgcuccggccagugcguccaggccuucgagacccacgaguccgacaucaacuccguccgcuacuaccccuccggcgacgccuucgccuccggcuccgacgacgccaccugccgccucuacgaccuccgcgccgaccgcgaggucgccaucuacuccaaggaguccaucaucuucggcgccuccuccgucgacuucucccucuccggccgccuccucuucgccggcuacaacgacuacaccaucaacgucugggacguccucaagggcucccgcgucuccauccucuucggccacgagaaccgcgucuccacccuccgcgucucccccgacggcaccgccuucugcuccggcuccugggaccacacccuccgcgucugggccuga

SEQ ID NO: 43722 - RNA, 2262 nt, Artificial Sequence
  derived and/or modified sequence opt2 from GNE__Homo_sapiens__NP_001121699
auggagaccuacggcuaccuccagcgcgaguccugcuuccagggcccccacgagcucuacuucaagaaccucuccaagcgcaacaagcagaucauggagaagaacggcaacaaccgcaagcuccgcgucugcgucgccaccugcaaccgcgccgacuacuccaagcucgcccccaucauguucggcaucaagaccgagcccgaguucuucgagcucgacgucgucguccucggcucccaccucaucgacgacuacggcaacaccuaccgcaugaucgagcaggacgacuucgacaucaacacccgccuccacaccaucguccgcggcgaggacgaggccgccauggucgaguccgucggccucgcccucgucaagcuccccgacguccucaaccgccucaagcccgacaucaugaucguccacggcgaccgcuucgacgcccucgcccucgccaccuccgccgcccucaugaacauccgcauccuccacaucgagggcggcgaggucuccggcaccaucgacgacuccauccgccacgccaucaccaagcucgcccacuaccacgucugcugcacccgcuccgccgagcagcaccucaucuccaugugcgaggaccacgaccgcauccuccucgccggcugccccuccuacgacaagcuccucuccgccaagaacaaggacuacauguccaucauccgcauguggcucggcgacgacgucaaguccaaggacuacaucgucgcccuccagcaccccgucaccaccgacaucaagcacuccaucaagauguucgagcucacccucgacgcccucaucuccuucaacaagcgcacccucguccucuuccccaacaucgacgccggcuccaaggagaugguccgcgucaugcgcaagaagggcaucgagcaccaccccaacuuccgcgccgucaagcacguccccuucgaccaguucauccagcucgucgcccacgccggcugcaugaucggcaacuccuccugcggcguccgcgaggucggcgccuucggcacccccgucaucaaccucggcacccgccagaucggccgcgagaccggcgagaacguccuccacguccgcgacgccgacacccaggacaagauccuccaggcccuccaccuccaguucggcaagcaguaccccugcuccaagaucuacggcgacggcaacgccgucccccgcauccucaaguuccucaaguccaucgaccuccaggagccccuccagaagaaguucugcuucccccccgucaaggagaacaucucccaggacaucgaccacauccucgagacccucuccgcccucgccgucgaccucggcggcaccaaccuccgcgucgccaucgucuccaugaagggcgagaucgucaagaaguacacccaguucaaccccaagaccuacgaggagcgcaucaaccucauccuccagaugugcgucgaggccgccgccgaggccgucaagcucaacugccgcauccucggcgucggcaucuccaccggcggccgcgucaacccccgcgagggcaucguccuccacuccaccaagcucauccaggaguggaacuccgucgaccuccgcaccccccucuccgacacccuccaccuccccgucugggucgacaacgacggcaacugcgccgcccucgccgagcgcaaguucggccagggcaagggccucgagaacuucgucacccucaucaccggcaccggcaucggcggcggcaucauccaccagcacgagcucauccacggcuccuccuucugcgccgccgagcucggccaccucgucgucucccucgacggccccgacugcuccugcggcucccacggcugcaucgaggccuacgccuccggcauggcccuccagcgcgaggccaagaagcuccacgacgaggaccuccuccucgucgagggcauguccguccccaaggacgaggccgucggcgcccuccaccucauccaggccgccaagcucggcaacgccaaggcccaguccauccuccgcaccgccggcaccgcccucggccucggcgucgucaacauccuccacaccaugaaccccucccucgucauccucuccggcguccucgccucccacuacauccacaucgucaaggacgucauccgccagcaggcccucuccuccguccaggacgucgacgucgucgucuccgaccucgucgaccccgcccuccucggcgccgccuccaugguccucgacuacaccacccgccgcaucuacuga

SEQ ID NO: 43723 - RNA, 207 nt, Artificial Sequence
  derived and/or modified sequence opt2 from GNG10__Homo_sapiens__NP_001017998
auguccuccggcgccuccgccuccgcccuccagcgccucgucgagcagcucaagcucgaggccggcgucgagcgcaucaaggucucccaggccgccgccgagcuccagcaguacugcaugcagaacgccugcaaggacgcccuccucgucggcguccccgccggcuccaaccccuuccgcgagccccgcuccugcgcccuccucuga

SEQ ID NO: 43724 - RNA, 222 nt, Artificial Sequence
  derived and/or modified sequence opt2 from GNG11__Homo_sapiens__NP_004117
augcccgcccuccacaucgaggaccuccccgagaaggagaagcucaagauggaggucgagcagcuccgcaaggaggucaagcuccagcgccagcaggucuccaagugcuccgaggagaucaagaacuacaucgaggagcgcuccggcgaggacccccucgucaagggcauccccgaggacaagaaccccuucaaggagaagggcuccugcgucaucuccuga

SEQ ID NO: 43725 - RNA, 216 nt, Artificial Sequence
  derived and/or modified sequence opt2 from GNG2__Homo_sapiens__XP_011535148
auggccuccaacaacaccgccuccaucgcccaggcccgcaagcucgucgagcagcucaagauggaggccaacaucgaccgcaucaaggucuccaaggccgccgccgaccucauggccuacugcgaggcccacgccaaggaggacccccuccucacccccguccccgccuccgagaaccccuuccgcgagaagaaguucuucugcgccauccucuga

SEQ ID NO: 43726 - RNA, 228 nt, Artificial Sequence
  derived and/or modified sequence opt2 from GNG4__Homo_sapiens__NP_004476
augaaggagggcauguccaacaacuccaccaccuccaucucccaggcccgcaaggccgucgagcagcucaagauggaggccugcauggaccgcgucaaggucucccaggccgccgccgaccuccucgccuacugcgaggcccacguccgcgaggacccccucaucauccccguccccgccuccgagaaccccuuccgcgagaagaaguucuucugcaccauccucuga

SEQ ID NO: 43727 - RNA, 207 nt, Artificial Sequence
  derived and/or modified sequence opt2 from GNG7__Homo_sapiens__NP_443079
auguccgccaccaacaacaucgcccaggcccgcaagcucgucgagcagcuccgcaucgaggccggcaucgagcgcaucaaggucuccaaggccgccuccgaccucauguccuacugcgagcagcacgcccgcaacgacccccuccucgucggcguccccgccuccgagaaccccuucaaggacaagaagcccugcaucauccucuga

SEQ ID NO: 43728 - RNA, 213 nt, Artificial Sequence
  derived and/or modified sequence opt2 from GNG8__Homo_sapiens__NP_150283
auguccaacaacauggccaagaucgccgaggcccgcaagaccgucgagcagcucaagcucgaggucaacaucgaccgcaugaaggucucccaggccgccgccgagcuccucgccuucugcgagacccacgccaaggacgacccccucgucacccccguccccgccgccgagaaccccuuccgcgacaagcgccucuucugcguccuccucuga

SEQ ID NO: 43729 - RNA, 225 nt, Artificial Sequence
  derived and/or modified sequence opt2 from GNGT1__Homo_sapiens__NP_068774
augcccgucaucaacaucgaggaccucaccgagaaggacaagcucaagauggaggucgaccagcucaagaaggaggucacccucgagcgcaugcucgucuccaagugcugcgaggagguccgcgacuacgucgaggagcgcuccggcgaggacccccucgucaagggcauccccgaggacaagaaccccuucaaggagcucaagggcggcugcgucaucuccuga

SEQ ID NO: 43730 - RNA, 210 nt, Artificial Sequence
  derived and/or modified sequence opt2 from GNGT2__Homo_sapiens__XP_006721882
auggcccaggaccucuccgagaaggaccuccucaagauggaggucgagcagcucaagaaggaggucaagaacacccgcauccccaucuccaaggccggcaaggagaucaaggaguacgucgaggcccaggccggcaacgaccccuuccucaagggcauccccgaggacaagaaccccuucaaggagaagggcggcugccucaucuccuga

SEQ ID NO: 43731 - RNA, 1824 nt, Artificial Sequence
  derived and/or modified sequence opt2 from GNL1__Homo_sapiens__NP_005266
augccccgcaagaagcccuucuccgucaagcagaagaagaagcagcuccaggacaagcgcgagcgcaagcgcggccuccaggacggccuccgcuccuccuccaacucccgcuccggcucccgcgagcgccgcgaggagcagaccgacaccuccgacggcgaguccgucacccaccacauccgccgccucaaccagcagcccucccagggccucggcccccgcggcuacgaccccaaccgcuaccgccuccacuucgagcgcgacucccgcgaggaggucgagcgccgcaagcgcgccgcccgcgagcagguccuccagcccgucuccgccgagcuccucgagcucgacauccgcgaggucuaccagcccggcuccguccucgacuucccccgccgcccccccugguccuacgagauguccaaggagcagcucaugucccaggaggagcgcuccuuccaggacuaccucggcaagauccacggcgccuacuccuccgagaagcucuccuacuucgagcacaaccucgagaccuggcgccagcucuggcgcguccucgagauguccgacaucguccuccucaucaccgacauccgccaccccgucgucaacuucccccccgcccucuacgaguacgucaccggcgagcucggccucgcccucguccucguccucaacaaggucgaccucgccccccccgcccucgucgucgccuggaagcacuacuuccaccagcacuacccccagcuccacgucguccucuucaccuccuucccccgcgacccccgcaccccccaggaccccuccuccguccucaagaagucccgccgccgcggccgcggcuggacccgcgcccucggccccgagcagcuccuccgcgccugcgaggccaucaccgucggcaaggucgaccucuccuccuggcgcgagaagaucgcccgcgacgucgccggcgccaccuggggcaacggcuccggcgaggaggaggaggaggaggacggccccgccguccucgucgagcagcagaccgacuccgccauggagcccaccggccccacccaggagcgcuacaaggacggcgucgucaccaucggcugcgucggcuuccccaacgucggcaaguccucccucaucaacggccucgucggccgcaaggucgucuccgucucccgcacccccggccacacccgcuacuuccagaccuacuuccucacccccuccgucaagcucugcgacugccccggccucaucuuccccucccuccucccccgccagcuccagguccucgccggcaucuaccccaucgcccagauccaggagcccuacaccgccgucggcuaccucgccucccgcauccccguccaggcccuccuccaccuccgccaccccgaggccgaggaccccuccgccgagcaccccuggugcgccugggacaucugcgaggccugggccgagaagcgcggcuacaagaccgccaaggccgcccgcaacgacgucuaccgcgccgccaacucccuccuccgccucgccgucgacggccgccucucccucugcuuccacccccccggcuacuccgagcagaagggcaccugggagucccaccccgagaccaccgagcucgucguccuccagggccgcgucggccccgccggcgacgaggaggaggaggaggaggaggagcucuccuccuccugcgaggaggagggcgaggaggaccgcgacgccgacgaggagggcgagggcgacgaggagacccccaccuccgcccccggcuccucccucgccggccgcaaccccuacgcccuccucggcgaggacgagugcuga

SEQ ID NO: 43732 - RNA, 1650 nt, Artificial Sequence
  derived and/or modified sequence opt2 from GNL3__Homo_sapiens__NP_055181
augaagcgccccaagcucaagaaggccuccaagcgcaugaccugccacaagcgcuacaagauccagaagaagguccgcgagcaccaccgcaagcuccgcaaggaggccaagaagcgcggccacaagaagccccgcaaggaccccggcguccccaacuccgcccccuucaaggaggcccuccuccgcgaggccgagcuccgcaagcagcgccucgaggagcucaagcagcagcagaagcucgaccgccagaaggagcucgagaagaagcgcaagcucgagaccaaccccgacaucaagcccuccaacgucgagcccauggagaaggaguucggccucugcaagaccgagaacaaggccaaguccggcaagcagaacuccaagaagcucuacugccaggagcucaagaaggucaucgaggccuccgacgucguccucgagguccucgacgcccgcgacccccucggcugccgcugcccccaggucgaggaggccaucguccaguccggccagaagaagcucguccucauccucaacaaguccgaccucguccccaaggagaaccucgaguccuggcucaacuaccucaagaaggagcuccccaccgucgucuuccgcgccuccaccaagcccaaggacaagggcaagaucaccaagcgcgucaaggccaagaagaacgccgcccccuuccgcuccgaggucugcuucggcaaggagggccucuggaagcuccucggcggcuuccaggagaccugcuccaaggccauccgcgucggcgucaucggcuuccccaacgucggcaaguccuccaucaucaacucccucaagcaggagcagaugugcaacgucggcgucuccaugggccucacccgcuccaugcaggucgucccccucgacaagcagaucaccaucaucgacucccccuccuucaucgucuccccccucaacuccuccuccgcccucgcccuccgcucccccgccuccaucgaggucgucaagcccauggaggccgccuccgccauccucucccaggccgacgcccgccaggucguccucaaguacaccguccccggcuaccgcaacucccucgaguucuucaccguccucgcccagcgccgcggcaugcaccagaagggcggcauccccaacgucgagggcgccgccaagcuccucugguccgaguggaccggcgccucccucgccuacuacugccacccccccaccuccuggacccccccccccuacuucaacgaguccaucgucgucgacaugaaguccggcuucaaccucgaggagcucgagaagaacaacgcccaguccauccgcgccaucaagggcccccaccucgccaacuccauccucuuccaguccuccggccucaccaacggcaucaucgaggagaaggacauccacgaggagcuccccaagcgcaaggagcgcaagcaggaggagcgcgaggacgacaaggacuccgaccaggagaccgucgacgaggaggucgacgagaacuccuccggcauguucgccgccgaggagaccggcgaggcccucuccgaggagaccaccgccggcgagcaguccacccgcuccuucauccucgacaagaucaucgaggaggacgacgccuacgacuucuccaccgacuacgucuga

SEQ ID NO: 43733 - RNA, 1749 nt, Artificial Sequence
  derived and/or modified sequence opt2 from GNL3L__Homo_sapiens__NP_061940
augaugaagcuccgccacaagaacaagaagcccggcgagggcuccaagggccacaagaagaucuccuggcccuacccccagcccgccaagcagaacggcaagaaggccaccuccaagguccccuccgccccccacuucguccaccccaacgaccacgccaaccgcgaggccgagcucaagaagaagugggucgaggagaugcgcgagaagcagcaggccgcccgcgagcaggagcgccagaagcgccgcaccaucgaguccuacugccaggacguccuccgccgccaggaggaguucgagcacaaggaggagguccuccaggagcucaacauguucccccagcucgacgacgaggccacccgcaaggccuacuacaaggaguuccgcaaggucgucgaguacuccgacgucauccucgagguccucgacgcccgcgacccccucggcugccgcugcuuccagauggaggaggccguccuccgcgcccagggcaacaagaagcucguccucguccucaacaagaucgaccucguccccaaggaggucgucgagaaguggcucgacuaccuccgcaacgagcuccccaccgucgccuucaaggccuccacccagcaccaggucaagaaccucaaccgcugcuccguccccgucgaccaggccuccgagucccuccucaaguccaaggccugcuucggcgccgagaaccucaugcgcguccucggcaacuacugccgccucggcgagguccgcacccacauccgcgucggcgucgucggccuccccaacgucggcaaguccucccucaucaacucccucaagcgcucccgcgccugcuccgucggcgccguccccggcaucaccaaguucaugcaggaggucuaccucgacaaguucauccgccuccucgacgcccccggcaucguccccggccccaacuccgaggucggcaccauccuccgcaacugcguccacguccagaagcucgccgaccccgucacccccgucgagaccauccuccagcgcugcaaccucgaggagaucuccaacuacuacggcgucuccggcuuccagaccaccgagcacuuccucaccgccgucgcccaccgccucggcaagaagaagaagggcggccucuacucccaggagcaggccgccaaggccguccucgccgacugggucuccggcaagaucuccuucuacauccccccccccgccacccacacccuccccacccaccucuccgccgagaucgucaaggagaugaccgaggucuucgacaucgaggacaccgagcaggccaacgaggacaccauggagugccucgccaccggcgaguccgacgagcuccucggcgacaccgacccccucgagauggagaucaagcuccuccacucccccaugaccaagaucgccgacgccaucgagaacaagaccaccgucuacaagaucggcgaccucaccggcuacugcaccaaccccaaccgccaccagaugggcugggccaagcgcaacgucgaccaccgccccaaguccaacuccauggucgacgucugcuccgucgaccgccgcuccguccuccagcgcaucauggagaccgacccccuccagcagggccaggcccucgccuccgcccucaagaacaagaagaagaugcagaagcgcgccgacaagaucgccuccaagcucuccgacuccaugauguccgcccucgaccucuccggcaacgccgacgacggcgucggcgacuga

SEQ ID NO: 43734 - RNA, 519 nt, Artificial Sequence
  derived and/or modified sequence opt2 from GNLY__Homo_sapiens__NP_001289687
auggccaccugggcccuccuccuccucgccgccaugcuccucggcaaccccggccucgaggucuccgucucccccaagggcaagaacaccuccggccgcgaguccggcuucggcugggccaucuggauggagggccucgucuucucccgccucucccccgaguacuacgaccucgcccgcgcccaccuccgcgacgaggagaaguccugccccugccucgcccaggagggcccccagggcgaccuccucaccaagacccaggagcucggccgcgacuaccgcaccugccucaccaucguccagaagcucaagaagauggucgacaagcccacccagcgcuccgucuccaacgccgccacccgcgucugccgcaccggccgcucccgcuggcgcgacgucugccgcaacuucaugcgccgcuaccagucccgcgucacccagggccucgucgccggcgagaccgcccagcagaucugcgaggaccuccgccucugcauccccuccaccggcccccucuga

SEQ ID NO: 43735 - RNA, 888 nt, Artificial Sequence
  derived and/or modified sequence opt2 from GNMT__Homo_sapiens__NP_061833
auggucgacuccgucuaccgcacccgcucccucggcgucgccgccgagggccuccccgaccaguacgccgacggcgaggccgcccgcgucuggcagcucuacaucggcgacacccgcucccgcaccgccgaguacaaggccuggcuccucggccuccuccgccagcacggcugccagcgcguccucgacgucgccugcggcaccggcgucgacuccaucaugcucgucgaggagggcuucuccgucaccuccgucgacgccuccgacaagaugcucaaguacgcccucaaggagcgcuggaaccgccgccacgagcccgccuucgacaagugggucaucgaggaggccaacuggaugacccucgacaaggacgucccccaguccgccgagggcggcuucgacgccgucaucugccucggcaacuccuucgcccaccuccccgacugcaagggcgaccaguccgagcaccgccucgcccucaagaacaucgccuccaugguccgcgccggcggccuccucgucaucgaccaccgcaacuacgaccacauccucuccaccggcugcgccccccccggcaagaacaucuacuacaaguccgaccucaccaaggacgucaccaccuccguccucaucgucaacaacaaggcccacauggucacccucgacuacaccguccagguccccggcgccggccaggacggcucccccggccucuccaaguuccgccucuccuacuacccccacugccucgccuccuucaccgagcuccuccaggccgccuucggcggcaagugccagcacuccguccucggcgacuucaagcccuacaagcccggccagaccuacauccccugcuacuucauccacguccucaagcgcaccgacuga

SEQ ID NO: 43736 - RNA, 2043 nt, Artificial Sequence
  derived and/or modified sequence opt2 from GNPAT__Homo_sapiens__NP_055051
auggaguccuccuccuccuccaacuccuacuucuccgucggccccaccucccccuccgccgucguccuccucuacuccaaggagcucaagaagugggacgaguucgaggacauccucgaggagcgccgccacgucuccgaccucaaguucgccaugaagugcuacaccccccucgucuacaagggcaucacccccugcaagcccaucgacaucaagugcuccguccucaacuccgaggagauccacuacgucaucaagcagcucuccaaggagucccuccaguccgucgacguccuccgcgaggaggucuccgagauccucgacgagaugucccacaagcuccgccucggcgccauccgcuucugcgccuucacccucuccaaggucuucaagcagaucuucuccaaggucugcgucaacgaggagggcauccagaagcuccagcgcgccauccaggagcaccccgucguccuccuccccucccaccgcuccuacaucgacuuccucaugcucuccuuccuccucuacaacuacgaccuccccguccccgucaucgccgccggcauggacuuccucggcaugaagauggucggcgagcuccuccgcauguccggcgccuucuucaugcgccgcaccuucggcggcaacaagcucuacugggccgucuucuccgaguacgucaagaccaugcuccgcaacggcuacgcccccgucgaguucuuccucgagggcacccgcucccgcuccgccaagacccucacccccaaguucggccuccucaacaucgucauggagcccuucuucaagcgcgaggucuucgacaccuaccucguccccaucuccaucuccuacgacaagauccucgaggagacccucuacgucuacgagcuccucggcguccccaagcccaaggaguccaccaccggccuccucaaggcccgcaagauccucuccgagaacuucggcuccauccacgucuacuucggcgaccccgucucccuccgcucccucgccgccggccgcaugucccgcuccuccuacaaccucgucccccgcuacaucccccagaagcaguccgaggacaugcacgccuucgucaccgaggucgccuacaagauggagcuccuccagaucgagaacaugguccucucccccuggacccucaucgucgccguccuccuccagaaccgccccuccauggacuucgacgcccucgucgagaagacccucuggcucaagggccucacccaggccuucggcggcuuccucaucuggcccgacaacaagcccgccgaggaggucguccccgccuccauccuccuccacuccaacaucgccucccucgucaaggaccaggucauccucaaggucgacuccggcgacuccgaggucgucgacggccucaugcuccagcacaucacccuccucaugugcuccgccuaccgcaaccagcuccucaacaucuucguccgccccucccucgucgccgucgcccuccagaugacccccggcuuccgcaaggaggacgucuacuccugcuuccgcuuccuccgcgacgucuucgccgacgaguucaucuuccuccccggcaacacccucaaggacuucgaggagggcugcuaccuccucugcaaguccgaggccauccaggucaccaccaaggacauccucgucaccgagaagggcaacaccguccucgaguuccucgucggccucuucaagcccuucgucgaguccuaccagaucaucugcaaguaccuccucuccgaggaggaggaccacuucuccgaggagcaguaccucgccgccguccgcaaguucaccucccagcuccucgaccagggcaccucccagugcuacgacguccucuccuccgacguccagaagaacgcccucgccgccugcguccgccucggcgucgucgagaagaagaagaucaacaacaacugcaucuucaacgucaacgagcccgccaccaccaagcucgaggagaugcucggcugcaagacccccaucggcaagcccgccaccgccaagcucuga

SEQ ID NO: 43737 - RNA, 957 nt, Artificial Sequence
  derived and/or modified sequence opt2 from GNPDA1__Homo_sapiens__XP_005268405
auguccuccuucugguccgacuaccucuuccccuucguccucuggggcaagcucaagacccagcgcggcucccaguccaaggacaagaugaagcucaucauccucgagcacuacucccaggccuccgagugggccgccaaguacauccgcaaccgcaucauccaguucaaccccggccccgagaaguacuucacccucggccuccccaccggcuccaccccccucggcugcuacaagaagcucaucgaguacuacaagaacggcgaccucuccuucaaguacgucaagaccuucaacauggacgaguacgucggccucccccgcgaccaccccgaguccuaccacuccuucauguggaacaacuucuucaagcacaucgacauccaccccgagaacacccacauccucgacggcaacgccgucgaccuccaggccgagugcgacgccuucgaggagaagaucaaggccgccggcggcaucgagcucuucgucggcggcaucggccccgacggccacaucgccuucaacgagcccggcuccucccucgucucccgcacccgcgucaagacccucgccauggacaccauccucgccaacgcccgcuucuucgacggcgagcucaccaagguccccaccauggcccucaccgucggcgucggcaccgucauggacgcccgcgaggucaugauccucaucaccggcgcccacaaggccuucgcccucuacaaggccaucgaggagggcgucaaccacauguggaccgucuccgccuuccagcagcacccccgcaccgucuucgucugcgacgaggacgccacccucgagcucaaggucaagaccgucaaguacuucaagggccucaugcucguccacaacaagcucgucgacccccucuacuccaucaaggagaaggagaccgagaagucccaguccuccaagaagcccuacuccgacuga

SEQ ID NO: 43738 - RNA, 729 nt, Artificial Sequence
  derived and/or modified sequence opt2 from GNPDA2__Homo_sapiens__NP_001257809
augcgccucgucauccucgacaacuacgaccucgccuccgagugggccgccaaguacaucugcaaccgcaucauccaguucaagcccggccaggaccgcuacuucacccucggccuccccaccggccucccccgcaaccaccccgaguccuaccacuccuacauguggaacaacuucuucaagcacaucgacaucgaccccaacaacgcccacauccucgacggcaacgccgccgaccuccaggccgagugcgacgccuucgagaacaagaucaaggaggccggcggcaucgaccucuucgucggcggcaucggccccgacggccacaucgccuucaacgagcccggcuccucccucgucucccgcacccgccucaagacccucgccauggacaccauccucgccaacgccaaguacuucgacggcgaccucuccaagguccccaccauggcccucaccgucggcgucggcaccgucauggacgcccgcgaggucaugauccucaucaccggcgcccacaaggccuucgcccucuacaaggccaucgaggagggcgucaaccacauguggaccgucuccgccuuccagcagcacccccgcaccaucuucgucugcgacgaggacgccacccucgagcuccgcgucaagaccgucaaguacuucaagggccucaugcacguccacaacaagcucgucgacccccucuucuccaugaaggacggcaacuga

SEQ ID NO: 43739 - RNA, 3771 nt, Artificial Sequence
  derived and/or modified sequence opt2 from GNPTAB__Homo_sapiens__NP_077288
augcucuucaagcuccuccagcgccagaccuacaccugccucucccaccgcuacggccucuacgucugcuuccucggcgucgucgucaccaucgucuccgccuuccaguucggcgaggucguccucgaguggucccgcgaccaguaccacguccucuucgacuccuaccgcgacaacaucgccggcaaguccuuccagaaccgccucugccuccccaugcccaucgacgucgucuacaccugggucaacggcaccgaccucgagcuccucaaggagcuccagcagguccgcgagcagauggaggaggagcagaaggccaugcgcgagauccucggcaagaacaccaccgagcccaccaagaaguccgagaagcagcucgagugccuccucacccacugcaucaagguccccaugcucguccucgaccccgcccuccccgccaacaucacccucaaggaccuccccucccucuaccccuccuuccacuccgccuccgacaucuucaacgucgccaagcccaagaaccccuccaccaacgucuccgucgucgucuucgacuccaccaaggacgucgaggacgcccacuccggccuccucaagggcaacucccgccagaccgucuggcgcggcuaccucaccaccgacaaggagguccccggccucguccucaugcaggaccucgccuuccucuccggcuucccccccaccuucaaggagaccaaccagcucaagaccaagcuccccgagaaccucuccuccaaggucaagcuccuccagcucuacuccgaggccuccgucgcccuccucaagcucaacaaccccaaggacuuccaggagcucaacaagcagaccaagaagaacaugaccaucgacggcaaggagcucaccaucucccccgccuaccuccucugggaccucuccgccaucucccaguccaagcaggacgaggacaucuccgccucccgcuucgaggacaacgaggagcuccgcuacucccuccgcuccaucgagcgccacgcccccuggguccgcaacaucuucaucgucaccaacggccagauccccuccuggcucaaccucgacaacccccgcgucaccaucgucacccaccaggacgucuuccgcaaccucucccaccuccccaccuucuccucccccgccaucgagucccacauccaccgcaucgagggccucucccagaaguucaucuaccucaacgacgacgucauguucggcaaggacgucuggcccgacgacuucuacucccacuccaagggccagaaggucuaccucaccuggcccguccccaacugcgccgagggcugccccggcuccuggaucaaggacggcuacugcgacaaggccugcaacaacuccgccugcgacugggacggcggcgacugcuccggcaacuccggcggcucccgcuacaucgccggcggcggcggcaccggcuccaucggcgucggccagcccuggcaguucggcggcggcaucaacuccgucuccuacugcaaccagggcugcgccaacuccuggcucgccgacaaguucugcgaccaggccugcaacguccucuccugcggcuucgacgccggcgacugcggccaggaccacuuccacgagcucuacaaggucauccuccuccccaaccagacccacuacaucauccccaagggcgagugccuccccuacuucuccuucgccgaggucgccaagcgcggcgucgagggcgccuacuccgacaaccccaucauccgccacgccuccaucgccaacaaguggaagaccauccaccucaucaugcacuccggcaugaacgccaccaccauccacuucaaccucaccuuccagaacaccaacgacgaggaguucaagaugcagaucaccgucgaggucgacacccgcgagggccccaagcucaacuccaccgcccagaagggcuacgagaaccucgucucccccaucacccuccuccccgaggccgagauccucuucgaggacauccccaaggagaagcgcuuccccaaguucaagcgccacgacgucaacuccacccgccgcgcccaggaggaggucaagaucccccucgucaacaucucccuccuccccaaggacgcccagcucucccucaacacccucgaccuccagcucgagcacggcgacaucacccucaagggcuacaaccucuccaaguccgcccuccuccgcuccuuccucaugaacucccagcacgccaagaucaagaaccaggccaucaucaccgacgagaccaacgacucccucgucgccccccaggagaagcagguccacaaguccauccuccccaacucccucggcgucuccgagcgccuccagcgccucaccuuccccgccgucuccgucaaggucaacggccacgaccagggccagaaccccccccucgaccucgagaccaccgcccgcuuccgcgucgagacccacacccagaagaccaucggcggcaacgucaccaaggagaagccccccucccucaucgucccccucgagucccagaugaccaaggagaagaagaucaccggcaaggagaaggagaacucccgcauggaggagaacgccgagaaccacaucggcgucaccgagguccuccucggccgcaagcuccagcacuacaccgacuccuaccucggcuuccuccccugggagaagaagaaguacuuccaggaccuccucgacgaggaggagucccucaagacccagcucgccuacuucaccgacuccaagaacaccggccgccagcucaaggacaccuucgccgacucccuccgcuacgucaacaagauccucaacuccaaguucggcuucaccucccgcaagguccccgcccacaugccccacaugaucgaccgcaucgucaugcaggagcuccaggacauguuccccgaggaguucgacaagaccuccuuccacaagguccgccacuccgaggacaugcaguucgccuucuccuacuucuacuaccucauguccgccguccagccccucaacaucucccaggucuucgacgaggucgacaccgaccaguccggcguccucuccgaccgcgagauccgcacccucgccacccgcauccacgagcucccccucucccuccaggaccucaccggccucgagcacaugcucaucaacugcuccaagaugcuccccgccgacaucacccagcucaacaacaucccccccacccaggaguccuacuacgaccccaaccucccccccgucaccaagucccucgucaccaacugcaagcccgucaccgacaagauccacaaggccuacaaggacaagaacaaguaccgcuucgagaucaugggcgaggaggagaucgccuucaagaugauccgcaccaacgucucccacgucgucggccagcucgacgacauccgcaagaacccccgcaaguucgucugccucaacgacaacaucgaccacaaccacaaggacgcccagaccgucaaggccguccuccgcgacuucuacgaguccauguuccccauccccucccaguucgagcucccccgcgaguaccgcaaccgcuuccuccacaugcacgagcuccaggaguggcgcgccuaccgcgacaagcucaaguucuggacccacugcguccucgccacccucaucauguucaccaucuucuccuucuucgccgagcagcucaucgcccucaagcgcaagaucuucccccgccgccgcauccacaaggaggccucccccaaccgcauccgcgucuga

SEQ ID NO: 43740 - RNA, 918 nt, Artificial Sequence
  derived and/or modified sequence opt2 from GNPTG__Homo_sapiens__NP_115909
auggccgccggccucgcccgccuccuccuccuccucggccucuccgccggcggccccgcccccgccggcgccgccaagaugaaggucgucgaggagcccaacgccuucggcgucaacaaccccuuccucccccaggccucccgccuccaggccaagcgcgaccccucccccgucuccggccccguccaccucuuccgccucuccggcaagugcuucucccucgucgaguccaccuacaaguacgaguucugccccuuccacaacgucacccagcacgagcagaccuuccgcuggaacgccuacuccggcauccucggcaucuggcacgagugggagaucgccaacaacaccuucaccggcauguggaugcgcgacggcgacgccugccgcucccgcucccgccaguccaaggucgagcucgccugcggcaaguccaaccgccucgcccacgucuccgagcccuccaccugcgucuacgcccucaccuucgagaccccccucgucugccacccccacgcccuccucgucuaccccacccuccccgaggcccuccagcgccagugggaccaggucgagcaggaccucgccgacgagcucaucaccccccagggccacgagaagcuccuccgcacccucuucgaggacgccggcuaccucaagacccccgaggagaacgagcccacccagcucgagggcggccccgacucccucggcuucgagacccucgagaacugccgcaaggcccacaaggagcucuccaaggagaucaagcgccucaagggccuccucacccagcacggcauccccuacacccgccccaccgagaccuccaaccucgagcaccucggccacgagaccccccgcgccaagucccccgagcagcuccgcggcgaccccggccuccgcggcucccucuga

SEQ ID NO: 43741 - RNA, 291 nt, Artificial Sequence
  derived and/or modified sequence opt2 from GNRH1__Homo_sapiens__NP_000816
augugccuccgcaugaagcccauccagaagcuccucgccggccucauccuccucaccuggugcgucgagggcugcuccucccagcacugguccuacggccuccgccccggcggcaagcgcgacgccgagaaccucaucgacuccuuccaggagaucgucaaggaggucggccagcucgccgagacccagcgcuucgagugcaccacccaccagccccgcuccccccuccgcgaccucaagggcgcccucgagucccucaucgaggaggagaccggccagaagaagaucuga

SEQ ID NO: 43742 - RNA, 342 nt, Artificial Sequence
  derived and/or modified sequence opt2 from GNRH2__Homo_sapiens__NP_847901
auggccuccucccgccgcggccuccuccuccuccuccuccucaccgcccaccucggccccuccgaggcccagcacuggucccacggcugguaccccggcggcaagcgcgcccucuccuccgcccaggacccccagaacgcccuccgcccccccgccggcucccccguccagaccgcccacggccuccccuccgacgcccucgccccccucgacgacuccaugcccugggagggccgcaccaccgcccaguggucccuccaccgcaagcgccaccucgcccgcacccuccucaccgccgcccgcgagccccgccccgccccccccuccuccaacaaggucuga

SEQ ID NO: 43743 - RNA, 987 nt, Artificial Sequence
  derived and/or modified sequence opt2 from GNRHR__Homo_sapiens__NP_000397
auggccaacuccgccucccccgagcagaaccagaaccacugcuccgccaucaacaacuccaucccccucaugcagggcaaccuccccacccucacccucuccggcaagauccgcgucaccgucaccuucuuccucuuccuccucuccgccaccuucaacgccuccuuccuccucaagcuccagaaguggacccagaagaaggagaagggcaagaagcucucccgcaugaagcuccuccucaagcaccucacccucgccaaccuccucgagacccucaucgucaugccccucgacggcauguggaacaucaccguccagugguacgccggcgagcuccucugcaagguccucuccuaccucaagcucuucuccauguacgcccccgccuucaugauggucgucaucucccucgaccgcucccucgccaucacccgcccccucgcccucaaguccaacuccaaggucggccaguccauggucggccucgccuggauccucuccuccgucuucgccggcccccagcucuacaucuuccgcaugauccaccucgccgacuccuccggccagaccaaggucuucucccagugcgucacccacugcuccuucucccagugguggcaccaggccuucuacaacuucuucaccuucuccugccucuucaucaucccccucuucaucaugcucaucugcaacgccaagaucaucuucacccucacccgcguccuccaccaggacccccacgagcuccagcucaaccaguccaagaacaacaucccccgcgcccgccucaagacccucaagaugaccgucgccuucgccaccuccuucaccgucugcuggacccccuacuacguccucggcaucugguacugguucgaccccgagaugcucaaccgccucuccgaccccgucaaccacuucuucuuccucuucgccuuccucaaccccugcuucgacccccucaucuacggcuacuucucccucuga

SEQ ID NO: 43744 - RNA, 1659 nt, Artificial Sequence
  derived and/or modified sequence opt2 from GNS__Homo_sapiens__NP_002067
augcgccuccucccccucgcccccggccgccuccgccgcggcuccccccgccaccuccccuccugcucccccgcccuccuccuccucguccucggcggcugccucggcgucuucggcgucgccgccggcacccgccgccccaacgucguccuccuccucaccgacgaccaggacgagguccucggcggcaugaccccccucaagaagaccaaggcccucaucggcgagaugggcaugaccuucuccuccgccuacguccccuccgcccucugcugccccucccgcgccuccauccucaccggcaaguacccccacaaccaccacgucgucaacaacacccucgagggcaacugcuccuccaaguccuggcagaagauccaggagcccaacaccuuccccgccauccuccgcuccaugugcggcuaccagaccuucuucgccggcaaguaccucaacgaguacggcgcccccgacgccggcggccucgagcacgucccccucggcugguccuacugguacgcccucgagaagaacuccaaguacuacaacuacacccucuccaucaacggcaaggcccgcaagcacggcgagaacuacuccgucgacuaccucaccgacguccucgccaacgucucccucgacuuccucgacuacaaguccaacuucgagcccuucuucaugaugaucgccacccccgccccccacucccccuggaccgccgccccccaguaccagaaggccuuccagaacgucuucgccccccgcaacaagaacuucaacauccacggcaccaacaagcacuggcucauccgccaggccaagacccccaugaccaacuccuccauccaguuccucgacaacgccuuccgcaagcgcuggcagacccuccucuccgucgacgaccucgucgagaagcucgucaagcgccucgaguucaccggcgagcucaacaacaccuacaucuucuacaccuccgacaacggcuaccacaccggccaguucucccuccccaucgacaagcgccagcucuacgaguucgacaucaaggucccccuccucguccgcggccccggcaucaagcccaaccagaccuccaagaugcucgucgccaacaucgaccucggccccaccauccucgacaucgccggcuacgaccucaacaagacccagauggacggcaugucccuccuccccauccuccgcggcgccuccaaccucaccuggcgcuccgacguccucgucgaguaccagggcgagggccgcaacgucaccgaccccaccugccccucccucucccccggcgucucccagugcuuccccgacugcgucugcgaggacgccuacaacaacaccuacgccugcguccgcaccauguccgcccucuggaaccuccaguacugcgaguucgacgaccaggaggucuucgucgaggucuacaaccucaccgccgaccccgaccagaucaccaacaucgccaagaccaucgaccccgagcuccucggcaagaugaacuaccgccucaugaugcuccaguccugcuccggccccaccugccgcacccccggcgucuucgaccccggcuaccgcuucgacccccgccucauguucuccaaccgcggcuccguccgcacccgccgcuucuccaagcaccuccucuga

SEQ ID NO: 43745 - RNA, 2304 nt, Artificial Sequence
  derived and/or modified sequence opt2 from GOLGA1__Homo_sapiens__NP_002068
auguucgccaagcucaagaagaagaucgccgaggagaccgccgucgcccagcgccccggcggcgccacccgcaucccccgcuccgucuccaaggaguccgucgccuccaugggcgccgacuccggcgacgacuucgccuccgacggcuccuccucccgcgaggaccucuccucccagcuccuccgccgcaacgagcagauccgcaagcucgaggcccgccucuccgacuacgccgagcagguccgcaaccuccagaagaucaaggagaagcucgagaucgcccucgagaagcaccaggacuccuccaugcgcaaguuccaggagcagaacgagaccuuccaggccaaccgcgccaagauggccgagggccucgcccucgcccucgcccgcaaggaccaggagugguccgagaagauggaccagcucgagaaggagaagaacauccucaccgcccagcuccaggagaugaagaaccaguccaugaaccucuuccagcgccgcgacgagauggacgagcucgagggcuuccagcagcaggagcucuccaagaucaagcacaugcuccucaagaaggaggagucccucggcaagauggagcaggagcucgaggcccgcacccgcgagcucucccgcacccaggaggagcucaugaacuccaaccagauguccuccgaccucucccagaagcucgaggagcuccagcgccacuacuccacccucgaggagcagcgcgaccacgucaucgccuccaagaccggcgccgaguccaagaucaccgcccucgagcagaaggagcaggagcuccaggcccucauccagcagcucuccaucgaccuccagaaggucaccgccgagacccaggagaaggaggacgucaucacccaccuccaggagaaggucgccucccucgagaagcgccucgagcagaaccucuccggcgaggagcacguccaggagcuccucaaggagaagacccucgccgagcagaaccucgaggacacccgccagcagcuccucgccgcccgcuccucccaggccaaggccaucaacacccucgagacccgcguccgcgagcucgagcagacccuccaggccuccgaggagcagcuccagcaguccaagggcaucgucgccgcccaggagacccagauccaggagcucgccgccgccaaccaggaguccucccacguccagcagcaggcccucgcccucgagcagcaguuccucgagcgcacccaggcccucgaggcccagaucgucgcccucgagcgcacccgcgccgccgaccagaccaccgccgagcagggcaugcgccagcucgagcaggagaacgccgcccucaaggagugccgcaacgaguacgagcgcucccuccagaaccaccaguucgagcucaagaagcucaaggaggaguggucccagcgcgagaucgucuccgucgccauggcccaggcccucgaggagguccgcaagcagcgcgaggaguuccagcagcaggccgccaaccucaccgccaucaucgacgagaaggagcagaaccuccgcgagaagaccgagguccuccuccagaaggagcaggagauccuccagcucgagcgcggccacaacuccgcccuccuccagauccaccagcuccaggccgagcucgaggcccuccgcacccucaaggccgaggaggccgccgucgucgccgagcaggaggaccuccuccgccuccgcggcccccuccaggccgaggcccucuccgucaacgagucccacgucaccucccgcgccaugcaggaccccgucuuccagcuccccaccgccggccgcacccccaacggcgaggucggcgccauggaccucacccagcuccagaaggagaagcaggaccucgagcagcagcuccucgagaagaacaagaccaucaagcagaugcagcagcgcaugcucgagcuccgcaagacccuccagaaggagcucaagauccgccccgacaacgagcucuucgagguccgcgagaagcccggccccgagauggccaacauggcccccuccgucaccaacaacaccgaccucaccgacgcccgcgagaucaacuucgaguaccucaagcacgucguccucaaguucauguccugccgcgaguccgaggccuuccaccucaucaaggccgucuccguccuccucaacuucucccaggaggaggagaacaugcucaaggagacccucgaguacaagauguccugguucggcuccaagcccgcccccaagggcuccauccgccccuccaucuccaacccccgcauccccugguccuga

SEQ ID NO: 43746 - RNA, 3009 nt, Artificial Sequence
  derived and/or modified sequence opt2 from GOLGA2__Homo_sapiens__NP_004477
auguggccccagccccgccuccccccccgccccgccauguccgaggagacccgccaguccaagcucgccgccgccaagaagaagcuccgcgaguaccagcagcgcaacucccccggcguccccaccggcgccaagaagaagaagaagaucaagaacggcuccaaccccgagaccaccaccuccggcggcugccacucccccgaggacacccccaaggacaacgccgccacccuccagcccuccgacgacaccguccuccccggcggcguccccucccccggcgccucccucaccuccauggccgccucccagaaccacgacgccgacaacguccccaaccucauggacgagaccaagaccuucuccuccaccgagucccuccgccagcucucccagcagcucaacggccucgucugcgaguccgccaccugcgucaacggcgagggccccgccuccuccgccaaccucaaggaccucgagucccgcuaccagcagcucgccgucgcccucgacuccuccuacgucaccaacaagcagcucaacaucaccaucgagaagcucaagcagcagaaccaggagaucaccgaccagcucgaggaggagaagaaggagugccaccagaagcagggcgcccuccgcgagcagcuccagguccacauccagaccaucggcauccucgucuccgagaaggccgagcuccagaccgcccucgcccacacccagcacgccgcccgccagaaggagggcgaguccgaggaccucgccucccgccuccaguacucccgccgccgcgucggcgagcucgagcgcgcccucuccgccgucuccacccagcagaagaaggccgaccgcuacaacaaggagcucaccaaggagcgcgacgcccuccgccucgagcucuacaagaacacccaguccaacgaggaccucaagcaggagaaguccgagcucgaggagaagcuccgcguccucgucaccgagaaggccggcaugcagcucaaccucgaggagcuccagaagaagcucgagaugaccgagcuccuccuccagcaguucuccucccgcugcgaggcccccgacgccaaccagcagcuccagcaggccauggaggagcgcgcccagcucgaggcccaccucggccaggucauggaguccguccgccagcuccagauggagcgcgacaaguacgccgagaaccucaagggcgaguccgccauguggcgccagcgcaugcagcagauguccgagcagguccacacccuccgcgaggagaaggagugcuccaugucccgcguccaggagcucgagaccucccucgccgagcuccgcaaccagauggccgagccccccccccccgagccccccgccggccccuccgaggucgagcagcagcuccaggccgaggccgagcaccuccgcaaggagcucgagggccucgccggccagcuccaggcccagguccaggacaacgagggccucucccgccucaaccgcgagcaggaggagcgccuccucgagcucgagcgcgccgccgagcucuggggcgagcaggccgaggcccgccgccagauccucgagaccaugcagaacgaccgcaccaccaucucccgcgcccucucccagaaccgcgagcucaaggagcagcucgccgagcuccaguccggcuucgucaagcucaccaacgagaacauggagaucaccuccgcccuccaguccgagcagcacgucaagcgcgagcucggcaagaagcucggcgagcuccaggagaagcucuccgagcucaaggagaccgucgagcucaagucccaggaggcccagucccuccagcagcagcgcgaccaguaccucggccaccuccagcaguacgucgccgccuaccagcagcucaccuccgagaaggagguccuccacaaccagcuccuccuccagacccagcucgucgaccagcuccagcagcaggaggcccagggcaaggccgucgccgagauggcccgccaggagcuccaggagacccaggagcgccucgaggccgccacccagcagaaccagcagcuccgcgcccagcucucccucauggcccaccccggcgagggcgacggccucgaccgcgaggaggaggaggacgaggaggaggaggaggaggaggccgucgccgucccccagcccaugcccuccauccccgaggaccucgagucccgcgaggccauggucgccuucuucaacuccgccgucgccuccgccgaggaggagcaggcccgccuccgcggccagcucaaggagcagcgcguccgcugccgccgccucgcccaccuccucgccuccgcccagaaggagcccgaggccgccgcccccgcccccggcaccggcggcgacuccgucugcggcgagacccaccgcgcccuccagggcgccauggagaagcuccagucccgcuucauggagcucaugcaggagaaggccgaccucaaggagcgcgucgaggagcucgagcaccgcugcauccagcucuccggcgagaccgacaccaucggcgaguacaucgcccucuaccagucccagcgcgccguccucaaggagcgccaccgcgagaaggaggaguacaucucccgccucgcccaggacaaggaggagaugaaggucaagcuccucgagcuccaggagcucguccuccgccucgucggcgaccgcaacgaguggcacggccgcuuccucgccgccgcccagaaccccgccgacgagcccaccuccggcgcccccgccccccaggagcucggcgccgccaaccagcagggcgaccucugcgaggucucccucgccggcuccgucgagcccgcccagggcgaggcccgcgagggcuccccccgcgacaaccccaccgcccagcagaucaugcagcuccuccgcgagaugcagaacccccgcgagcgccccggccucggcuccaaccccugcauccccuucuucuaccgcgccgacgagaacgacgaggucaagaucaccgucaucuga

SEQ ID NO: 43747 - RNA, 3405 nt, Artificial Sequence
  derived and/or modified sequence opt2 from GOLGA3__Homo_sapiens__NP_001166028
auggacggcgccuccgccgagcaggacggccuccaggaggaccgcucccacuccggccccuccucccuccccgaggccccccucaagccccccggcccccucgucccccccgaccagcaggacaagguccagugcgccgaggucaaccgcgccuccaccgagggcgagucccccgacggccccggccagggcggccucugccagaacggccccaccccccccuuccccgacccccccuccucccucgaccccaccaccucccccgucggccccgacgccucccccggcgucgccggcuuccacgacaaccuccgcaagucccagggcaccuccgccgagggcuccguccgcaaggaggcccuccagucccuccgccucucccuccccaugcaggagacccagcucugcuccaccgacuccccccucccccucgagaaggaggagcagguccgccuccaggcccgcaaguggcucgaggagcagcucaagcaguaccgcgucaagcgccagcaggagcgcuccucccagcccgccaccaagacccgccucuucuccacccucgaccccgagcucaugcucaaccccgagaaccucccccgcgccuccacccucgccaugaccaaggaguacuccuuccuccgcaccuccgucccccgcggccccaaggucggcucccucggccuccccgcccacccccgcgagaagaagaccuccaaguccuccaagauccgcucccucgccgacuaccgcaccgaggacuccaacgccggcaacuccggcggcaacguccccgcccccgacuccaccaagggcucccucaagcagaaccgcuccuccgccgccuccgucgucuccgagaucucccucucccccgacaccgacgaccgccucgagaacaccucccucgccggcgacuccgucuccgaggucgacggcaacgacuccgacuccuccuccuacuccuccgccuccacccgcggcaccuacggcauccucuccaagaccgucggcacccaggacacccccuacauggucaacggccaggagauccccgccgacacccucggccaguuccccuccaucaaggacguccuccaggccgccgccgccgagcaccaggaccagggccaggaggucaacggcgagguccgcucccgccgcgacuccaucugcuccuccgucucccucgaguccuccgccgccgagacccaggaggagaugcuccagguccucaaggagaagaugcgccucgagggccagcucgaggcccucucccucgaggccucccaggcccucaaggagaaggccgagcuccaggcccagcucgccgcccucuccaccaagcuccaggcccaggucgagugcucccacuccucccagcagcgccaggacucccucuccuccgaggucgacacccucaagcaguccugcugggaccucgagcgcgccaugaccgaccuccagaacaugcucgaggccaagaacgccucccucgccuccuccaacaacgaccuccaggucgccgaggagcaguaccagcgccucauggccaaggucgaggacaugcagcgcuccaugcucuccaaggacaacaccguccacgaccuccgccagcagaugaccgcccuccagucccagcuccagcagguccagcucgagcgcaccacccucaccuccaagcucaaggccucccaggccgagaucuccucccuccaguccguccgccagugguaccagcagcagcucgcccucgcccaggaggcccgcguccgccuccagggcgagauggcccacauccaggucggccagaugacccaggccggccuccucgagcaccucaagcucgagaacgucucccucucccagcagcucaccgagacccagcaccgcuccaugaaggagaagggccgcaucgccgcccagcuccagggcaucgaggccgacaugcucgaccaggaggccgccuucaugcagauccaggaggccaagaccauggucgaggaggaccuccagcgccgccucgaggaguucgagggcgagcgcgagcgccuccagcgcauggccgacuccgccgccucccucgagcagcagcucgagcaggucaagcucacccuccuccagcgcgaccagcagcucgaggcccuccagcaggagcaccucgaccucaugaagcagcucacccucacccaggaggcccuccagucccgcgagcagucccucgacgcccuccagacccacuacgacgagcuccaggcccgccucggcgagcuccagggcgaggccgccucccgcgaggacaccaucugccuccuccagaacgagaagaucauccucgaggccgcccuccaggccgccaaguccggcaaggaggagcucgaccgcggcgcccgccgccucgaggagggcaccgaggagaccuccgagacccucgagaagcuccgcgaggagcucgccaucaaguccggccaggucgagcaccuccagcaggagaccgccgcccucaagaagcagaugcagaagaucaaggagcaguuccuccagcagaaggucauggucgaggccuaccgccgcgacgccaccuccaaggaccagcucaucuccgagcucaaggccacccgcaagcgccucgacuccgagcucaaggagcuccgccaggagcucaugcagguccacggcgagaagcgcaccgccgaggccgagcucucccgccuccaccgcgaggucgcccagguccgccagcacauggccgaccucgagggccaccuccaguccgcccagaaggagcgcgacgagauggagacccaccuccagucccuccaguucgacaaggagcagauggucgccgucaccgaggccaacgaggcccucaagaagcagaucgaggagcuccagcaggaggcccgcaaggccaucaccgagcagaagcagaagaugcgccgccucggcuccgaccucaccuccgcccagaaggagaugaagaccaagcacaaggccuacgagaacgccgucggcauccucucccgccgccuccaggaggcccucgccgccaaggaggccgccgacgccgagcucggccagcuccgcgcccagggcggcuccuccgacuccucccucgcccuccacgagcgcauccaggcccucgaggccgagcuccaggccgucucccacuccaagacccuccucgagaaggagcuccaggaggucaucgcccucaccucccaggagcucgaggagucccgcgagaagguccucgagcucgaggacgagguccgccccggccaccuccucuggcgccagcgcggcgccggccacgucucccccggccacgccgccacccgcgagacccgccgcaccaagcuccaccgcguccccuccgucgccaccuucggcgucgccaccuucuga

SEQ ID NO: 43748 - RNA, 6732 nt, Artificial Sequence
  derived and/or modified sequence opt2 from GOLGA4__Homo_sapiens__NP_001166184
auguucaagaagcucaagcagaagaucuccgaggagcagcagcagcuccagcaggcccucgcccccgcccaggccuccuccaacuccuccacccccacccgcaugcgcucccgcaccuccuccuucaccgagcagcucgacgagggcacccccaaccgcgagaacgccuccacccacgccuccaagucccccgacuccgucaacggcuccgagcccuccaucccccaguccggcgacacccaguccuucgcccagaagcuccagcuccgcguccccuccgucgagucccucuuccgcucccccaucaaggagucccucuuccgcuccuccuccaaggagucccucguccgcaccuccucccgcgagucccucaaccgccucgaccucgacuccuccaccgccuccuucgacccccccuccgacauggacuccgaggccgaggaccucgucggcaacuccgacucccucaacaaggagcagcucauccagcgccuccgccgcauggagcgcucccucuccuccuaccgcggcaaguacuccgagcucgucaccgccuaccagaugcuccagcgcgagaagaagaagcuccagggcauccucucccagucccaggacaagucccuccgccgcaucgccgagcuccgcgaggagcuccagauggaccagcaggccaagaagcaccuccaggaggaguucgacgccucccucgaggagaaggaccaguacaucuccguccuccagacccaggucucccuccucaagcagcgccuccgcaacggccccaugaacgucgacguccucaagccccucccccagcucgagccccaggccgaggucuucaccaaggaggagaaccccgaguccgacggcgagcccgucgucgaggacggcaccuccgucaagacccucgagacccuccagcagcgcgucaagcgccaggagaaccuccucaagcgcugcaaggagaccauccagucccacaaggagcagugcacccuccucaccuccgagaaggaggcccuccaggagcagcucgacgagcgccuccaggagcucgagaagaucaaggaccuccacauggccgagaagaccaagcucaucacccagcuccgcgacgccaagaaccucaucgagcagcucgagcaggacaagggcauggucaucgccgagaccaagcgccagaugcacgagacccucgagaugaaggaggaggagaucgcccagcuccgcucccgcaucaagcagaugaccacccagggcgaggagcuccgcgagcagaaggagaaguccgagcgcgccgccuucgaggagcucgagaaggcccucuccaccgcccagaagaccgaggaggcccgccgcaagcucaaggccgagauggacgagcagaucaagaccaucgagaagaccuccgaggaggagcgcaucucccuccagcaggagcucucccgcgucaagcaggaggucgucgacgucaugaagaaguccuccgaggagcagaucgccaagcuccagaagcuccacgagaaggagcucgcccgcaaggagcaggagcucaccaagaagcuccagacccgcgagcgcgaguuccaggagcagaugaaggucgcccucgagaagucccaguccgaguaccucaagaucucccaggagaaggagcagcaggagucccucgcccucgaggagcucgagcuccagaagaaggccauccucaccgaguccgagaacaagcuccgcgaccuccagcaggaggccgagaccuaccgcacccgcauccucgagcucgaguccucccucgagaagucccuccaggagaacaagaaccaguccaaggaccucgccguccaccucgaggccgagaagaacaagcacaacaaggagaucaccgucauggucgagaagcacaagaccgagcucgagucccucaagcaccagcaggacgcccucuggaccgagaagcuccagguccucaagcagcaguaccagaccgagauggagaagcuccgcgagaagugcgagcaggagaaggagacccuccucaaggacaaggagaucaucuuccaggcccacaucgaggagaugaacgagaagacccucgagaagcucgacgucaagcagaccgagcucgagucccucuccuccgagcucuccgagguccucaaggcccgccacaagcucgaggaggagcucuccguccucaaggaccagaccgacaagaugaagcaggagcucgaggccaagauggacgagcagaagaaccaccaccagcagcaggucgacuccaucaucaaggagcacgaggucuccauccagcgcaccgagaaggcccucaaggaccagaucaaccagcucgagcuccuccucaaggagcgcgacaagcaccucaaggagcaccaggcccacgucgagaaccucgaggccgacaucaagcgcuccgagggcgagcuccagcaggccuccgccaagcucgacgucuuccaguccuaccaguccgccacccacgagcagaccaaggccuacgaggagcagcucgcccagcuccagcagaagcuccucgaccucgagaccgagcgcauccuccucaccaagcaggucgccgaggucgaggcccagaagaaggacgucugcaccgagcucgacgcccacaagauccagguccaggaccucaugcagcagcucgagaagcagaacuccgagauggagcagaaggucaagucccucacccaggucuacgaguccaagcucgaggacggcaacaaggagcaggagcagaccaagcagauccucgucgagaaggagaacaugauccuccagaugcgcgagggccagaagaaggagaucgagauccucacccagaagcucuccgccaaggaggacuccauccacauccucaacgaggaguacgagaccaaguucaagaaccaggagaagaagauggagaaggucaagcagaaggccaaggagaugcaggagacccucaagaagaagcuccucgaccaggaggccaagcucaagaaggagcucgagaacaccgcccucgagcucucccagaaggagaagcaguucaacgccaagaugcucgagauggcccaggccaacuccgccggcaucuccgacgccgucucccgccucgagaccaaccagaaggagcagaucgagucccucaccgagguccaccgccgcgagcucaacgacgucaucuccaucugggagaagaagcucaaccagcaggccgaggagcuccaggagauccacgagauccagcuccaggagaaggagcaggaggucgccgagcucaagcagaagauccuccucuucggcugcgagaaggaggagaugaacaaggagaucaccuggcucaaggaggagggcgucaagcaggacaccacccucaacgagcuccaggagcagcucaagcagaaguccgcccacgucaacucccucgcccaggacgagaccaagcucaaggcccaccucgagaagcucgaggucgaccucaacaagucccucaaggagaacaccuuccuccaggagcagcucgucgagcucaagaugcucgccgaggaggacaagcgcaaggucuccgagcucaccuccaagcucaagaccaccgacgaggaguuccagucccucaaguccucccacgagaaguccaacaagucccucgaggacaagucccucgaguucaagaagcucuccgaggagcucgccauccagcucgacaucugcugcaagaagaccgaggcccuccucgaggccaagaccaacgagcucaucaacaucuccuccuccaagaccaacgccauccucucccgcaucucccacugccagcaccgcaccaccaaggucaaggaggcccuccucaucaagaccugcaccgucuccgagcucgaggcccagcuccgccagcucaccgaggagcagaacacccucaacaucuccuuccagcaggccacccaccagcucgaggagaaggagaaccagaucaaguccaugaaggccgacaucgagucccucgucaccgagaaggaggcccuccagaaggagggcggcaaccagcagcaggccgccuccgagaaggaguccugcaucacccagcucaagaaggagcucuccgagaacaucaacgccgucacccucaugaaggaggagcucaaggagaagaaggucgagaucuccucccucuccaagcagcucaccgaccucaacguccagcuccagaacuccaucucccucuccgagaaggaggccgccaucuccucccuccgcaagcaguacgacgaggagaagugcgagcuccucgaccagguccaggaccucuccuucaaggucgacacccucuccaaggagaagaucuccgcccucgagcaggucgacgacugguccaacaaguucuccgaguggaagaagaaggcccagucccgcuucacccagcaccagaacaccgucaaggagcuccagauccagcucgagcucaaguccaaggaggccuacgagaaggacgagcagaucaaccuccucaaggaggagcucgaccagcagaacaagcgcuucgacugccucaagggcgagauggaggacgacaaguccaagauggagaagaaggaguccaaccucgagaccgagcucaagucccagaccgcccgcaucauggagcucgaggaccacaucacccagaagaccaucgagaucgagucccucaacgagguccucaagaacuacaaccagcagaaggacaucgagcacaaggagcucguccagaagcuccagcacuuccaggagcucggcgaggagaaggacaaccgcgucaaggaggccgaggagaagauccucacccucgagaaccaggucuacuccaugaaggccgagcucgagaccaagaagaaggagcucgagcacgucaaccucuccgucaaguccaaggaggaggagcucaaggcccucgaggaccgccucgaguccgaguccgccgccaagcucgccgagcucaagcgcaaggccgagcagaagaucgccgccaucaagaagcagcuccucucccagauggaggagaaggaggagcaguacaagaagggcaccgagucccaccucuccgagcucaacaccaagcuccaggagcgcgagcgcgagguccacauccucgaggagaagcucaaguccgucgaguccucccaguccgagacccucaucgucccccgcuccgccaagaacgucgccgccuacaccgagcaggaggaggccgacucccagggcugcguccagaagaccuacgaggagaagaucuccguccuccagcgcaaccucaccgagaaggagaagcuccuccagcgcgucggccaggagaaggaggagaccgucuccucccacuucgagaugcgcugccaguaccaggagcgccucaucaagcucgagcacgccgaggccaagcagcacgaggaccaguccaugaucggccaccuccaggaggagcucgaggagaagaacaagaaguacucccucaucgucgcccagcacgucgagaaggagggcggcaagaacaacauccaggccaagcagaaccucgagaacgucuucgacgacguccagaagacccuccaggagaaggagcucaccugccagauccucgagcagaagaucaaggagcucgacuccugccucguccgccagaaggagguccaccgcgucgagauggaggagcucaccuccaaguacgagaagcuccaggcccuccagcagauggacggccgcaacaagcccaccgagcuccucgaggagaacaccgaggagaaguccaagucccaccucguccagcccaagcuccucuccaacauggaggcccagcacaacgaccucgaguucaagcucgccggcgccgagcgcgagaagcagaagcucggcaaggagaucguccgccuccagaaggaccuccgcaugcuccgcaaggagcaccagcaggagcucgagauccucaagaaggaguacgaccaggagcgcgaggagaagaucaagcaggagcaggaggaccucgagcucaagcacaacuccacccucaagcagcucaugcgcgaguucaacacccagcucgcccagaaggagcaggagcucgagaugaccaucaaggagaccaucaacaaggcccaggaggucgaggccgagcuccucgagucccaccaggaggagaccaaccagcuccucaagaagaucgccgagaaggacgacgaccucaagcgcaccgccaagcgcuacgaggagauccucgacgcccgcgaggaggagaugaccgccaagguccgcgaccuccagacccagcucgaggagcuccagaagaaguaccagcagaagcucgagcaggaggagaaccccggcaacgacaacacccagcucgcccagaagaccacccucaucuccgacuccaagcucaaggagcaggaguuccgcgagcagauccacaaccucgaggaccgccucaagaaguacgagaagaacgucuacgccaccaccgucggcacccccuacaagggcggcaaccucuaccacaccgacgucucccucuucggcgagcccaccgaguucgaguaccuccgcaagguccucuucgaguacaugaugggccgcgagaccaagaccauggccaaggucaucaccaccguccucaaguuccccgacgaccagacccagaagauccucgagcgcgaggacgcccgccucauguccuggcuccgcuccuccuccuga

SEQ ID NO: 43749 - RNA, 2196 nt, Artificial Sequence
  derived and/or modified sequence opt2 from GOLGA5__Homo_sapiens__NP_005104
auguccugguucgucgaccucgccggcaaggccgaggaccuccucaaccgcgucgaccagggcgccgccaccgcccucucccgcaaggacaacgccuccaacaucuacuccaagaacaccgacuacaccgagcuccaccagcagaacaccgaccucaucuaccagaccggccccaaguccaccuacaucuccuccgccgccgacaacauccgcaaccagaaggccaccauccucgccggcaccgccaacgucaaggucggcucccgcacccccgucgaggccucccaccccgucgagaacgccuccgucccccgccccuccucccacuucguccgccgcaagaaguccgagcccgacgacgagcuccucuucgacuuccucaacuccucccagaaggagcccaccggccgcgucgagauccgcaaggagaagggcaagacccccgucuuccaguccucccagaccuccuccgucuccuccgucaaccccuccgucaccaccaucaagaccaucgaggagaacuccuucggcucccagacccacgaggccgccuccaacuccgacuccucccacgagggccaggaggaguccuccaaggagaacgucuccuccaacgccgccugccccgaccacacccccacccccaacgacgacggcaagucccacgagcucuccaaccuccgccucgagaaccagcuccuccgcaacgagguccagucccucaaccaggagauggccucccuccuccagcgcuccaaggagacccaggaggagcucaacaaggcccgcgcccgcgucgagaaguggaacgccgaccacuccaaguccgaccgcaugacccgcggccuccgcgcccaggucgacgaccucaccgaggccgucgccgccaaggacucccagcucgccguccucaagguccgccuccaggaggccgaccagcuccucuccacccgcaccgaggcccucgaggcccuccaguccgagaagucccgcaucaugcaggaccaguccgagggcaacucccuccagaaccaggcccuccagacccuccaggagcgccuccacgaggccgacgccacccucaagcgcgagcaggaguccuacaagcagaugcaguccgaguucgccgcccgccucaacaaggucgagauggagcgccagaaccucgccgaggccaucacccucgccgagcgcaaguacuccgacgagaagaagcgcgucgacgagcuccagcagcaggucaagcucuacaagcucaaccucgaguccuccaagcaggagcucaucgacuacaagcagaaggccacccgcauccuccaguccaaggagaagcucaucaacucccucaaggagggcuccggcuucgagggccucgacuccuccaccgccuccuccauggagcucgaggagcuccgccacgagaaggagaugcagcgcgaggagauccagaagcucaugggccagauccaccagcuccgcuccgagcuccaggacauggaggcccagcaggucaacgaggccgaguccgcccgcgagcagcuccaggaccuccacgaccagaucgccggccagaaggccuccaagcaggagcucgagaccgagcucgagcgccucaagcaggaguuccacuacaucgaggaggaccucuaccgcaccaagaacacccuccagucccgcaucaaggaccgcgacgaggagauccagaagcuccgcaaccagcucaccaacaagacccucuccaacuccucccaguccgagcucgagaaccgccuccaccagcucaccgagacccucauccagaagcagaccaugcucgagucccucuccaccgagaagaacucccucgucuuccagcucgagcgccucgagcagcagaugaacuccgccuccggcuccuccuccaacggcuccuccaucaacauguccggcaucgacaacggcgagggcacccgccuccgcaacguccccguccucuucaacgacaccgagaccaaccucgccggcauguacggcaagguccgcaaggccgccuccuccaucgaccaguucuccauccgccucggcaucuuccuccgccgcuaccccaucgcccgcgucuucgucaucaucuacauggcccuccuccaccucugggucaugaucguccuccucaccuacacccccgagaugcaccacgaccagcccuacggcaaguga

SEQ ID NO: 43750 - RNA, 1812 nt, Artificial Sequence
  derived and/or modified sequence opt2 from GOLGA8B__Homo_sapiens__NP_001018861
auggccgaggagaccggccaguccaagcucgccgccgccaagaagaaguucaaggaguacuggcagcgcaaccgccccggcguccccgccgccgccaagcgcaacaccaaggccaacggcuccucccccgagaccgccgccuccggcggcugccacuccuccgaggccuccuccuccgccuccuccucccuccacgcccgccagucccccugccaggagcaggccgccguccucaacucccgcuccaucaagaucucccgccucaacgacaccaucaagucccucaagcagcagaagaagcaggucgagcaccagcucgaggaggagaagaaggccaacaacgagaagcagaaggccgagcgcgagcucgagggccagauccagcgccucaacaccgagaagaagaagcucaacaccgaccucuaccacaugaagcacucccuccgcuacuucgaggaggaguccaaggaccucgccggccgccuccagcgcuccucccagcgcaucggcgagcucgaguggucccucugcgccgucgccgccacccagaagaagaagcccgacggcuucuccucccgcuccaaggcccuccucaagcgccagcucgagcaguccauccgcgagcagauccuccucaagggccacgucacccagcucaaggagucccucaaggagguccagcucgagcgcgaccaguacgccgagcagaucaagggcgagcgcgcccaguggcagcagcgcaugcgcaagaugucccaggaggucugcacccucaaggaggagaagaagcacgacacccaccgcgucgaggagcucgagcgcucccucucccgccucaagaaccagauggccgagccccucccccccgacgcccccgccgucuccuccgaggucgagcuccaggaccuccgcaaggagcucgagcgcgucgccggcgagcuccaggcccaggucgagaacaaccagugcaucucccuccucaaccgcggccagaaggagcgccuccgcgagcaggaggagcgccuccaggagcagcaggagcgccuccgcgagcgcgagaagcgccuccagcagcucgccgagccccaguccgaccucgaggagcucaagcacgagaacaaguccgcccuccagcucgagcagcaggucaaggagcuccaggagaagcucggccaggucauggagacccucaccuccgccgagaaggagcccgaggccgccguccccgccuccggcaccggcggcgaguccuccggccucauggaccuccucgaggagaaggccgaccuccgcgagcacgucgagaagcucgagcucggcuucauccaguaccgccgcgagcgcugccaccagaagguccaccgccuccucaccgagcccggcgacuccgccaaggacgccucccccggcggcggccaccaccaggccggccccggccagggcggcgaggagggcgaggccgccggcgccgccggcgacggcgucgccgccugcggcuccuacuccgagggccacggcaaguuccucgccgccgcccgcaaccccgccgccgagcccucccccggcgcccccgccccccaggagcucggcgccgccgacaagcacggcgaccucugcgaggccucccucaccaacuccgucgagcccgcccagggcgaggcccgcgagggcuccucccaggacaaccccaccgcccagcccguccuccagcuccucggcgagaugcaggaccaccaggagcaccccggccucggcuccaacugcugcguccccugcuucugcugggccuggcucccccgccgccgccgcuga

SEQ ID NO: 43751 - RNA, 9810 nt, Artificial Sequence
  derived and/or modified sequence opt2 from GOLGB1__Homo_sapiens__NP_001243415
augcucucccgccucuccggccucgccaacgucguccuccacgagcucuccggcgacgacgacaccgaccagaacaugcgcgccccccucgaccccgagcuccaccaggaguccgacauggaguucaacaacaccacccaggaggacguccaggagcgccucgccuacgccgagcagcucgucgucgagcucaaggacaucauccgccagaaggacguccagcuccagcagaaggacgaggcccuccaggaggagcgcaaggccgccgacaacaagaucaagaagcucaagcuccacgccaaggccaagcucaccucccucaacaaguacaucgaggagaugaaggcccagggcggcaccguccuccccaccgagccccaguccgaggagcagcucuccaagcacgacaaguccuccaccgaggaggagauggagaucgagaagaucaagcacaagcuccaggagaaggaggagcucaucuccacccuccaggcccagcucacccaggcccaggccgagcagcccgcccaguccuccaccgagauggaggaguucgucaugaugaagcagcagcuccaggagaaggaggaguucaucuccacccuccaggcccagcucucccagacccaggccgagcaggccgcccagcucuccuccaugcagcaggucguccgcgagaaggacgcccgcuucgagacccagguccgccuccacgaggacgagcuccuccagcucgucacccaggccgacgucgagaccgagaugcagcagaagcuccgcguccuccagcgcaagcucgaggagcacgaggagucccucgucggccgcgcccaggucgucgaccuccuccagcaggagcucaccgccgccgagcagcgcaaccagauccucucccagcagcuccagcagauggaggccgagcacaacacccuccgcaacaccgucgagaccgagcgcgaggaguccaagauccuccucgagaagauggagcucgaggucgccgagcgcaagcucuccuuccacaaccuccaggaggagaugcaccaccuccucgagcaguucgagcaggccggccaggcccaggccgagcucgagucccgcuacuccgcccucgagcagaagcacaaggccgagauggaggagaagaccucccacauccucucccuccagaagaccggccaggagcuccaguccgccugcgacgcccucaaggaccagaacuccaagcuccuccaggacaagaacgagcaggccguccaguccgcccagaccauccagcagcucgaggaccagcuccagcagaaguccaaggagaucucccaguuccucaaccgccucccccuccagcagcacgagaccgccucccagaccuccuuccccgacgucuacaacgagggcacccaggccgucaccgaggagaacaucgccucccuccagaagcgcgucgucgagcucgagaacgagaagggcgcccuccuccucuccuccaucgagcucgaggagcucaaggccgagaacgagaagcucuccucccagaucacccuccucgaggcccagaaccgcaccggcgaggccgaccgcgaggucuccgagaucuccaucgucgacaucgccaacaagcgcuccuccuccgccgaggaguccggccaggacguccucgagaacaccuucucccagaagcacaaggagcucuccguccuccuccucgagaugaaggaggcccaggaggagaucgccuuccucaagcuccagcuccagggcaagcgcgccgaggaggccgaccacgagguccucgaccagaaggagaugaagcagauggagggcgagggcaucgcccccaucaagaugaaggucuuccucgaggacaccggccaggacuucccccucaugcccaacgaggaguccucccuccccgccgucgagaaggagcaggccuccaccgagcaccagucccgcaccuccgaggagaucucccucaacgacgccggcgucgagcucaaguccaccaagcaggacggcgacaagucccucuccgccguccccgacaucggccagugccaccaggacgagcucgagcgccucaagucccagauccucgagcucgagcucaacuuccacaaggcccaggagaucuacgagaagaaccucgacgagaaggccaaggagaucuccaaccucaaccagcucaucgaggaguucaagaagaacgccgacaacaacuccuccgccuucaccgcccucuccgaggagcgcgaccagcuccucucccaggucaaggagcucuccauggucaccgagcuccgcgcccaggucaagcagcucgagaugaaccucgccgaggccgagcgccagcgccgccucgacuacgagucccagaccgcccacgacaaccuccucaccgagcagauccacucccucuccaucgaggccaaguccaaggacgucaagaucgagguccuccagaacgagcucgacgacguccagcuccaguucuccgagcaguccacccucauccgcucccuccagucccagcuccagaacaaggaguccgagguccucgagggcgccgagcgcguccgccacaucuccuccaaggucgaggagcucucccaggcccucucccagaaggagcucgagaucaccaagauggaccagcuccuccucgagaagaagcgcgacgucgagacccuccagcagaccaucgaggagaaggaccagcaggucaccgagaucuccuucuccaugaccgagaagaugguccagcucaacgaggagaaguucucccucggcgucgagaucaagacccucaaggagcagcucaaccuccucucccgcgccgaggaggccaagaaggagcaggucgaggaggacaacgaggucuccuccggccucaagcagaacuacgacgagaugucccccgccggccagaucuccaaggaggagcuccagcacgaguucgaccuccucaagaaggagaacgagcagcgcaagcgcaagcuccaggccgcccucaucaaccgcaaggagcuccuccagcgcgucucccgccucgaggaggagcucgccaaccucaaggacgaguccaagaaggagaucccccucuccgagaccgagcgcggcgaggucgaggaggacaaggagaacaaggaguacuccgagaagugcgucaccuccaagugccaggagaucgagaucuaccucaagcagaccaucuccgagaaggaggucgagcuccagcacauccgcaaggaccucgaggagaagcucgccgccgaggagcaguuccaggcccucgucaagcagaugaaccagacccuccaggacaagaccaaccagaucgaccuccuccaggccgagaucuccgagaaccaggccaucauccagaagcucaucaccuccaacaccgacgccuccgacggcgacuccgucgcccucgucaaggagaccgucgucaucuccccccccugcaccggcuccuccgagcacuggaagcccgagcucgaggagaagauccucgcccucgagaaggagaaggagcagcuccagaagaagcuccaggaggcccucaccucccgcaaggccauccucaagaaggcccaggagaaggagcgccaccuccgcgaggagcucaagcagcagaaggacgacuacaaccgccuccaggagcaguucgacgagcaguccaaggagaacgagaacaucggcgaccagcuccgccagcuccagauccagguccgcgaguccaucgacggcaagcuccccuccaccgaccagcaggaguccugcuccuccacccccggccucgaggagccccucuucaaggccaccgagcagcaccacacccagcccguccucgaguccaaccucugccccgacuggcccucccacuccgaggacgccuccgcccuccagggcggcaccuccgucgcccagaucaaggcccagcucaaggagaucgaggccgagaaggucgagcucgagcucaaggucuccuccaccaccuccgagcucaccaagaaguccgaggaggucuuccagcuccaggagcagaucaacaagcagggccucgagaucgagucccucaagaccgucucccacgaggccgagguccacgccgagucccuccagcagaagcucgaguccucccagcuccagaucgccggccucgagcaccuccgcgagcuccagcccaagcucgacgagcuccagaagcucaucuccaagaaggaggaggacgucuccuaccucuccggccagcucuccgagaaggaggccgcccucaccaagauccagaccgagaucaucgagcaggaggaccucaucaaggcccuccacacccagcucgagaugcaggccaaggagcacgacgagcgcaucaagcagcuccaggucgagcucugcgagaugaagcagaagcccgaggagaucggcgaggagucccgcgccaagcagcagauccagcgcaagcuccaggccgcccucaucucccgcaaggaggcccucaaggagaacaagucccuccaggaggagcucucccucgcccgcggcaccaucgagcgccucaccaagucccucgccgacgucgagucccaggucuccgcccagaacaaggagaaggacaccguccucggccgccucgcccuccuccaggaggagcgcgacaagcucaucaccgagauggaccgcucccuccucgagaaccagucccucuccuccuccugcgagucccucaagcucgcccucgagggccucaccgaggacaaggagaagcucgucaaggagaucgagucccucaaguccuccaagaucgccgaguccaccgaguggcaggagaagcacaaggagcuccagaaggaguacgagauccuccuccaguccuacgagaacgucuccaacgaggccgagcgcauccagcacgucgucgaggccguccgccaggagaagcaggagcucuacggcaagcuccgcuccaccgaggccaacaagaaggagaccgagaagcagcuccaggaggccgagcaggagauggaggagaugaaggagaagaugcgcaaguucgccaaguccaagcagcagaagauccucgagcucgaggaggagaacgaccgccuccgcgccgagguccaccccgccggcgacaccgccaaggagugcauggagacccuccucuccuccaacgccuccaugaaggaggagcucgagcgcgucaagauggaguacgagacccucuccaagaaguuccagucccucauguccgagaaggacucccucuccgaggagguccaggaccucaagcaccagaucgagggcaacgucuccaagcaggccaaccucgaggccaccgagaagcacgacaaccagaccaacgucaccgaggagggcacccaguccauccccggcgagaccgaggagcaggacucccucuccauguccacccgccccaccugcuccgaguccguccccuccgccaaguccgccaaccccgccgucuccaaggacuucuccucccacgacgagaucaacaacuaccuccagcagaucgaccagcucaaggagcgcaucgccggccucgaggaggagaagcagaagaacaaggaguucucccagacccucgagaacgagaagaacacccuccucucccagaucuccaccaaggacggcgagcucaagaugcuccaggaggaggucaccaagaugaaccuccucaaccagcagauccaggaggagcucucccgcgucaccaagcucaaggagaccgccgaggaggagaaggacgaccucgaggagcgccucaugaaccagcucgccgagcucaacggcuccaucggcaacuacugccaggacgucaccgacgcccagaucaagaacgagcuccucgaguccgagaugaagaaccucaagaagugcgucuccgagcucgaggaggagaagcagcagcucgucaaggagaagaccaaggucgaguccgagauccgcaaggaguaccucgagaagauccagggcgcccagaaggagcccggcaacaagucccacgccaaggagcuccaggagcuccucaaggagaagcagcaggaggucaagcagcuccagaaggacugcauccgcuaccaggagaagaucuccgcccucgagcgcaccgucaaggcccucgaguucguccagaccgagucccagaaggaccucgagaucaccaaggagaaccucgcccaggccgucgagcaccgcaagaaggcccaggccgagcucgccuccuucaagguccuccucgacgacacccaguccgaggccgcccgcguccucgccgacaaccucaagcucaagaaggagcuccaguccaacaaggaguccgucaagucccagaugaagcagaaggacgaggaccucgagcgccgccucgagcaggccgaggagaagcaccucaaggagaagaagaacaugcaggagaagcucgacgcccuccgccgcgagaagguccaccucgaggagaccaucggcgagauccaggucacccucaacaagaaggacaaggagguccagcagcuccaggagaaccucgacuccaccgucacccagcucgccgccuucaccaaguccauguccucccuccaggacgaccgcgaccgcgucaucgacgaggccaagaagugggagcgcaaguucuccgacgccauccaguccaaggaggaggagauccgccucaaggaggacaacugcuccguccucaaggaccagcuccgccagauguccauccacauggaggagcucaagaucaacaucucccgccucgagcacgacaagcagaucugggaguccaaggcccagaccgagguccagcuccagcagaaggucugcgacacccuccagggcgagaacaaggagcuccucucccagcucgaggagacccgccaccucuaccacuccucccagaacgagcucgccaagcucgaguccgagcucaagucccucaaggaccagcucaccgaccucuccaacucccucgagaagugcaaggagcagaagggcaaccucgagggcaucauccgccagcaggaggccgacauccagaacuccaaguucuccuacgagcagcucgagaccgaccuccaggccucccgcgagcucaccucccgccuccacgaggagaucaacaugaaggagcagaagaucaucucccuccucuccggcaaggaggaggccauccaggucgccaucgccgagcuccgccagcagcacgacaaggagaucaaggagcucgagaaccuccucucccaggaggaggaggagaacaucguccucgaggaggagaacaagaaggccgucgacaagaccaaccagcucauggagacccucaagaccaucaagaaggagaacauccagcagaaggcccagcucgacuccuucgucaaguccauguccucccuccagaacgaccgcgaccgcaucgucggcgacuaccagcagcucgaggagcgccaccucuccaucauccucgagaaggaccagcucauccaggaggccgccgccgagaacaacaagcucaaggaggagauccgcggccuccgcucccacauggacgaccucaacuccgagaacgccaagcucgacgccgagcucauccaguaccgcgaggaccucaaccaggucaucaccaucaaggacucccagcagaagcagcuccucgagguccagcuccagcagaacaaggagcucgagaacaaguacgccaagcucgaggagaagcucaaggaguccgaggaggccaacgaggaccuccgccgcuccuucaacgcccuccaggaggagaagcaggaccucuccaaggagaucgagucccucaaggucuccaucucccagcucacccgccaggucaccgcccuccaggaggagggcacccucggccucuaccacgcccagcucaaggucaaggaggaggagguccaccgccucuccgcccucuucuccuccucccagaagcgcaucgccgagcucgaggaggagcucgucugcguccagaaggaggccgccaagaaggucggcgagaucgaggacaagcucaagaaggagcucaagcaccuccaccacgacgccggcaucaugcgcaacgagaccgagaccgccgaggagcgcgucgccgagcucgcccgcgaccucgucgagauggagcagaagcuccucauggucaccaaggagaacaagggccucaccgcccagauccaguccuucggccgcuccauguccucccuccagaacucccgcgaccacgccaacgaggagcucgacgagcucaagcgcaaguacgacgccucccucaaggagcucgcccagcucaaggagcagggccuccucaaccgcgagcgcgacgcccuccucuccgagaccgccuucuccaugaacuccaccgaggagaacucccucucccaccucgagaagcucaaccagcagcuccucuccaaggacgagcagcuccuccaccucuccucccagcucgaggacuccuacaaccagguccaguccuucuccaaggccauggccucccuccagaacgagcgcgaccaccucuggaacgagcucgagaaguuccgcaaguccgaggagggcaagcagcgcuccgccgcccagcccuccaccucccccgccgagguccagucccucaagaaggccauguccucccuccagaacgaccgcgaccgccuccucaaggagcucaagaaccuccagcagcaguaccuccagaucaaccaggagaucaccgagcuccacccccucaaggcccagcuccaggaguaccaggacaagaccaaggccuuccagaucaugcaggaggagcuccgccaggagaaccucuccuggcagcacgagcuccaccagcuccgcauggagaaguccuccugggagauccacgagcgccgcaugaaggagcaguaccucauggccaucuccgacaaggaccagcagcucucccaccuccagaaccucauccgcgagcuccgcuccuccuccucccagacccagccccucaagguccaguaccagcgccaggccucccccgagaccuccgccucccccgacggcucccagaaccucgucuacgagaccgagcuccuccgcacccagcucaacgacucccucaaggagauccaccagaaggagcuccgcauccagcagcucaacuccaacuucucccagcuccucgaggagaagaacacccucuccauccagcucugcgacaccucccagucccuccgcgagaaccagcagcacuacggcgaccuccucaaccacugcgccguccucgagaagcagguccaggagcuccaggccgucuccaaggagaagggcccccucaacaucgacgucgcccccggcgccccccaggagaagaacggcguccaccgcaaguccgaccccgaggagcuccgcgagccccagcaguccuucuccgaggcccagcagcagcucugcaacacccgccaggaggucaacgagcuccgcaagcuccucgaggaggagcgcgaccagcgcgucgccgccgagaacgcccucuccgucgccgaggagcagauccgccgccucgagcacuccgagugggacuccucccgcacccccaucaucggcuccugcggcacccaggagcaggcccuccucaucgaccucaccuccaacuccugccgccgcacccgcuccggcgucggcuggaagcgcguccuccgcucccucugccacucccgcacccgcgucccccuccucgccgccaucuacuuccucaugauccacguccuccucauccucugcuucaccggccaccucuga

SEQ ID NO: 43752 - RNA, 1206 nt, Artificial Sequence
  derived and/or modified sequence opt2 from GOLM1__Homo_sapiens__NP_808800
augaugggccucggcaacggccgccgcuccaugaagucccccccccucguccucgccgcccucgucgccugcaucaucguccucggcuucaacuacuggaucgccuccucccgcuccgucgaccuccagacccgcaucauggagcucgagggccgcguccgccgcgccgccgccgagcgcggcgccgucgagcucaagaagaacgaguuccagggcgagcucgagaagcagcgcgagcagcucgacaagauccaguccucccacaacuuccagcucgaguccgucaacaagcucuaccaggacgagaaggccguccucgucaacaacaucaccaccggcgagcgccucauccgcguccuccaggaccagcucaagacccuccagcgcaacuacggccgccuccagcaggacguccuccaguuccagaagaaccagaccaaccucgagcgcaaguucuccuacgaccucucccagugcaucaaccagaugaaggaggucaaggagcagugcgaggagcgcaucgaggaggucaccaagaagggcaacgaggccgucgccucccgcgaccucuccgagaacaacgaccagcgccagcagcuccaggcccucuccgagccccagccccgccuccaggccgccggccucccccacaccgaggucccccagggcaagggcaacguccucggcaacuccaagucccagacccccgcccccuccuccgaggucguccucgacuccaagcgccaggucgagaaggaggagaccaacgagauccaggucgucaacgaggagccccagcgcgaccgccucccccaggagcccggccgcgagcaggucgucgaggaccgccccgucggcggccgcggcuucggcggcgccggcgagcucggccagaccccccagguccaggccgcccucuccgucucccaggagaaccccgagauggagggccccgagcgcgaccagcucgucauccccgacggccaggaggaggagcaggaggccgccggcgagggccgcaaccagcagaagcuccgcggcgaggacgacuacaacauggacgagaacgaggccgaguccgagaccgacaagcaggccgcccucgccggcaacgaccgcaacaucgacgucuucaacgucgaggaccagaagcgcgacaccaucaaccuccucgaccagcgcgagaagcgcaaccacacccucuga

SEQ ID NO: 43753 - RNA, 897 nt, Artificial Sequence
  derived and/or modified sequence opt2 from GOLPH3__Homo_sapiens__NP_071413
augaccucccucacccagcgcuccuccggccucguccagcgccgcaccgaggccucccgcaacgccgccgacaaggagcgcgccgccggcggcggcgccggcuccuccgaggacgacgcccagucccgccgcgacgagcaggacgacgacgacaagggcgacuccaaggagacccgccucacccucauggaggagguccuccuccucggccucaaggaccgcgagggcuacaccuccuucuggaacgacugcaucuccuccggccuccgcggcugcaugcucaucgagcucgcccuccgcggccgccuccagcucgaggccugcggcaugcgccgcaagucccuccucacccgcaaggucaucugcaaguccgacgcccccaccggcgacguccuccucgacgaggcccucaagcacgucaaggagacccagccccccgagaccguccagaacuggaucgagcuccucuccggcgagaccuggaacccccucaagcuccacuaccagcuccgcaacguccgcgagcgccucgccaagaaccucgucgagaagggcguccucaccaccgagaagcagaacuuccuccucuucgacaugaccacccacccccucaccaacaacaacaucaagcagcgccucaucaagaagguccaggaggccguccucgacaagugggucaacgacccccaccgcauggaccgccgccuccucgcccucaucuaccucgcccacgccuccgacguccucgagaacgccuucgccccccuccucgacgagcaguacgaccucgccaccaagcgcguccgccagcuccucgaccucgaccccgaggucgagugccucaaggccaacaccaacgagguccucugggccgucgucgccgccuucaccaaguga

SEQ ID NO: 43754 - RNA, 399 nt, Artificial Sequence
  derived and/or modified sequence opt2 from GOLT1A__Homo_sapiens__NP_940849
augaucuccaucaccgaguggcagaagaucggcgucggcaucaccggcuucggcaucuucuucauccucuucggcacccuccucuacuucgacuccguccuccucgccuucggcaaccuccucuuccucaccggccucucccucaucaucggccuccgcaagaccuucugguucuucuuccagcgccacaagcucaagggcaccuccuuccuccucggcggcgucgucaucguccuccuccgcuggccccuccucggcauguuccucgagaccuacggcuucuucucccucuucaagggcuucuuccccgucgccuucggcuuccucggcaacgucugcaacauccccuuccucggcgcccucuuccgccgccuccagggcaccuccuccauggucuga

SEQ ID NO: 43755 - RNA, 417 nt, Artificial Sequence
  derived and/or modified sequence opt2 from GOLT1B__Homo_sapiens__NP_057156
augaucucccucaccgacacccagaagaucggcaugggccucaccggcuucggcgucuucuuccucuucuucggcaugauccucuucuucgacaaggcccuccucgccaucggcaacguccucuucgucgccggccucgccuucgucaucggccucgagcgcaccuuccgcuucuucuuccagaagcacaagaugaaggccaccggcuucuuccucggcggcgucuucgucguccucaucggcuggccccucaucggcaugaucuucgagaucuacggcuucuuccuccucuuccgcggcuucuuccccgucgucgucggcuucauccgccgcguccccguccucggcucccuccucaaccuccccggcauccgcuccuucgucgacaaggucggcgaguccaacaacauggucuga

SEQ ID NO: 43756 - RNA, 6723 nt, Artificial Sequence
  derived and/or modified sequence opt2 from GON4L__Homo_sapiens__NP_001269787
augcuccccugcaagaagcgccgcaccaccgucaccgagucccuccagcacaagggcaaccaggaggagaacaacgucgaccucgaguccgccgucaagcccgaguccgaccaggucaaggaccucuccuccgucucccucuccugggaccccucccacggccgcgucgccggcuucgagguccagucccuccaggacgccggcaaccagcucggcauggaggacaccucccucuccuccggcaugcucacccagaacaccaacguccccauccucgagggcgucgacgucgccaucucccagggcaucacccuccccucccucgaguccuuccacccccucaacauccacaucggcaagggcaagcuccacgccaccggcuccaagcgcggcaagaagaugacccuccgccccggccccgucacccaggaggaccgcugcgaccaccucacccucaaggagcccuucuccggcgagcccuccgaggaggucaaggaggagggcggcaagccccagaugaacuccgagggcgagauccccucccuccccuccggcucccaguccgccaagcccgucucccagccccgcaaguccacccagcccgacgucugcgccuccccccaggagaagccccuccgcacccucuuccaccagcccgaggaggagaucgaggacggcggccucuucauccccauggaggagcaggacaacgaggaguccgagaagcgccgcaagaagaagaagggcaccaagcgcaagcgcgacggccgcggccaggagggcacccucgccuacgaccucaagcucgacgacaugcucgaccgcacccucgaggacggcgccaagcagcacaaccucaccgccgucaacguccgcaacauccuccacgaggucaucaccaacgagcacgucgucgccaugaugaaggccgccaucuccgagaccgaggacaugcccauguucgagcccaagaugacccgcuccaagcucaaggaggucgucgagaagggcgucgucauccccaccuggaacaucucccccaucaagaaggccaacgagaucaagcccccccaguucgucgacauccaccucgaggaggacgacuccuccgacgaggaguaccagcccgacgacgaggaggaggacgagaccgccgaggagucccuccucgaguccgacgucgaguccaccgccuccuccccccgcggcgccaagaagucccgccuccgccaguccuccgagaugaccgagaccgacgaggaguccggcauccucuccgaggccgagaaggucaccacccccgccauccgccacaucuccgccgaggucguccccaugggccccccccccccccccaagcccaagcagacccgcgacuccaccuucauggagaagcuccacgccgucgacgaggagcucgccuccucccccgucugcauggacuccuuccagcccauggacgacucccucaucgccuuccgcacccgcuccaagaugccccucaaggacgucccccucggccagcucgaggccgagcuccaggcccccgacaucacccccgacauguacgaccccaacaccgccgacgacgaggacuggaagauguggcucggcggccucaugaacgacgacgucggcaacgaggacgaggccgacgacgacgacgaccccgaguacaacuuccucgaggaccucgacgagcccgacaccgaggacuuccgcaccgaccgcgccguccgcaucaccaagaaggaggucaacgagcucauggaggagcucuucgagaccuuccaggacgagaugggcuucuccaacauggaggacgacggccccgaggaggaggagugcgucgccgagccccgccccaacuucaacaccccccaggcccuccgcuucgaggagccccucgccaaccuccucaacgagcagcaccgcaccgucaaggagcucuucgagcagcucaagaugaagaaguccuccgccaagcagcuccaggaggucgagaaggucaagccccaguccgagaagguccaccagacccucauccucgaccccgcccagcgcaagcgccuccagcagcagaugcagcagcacguccagcuccucacccagauccaccuccucgccaccugcaaccccaaccucaaccccgaggccaccaccacccgcaucuuccucaaggagcucggcaccuucgcccaguccuccaucgcccuccaccaccaguacaaccccaaguuccagacccucuuccagcccugcaaccucaugggcgccaugcagcucaucgaggacuucuccacccacgucuccaucgacugcuccccccacaagaccgucaagaagaccgccaacgaguuccccugccuccccaagcaggucgccuggauccucgccaccuccaaggucuucauguaccccgagcuccuccccgucugcucccucaaggccaagaacccccaggacaagaucgucuucaccaaggccgaggacaaccuccucgcccucggccucaagcacuucgagggcaccgaguuccccaacccccucaucuccaaguaccuccucaccugcaagaccgcccaccagcucaccguccgcaucaagaaccucaacaugaaccgcgcccccgacaacaucaucaaguucuacaagaagaccaagcagcuccccguccucggcaagugcugcgaggagauccagccccaccaguggaagccccccaucgagcgcgaggagcaccgccuccccuucuggcucaaggccucccuccccuccauccaggaggagcuccgccacauggccgacggcgcccgcgaggucggcaacaugaccggcaccaccgagaucaacuccgaccgcucccucgagaaggacaaccucgagcucggcuccgagucccgcuacccccuccuccuccccaagggcgucguccucaagcucaagcccgucgccacccgcuucccccgcaaggccuggcgccagaagcgcuccuccguccucaagccccuccucauccagcccucccccucccuccagcccuccuucaaccccggcaagacccccgcccgcuccacccacuccgaggccccccccuccaagaugguccuccgcaucccccaccccauccagcccgccaccguccuccagaccguccccggcguccccccccucggcgucuccggcggcgaguccuucgagucccccgccgcccuccccgccgucccccccgaggcccgcaccuccuucccccucuccgagucccagacccuccucuccuccgcccccguccccaaggucaugcuccccucccucgcccccuccaaguuccgcaagcccuacguccgccgccgccccuccaagcgccgcggcgucaaggccucccccugcaugaagcccgcccccgucauccaccaccccgccuccgucaucuucaccguccccgccaccaccgucaagaucgucucccucggcggcggcugcaacaugauccagcccgucaacgccgccgucgcccaguccccccagaccauccccaucaccacccuccucgucaaccccaccuccuuccccugcccccucaaccagucccucgucgccuccuccgucuccccccucaucgucuccggcaacuccgucaaccuccccauccccuccacccccgaggacaaggcccacgucaacgucgacaucgccugcgccgucgccgacggcgagaacgccuuccagggccucgagcccaagcucgagccccaggagcucuccccccucuccgccaccgucuuccccaaggucgagcacucccccggccccccccucgccgacgccgagugccaggagggccucuccgagaacuccgccugccgcuggaccgucgucaagaccgaggagggccgccaggcccucgagccccucccccagggcauccaggagucccucaacaaccccacccccggcgaccucgaggagaucgucaagauggagcccgaggaggcccgcgaggagaucuccggcucccccgagcgcgacaucugcgacgacaucaaggucgagcacgccgucgagcucgacaccggcgcccccuccgaggagcucuccuccgccggcgaggucaccaagcagaccguccuccagaaggaggaggagcgcucccagcccaccaagacccccuccuccucccaggagccccccgacgagggcaccuccggcaccgacgucaacaagggcuccuccaagaacgcccucuccuccauggaccccgagguccgccucuccuccccccccggcaagcccgaggacuccuccuccgucgacggccaguccgucggcacccccgucggccccgagaccggcggcgagaagaacggccccgaggaggaggaggaggaggacuucgacgaccucacccaggacgaggaggacgagauguccuccgccuccgaggaguccguccucuccguccccgagcuccaggagaccauggagaagcucaccuggcucgccuccgagcgccgcaugucccaggagggcgaguccgaggaggagaacucccaggaggagaacuccgagcccgaggaggaggaggaggaggaggccgagggcauggagucccuccagaaggaggacgagaugaccgacgaggccgucggcgacuccgccgagaagccccccaccuucgccucccccgagaccgcccccgaggucgagaccucccgcaccccccccggcgaguccaucaaggccgccggcaagggccgcaacaaccaccgcgcccgcaacaagcgcggcucccgcgcccgcgccuccaaggacaccuccaagcuccuccuccucuacgacgaggacauccucgagcgcgacccccuccgcgagcagaaggaccucgccuucgcccaggccuaccucacccgcguccgcgaggcccuccagcacauccccggcaaguacgaggacuuccuccaggucaucuacgaguucgaguccuccacccagcgccgcaccgccgucgaccucuacaagucccuccagauccuccuccaggacuggccccagcuccucaaggacuucgccgccuuccuccuccccgagcaggcccucgccugcggccucuucgaggagcagcaggccuucgagaagucccgcaaguuccuccgccagcucgagaucugcuucgccgagaaccccucccaccaccagaagaucaucaagguccuccagggcugcgccgacugccucccccaggagaucaccgagcucaagacccagauguggcagcuccucaagggccacgaccaccuccaggacgaguucuccaucuucuucgaccaccuccgccccgccgccucccgcaugggcgacuucgaggagaucaacuggaccgaggagaaggaguacgaguucgacggcuucgaggaggucgcccuccccgacgucgaggaggaggaggagccccccaagauccccaccgccuccaagaacaagcgcaagaaggagaucggcguccagaaccacgacaaggagaccgaguggcccgacggcgccaaggacugcgccugcuccugccacgagggcggccccgacuccaagcucaagaaguccaagcgccgcuccugcucccacugcuccuccaaggucugcgacuccaaguccuacaaguccaaggagccccacgagcucgucggcuccuccccccaccgcgaggccucccccaugcccggcgccaaggaggccggccagggcaaggacaugauggaggaggaggcccccgaggagcgcgaguccaccgaggccacccagucccgcaccguccgcaccacccgcaagggcgagaugcccgucuccggccucgccgucggcuccacccuccccuccccccgcgaggucaccgucaccgagcgccuccuccucgacggcccccccccccacucccccgagaccccccaguucccccccaccaccggcgccguccucuacaccgucaagcgcaaccaggucggccccgagguccgcuccugccccaaggccuccccccgccuccagaaggagcgcgagggccagaaggccgucuccgaguccgaggcccucaugcucgucugggacgccuccgagaccgagaagcuccccggcaccgucgagccccccgccuccuuccucucccccgucuccuccaagacccgcgacgccggccgccgccacgucuccggcaagcccgacacccaggagcgcuggcuccccuccucccgcgcccgcgucaagacccgcgaccgcaccugccccguccacgagucccccuccggcaucgacaccuccgagaccucccccaaggccccccgcggcggccucgccaaggacuccggcacccaggccaagggccccgagggcgagcagcagcccaaggccgccgaggccaccgucugcgccaacaacuccaaggucuccuccaccggcgagaaggucguccucuggacccgcgaggccgaccgcgucauccucaccaugugccaggagcagggcgcccagccccagaccuucaacaucaucucccagcagcucggcaacaagacccccgccgaggucucccaccgcuuccgcgagcucaugcagcucuuccacaccgccugcgaggccuccuccgaggacgaggacgacgccaccuccaccuccaacgccgaccagcucuccgaccacggcgaccuccucuccgaggaggagcucgacgaguga

SEQ ID NO: 43757 - RNA, 1365 nt, Artificial Sequence
  derived and/or modified sequence opt2 from GOPC__Homo_sapiens__NP_001017408
auguccgccggcggccccugccccgccgccgccggcggcggccccggcggcgccuccugcuccgucggcgcccccggcggcgucuccauguuccgcuggcucgagguccucgagaaggaguucgacaaggccuucgucgacgucgaccuccuccucggcgagaucgaccccgaccaggccgacaucaccuacgagggccgccagaagaugaccucccucuccuccugcuucgcccagcucugccacaaggcccaguccgucucccagaucaaccacaagcucgaggcccagcucgucgaccucaaguccgagcucaccgagacccaggccgagaaggucguccucgagaaggagguccacgaccagcuccuccagcuccacuccauccagcuccagcuccacgccaagaccggccaguccgccgacuccggcaccaucaaggccaagcucgagcgcgagcucgaggccaacaagaaggagaagaugaaggaggcccagcucgaggccgaggucaagcuccuccgcaaggagaacgaggcccuccgccgccacaucgccguccuccaggccgaggucuacggcgcccgccucgccgccaaguaccucgacaaggagcucgccggccgcguccagcagauccagcuccucggccgcgacaugaagggccccgcccacgacaagcucuggaaccagcucgaggccgagauccaccuccaccgccacaagaccgucauccgcgccugccgcggccgcaacgaccucaagcgccccaugcaggccccccccggccacgaccaggacucccucaagaagucccagggcgucggccccauccgcaagguccuccuccucaaggaggaccacgagggccucggcaucuccaucaccggcggcaaggagcacggcguccccauccucaucuccgagauccaccccggccagcccgccgaccgcugcggcggccuccacgucggcgacgccauccucgccgucaacggcgucaaccuccgcgacaccaagcacaaggaggccgucaccauccucucccagcagcgcggcgagaucgaguucgaggucgucuacgucgcccccgaggucgacuccgacgacgagaacgucgaguacgaggacgaguccggccaccgcuaccgccucuaccucgacgagcucgagggcggcggcaaccccggcgccuccugcaaggacaccuccggcgagaucaagguccuccagggcuucaacaagaaggccgucaccgacacccacgagaacggcgaccucggcaccgccuccgagaccccccucgacgacggcgccuccaagcucgacgaccuccacacccucuaccacaagaaguccuacuga

SEQ ID NO: 43758 - RNA, 741 nt, Artificial Sequence
  derived and/or modified sequence opt2 from GORAB__Homo_sapiens__NP_001139511
auguccugggccgccguccucgccgucgccgccgcccgcuucggccacuucuggggcugccgcuggcccggccccauggcccagggcugggccggcuucuccgaggaggagcuccgccgccucaagcagaccaaggaccccuucgagccccagcgccgccuccccgccaagaagucccgccagcagcuccagcgcgagaaggcccucgucgagcagucccagaagcucggccuccaggacggcuccaccucccuccuccccgagcagcuccucuccgcccccaagcagcgcgucaacguccagaagccccccuucuccucccccacccuccccucccacuucacccucaccucccccgucggcgacggccagccccagggcaucgagucccagcccaaggagcucggccucgagaacucccacgacggccacaacaacgucgagauccucccccccaagcccgacugcaagcucgagaagaagaaggucgagcuccaggagaagucccgcugggagguccuccagcaggagcagcgccucauggaggagaagaacaagcgcaagaaggcccuccucgccaaggccaucgccgagcgcuccaagcgcacccaggccgagaccaugaagcucaagcgcauccagaaggagcuccaggcccucgacgacauggucuccgccgacaucggcauccuccgcaaccgcaucgaccaggccucccucgacuacuccuacgcccgcuga

SEQ ID NO: 43759 - RNA, 1323 nt, Artificial Sequence
  derived and/or modified sequence opt2 from GORASP1__Homo_sapiens__NP_114105
augggccucggcgucuccgccgagcagcccgccggcggcgccgagggcuuccaccuccacggcguccaggagaacucccccgcccagcaggccggccucgagcccuacuucgacuucaucaucaccaucggccacucccgccucaacaaggagaacgacacccucaaggcccuccucaaggccaacgucgagaagcccgucaagcucgaggucuucaacaugaagaccaugcgcguccgcgaggucgaggucguccccuccaacauguggggcggccagggccuccucggcgccuccguccgcuucugcuccuuccgccgcgccuccgagcaggucuggcacguccucgacgucgagcccuccucccccgccgcccucgccggccuccgccccuacaccgacuacgucgucggcuccgaccagauccuccaggaguccgaggacuucuucacccucaucgagucccacgagggcaagccccucaagcucauggucuacaacuccaaguccgacuccugccgcgaggucaccgucacccccaacgccgccuggggcggcgagggcucccucggcugcggcaucggcuacggcuaccuccaccgcauccccacccagccccccuccuaccacaagaagccccccggcacccccccccccuccgcccucccccucggcgcccccccccccgacgcccucccccccggccccacccccgaggacucccccucccucgagaccggcucccgccaguccgacuacauggaggcccuccuccaggcccccggcuccuccauggaggacccccuccccggccccggcucccccucccacuccgcccccgaccccgacggccucccccacuucauggagaccccccuccagccccccccccccguccagcgcgucauggaccccggcuuccucgacgucuccggcaucucccuccucgacaacuccaacgccuccgucuggcccucccuccccuccuccaccgagcucaccaccaccgccgucuccaccuccggccccgaggacaucugcuccuccuccuccucccacgagcgcggcggcgaggccaccugguccggcuccgaguucgaggucuccuuccucgacucccccggcgcccaggcccaggccgaccaccucccccagcucacccuccccgacucccucaccuccgccgccucccccgaggacggccucuccgccgagcuccucgaggcccaggccgaggaggagcccgccuccaccgagggccucgacaccggcaccgaggccgagggccucgacucccaggcccagaucuccaccaccgaguga

SEQ ID NO: 43760 - RNA, 1359 nt, Artificial Sequence
  derived and/or modified sequence opt2 from GORASP2__Homo_sapiens__NP_056345
augggcuccucccaguccgucgagauccccggcggcggcaccgagggcuaccacguccuccgcguccaggagaacucccccggccaccgcgccggccucgagcccuucuucgacuucaucgucuccaucaacggcucccgccucaacaaggacaacgacacccucaaggaccuccucaaggccaacgucgagaagcccgucaagaugcucaucuacuccuccaagacccucgagcuccgcgagaccuccgucacccccuccaaccucuggggcggccagggccuccucggcgucuccauccgcuucugcuccuucgacggcgccaacgagaacgucuggcacguccucgaggucgaguccaacucccccgccgcccucgccggccuccgcccccacuccgacuacaucaucggcgccgacaccgucaugaacgaguccgaggaccucuucucccucaucgagacccacgaggccaagccccucaagcucuacgucuacaacaccgacaccgacaacugccgcgaggucaucaucacccccaacuccgccuggggcggcgagggcucccucggcugcggcaucggcuacggcuaccuccaccgcauccccacccgccccuucgaggagggcaagaagaucucccuccccggccagauggccggcacccccaucaccccccucaaggacggcuucaccgagguccagcucuccuccgucaacccccccucccucuccccccccggcaccaccggcaucgagcagucccucaccggccucuccaucuccuccaccccccccgccgucuccuccguccucuccaccggcguccccaccgucccccuccuccccccccaggucaaccagucccucaccuccgucccccccaugaaccccgccaccacccuccccggccucaugccccuccccgccggccuccccaaccuccccaaccucaaccucaaccuccccgccccccacaucaugcccggcgucggccuccccgagcucgucaaccccggccuccccccccuccccuccaugcccccccgcaaccuccccggcaucgccccccucccccuccccuccgaguuccuccccuccuucccccucguccccgaguccuccuccgccgccuccuccggcgagcuccucuccucccucccccccaccuccaacgcccccuccgaccccgccaccaccaccgccaaggccgacgccgccuccucccucaccgucgacgucaccccccccaccgccaaggcccccaccaccgucgaggaccgcgucggcgacuccacccccgucuccgagaagcccgucuccgccgccgucgacgccaacgccuccgagucccccuga

SEQ ID NO: 43761 - RNA, 747 nt, Artificial Sequence
  derived and/or modified sequence opt2 from GOSR1__Homo_sapiens__NP_001007026
auggccgccggcaccuccuccuacugggaggaccuccgcaagcaggcccgccagcucgagaacgagcucgaccucaagcucgucuccuucuccaagcucugcaccuccuacucccacuccuccacccgcgacggccgccgcgacuccuccgacaccaccccccuccucaacggcuccucccaggaccgcauguucgagaccauggccaucgagaucgagcagcuccucgcccgccucaccggcgucaacgacaagauggccgaguacaccaacuccgccggcguccccucccucaacgccgcccucaugcacacccuccagcgccaccgcgacauccuccaggacuacacccacgaguuccacaagaccaaggccaacuucauggccauccgcgagcgcgagaaccucaugggcuccguccgcaaggacaucgaguccuacaaguccggcuccggcgucaacaaccgccgcaccgagcucuuccucaaggagcacgaccaccuccgcaacuccgaccgccucaucgaggagaccaucuccaucgccauggccaccaaggagaacaugaccucccagcgcggcaugcucaaguccauccacuccaagaugaacacccucgccaaccgcuuccccgccgucaacucccucauccagcgcaucaaccuccgcaagcgccgcgacucccucauccucggcggcgucaucggcaucugcaccauccuccuccuccucuacgccuuccacuga

SEQ ID NO: 43762 - RNA, 588 nt, Artificial Sequence
  derived and/or modified sequence opt2 from GOSR2__Homo_sapiens__NP_001012529
auggacccccucuuccagcagacccacaagcagguccacgagauccaguccugcaugggccgccucgagaccgccgacaagcaguccguccacaucgucgagaacgagauccaggccuccaucgaccagaucuucucccgccucgagcgccucgagauccucuccuccaaggagccccccaacaagcgccagaacgcccgccuccgcgucgaccagcucaaguacgacguccagcaccuccagaccgcccuccgcaacuuccagcaccgccgccacgcccgcgagcagcaggagcgccagcgcgaggagcuccucucccgcaccuucaccaccaacgacuccgacaccaccauccccauggacgagucccuccaguucaacuccucccuccagaagguccacaacggcauggacgaccucauccucgacggccacaacauccucgacggccuccgcacccagcgccucacccucaaggucggcucccuccucggcgaccgcgagaaggccuccugcuucucccucauccagcaguucuccaacugcgucuacauccucaucaccugcccccagaucgucaucuucuga

SEQ ID NO: 43763 - RNA, 1242 nt, Artificial Sequence
  derived and/or modified sequence opt2 from GOT1__Homo_sapiens__NP_002070
auggccccccccuccgucuucgccgaggucccccaggcccagcccguccucgucuucaagcucaccgccgacuuccgcgaggaccccgacccccgcaaggucaaccucggcgucggcgccuaccgcaccgacgacugccaccccuggguccuccccgucgucaagaaggucgagcagaagaucgccaacgacaacucccucaaccacgaguaccuccccauccucggccucgccgaguuccgcuccugcgccucccgccucgcccucggcgacgacucccccgcccucaaggagaagcgcgucggcggcguccagucccucggcggcaccggcgcccuccgcaucggcgccgacuuccucgcccgcugguacaacggcaccaacaacaagaacacccccgucuacgucuccucccccaccugggagaaccacaacgccgucuucuccgccgccggcuucaaggacauccgcuccuaccgcuacugggacgccgagaagcgcggccucgaccuccagggcuuccucaacgaccucgagaacgcccccgaguucuccaucgucguccuccacgccugcgcccacaaccccaccggcaucgaccccacccccgagcaguggaagcagaucgccuccgucaugaagcaccgcuuccucuuccccuucuucgacuccgccuaccagggcuucgccuccggcaaccucgagcgcgacgccugggccauccgcuacuucgucuccgagggcuucgaguucuucugcgcccaguccuucuccaagaacuucggccucuacaacgagcgcgucggcaaccucaccgucgucggcaaggagcccgaguccauccuccagguccucucccagauggagaagaucguccgcaucaccugguccaacccccccgcccagggcgcccgcaucgucgccuccacccucuccaaccccgagcucuucgaggaguggaccggcaacgucaagaccauggccgaccgcauccucaccaugcgcuccgagcuccgcgcccgccucgaggcccucaagacccccggcaccuggaaccacaucaccgaccagaucggcauguucuccuucaccggccucaaccccaagcaggucgaguaccucgucaacgagaagcacaucuaccuccuccccuccggccgcaucaacgucuccggccucaccaccaagaaccucgacuacgucgccaccuccauccacgaggccgucaccaagauccaguga

SEQ ID NO: 43764 - RNA, 1164 nt, Artificial Sequence
  derived and/or modified sequence opt2 from GOT2__Homo_sapiens__NP_001273149
auggcccuccuccacuccggccgcguccuccccggcaucgccgccgccuuccaccccggccucgccgccgccgccuccgcccgcgccuccuccugguggacccacgucgagaugggcccccccgaccccauccucggcgucaccgaggccuucaagcgcgacaccaacuccaagaagaugaaccucggcgucggcgccuaccgcgacgacaacggcaagcccuacguccuccccuccguccgcaaguucgucaccguccagaccaucuccggcaccggcgcccuccgcaucggcgccuccuuccuccagcgcuucuucaaguucucccgcgacgucuuccuccccaagcccaccuggggcaaccacacccccaucuuccgcgacgccggcaugcagcuccagggcuaccgcuacuacgaccccaagaccugcggcuucgacuucaccggcgccgucgaggacaucuccaagauccccgagcaguccguccuccuccuccacgccugcgcccacaaccccaccggcgucgacccccgccccgagcaguggaaggagaucgccaccgucgucaagaagcgcaaccucuucgccuucuucgacauggccuaccagggcuucgccuccggcgacggcgacaaggacgccugggccguccgccacuucaucgagcagggcaucaacgucugccucugccaguccuacgccaagaacaugggccucuacggcgagcgcgucggcgccuucaccauggucugcaaggacgccgacgaggccaagcgcgucgagucccagcucaagauccucauccgccccauguacuccaaccccccccucaacggcgcccgcaucgccgccgccauccucaacacccccgaccuccgcaagcaguggcuccaggaggucaaggucauggccgaccgcaucaucggcaugcgcacccagcucgucuccaaccucaagaaggagggcuccacccacaacuggcagcacaucaccgaccagaucggcauguucugcuucaccggccucaagcccgagcaggucgagcgccucaucaaggaguucuccaucuacaugaccaaggacggccgcaucuccgucgccggcgucaccuccuccaacgucggcuaccucgcccacgccauccaccaggucaccaaguga

SEQ ID NO: 43765 - RNA, 1959 nt, Artificial Sequence
  derived and/or modified sequence opt2 from GP1BA__Homo_sapiens__NP_000164
augccccuccuccuccuccuccuccuccuccccuccccccuccacccccaccccaucugcgaggucuccaaggucgccucccaccucgaggucaacugcgacaagcgcaaccucaccgcccucccccccgaccuccccaaggacaccaccauccuccaccucuccgagaaccuccucuacaccuucucccucgccacccucaugcccuacacccgccucacccagcucaaccucgaccgcugcgagcucaccaagcuccaggucgacggcacccuccccguccucggcacccucgaccucucccacaaccagcuccagucccucccccuccucggccagacccuccccgcccucaccguccucgacgucuccuucaaccgccucaccucccucccccucggcgcccuccgcggccucggcgagcuccaggagcucuaccucaagggcaacgagcucaagacccucccccccggccuccucacccccacccccaagcucgagaagcucucccucgccaacaacaaccucaccgagcuccccgccggccuccucaacggccucgagaaccucgacacccuccuccuccaggagaacucccucuacaccauccccaagggcuucuucggcucccaccuccuccccuucgccuuccuccacggcaaccccuggcucugcaacugcgagauccucuacuuccgccgcuggcuccaggacaacgccgagaacgucuacgucuggaagcagggcgucgacgucaaggccaugaccuccaacgucgccuccguccagugcgacaacuccgacaaguuccccgucuacaaguaccccggcaagggcugccccacccucggcgacgagggcgacaccgaccucuacgacuacuaccccgaggaggacaccgagggcgacaagguccgcgccacccgcaccgucgucaaguuccccaccaaggcccacaccacccccuggggccucuucuacuccugguccaccgccucccucgacucccagaugcccuccucccuccaccccacccaggaguccaccaaggagcagaccaccuuccccccccgcuggacccccaacuucacccuccacauggaguccaucaccuucuccaagacccccaaguccaccaccgagcccacccccucccccaccaccuccgagcccguccccgagcccgcccccaacaugaccacccucgagcccacccccucccccaccacccccgagcccaccuccgagcccgcccccucccccaccacccccgagcccaccuccgagcccgcccccucccccaccacccccgagcccaccuccgagcccgcccccucccccaccacccccgagcccacccccauccccaccaucgccaccucccccaccauccucgucuccgccaccucccucaucacccccaaguccaccuuccucaccaccaccaagcccgucucccuccucgaguccaccaagaagaccauccccgagcucgaccagccccccaagcuccgcggcguccuccagggccaccucgaguccucccgcaacgaccccuuccuccaccccgacuucugcugccuccucccccucggcuucuacguccucggccucuucuggcuccucuucgccuccgucguccucauccuccuccucuccugggucggccacgucaagccccaggcccucgacuccggccagggcgccgcccucaccaccgccacccagaccacccaccucgagcuccagcgcggccgccaggucaccgucccccgcgccuggcuccucuuccuccgcggcucccuccccaccuuccgcuccucccucuuccucuggguccgccccaacggccgcgucggcccccucgucgccggccgccgccccuccgcccucucccagggccgcggccaggaccuccucuccaccgucuccauccgcuacuccggccacucccucuga

SEQ ID NO: 43766 - RNA, 621 nt, Artificial Sequence
  derived and/or modified sequence opt2 from GP1BB__Homo_sapiens__NP_000398
augggcuccggcccccgcggcgcccucucccuccuccuccuccuccucgccccccccucccgccccgccgccggcugccccgcccccugcuccugcgccggcacccucgucgacugcggccgccgcggccucaccugggccucccuccccaccgccuuccccgucgacaccaccgagcucguccucaccggcaacaaccucaccgcccucccccccggccuccucgacgcccuccccgcccuccgcaccgcccaccucggcgccaaccccuggcgcugcgacugccgccucgucccccuccgcgccuggcucgccggccgccccgagcgcgcccccuaccgcgaccuccgcugcgucgccccccccgcccuccgcggccgccuccuccccuaccucgccgaggacgagcuccgcgccgccugcgcccccggcccccucugcuggggcgcccucgccgcccagcucgcccuccucggccucggccuccuccacgcccuccuccucguccuccuccucugccgccuccgccgccuccgcgcccgcgcccgcgcccgcgccgccgcccgccucucccucaccgacccccucgucgccgagcgcgccggcaccgacgaguccuga

SEQ ID NO: 43767 - RNA, 1614 nt, Artificial Sequence
  derived and/or modified sequence opt2 from GP2__Homo_sapiens__NP_001007241
augccccaccucauggagcgcauggucggcuccggccuccucuggcucgcccucgucuccugcauccucacccaggccuccgccguccagcgcggcuacggcaaccccaucgaggccuccuccuacggccucgaccucgacugcggcgcccccggcacccccgaggcccacgucugcuucgaccccugccagaacuacacccuccucgacgagcccuuccgcuccaccgagaacuccgccggcucccagggcugcgacaagaacauguccggcugguaccgcuucgucggcgagggcggcguccgcauguccgagaccugcguccagguccaccgcugccagaccgacgcccccauguggcucaacggcacccaccccgcccucggcgacggcaucaccaaccacaccgccugcgcccacugguccggcaacugcugcuucuggaagaccgagguccucgucaaggccugccccggcggcuaccacgucuaccgccucgagggcacccccuggugcaaccuccgcuacugcaccgucccccgcgaccccuccaccgucgaggacaagugcgagaaggccugccgccccgaggaggagugccucgcccucaacuccaccuggggcugcuucugccgccaggaccucaacuccuccgacguccacucccuccagccccagcucgacugcggcccccgcgagaucaaggucaaggucgacaagugccuccucggcggccucggccucggcgaggaggucaucgccuaccuccgcgaccccaacugcuccuccauccuccagaccgaggagcgcaacugggucuccgucaccucccccguccaggccuccgccugccgcaacauccucgagcgcaaccagacccacgccaucuacaagaacacccucucccucgucaacgacuucaucauccgcgacaccauccucaacaucaacuuccagugcgccuacccccucgacaugaaggucucccuccaggccgcccuccagcccaucgucuccucccucaacgucuccgucgacggcaacggcgaguucaucguccgcauggcccucuuccaggaccagaacuacaccaaccccuacgagggcgacgccgucgagcucuccgucgaguccguccucuacgucggcgccauccucgagcagggcgacaccucccgcuucaaccucguccuccgcaacugcuacgccacccccaccgaggacaaggccgaccucgucaaguacuucaucauccgcaacuccugcuccaaccagcgcgacuccaccauccacgucgaggagaacggccaguccuccgagucccgcuucuccguccagauguucauguucgccggccacuacgaccucgucuuccuccacugcgagauccaccucugcgacucccucaacgagcagugccagcccuccugcucccgcucccagguccgcuccgagguccccgccaucgaccucgcccgcguccucgaccucggccccaucacccgccgcggcgcccagucccccggcgucaugaacggcacccccuccaccgccggcuuccucgucgccuggcccaugguccuccucaccguccuccucgccuggcucuucuga

SEQ ID NO: 43768 - RNA, 1683 nt, Artificial Sequence
  derived and/or modified sequence opt2 from GP5__Homo_sapiens__NP_004479
augcuccgcggcacccuccucugcgccguccucggccuccuccgcgcccagcccuuccccugcccccccgccugcaagugcgucuuccgcgacgccgcccagugcuccggcggcgacgucgcccgcaucuccgcccucggccuccccaccaaccucacccacauccuccucuucggcaugggccgcggcguccuccagucccaguccuucuccggcaugaccguccuccagcgccucaugaucuccgacucccacaucuccgccgucgcccccggcaccuucuccgaccucaucaagcucaagacccuccgccucucccgcaacaagaucacccaccuccccggcgcccuccucgacaagaugguccuccucgagcagcucuuccucgaccacaacgcccuccgcggcaucgaccagaacauguuccagaagcucgucaaccuccaggagcucgcccucaaccagaaccagcucgacuuccuccccgccucccucuucaccaaccucgagaaccucaagcuccucgaccucuccggcaacaaccucacccaccuccccaagggccuccucggcgcccaggccaagcucgagcgccuccuccuccacuccaaccgccucgucucccucgacuccggccuccucaacucccucggcgcccucaccgagcuccaguuccaccgcaaccacauccgcuccaucgcccccggcgccuucgaccgccuccccaaccucuccucccucacccucucccgcaaccaccucgccuuccuccccuccgcccucuuccuccacucccacaaccucacccuccucacccucuucgagaacccccucgccgagcuccccggcguccucuucggcgagaugggcggccuccaggagcucuggcucaaccgcacccagcuccgcacccuccccgccgccgccuuccgcaaccucucccgccuccgcuaccucggcgucacccucuccccccgccucuccgcccucccccagggcgccuuccagggccucggcgagcuccagguccucgcccuccacuccaacggccucaccgcccuccccgacggccuccuccgcggccucggcaagcuccgccaggucucccuccgccgcaaccgccuccgcgcccucccccgcgcccucuuccgcaaccucuccucccucgaguccguccagcucgaccacaaccagcucgagacccuccccggcgacgucuucggcgcccucccccgccucaccgagguccuccucggccacaacuccuggcgcugcgacugcggccucggccccuuccucggcuggcuccgccagcaccucggccucgucggcggcgaggagcccccccgcugcgccggccccggcgcccacgccggccucccccucugggcccuccccggcggcgacgccgagugccccggcccccgcggcccccccccccgccccgccgccgacuccuccuccgaggcccccguccaccccgcccucgcccccaacuccuccgagcccugggucugggcccagcccgucaccaccggcaagggccaggaccacucccccuucuggggcuucuacuuccuccuccucgccguccaggccaugaucaccgucaucaucgucuucgccaugaucaagaucggccagcucuuccgcaagcucauccgcgagcgcgcccucggcuga

SEQ ID NO: 43769 - RNA, 1863 nt, Artificial Sequence
  derived and/or modified sequence opt2 from GP6__Homo_sapiens__NP_001077368
augucccccucccccaccgcccucuucugccucggccucugccucggccgcguccccgcccaguccggcccccuccccaagcccucccuccaggcccuccccuccucccucgucccccucgagaagcccgucacccuccgcugccagggcccccccggcgucgaccucuaccgccucgagaagcucuccuccucccgcuaccaggaccaggccguccucuucauccccgccaugaagcgcucccucgccggccgcuaccgcugcuccuaccagaacggcucccucuggucccuccccuccgaccagcucgagcucgucgccaccggcgucuucgccaagcccucccucuccgcccagcccggccccgccgucuccuccggcggcgacgucacccuccagugccagacccgcuacggcuucgaccaguucgcccucuacaaggagggcgaccccgcccccuacaagaaccccgagcgcugguaccgcgccuccuuccccaucaucaccgucaccgccgcccacuccggcaccuaccgcugcuacuccuucuccucccgcgaccccuaccucugguccgcccccuccgacccccucgagcucgucgucaccggcaccuccgucacccccucccgccuccccaccgagccccccucccccgucgccgaguucuccgaggccaccgccgagcucaccgucuccuucaccaacgaggucuucaccaccgagaccucccgcuccaucaccgccucccccaaggaguccgacucccccgccggcgaguccugcccccccguccuccaccagggccagcccggccccgacaugccccgcggcugcgaccccaacaaccccggcggcgucuccggccgcggccucgcccagcccgaggaggcccccgccgcccagggccagggcugcgccgaggccgccuccgccccccccgccccccccgccgaccccgagaucaagcgcggcuccggcuggcgccccaccggcugcucccagccccgcgucauguucaugaccgccgagccccaggcccgcuccuacccccgcgagggcuccuggcacggccgccgccucaaggacuggcgcgucugguccgucgaggccggcggccagcgccuccagcucuggaagcgcggccacgccgccuccuccuggugcuccauccgcgagcccuucggccagugccucuccgucugccucccccucugccuccgcgcccccuccaucugggacggccgcaaccucuggcgcccccaccccccccccugcacccucuggaugaccugguaccccggcuggaccaccuacuggccccucuccuccaccucccucaucugggcccccgacggcucccuccgcuuccccgcccuccgcgucgacuccguccccuccuccguccagaacccccccguccuccccuucggcccccucugcuccugccucgucuucccccgcaacucccacccccacuccaucucccacugcggccucaccaaccuccucuccucccuccgcaccggccucgccggcucccucggcauguccuucaucuuccucuccgucaagcucgcccgcugcccccuccccuucacccucgagaacaagaucucccucugcaacauggucaagccccaccucuaccagcagaacaagaagacccagaagcucgcccgcugcggcggcgccucccucuacucccagcagcuccgcggccuccgcugggagaacggccucucccucggcggccgcggcugcuccgagcuccgcucccaccacugcacccucgcccgcgucaccaagcccgacuucgucuccaagaacaccggcaugaacauguccaucacccucaucuga

SEQ ID NO: 43770 - RNA, 534 nt, Artificial Sequence
  derived and/or modified sequence opt2 from GP9__Homo_sapiens__NP_000165
augcccgccuggggcgcccucuuccuccucugggccaccgccgaggccaccaaggacugccccucccccugcaccugccgcgcccucgagaccaugggccucugggucgacugccgcggccacggccucaccgcccuccccgcccuccccgcccgcacccgccaccuccuccucgccaacaacucccuccaguccgucccccccggcgccuucgaccaccucccccagcuccagacccucgacgucacccagaaccccuggcacugcgacugcucccucaccuaccuccgccucuggcucgaggaccgcacccccgaggcccuccuccagguccgcugcgccucccccucccucgccgcccacggcccccucggccgccucaccggcuaccagcucggcuccugcggcuggcagcuccaggccuccuggguccgccccggcguccucugggacgucgcccucgucgccgucgccgcccucggccucgcccuccucgccggccuccucugcgccaccaccgaggcccucgacuga

SEQ ID NO: 43771 - RNA, 960 nt, Artificial Sequence
  derived and/or modified sequence opt2 from GPA33__Homo_sapiens__NP_005805
auggucggcaagauguggcccguccucuggacccucugcgccguccgcgucaccgucgacgccaucuccgucgagaccccccaggacguccuccgcgccucccagggcaaguccgucacccuccccugcaccuaccacaccuccaccuccucccgcgagggccucauccagugggacaagcuccuccucacccacaccgagcgcgucgucaucuggcccuucuccaacaagaacuacauccacggcgagcucuacaagaaccgcgucuccaucuccaacaacgccgagcaguccgacgccuccaucaccaucgaccagcucaccauggccgacaacggcaccuacgagugcuccgucucccucauguccgaccucgagggcaacaccaagucccgcguccgccuccucguccucgucccccccuccaagcccgagugcggcaucgagggcgagaccaucaucggcaacaacauccagcucaccugccaguccaaggagggcucccccaccccccaguacuccuggaagcgcuacaacauccucaaccaggagcagccccucgcccagcccgccuccggccagcccgucucccucaagaacaucuccaccgacaccuccggcuacuacaucugcaccuccuccaacgaggagggcacccaguucugcaacaucaccgucgccguccgcucccccuccaugaacgucgcccucuacgucggcaucgccgucggcgucgucgccgcccucaucaucaucggcaucaucaucuacugcugcugcugccgcggcaaggacgacaacaccgaggacaaggaggacgcccgccccaaccgcgaggccuacgaggagccccccgagcagcuccgcgagcucucccgcgagcgcgaggaggaggacgacuaccgccaggaggagcagcgcuccaccggccgcgagucccccgaccaccucgaccaguga

SEQ ID NO: 43772 - RNA, 1866 nt, Artificial Sequence
  derived and/or modified sequence opt2 from GPAA1__Homo_sapiens__NP_003792
augggccuccucuccgaccccguccgccgccgcgcccucgcccgccucguccuccgccucaacgccccccucugcguccucuccuacgucgccggcaucgccugguuccucgcccucgucuuccccccccucacccagcgcaccuacauguccgagaacgccaugggcuccaccauggucgaggagcaguucgccggcggcgaccgcgcccgcgccuucgcccgcgacuucgccgcccaccgcaagaaguccggcgcccuccccgucgccuggcucgagcgcaccaugcgcuccgucggccucgaggucuacacccaguccuucucccgcaagcuccccuuccccgacgagacccacgagcgcuacauggucuccggcaccaacgucuacggcauccuccgcgccccccgcgccgccuccaccgagucccucguccucaccguccccugcggcuccgacuccaccaacucccaggccgucggccuccuccucgcccucgccgcccacuuccgcggccagaucuacugggccaaggacaucgucuuccucgucaccgagcacgaccuccucggcaccgaggccuggcucgaggccuaccacgacgucaacgucaccggcaugcaguccuccccccuccagggccgcgccggcgccauccaggccgccgucgcccucgagcucuccuccgacgucgucaccucccucgacgucgccgucgagggccucaacggccagcuccccaaccucgaccuccucaaccucuuccagaccuucugccagaagggcggccuccucugcacccuccagggcaagcuccagcccgaggacuggaccucccucgacggcccccuccagggccuccagacccuccuccucaugguccuccgccaggccuccggccgcccccacggcucccacggccucuuccuccgcuaccgcgucgaggcccucacccuccgcggcaucaacuccuuccgccaguacaaguacgaccucgucgccgucggcaaggcccucgagggcauguuccgcaagcucaaccaccuccucgagcgccuccaccaguccuucuuccucuaccuccuccccggccucucccgcuucgucuccaucggccucuacaugcccgccgucggcuuccuccuccucguccucggccucaaggcccucgagcucuggaugcagcuccacgaggccggcaugggccucgaggagcccggcggcgcccccggccccuccgucccccucccccccucccagggcgucggccucgccucccucgucgccccccuccucaucucccaggccaugggccucgcccucuacguccuccccguccucggccagcacgucgccacccagcacuuccccgucgccgaggccgaggccgucguccucacccuccucgccaucuacgccgccggccucgcccucccccacaacacccaccgcgucgucuccacccaggcccccgaccgcggcuggauggcccucaagcucgucgcccucaucuaccucgcccuccagcucggcugcaucgcccucaccaacuucucccucggcuuccuccucgccaccaccaugguccccaccgccgcccucgccaagccccacggcccccgcacccucuacgccgcccuccucguccucaccucccccgccgccacccuccucggcucccucuuccucuggcgcgagcuccaggaggccccccucucccucgccgagggcuggcagcucuuccucgccgcccucgcccagggcguccucgagcaccacaccuacggcgcccuccucuucccccuccucucccucggccucuaccccugcuggcuccucuucuggaacguccucuucuggaaguga

SEQ ID NO: 43773 - RNA, 1023 nt, Artificial Sequence
  derived and/or modified sequence opt2 from GPALPP1__Homo_sapiens__NP_061029
auggcccgcgaccucaucggccccgcccucccccccggcuucaaggcccgcggcaccgccgaggacgaggagcgcgaccccucccccgucgccggccccgcccucccccccaacuacaaguccuccuccuccgacuccuccgacuccgacgaggacuccuccucccucuacgaggagggcaaccaggaguccgaggaggacgacuccggccccaccgcccgcaagcagcgcaagaaccaggacgacgacgacgacgacgacgacggcuucuucggccccgcccucccccccggcuucaagaagcaggacgacucccccccccgccccaucaucggccccgcccucccccccggcuucaucaaguccacccagaaguccgacaagggccgcgacgaccccggccagcaggagaccgacuccuccgaggacgaggacaucaucggccccaugcccgccaagggccccgucaacuacaacgucaccaccgaguucgagaagcgcgcccagcgcaugaaggagaagcucaccaagggcgacgacgacuccuccaagcccaucguccgcgaguccuggaugaccgagcucccccccgagaugaaggacuucggccucggcccccgcaccuucaagcgccgcgccgacgacaccuccggcgaccgcuccaucuggaccgacacccccgccgaccgcgagcgcaaggccaaggagacccaggaggcccgcaaguccuccuccaagaaggacgaggagcacauccucuccggccgcgacaagcgccucgccgagcaggucuccuccuacaacgaguccaagcgcuccgagucccucauggacauccaccacaagaagcucaaguccaaggccgccgaggacaagaacaagccccaggagcgcauccccuucgaccgcgacaaggaccucaaggucaaccgcuucgacgaggcccagaagaaggcccucaucaagaagucccgcgagcucaacacccgcuucucccacggcaagggcaacauguuccucuga

SEQ ID NO: 43774 - RNA, 2487 nt, Artificial Sequence
  derived and/or modified sequence opt2 from GPAM__Homo_sapiens__XP_005270055
auggacgaguccgcccucacccucggcaccaucgacgucuccuaccucccccacuccuccgaguacuccgucggccgcugcaagcacaccuccgaggaguggggcgagugcggcuuccgccccaccaucuuccgcuccgccacccucaaguggaaggagucccucaugucccgcaagcgccccuucgucggccgcugcugcuacuccugcaccccccaguccugggacaaguucuucaaccccuccauccccucccucggccuccgcaacgucaucuacaucaacgagacccacacccgccaccgcggcuggcucgcccgccgccucuccuacguccucuucauccaggagcgcgacguccacaagggcauguucgccaccaacgucaccgagaacguccucaacuccucccgcguccaggaggccaucgccgaggucgccgccgagcucaaccccgacggcuccgcccagcagcaguccaaggccgucaacaaggucaagaagaaggccaagcgcauccuccaggagauggucgccaccgucucccccgccaugauccgccucaccggcuggguccuccucaagcucuucaacuccuucuucuggaacauccagauccacaagggccagcucgagauggucaaggccgccaccgagaccaaccucccccuccucuuccuccccguccaccgcucccacaucgacuaccuccuccucaccuucauccucuucugccacaacaucaaggcccccuacaucgccuccggcaacaaccucaacauccccaucuucuccacccucauccacaagcucggcggcuucuucauccgccgccgccucgacgagacccccgacggccgcaaggacguccucuaccgcgcccuccuccacggccacaucgucgagcuccuccgccagcagcaguuccucgagaucuuccucgagggcacccgcucccgcuccggcaagaccuccugcgcccgcgccggccuccucuccgucgucgucgacacccucuccaccaacgucauccccgacauccucaucauccccgucggcaucuccuacgaccgcaucaucgagggccacuacaacggcgagcagcucggcaagcccaagaagaacgagucccucugguccgucgcccgcggcgucauccgcaugcuccgcaagaacuacggcugcguccgcgucgacuucgcccagcccuucucccucaaggaguaccucgagucccagucccagaagcccgucuccgcccuccucucccucgagcaggcccuccuccccgccauccuccccucccgccccuccgacgccgccgacgagggccgcgacaccuccaucaacgagucccgcaacgccaccgacgagucccuccgccgccgccucaucgccaaccucgccgagcacauccucuucaccgccuccaaguccugcgccaucauguccacccacaucgucgccugccuccuccucuaccgccaccgccagggcaucgaccucuccacccucgucgaggacuucuucgucaugaaggaggagguccucgcccgcgacuucgaccucggcuucuccggcaacuccgaggacgucgucaugcacgccauccagcuccucggcaacugcgucaccaucacccacaccucccgcaacgacgaguucuucaucacccccuccaccaccguccccuccgucuucgagcucaacuucuacuccaacggcguccuccacgucuucaucauggaggccaucaucgccugcucccucuacgccguccucaacaagcgcggccucggcggccccaccuccaccccccccaaccucaucucccaggagcagcucguccgcaaggccgccucccucugcuaccuccucuccaacgagggcaccaucucccuccccugccagaccuucuaccaggucugccacgagaccgucggcaaguucauccaguacggcauccucaccgucgccgagcacgacgaccaggaggacaucucccccucccucgccgagcagcagugggacaagaagcuccccgagccccucuccuggcgcuccgacgaggaggacgaggacuccgacuucggcgaggagcagcgcgacugcuaccucaaggucucccaguccaaggagcaccagcaguucaucaccuuccuccagcgccuccucggcccccuccucgaggccuacuccuccgccgccaucuucguccacaacuucuccggccccguccccgagcccgaguaccuccagaagcuccacaaguaccucaucacccgcaccgagcgcaacgucgccgucuacgccgaguccgccaccuacugccucgucaagaacgccgucaagauguucaaggacaucggcgucuucaaggagaccaagcagaagcgcgucuccguccucgagcucuccuccaccuuccucccccagugcaaccgccagaagcuccucgaguacauccucuccuucgucguccucuga

SEQ ID NO: 43775 - RNA, 1071 nt, Artificial Sequence
  derived and/or modified sequence opt2 from GPANK1__Homo_sapiens__NP_149417
augucccgcccccuccucaucaccuucacccccgccaccgaccccuccgaccucuggaaggacggccagcagcagccccagcccgagaagcccgaguccacccucgacggcgccgccgcccgcgccuucuacgaggcccucaucggcgacgaguccuccgcccccgacucccagcgcucccagaccgagcccgcccgcgagcgcaagcgcaagaagcgccgcaucaugaaggcccccgccgccgaggccgucgccgagggcgccuccggccgccacggccagggccgcucccucgaggccgaggacaagaugacccaccgcauccuccgcgccgcccaggagggcgaccuccccgagcuccgccgccuccucgagccccacgaggccggcggcgccggcggcaacaucaacgcccgcgacgccuucugguggaccccccucaugugcgccgcccgcgccggccagggcgccgccgucuccuaccuccucggccgcggcgccgccugggucggcgucugcgagcucuccggccgcgacgccgcccagcucgccgaggaggccggcuuccccgaggucgcccgcaugguccgcgagucccacggcgagacccgcucccccgagaaccgcucccccacccccucccuccaguacugcgagaacugcgacacccacuuccaggacuccaaccaccgcaccuccaccgcccaccuccucucccucucccagggcccccagccccccaaccucccccucggcguccccaucuccucccccggcuucaagcuccuccuccgcggcggcugggagcccggcaugggccucggcccccgcggcgagggccgcgccaaccccauccccaccguccucaagcgcgaccaggagggccucggcuaccgcuccgccccccagccccgcgucacccacuuccccgccugggacacccgcgccgucgccggccgcgagcgccccccccgcgucgccacccucuccuggcgcgaggagcgccgccgcgaggagaaggaccgcgccugggagcgcgaccuccgcaccuacaugaaccucgaguucuga

SEQ ID NO: 43776 - RNA, 2388 nt, Artificial Sequence
  derived and/or modified sequence opt2 from GPAT2__Homo_sapiens__NP_997211
auggccaccaugcucgagggccgcugccagacccagccccgcuccucccccuccggccgcgaggccucccucugguccuccggcuucggcaugaagcucgaggccgucacccccuuccucggcaaguaccgccccuucgucggccgcugcugccagaccugcacccccaaguccugggagucccucuuccaccgcuccaucaccgaccucggcuucugcaacgucauccucgucaaggaggagaacacccgcuuccgcggcuggcucguccgccgccucugcuacuuccucuggucccucgagcagcacaucccccccugccaggacgucccccagaagaucauggaguccaccggcguccagaaccuccucuccggccgcguccccggcggcaccggcgagggccagguccccgaccucgucaagaaggagguccagcgcauccucggccacauccaggcccccccccgccccuuccucguccgccucuucuccugggcccuccuccgcuuccucaacugccucuuccucaacguccagcuccacaagggccagaugaagaugguccagaaggccgcccaggccggccucccccucguccuccucuccacccacaagacccuccucgacggcauccuccuccccuucaugcuccucucccagggccucggcguccuccgcgucgccugggacucccgcgccugcucccccgcccuccgcgcccuccuccgcaagcucggcggccucuuccucccccccgaggccucccucucccucgacuccuccgagggccuccucgcccgcgccgucguccaggccgucaucgagcagcuccucgucuccggccagccccuccucaucuuccucgaggagccccccggcgcccucggcccccgccucuccgcccucggccaggccugggucggcuucgucguccaggccguccaggucggcaucguccccgacgcccuccucguccccgucgccgucaccuacgaccucguccccgacgcccccugcgacaucgaccacgccuccgccccccucggccucuggaccggcgcccucgccguccuccgcucccucuggucccgcuggggcugcucccaccgcaucugcucccgcguccaccucgcccagcccuucucccuccaggaguacaucgucuccgcccgcuccugcuggggcggccgccagacccucgagcagcuccuccagcccaucguccucggccagugcaccgccguccccgacaccgagaaggagcaggaguggacccccaucaccggcccccuccucgcccucaaggaggaggaccagcuccucguccgccgccucuccugccacguccucuccgccuccgucggcuccuccgccgucauguccaccgccaucauggccacccuccuccucuucaagcaccagaagcuccucggcgaguucuccuggcucaccgaggagauccuccuccgcggcuucgacgucggcuucuccggccagcuccgcucccuccuccagcacucccucucccuccuccgcgcccacgucgcccuccuccgcauccgccagggcgaccuccucgucgucccccagcccggccccggccucacccaccucgcccagcucuccgccgagcuccuccccgucuuccucuccgaggccgucggcgccugcgccguccgcggccuccucgccggccgcguccccccccagggccccugggagcuccagggcauccuccuccucucccagaacgagcucuaccgccagauccuccuccucaugcaccuccucccccaggaccuccuccuccucaagcccugccaguccuccuacugcuacugccaggagguccucgaccgccucauccagugcggccuccucgucgccgaggagacccccggcucccgccccgccugcgacaccggccgccagcgccucucccgcaagcuccucuggaagcccuccggcgacuucaccgacuccgacuccgacgacuucggcgaggccgacggccgcuacuuccgccucucccagcagucccacugccccgacuucuuccucuuccucugccgccuccucuccccccuccucaaggccuucgcccaggccgccgccuuccuccgccagggccagcuccccgacaccgagcucggcuacaccgagcagcucuuccaguuccuccaggccaccgcccaggaggagggcaucuucgagugcgccgaccccaagcucgccaucuccgccgucuggaccuuccgcgaccucggcguccuccagcagacccccucccccgccggcccccgccuccaccucucccccaccuucgccucccucgacaaccaggagaagcucgagcaguucauccgccaguucaucugcuccuga

SEQ ID NO: 43777 - RNA, 2796 nt, Artificial Sequence
  derived and/or modified sequence opt2 from GPATCH1__Homo_sapiens__NP_060495
auggccgcccgcgacuccgacuccgaggaggaccucgucuccuacggcaccggccucgagccccucgaggagggcgagcgccccaagaagcccaucccccuccaggaccagaccguccgcgacgagaagggccgcuacaagcgcuuccacggcgccuucuccggcggcuucuccgccggcuacuucaacaccgucggcuccaaggagggcuggacccccuccaccuucgucuccucccgccagaaccgcgccgacaaguccguccucggccccgaggacuucauggacgaggaggaccucuccgaguucggcaucgcccccaaggccaucgucaccaccgacgacuucgccuccaagaccaaggaccgcauccgcgagaaggcccgccagcucgccgccgccaccgcccccauccccggcgccacccuccucgacgaccucaucacccccgccaagcucuccgucggcuucgagcuccuccgcaagaugggcuggaaggagggccagggcgucggcccccgcgucaagcgccgcccccgccgccagaagcccgaccccggcgucaagaucuacggcugcgcccucccccccggcuccuccgagggcuccgagggcgaggacgacgacuaccuccccgacaacgucaccuucgcccccaaggacgucacccccgucgacuucacccccaaggacaacguccacggccucgccuacaagggccucgacccccaccaggcccucuucggcaccuccggcgagcacuucaaccucuucuccggcggcuccgagcgcgccggcgaccucggcgagaucggccucaacaagggccgcaagcucggcaucuccggccaggccuucggcgucggcgcccucgaggaggaggacgacgacaucuacgccaccgagacccucuccaaguacgacaccguccucaaggacgaggagcccggcgacggccucuacggcuggaccgccccccgccaguacaagaaccagaaggaguccgagaaggaccuccgcuacgucggcaagauccucgacggcuucucccucgccuccaagccccucuccuccaagaagaucuaccccccccccgagcucccccgcgacuaccgccccguccacuacuuccgccccauggucgccgccaccuccgagaacucccaccuccuccagguccucuccgaguccgccggcaaggccacccccgaccccggcacccacuccaagcaccagcucaacgccuccaagcgcgccgagcuccucggcgagacccccauccagggcuccgccaccuccguccucgaguuccucucccagaaggacaaggagcgcaucaaggagaugaagcaggccaccgaccucaaggccgcccagcucaaggcccgcucccucgcccagaacgcccaguccucccgcgcccagcucucccccgccgccgccgccggccacugcuccuggaacauggcccucggcggcggcaccgccacccucaaggccuccaacuucaagcccuucgccaaggaccccgagaagcagaagcgcuacgacgaguuccucguccacaugaagcagggccagaaggacgcccucgagcgcugccucgaccccuccaugaccgagugggagcgcggccgcgagcgcgacgaguucgcccgcgccgcccuccucuacgccuccucccacuccacccucuccucccgcuucacccacgccaaggaggaggacgacuccgaccaggucgaggucccccgcgaccaggagaacgacgucggcgacaagcaguccgccgucaagaugaagauguucggcaagcucacccgcgacaccuucgaguggcaccccgacaagcuccucugcaagcgcuucaacguccccgaccccuaccccgacuccacccucgucggccucccccgcgucaagcgcgacaaguacuccgucuucaacuuccucacccuccccgagaccgccucccuccccaccacccaggccuccuccgagaaggucucccagcaccgcggccccgacaagucccgcaagcccucccgcugggacaccuccaagcacgagaagaaggaggacuccaucuccgaguuccucucccucgcccgcuccaaggccgagccccccaagcagcaguccuccccccucgucaacaaggaggaggagcacgcccccgagcucuccgccaaccagaccgucaacaaggacgucgacgcccaggccgagggcgagggcucccgccccuccauggaccucuuccgcgccaucuucgccuccuccuccgacgagaaguccuccuccuccgaggacgagcagggcgacuccgaggacgaccaggccggcuccggcgaggccaacuuccaguccucccaggacaccgaccucggcgagaccuccuccgucgcccacgcccucguccccgccccccaggagcccccccccuccuuccccauccagaagaugcagaucgacgagcgcgaggaguucggcccccgccucccccccgucuucugccccaacgcccgccagacccucgaggucccccagaaggagaagcacaagaagaacaaggacaagcacaaggccaagaaggagcaccgccgcaagaaggagaagaagaagaagcaccgcaagcacaagcacaagggcaagcagaagaacaagaagcccgagaaguccuccuccuccgaguccuccgacuccuccgacucccaguccgacgaggagaccgccgacgucuccccccaggagcuccuccgccgccucaagucccucccccuccgccgccaguga

SEQ ID NO: 43778 - RNA, 1131 nt, Artificial Sequence
  derived and/or modified sequence opt2 from GPATCH2__Homo_sapiens__NP_001284683
auguucggcgccgccggccgccagcccaucggcgcccccgccgccggcaacuccuggcacuucucccgcaccauggaggagcucguccacgaccucgucuccgcccucgaggaguccuccgagcaggcccgcggcggcuucgccgagaccggcgaccacucccgcuccaucuccugcccccucaagcgccaggcccgcaagcgccgcggccgcaagcgccgcuccuacaacguccaccaccccugggagaccggccacugccucuccgagggcuccgacuccucccucgaggagcccuccaaggacuaccgcgagaaccacaacaacaacaagaaggaccacuccgacuccgacgaccagaugcucgucgccaagcgccgccccuccuccaaccucaacaacaacguccgcggcaagcgcccccucuggcacgaguccgacuucgccgucgacaacgucggcaaccgcacccuccgccgccgccgcaaggucaagcgcauggccgucgaccucccccaggacaucuccaacaagcgcaccaugacccagccccccgagggcugccgcgaccaggacauggacuccgaccgcgccuaccaguaccaggaguucaccaagaacaaggucaagaagcgcaagcucaagaucauccgccagggccccaagauccaggacgagggcgucguccucgaguccgaggagaccaaccagaccaacaaggacaagauggagugcgaggagcagaaggucuccgacgagcucauguccgaguccgacuccuccucccucuccuccaccgacgccggccucuucaccaacgacgagggccgccagggcgacgacgagcaguccgacugguucuacgagaaggaguccggcggcgccugcggcaucaccggcgucguccccuggugggagaaggaggaccccaccgagcucgacaagaacguccccgaccccgucuucgaguccauccucaccggcuccuucccccucaugucccaccccucccgccgcggcuuccaggcccgccucucccgccuccacggcauguccuccaagaacaucaagaaguccggcggcacccccaccuccauggccaccaacuggaccuccgagaucccccucuga

SEQ ID NO: 43779 - RNA, 1449 nt, Artificial Sequence
  derived and/or modified sequence opt2 from GPATCH2L__Homo_sapiens__NP_060396
auggacgagcucguccacgaccucgccuccgcccucgagcagaccuccgagcagaacaagcucggcgagcucugggaggagauggcccucuccccccgccagcagcgccgccagcuccgcaagcgccgcggccgcaagcgccgcuccgacuucacccaccucgccgagcacaccugcugcuacuccgaggccuccgaguccucccucgacgaggccaccaaggacugccgcgaggucgcccccgucaccaacuucuccgacuccgacgacaccauggucgccaagcgccaccccgcccucaacgccaucgucaaguccaagcagcacuccuggcacgaguccgacuccuucaccgagaacgcccccugccgcccccuccgccgccgccgcaaggucaagcgcgucaccuccgaggucgccgccucccuccagcagaagcucaaggucuccgacugguccuacgagcgcggcugccgcuucaaguccgccaagaagcagcgccucucccgcuggaaggagaacacccccuggaccuccuccggccacggccucugcgaguccgccgagaaccgcaccuuccucuccaagaccggccgcaaggagcgcauggagugcgagaccgacgagcagaagcagggcuccgacgagaacauguccgagugcgagaccuccuccgucugcuccuccuccgacaccggccucuucaccaacgacgagggccgccagggcgacgacgagcaguccgacugguucuacgagggcgagugcguccccggcuucaccguccccaaccuccuccccaagugggcccccgaccacugcuccgaggucgagcgcauggacuccggccucgacaaguucuccgacuccaccuuccuccuccccucccgccccgcccagcgcggcuaccacacccgccucaaccgccuccccggcgccgccgcccgcugccuccgcaagggccgccgccgccucgucggcaaggagaccuccaucaacacccucggcaccgagcgcaucucccacaucaucuccgacccccgccagaaggagaagaacaaggcccucgccuccgacuucccccacaucuccgccugcgcccacgaguucaacccccucuccccccucuacucccucgacguccucgccgacgccucccaccgccgcugcucccccgcccacugcuccgcccgccaggccaacguccacuggggcccccccugcucccgcgacaucaagcgcaagcgcaagcccgucgccaccgccucccucuccucccccuccgccguccacauggacgccgucgagcccaccacccccgccucccaggcccccaagucccccuccuccgaguggcucguccgcaccuccgccgccgagaaggccaccgacgccaccaccgccaccuucuucaagaugccccaggagaagucccccggcuacuccuga

SEQ ID NO: 43780 - RNA, 4509 nt, Artificial Sequence
  derived and/or modified sequence opt2 from GPATCH8__Homo_sapiens__NP_001002909
auggccgaccgcuucucccgcuucaacgaggaccgcgacuuccagggcaaccacuucgaccaguacgaggagggccaccucgagaucgagcaggccucccucgacaagcccaucgaguccgacaacaucggccaccgccuccuccagaagcacggcuggaagcucggccagggccucggcaagucccuccagggccgcaccgaccccauccccaucgucgucaaguacgacgucaugggcaugggccgcauggagauggagcucgacuacgccgaggacgccaccgagcgccgccgcguccucgaggucgagaaggaggacaccgaggagcuccgccagaaguacaaggacuacgucgacaaggagaaggccaucgccaaggcccucgaggaccuccgcgccaacuucuacugcgagcucugcgacaagcaguaccagaagcaccaggaguucgacaaccacaucaacuccuacgaccacgcccacaagcagcgccucaaggaccucaagcagcgcgaguucgcccgcaacgucuccucccgcucccgcaaggacgagaagaagcaggagaaggcccuccgccgccuccacgagcucgccgagcagcgcaagcaggccgagugcgcccccggcuccggccccauguucaagcccaccaccgucgccgucgacgaggagggcggcgaggacgacaaggacgaguccgccaccaacuccggcaccggcgccaccgccuccugcggccucggcuccgaguucuccaccgacaagggcggccccuucaccgccguccagaucaccaacaccaccggccucgcccaggcccccggccucgccucccagggcaucuccuucggcaucaagaacaaccucggcaccccccuccagaagcucggcgucuccuucuccuucgccaagaaggcccccgucaagcucgaguccaucgccuccgucuucaaggaccacgccgaggagggcaccuccgaggacggcaccaagcccgacgagaaguccuccgaccagggccuccagaaggucggcgacuccgacggcuccuccaaccucgacggcaagaaggaggacgaggacccccaggacggcggcucccucgccuccacccucuccaagcucaagcgcaugaagcgcgaggagggcgccggcgccaccgagcccgaguacuaccacuacaucccccccgcccacugcaaggucaagcccaacuuccccuuccuccucuucaugcgcgccuccgagcagauggacggcgacaacaccacccaccccaagaacgcccccgaguccaagaagggcuccucccccaagcccaaguccugcaucaaggccgccgccucccagggcgccgagaagaccgucuccgaggucuccgagcagcccaaggagaccuccaugaccgagcccuccgagcccggcuccaaggccgaggccaagaaggcccucggcggcgacgucuccgaccagucccucgagucccacucccagaaggucuccgagacccagaugugcgaguccaacuccuccaaggagaccucccucgccacccccgccggcaaggagucccaggagggccccaagcaccccaccggccccuucuuccccguccucuccaaggacgaguccaccgcccuccaguggcccuccgagcuccucaucuucaccaaggccgagcccuccaucuccuacuccugcaacccccucuacuucgacuucaagcucucccgcaacaaggacgcccgcaccaagggcaccgagaagcccaaggacaucggcuccuccuccaaggaccaccuccagggccucgaccccggcgagcccaacaaguccaaggaggucggcggcgagaagaucguccgcuccuccggcggccgcauggacgcccccgccuccggcuccgccugcuccggccucaacaagcaggagcccggcggcucccacggcuccgagaccgaggacaccggccgcucccuccccuccaagaaggagcgcuccggcaagucccaccgccacaagaagaagaagaagcacaagaaguccuccaagcacaagcgcaagcacaaggccgacaccgaggagaaguccuccaaggccgaguccggcgagaaguccaagaagcgcaagaagcgcaagcgcaagaagaacaaguccuccgcccccgccgacuccgagcgcggccccaagcccgagccccccggcuccggcucccccgcccccccccgccgccgccgccgcgcccaggacgacucccagcgccgcucccuccccgccgaggagggcuccuccggcaagaaggacgagggcggcggcggcuccuccucccaggaccacggcggccgcaagcacaagggcgagcucccccccuccuccugccagcgccgcgccggcaccaagcgcuccucccgcuccucccaccgcucccagcccuccuccggcgacgaggacuccgacgacgccuccucccaccgccuccaccagaagucccccucccaguacuccgaggaggaggaggaggaggacuccggcuccgagcacucccgcucccgcucccgcuccggccgccgccacuccucccaccgcuccucccgccgcuccuacuccuccuccuccgacgccuccuccgaccaguccugcuacucccgccagcgcuccuacuccgacgacuccuacuccgacuacuccgaccgcucccgccgccacuccaagcgcucccacgacuccgacgacuccgacuacgccuccuccaagcaccgcuccaagcgccacaaguacuccuccuccgacgacgacuacucccucuccugcucccagucccgcucccgcucccgcucccacacccgcgagcgcucccgcucccgcggccgcucccgcuccuccuccugcucccgcucccgcuccaagcgccgcucccgcuccaccaccgcccacuccuggcagcgcucccgcuccuacucccgcgaccgcucccgcuccacccgcucccccucccagcgcuccggcucccgcaagcgcuccuggggccacgagucccccgaggagcgccacuccggccgccgcgacuucauccgcuccaagaucuaccgcucccaguccccccacuacuuccgcuccggccgcggcgagggccccggcaagaaggacgacggccgcggcgacgacuccaaggccaccggcccccccucccagaacuccaacaucggcaccggccgcggcuccgagggcgacugcucccccgaggacaagaacuccgucaccgccaagcuccuccucgagaagauccagucccgcaaggucgagcgcaagcccuccgucuccgaggagguccaggccacccccaacaaggccggccccaagcucaaggaccccccccagggcuacuucggccccaagcucccccccucccucggcaacaagcccguccucccccucaucggcaagcuccccgccacccgcaagcccaacaagaagugcgaggaguccggccucgagcgcggcgaggagcaggagcaguccgagaccgaggagggcccccccggcuccuccgacgcccucuucggccaccaguuccccuccgaggagaccaccggcccccuccucgaccccccccccgaggaguccaaguccggcgaggccaccgccgaccaccccgucgccccccucggcacccccgcccacuccgacugcuaccccggcgaccccaccaucucccacaacuaccuccccgaccccuccgacggcgacacccucgagucccucgacuccuccucccagcccggccccgucgaguccucccuccuccccaucgcccccgaccucgagcacuuccccuccuacgccccccccuccggcgaccccuccaucgaguccaccgacggcgccgaggacgccucccucgccccccucgagucccagcccaucaccuucacccccgaggagauggagaaguacuccaagcuccagcaggccgcccagcagcacauccagcagcagcuccucgccaagcaggucaaggccuuccccgccuccgccgcccucgcccccgccacccccgcccuccagcccauccacauccagcagcccgccaccgccuccgccaccuccaucaccaccguccagcacgccauccuccagcaccacgccgccgccgccgccgccgccaucggcauccacccccacccccacccccagccccucgcccagguccaccacaucccccagccccaccucacccccaucucccucucccaccucacccacuccaucauccccggccaccccgccaccuuccucgccucccaccccauccacaucauccccgccuccgccauccaccccggccccuucaccuuccaccccgucccccacgccgcccucuaccccacccuccucgccccccgccccgccgccgccgccgccaccgcccuccaccuccacccccuccuccaccccaucuucuccggccaggaccuccagcacccccccucccacggcaccuga

SEQ ID NO: 43781 - RNA, 993 nt, Artificial Sequence
  derived and/or modified sequence opt2 from GPBAR1__Homo_sapiens__XP_011509046
augacccccaacuccaccggcgagguccccucccccauccccaagggcgcccucggccucucccucgcccucgccucccucaucaucaccgccaaccuccuccucgcccucggcaucgccugggaccgccgccuccgcuccccccccgccggcugcuucuuccucucccuccuccucgccggccuccucaccggccucgcccuccccacccuccccggccucuggaaccagucccgccgcggcuacugguccugccuccucgucuaccucgcccccaacuucuccuuccucucccuccucgccaaccuccuccucguccacggcgagcgcuacauggccguccuccgcccccuccagccccccggcuccauccgccucgcccuccuccucaccugggccggcccccuccucuucgccucccuccccgcccucggcuggaaccacuggacccccggcgccaacugcuccucccaggccaucuuccccgcccccuaccucuaccucgaggucuacggccuccuccuccccgccgucggcgccgccgccuuccucuccguccgcguccucgccaccgcccaccgccagcuccaggacaucugccgccucgagcgcgccgucugccgcgacgagcccuccgcccucgcccgcgcccucaccuggcgccaggcccgcgcccaggccggcgccaugcuccucuucggccucugcuggggccccuacgucgccacccuccuccucuccguccucgccuacgagcagcgccccccccucggccccggcacccuccucucccuccucucccucggcuccgccuccgccgccgccguccccgucgccaugggccucggcgaccagcgcuacaccgcccccuggcgcgccgccgcccagcgcugccuccagggccucuggggccgcgccucccgcgacucccccggccccuccaucgccuaccaccccuccucccaguccuccgucgaccucgaccucaacuga

SEQ ID NO: 43782 - RNA, 1677 nt, Artificial Sequence
  derived and/or modified sequence opt2 from GPC1__Homo_sapiens__NP_002072
auggagcuccgcgcccgcggcugguggcuccucugcgccgccgccgcccucgucgccugcgcccgcggcgaccccgccuccaagucccgcuccugcggcgagguccgccagaucuacggcgccaagggcuucucccucuccgacgucccccaggccgagaucuccggcgagcaccuccgcaucugcccccagggcuacaccugcugcaccuccgagauggaggagaaccucgccaaccgcucccacgccgagcucgagaccgcccuccgcgacuccucccgcguccuccaggccaugcucgccacccagcuccgcuccuucgacgaccacuuccagcaccuccucaacgacuccgagcgcacccuccaggccaccuuccccggcgccuucggcgagcucuacacccagaacgcccgcgccuuccgcgaccucuacuccgagcuccgccucuacuaccgcggcgccaaccuccaccucgaggagacccucgccgaguucugggcccgccuccucgagcgccucuucaagcagcuccacccccagcuccuccuccccgacgacuaccucgacugccucggcaagcaggccgaggcccuccgccccuucggcgaggccccccgcgagcuccgccuccgcgccacccgcgccuucgucgccgcccgcuccuucguccagggccucggcgucgccuccgacgucguccgcaaggucgcccaggucccccucggccccgagugcucccgcgccgucaugaagcucgucuacugcgcccacugccucggcguccccggcgcccgccccugccccgacuacugccgcaacguccucaagggcugccucgccaaccaggccgaccucgacgccgaguggcgcaaccuccucgacuccaugguccucaucaccgacaaguucuggggcaccuccggcgucgaguccgucaucggcuccguccacaccuggcucgccgaggccaucaacgcccuccaggacaaccgcgacacccucaccgccaaggucauccagggcugcggcaaccccaaggucaacccccagggccccggccccgaggagaagcgccgccgcggcaagcucgccccccgcgagcgcccccccuccggcacccucgagaagcucgucuccgaggccaaggcccagcuccgcgacguccaggacuucuggaucucccuccccggcacccucugcuccgagaagauggcccucuccaccgccuccgacgaccgcugcuggaacggcauggcccgcggccgcuaccuccccgaggucaugggcgacggccucgccaaccagaucaacaaccccgaggucgaggucgacaucaccaagcccgacaugaccauccgccagcagaucaugcagcucaagaucaugaccaaccgccuccgcuccgccuacaacggcaacgacgucgacuuccaggacgccuccgacgacggcuccggcuccggcuccggcgacggcugccucgacgaccucugcucccgcaaggucucccgcaaguccuccuccucccgcaccccccucacccacgcccuccccggccucuccgagcaggagggccagaagaccuccgccgccuccugcccccagccccccaccuuccuccucccccuccuccucuuccucgcccucaccgucgcccgcccccgcuggcgcuga

SEQ ID NO: 43783 - RNA, 1740 nt, Artificial Sequence
  derived and/or modified sequence opt2 from GPC2__Homo_sapiens__NP_689955
auguccgcccuccgcccccuccuccuccuccuccucccccucugccccggccccggccccggccccggcuccgaggccaaggucacccgcuccugcgccgagacccgccagguccucggcgcccgcggcuacucccucaaccucaucccccccgcccucaucuccggcgagcaccuccgcgucugcccccaggaguacaccugcugcuccuccgagaccgagcagcgccucauccgcgagaccgaggccaccuuccgcggccucgucgaggacuccggcuccuuccucguccacacccucgccgcccgccaccgcaaguucgacgaguucuuccucgagaugcucuccgucgcccagcacucccucacccagcucuucucccacuccuacggccgccucuacgcccagcacgcccucaucuucaacggccucuucucccgccuccgcgacuucuacggcgaguccggcgagggccucgacgacacccucgccgacuucugggcccagcuccucgagcgcgucuucccccuccuccacccccaguacuccuucccccccgacuaccuccucugccucucccgccucgccuccuccaccgacggcucccuccagcccuucggcgacuccccccgccgccuccgccuccagaucacccgcacccucgucgccgcccgcgccuucguccagggccucgagaccggccgcaacgucgucuccgaggcccucaagguccccgucuccgagggcugcucccaggcccucaugcgccucaucggcugcccccucugccgcggcguccccucccucaugcccugccagggcuucugccucaacgucguccgcggcugccucuccucccgcggccucgagcccgacuggggcaacuaccucgacggccuccucauccucgccgacaagcuccagggccccuucuccuucgagcucaccgccgaguccaucggcgucaagaucuccgagggccucauguaccuccaggagaacuccgccaaggucuccgcccaggucuuccaggagugcggcccccccgaccccguccccgcccgcaaccgccgcgccccccccccccgcgaggaggccggccgccucugguccauggucaccgaggaggagcgccccaccaccgccgccggcaccaaccuccaccgccucgucugggagcuccgcgagcgccucgcccgcaugcgcggcuucugggcccgccucucccucaccgucugcggcgacucccgcauggccgccgacgccucccucgaggccgcccccugcuggaccggcgccggccgcggccgcuaccucccccccgucgucggcggcucccccgccgagcaggucaacaaccccgagcucaaggucgacgccuccggccccgacguccccacccgccgccgccgccuccagcuccgcgccgccaccgcccgcaugaagaccgccgcccucggccacgaccucgacggccaggacgccgacgaggacgccuccggcuccggcggcggccagcaguacgccgacgacuggauggccggcgccgucgccccccccgcccgccccccccgcccccccuaccccccccgccgcgacggcuccggcggcaagggcggcggcggcuccgcccgcuacaaccagggccgcucccgcuccggcggcgccuccaucggcuuccacacccagaccauccucauccucucccucuccgcccucgcccuccucggcccccgcuga

SEQ ID NO: 43784 - RNA, 1812 nt, Artificial Sequence
  derived and/or modified sequence opt2 from GPC3__Homo_sapiens__NP_001158089
auggccggcaccguccgcaccgccugccucgucgucgccaugcuccucucccucgacuuccccggccaggcccagccccccccccccccccccgacgccaccugccaccagguccgcuccuucuuccagcgccuccagcccggccucaaguggguccccgagacccccguccccggcuccgaccuccaggucugccuccccaagggccccaccugcugcucccgcaagauggaggagaaguaccagcucaccgcccgccucaacauggagcagcuccuccaguccgccuccauggagcucaaguuccucaucauccagaacgccgccgucuuccaggaggccuucgagaucgucguccgccacgccaagaacuacaccaacgccauguucaagaacaacuaccccucccucaccccccaggccuucgaguucgucggcgaguucuucaccgacgucucccucuacauccucggcuccgacaucaacgucgacgacauggucaacgagcucuucgacucccucuuccccgucaucuacacccagcucaugaaccccggccuccccgacuccgcccucgacaucaacgagugccuccgcggcgcccgccgcgaccucaaggucuucggcaacuuccccaagcucaucaugacccaggucuccaagucccuccaggucacccgcaucuuccuccaggcccucaaccucggcaucgaggucaucaacaccaccgaccaccucaaguucuccaaggacugcggccgcaugcucacccgcaugugguacugcuccuacugccagggccucaugauggucaagcccugcggcggcuacugcaacgucgucaugcagggcugcauggccggcgucgucgagaucgacaaguacuggcgcgaguacauccucucccucgaggagcucgucaacggcauguaccgcaucuacgacauggagaacguccuccucggccucuucuccaccauccacgacuccauccaguacguccagaagaacgccggcaagcucaccaccaccgagaccgagaagaagaucuggcacuucaaguaccccaucuucuuccucugcaucggccucgaccuccagaucggcaagcucugcgcccacucccagcagcgccaguaccgcuccgccuacuaccccgaggaccucuucaucgacaagaagguccucaaggucgcccacgucgagcacgaggagacccucuccucccgccgccgcgagcucauccagaagcucaaguccuucaucuccuucuacuccgcccuccccggcuacaucugcucccacucccccgucgccgagaacgacacccucugcuggaacggccaggagcucgucgagcgcuacucccagaaggccgcccgcaacggcaugaagaaccaguucaaccuccacgagcucaagaugaagggccccgagcccgucgucucccagaucaucgacaagcucaagcacaucaaccagcuccuccgcaccauguccaugcccaagggccgcguccucgacaagaaccucgacgaggagggcuucgaguccggcgacugcggcgacgacgaggacgagugcaucggcggcuccggcgacggcaugaucaaggucaagaaccagcuccgcuuccucgccgagcucgccuacgaccucgacgucgacgacgcccccggcaacucccagcaggccacccccaaggacaacgagaucuccaccuuccacaaccucggcaacguccacuccccccucaagcuccucaccuccauggccaucuccgucgucugcuucuucuuccucguccacuga

SEQ ID NO: 43785 - RNA, 1671 nt, Artificial Sequence
  derived and/or modified sequence opt2 from GPC4__Homo_sapiens__NP_001439
auggcccgcuucggccuccccgcccuccucugcacccucgccguccucuccgccgcccuccucgccgccgagcucaaguccaaguccugcuccgagguccgccgccucuacgucuccaagggcuucaacaagaacgacgccccccuccacgagaucaacggcgaccaccucaagaucugcccccagggcuccaccugcugcucccaggagauggaggagaaguacucccuccaguccaaggacgacuucaaguccgucgucuccgagcagugcaaccaccuccaggccgucuucgccucccgcuacaagaaguucgacgaguucuucaaggagcuccucgagaacgccgagaagucccucaacgacauguucgucaagaccuacggccaccucuacaugcagaacuccgagcucuucaaggaccucuucgucgagcucaagcgcuacuacgucgucggcaacgucaaccucgaggagaugcucaacgacuucugggcccgccuccucgagcgcauguuccgccucgucaacucccaguaccacuucaccgacgaguaccucgagugcgucuccaaguacaccgagcagcucaagcccuucggcgacgucccccgcaagcucaagcuccaggucacccgcgccuucgucgccgcccgcaccuucgcccagggccucgccgucgccggcgacgucgucuccaaggucuccgucgucaaccccaccgcccagugcacccacgcccuccucaagaugaucuacugcucccacugccgcggccucgucaccgucaagcccugcuacaacuacugcuccaacaucaugcgcggcugccucgccaaccagggcgaccucgacuucgaguggaacaacuucaucgacgccaugcucauggucgccgagcgccucgagggccccuucaacaucgaguccgucauggaccccaucgacgucaagaucuccgacgccaucaugaacaugcaggacaacuccguccaggucucccagaaggucuuccagggcugcggcccccccaagccccuccccgccggccgcaucucccgcuccaucuccgaguccgccuucuccgcccgcuuccgcccccaccaccccgaggagcgccccaccaccgccgccggcaccucccucgaccgccucgucaccgacgucaaggagaagcucaagcaggccaagaaguucugguccucccuccccuccaacgucugcaacgacgagcgcauggccgccggcaacggcaacgaggacgacugcuggaacggcaagggcaagucccgcuaccucuucgccgucaccggcaacggccucgccaaccagggcaacaaccccgagguccaggucgacaccuccaagcccgacauccucauccuccgccagaucauggcccuccgcgucaugaccuccaagaugaagaacgccuacaacggcaacgacgucgacuucuucgacaucuccgacgaguccuccggcgagggcuccggcuccggcugcgaguaccagcagugccccuccgaguucgacuacaacgccaccgaccacgccggcaaguccgccaacgagaaggccgacuccgccggcguccgccccggcgcccaggccuaccuccucaccgucuucugcauccucuuccucgucaugcagcgcgaguggcgcuga

SEQ ID NO: 43786 - RNA, 1719 nt, Artificial Sequence
  derived and/or modified sequence opt2 from GPC5__Homo_sapiens__NP_004457
auggacgcccagaccuggcccgucggcuuccgcugccuccuccuccucgcccucgucggcuccgcccgcuccgagggcguccagaccugcgaggagguccgcaagcucuuccaguggcgccuccucggcgccguccgcggccuccccgacuccccccgcgccggccccgaccuccaggucugcaucuccaagaagcccaccugcugcacccgcaagauggaggagcgcuaccagaucgccgcccgccaggacaugcagcaguuccuccagaccuccuccuccacccucaaguuccucaucucccgcaacgccgccgccuuccaggagacccucgagacccucaucaagcaggccgagaacuacaccuccauccucuucugcuccaccuaccgcaacauggcccucgaggccgccgccuccguccaggaguucuucaccgacgucggccucuaccucuucggcgccgacgucaaccccgaggaguucgucaaccgcuucuucgacucccucuucccccucgucuacaaccaccucaucaaccccggcgucaccgacuccucccucgaguacuccgagugcauccgcauggcccgccgcgacgucucccccuucggcaacaucccccagcgcgucaugggccagaugggccgcucccuccuccccucccgcaccuuccuccaggcccucaaccucggcaucgaggucaucaacaccaccgacuaccuccacuucuccaaggagugcucccgcgcccuccucaagaugcaguacugcccccacugccagggccucgcccucaccaagcccugcaugggcuacugccucaacgucaugcgcggcugccucgcccacauggccgagcucaacccccacuggcacgccuacauccgcucccucgaggagcucuccgacgccaugcacggcaccuacgacaucggccacguccuccucaacuuccaccuccucgucaacgacgccguccuccaggcccaccucaacggccagaagcuccucgagcaggucaaccgcaucugcggccgccccguccgcacccccacccaguccccccgcugcuccuucgaccaguccaaggagaagcacggcaugaagaccaccacccgcaacuccgaggagacccucgccaaccgccgcaaggaguucaucaacucccuccgccucuaccgcuccuucuacggcggccucgccgaccagcucugcgccaacgagcucgccgccgccgacggccuccccugcuggaacggcgaggacaucgucaaguccuacacccagcgcgucgucggcaacggcaucaaggcccaguccggcaaccccgaggucaaggucaagggcaucgaccccgucaucaaccagaucaucgacaagcucaagcacgucguccagcuccuccagggccgcucccccaagcccgacaagugggagcuccuccagcucggcuccggcggcggcauggucgagcaggucuccggcgacugcgacgacgaggacggcugcggcggcuccggcuccggcgaggucaagcgcacccucaagaucaccgacuggaugcccgacgacaugaacuucuccgacgucaagcagauccaccagaccgacaccggcuccacccucgacaccaccggcgccggcugcgccgucgccaccgaguccaugaccuucacccucaucuccgucgucaugcuccuccccggcaucugguga

SEQ ID NO: 43787 - RNA, 1668 nt, Artificial Sequence
  derived and/or modified sequence opt2 from GPC6__Homo_sapiens__NP_005699
augcccuccuggaucggcgccgucauccucccccuccucggccuccuccucucccuccccgccggcgccgacgucaaggcccgcuccugcggcgagguccgccaggccuacggcgccaagggcuucucccucgccgacauccccuaccaggagaucgccggcgagcaccuccgcaucugcccccaggaguacaccugcugcaccaccgagauggaggacaagcucucccagcaguccaagcucgaguucgagaaccucgucgaggagaccucccacuucguccgcaccaccuucgucucccgccacaagaaguucgacgaguucuuccgcgagcuccucgagaacgccgagaagucccucaacgacauguucguccgcaccuacggcaugcucuacaugcagaacuccgaggucuuccaggaccucuucaccgagcucaagcgcuacuacaccggcggcaacgucaaccucgaggagaugcucaacgacuucugggcccgccuccucgagcgcauguuccagcucaucaacccccaguaccacuucuccgaggacuaccucgagugcgucuccaaguacaccgaccagcucaagcccuucggcgacgucccccgcaagcucaagauccaggucacccgcgccuucaucgccgcccgcaccuucguccagggccucaccgucggccgcgaggucgccaaccgcgucuccaaggucucccccacccccggcugcauccgcgcccucaugaagaugcucuacugccccuacugccgcggccuccccaccguccgccccugcaacaacuacugccucaacgucaugaagggcugccucgccaaccaggccgaccucgacaccgaguggaaccucuucaucgacgccaugcuccucgucgccgagcgccucgagggccccuucaacaucgaguccgucauggaccccaucgacgucaagaucuccgaggccaucaugaacaugcaggagaacuccaugcaggucuccgccaaggucuuccagggcugcggccagcccaagcccgcccccgcccuccgcuccgcccgcuccgcccccgagaacuucaacacccgcuuccgccccuacaaccccgaggagcgccccaccaccgccgccggcaccucccucgaccgccucgucaccgacaucaaggagaagcucaagcucuccaagaaggucugguccgcccuccccuacaccaucugcaaggacgaguccgucaccgccggcaccuccaacgaggaggagugcuggaacggccacuccaaggcccgcuaccuccccgagaucaugaacgacggccucaccaaccagaucaacaaccccgaggucgacgucgacaucacccgccccgacaccuucauccgccagcagaucauggcccuccgcgucaugaccaacaagcucaagaacgccuacaacggcaacgacgucaacuuccaggacaccuccgacgaguccuccggcuccggcuccggcuccggcugcauggacgacgucugccccaccgaguucgaguucgucaccaccgaggcccccgccgucgaccccgaccgccgcgaggucgacuccuccgccgcccagcgcggccacucccuccucuccuggucccucaccugcaucguccucgcccuccagcgccucugccgcuga

SEQ ID NO: 43788 - RNA, 2019 nt, Artificial Sequence
  derived and/or modified sequence opt2 from GPCPD1__Homo_sapiens__NP_062539
augacccccucccaggucgccuucgagauccgcggcacccuccuccccggcgaggucuucgccaucugcggcuccugcgacgcccucggcaacuggaacccccagaacgccgucgcccuccuccccgagaacgacaccggcgaguccaugcucuggaaggccaccaucguccucucccgcggcgucuccguccaguaccgcuacuucaagggcuacuuccucgagcccaagaccaucggcggccccugccaggucaucguccacaagugggagacccaccuccagccccgcuccaucaccccccucgaguccgagaucaucaucgacgacggccaguucggcauccacaacggcgucgagacccucgacuccggcuggcucaccugccagaccgagauccgccuccgccuccacuacuccgagaagccccccgucuccaucaccaagaagaagcucaagaagucccgcuuccgcgucaagcucacccucgagggccucgaggaggacgacgacgaccgcgucucccccaccguccuccacaagauguccaacucccucgagaucucccucaucuccgacaacgaguucaagugccgccacucccagcccgagugcggcuacggccuccagcccgaccgcuggaccgaguacuccauccagaccauggagcccgacaaccucgagcucaucuucgacuucuucgaggaggaccucuccgagcacgucguccagggcgacgcccuccccggccacgucggcaccgccugccuccucuccuccaccaucgccgaguccggcaaguccgccggcauccucacccuccccaucaugucccgcaacucccgcaagaccaucggcaagguccgcgucgacuacaucaucaucaagccccuccccggcuacuccugcgacaugaaguccuccuucuccaaguacuggaagccccgcaucccccucgacgucggccaccgcggcgccggcaacuccaccaccaccgcccagcucgccaagguccaggagaacaccaucgccucccuccgcaacgccgccucccacggcgccgccuucgucgaguucgacguccaccucuccaaggacuucguccccgucgucuaccacgaccucaccugcugccucaccaugaagaagaaguucgacgccgaccccgucgagcucuucgagauccccgucaaggagcucaccuucgaccagcuccagcuccucaagcucacccacgucaccgcccucaaguccaaggaccgcaaggaguccgucguccaggaggagaacuccuucuccgagaaccagcccuuccccucccucaagaugguccucgagucccuccccgaggacgucggcuucaacaucgagaucaaguggaucugccagcagcgcgacggcaugugggacggcaaccucuccaccuacuucgacaugaaccucuuccucgacaucauccucaagaccguccucgagaacuccggcaagcgccgcaucgucuucuccuccuucgacgccgacaucugcaccaugguccgccagaagcagaacaaguaccccauccucuuccucacccagggcaaguccgagaucuaccccgagcucauggaccuccgcucccgcaccacccccaucgccauguccuucgcccaguucgagaaccuccucggcaucaacguccacaccgaggaccuccuccgcaaccccuccuacauccaggaggccaaggccaagggccucgucaucuucugcuggggcgacgacaccaacgaccccgagaaccgccgcaagcucaaggagcucggcgucaacggccucaucuacgaccgcaucuacgacuggaugcccgagcagcccaacaucuuccaggucgagcagcucgagcgccucaagcaggagcuccccgagcucaaguccugccucugccccaccgucucccgcuucguccccuccucccucugcggcgaguccgacauccacgucgacgccaacggcaucgacaacgucgagaacgccuga

SEQ ID NO: 43789 - RNA, 981 nt, Artificial Sequence
  derived and/or modified sequence opt2 from GPD1__Homo_sapiens__NP_001244128
auggccuccaagaaggucugcaucgucggcuccggcaacuggggcuccgccaucgccaagaucgucggcggcaacgccgcccagcucgcccaguucgacccccgcgucaccaugugggucuucgaggaggacaucggcggcaagaagcucaccgagaucaucaacacccagcacgagaacgucaaguaccuccccggccacaagcucccccccaacgucuucaucggcaagaucugcgaccagcucaagggccaccucaaggccaacgccaccggcaucucccucaucaagggcgucgacgagggccccaacggccucaagcucaucuccgaggucaucggcgagcgccucggcauccccauguccguccucaugggcgccaacaucgccuccgaggucgccgacgagaaguucugcgagaccaccaucggcugcaaggaccccgcccagggccagcuccucaaggagcucaugcagacccccaacuuccgcaucaccgucguccaggaggucgacaccgucgagaucugcggcgcccucaagaacgucgucgccgucggcgccggcuucugcgacggccucggcuucggcgacaacaccaaggccgccgucauccgccucggccucauggagaugaucgccuucgccaagcucuucugcuccggccccgucuccuccgccaccuuccucgaguccugcggcgucgccgaccucaucaccaccugcuacggcggccgcaaccgcaaggucgccgaggccuucgcccgcaccggcaaguccaucgagcagcucgagaaggagcuccucaacggccagaagcuccagggccccgagaccgcccgcgagcucuacuccauccuccagcacaagggccucgucgacaaguucccccucuucauggccgucuacaaggucugcuacgagggccagcccgucggcgaguucauccacugccuccagaaccaccccgagcacauguga

SEQ ID NO: 43790 - RNA, 1056 nt, Artificial Sequence
  derived and/or modified sequence opt2 from GPD1L__Homo_sapiens__NP_055956
auggccgccgccccccucaaggucugcaucgucggcuccggcaacuggggcuccgccgucgccaagaucaucggcaacaacgucaagaagcuccagaaguucgccuccaccgucaagaugugggucuucgaggagaccgucaacggccgcaagcucaccgacaucaucaacaacgaccacgagaacgucaaguaccuccccggccacaagcuccccgagaacgucgucgccauguccaaccucuccgaggccguccaggacgccgaccuccucgucuucgucaucccccaccaguucauccaccgcaucugcgacgagaucaccggccgcguccccaagaaggcccucggcaucacccucaucaagggcaucgacgagggccccgagggccucaagcucaucuccgacaucauccgcgagaagaugggcaucgacaucuccguccucaugggcgccaacaucgccaacgaggucgccgccgagaaguucugcgagaccaccaucggcuccaaggucauggagaacggccuccucuucaaggagcuccuccagacccccaacuuccgcaucaccgucgucgacgacgccgacaccgucgagcucugcggcgcccucaagaacaucgucgccgucggcgccggcuucugcgacggccuccgcugcggcgacaacaccaaggccgccgucauccgccucggccucauggagaugaucgccuucgcccgcaucuucugcaagggccaggucuccaccgccaccuuccucgaguccugcggcgucgccgaccucaucaccaccugcuacggcggccgcaaccgccgcgucgccgaggccuucgcccgcaccggcaagaccaucgaggagcucgagaaggagaugcucaacggccagaagcuccagggcccccagaccuccgccgaggucuaccgcauccucaagcagaagggccuccucgacaaguucccccucuucaccgccgucuaccagaucugcuacgagucccgccccguccaggagaugcucuccugccuccagucccaccccgagcacaccuga

SEQ ID NO: 43791 - RNA, 2184 nt, Artificial Sequence
  derived and/or modified sequence opt2 from GPD2__Homo_sapiens__NP_001076581
auggccuuccagaaggccgucaagggcaccauccucgucggcggcggcgcccucgccaccguccucggccucucccaguucgcccacuaccgccgcaagcagaugaaccucgccuacgucaaggccgccgacugcaucuccgagcccgucaaccgcgagccccccucccgcgaggcccagcuccucacccuccagaacaccuccgaguucgacauccucgucaucggcggcggcgccaccggcuccggcugcgcccucgacgccgucacccgcggccucaagaccgcccucgucgagcgcgacgacuucuccuccggcaccuccucccgcuccaccaagcucauccacggcggcguccgcuaccuccagaaggccaucaugaagcucgacaucgagcaguaccgcauggucaaggaggcccuccacgagcgcgccaaccuccucgagaucgccccccaccucuccgccccccuccccaucaugcuccccgucuacaagugguggcagcuccccuacuacugggucggcaucaagcucuacgaccucgucgccggcuccaacugccucaaguccuccuacguccucuccaagucccgcgcccucgagcacuuccccaugcuccagaaggacaagcucgucggcgccaucgucuacuacgacggccagcacaacgacgcccgcaugaaccucgccaucgcccucaccgccgcccgcuacggcgccgccaccgccaacuacauggaggucgucucccuccucaagaagaccgacccccagaccggcaagguccgcgucuccggcgcccgcugcaaggacguccucaccggccaggaguucgacguccgcgccaagugcgucaucaacgccaccggccccuucaccgacuccguccgcaagauggacgacaaggacgccgccgccaucugccagcccuccgccggcguccacaucgucaugcccggcuacuacucccccgaguccaugggccuccucgaccccgccaccuccgacggccgcgucaucuucuuccuccccuggcagaagaugaccaucgccggcaccaccgacacccccaccgacgucacccaccaccccauccccuccgaggaggacaucaacuucauccucaacgagguccgcaacuaccucuccugcgacgucgagguccgccgcggcgacguccucgccgccugguccggcauccgcccccucgucaccgaccccaaguccgccgacacccaguccaucucccgcaaccacgucgucgacaucuccgaguccggccucaucaccaucgccggcggcaaguggaccaccuaccgcuccauggccgaggacaccaucaacgccgccgucaagacccacaaccucaaggccggccccucccgcaccgucggccucuuccuccagggcggcaaggacuggucccccacccucuacauccgccucguccaggacuacggccucgaguccgaggucgcccagcaccucgccgccaccuacggcgacaaggccuucgaggucgccaagauggccuccgucaccggcaagcgcuggcccaucgucggcguccgccucgucuccgaguuccccuacaucgaggccgaggucaaguacggcaucaaggaguacgccugcaccgccgucgacaugaucucccgccgcacccgccucgccuuccucaacguccaggccgccgaggaggcccucccccgcaucgucgagcucaugggccgcgagcucaacugggacgacuacaagaagcaggagcagcucgagaccgcccgcaaguuccucuacuacgagaugggcuacaagucccgcuccgagcagcucaccgaccgcuccgagaucucccuccuccccuccgacaucgaccgcuacaagaagcgcuuccacaaguucgacgccgaccagaagggcuucaucaccaucgucgacguccagcgcguccucgaguccaucaacguccagauggacgagaacacccuccacgagauccucaacgaggucgaccucaacaagaacggccaggucgagcucaacgaguuccuccagcucauguccgccauccagaagggccgcgucuccggcucccgccucgccauccucaugaagaccgccgaggagaaccucgaccgccgcguccccauccccgucgaccgcuccugcggcggccucuga

SEQ ID NO: 43792 - RNA, 1128 nt, Artificial Sequence
  derived and/or modified sequence opt2 from GPER1__Homo_sapiens__NP_001091671
auggacgucaccucccaggcccgcggcgucggccucgagauguaccccggcaccgcccagcccgccgcccccaacaccaccucccccgagcucaaccucucccacccccuccucggcaccgcccucgccaacggcaccggcgagcucuccgagcaccagcaguacgucaucggccucuuccucuccugccucuacaccaucuuccucuuccccaucggcuucgucggcaacauccucauccucgucgucaacaucuccuuccgcgagaagaugaccauccccgaccucuacuucaucaaccucgccgucgccgaccucauccucgucgccgacucccucaucgaggucuucaaccuccacgagcgcuacuacgacaucgccguccucugcaccuucaugucccucuuccuccaggucaacauguacuccuccgucuucuuccucaccuggauguccuucgaccgcuacaucgcccucgcccgcgccaugcgcugcucccucuuccgcaccaagcaccacgcccgccucuccugcggccucaucuggauggccuccgucuccgccacccucguccccuucaccgccguccaccuccagcacaccgacgaggccugcuucugcuucgccgacguccgcgagguccaguggcucgaggucacccucggcuucaucguccccuucgccaucaucggccucugcuacucccucaucguccgcguccucguccgcgcccaccgccaccgcggccuccgcccccgccgccagaaggcccuccgcaugauccucgccgucguccucgucuucuucgucugcuggcuccccgagaacgucuucaucuccguccaccuccuccagcgcacccagcccggcgccgcccccugcaagcaguccuuccgccacgcccacccccucaccggccacaucgucaaccucgccgccuucuccaacuccugccucaacccccucaucuacuccuuccucggcgagaccuuccgcgacaagcuccgccucuacaucgagcagaagaccaaccuccccgcccucaaccgcuucugccacgccgcccucaaggccgucauccccgacuccaccgagcaguccgacguccgcuucuccuccgccgucuga

SEQ ID NO: 43793 - RNA, 390 nt, Artificial Sequence
  derived and/or modified sequence opt2 from GPHA2__Homo_sapiens__NP_570125
augcccauggccuccccccagacccucguccucuaccuccucguccucgccgucaccgaggccuggggccaggaggccgucauccccggcugccaccuccaccccuucaacgucaccguccgcuccgaccgccagggcaccugccagggcucccacgucgcccaggccugcgucggccacugcgaguccuccgccuuccccucccgcuacuccguccucgucgccuccggcuaccgccacaacaucaccuccgucucccagugcugcaccaucuccggccucaagaaggucaagguccagcuccagugcgucggcucccgccgcgaggagcucgagaucuucaccgcccgcgccugccagugcgacaugugccgccucucccgcuacuga

SEQ ID NO: 43794 - RNA, 2211 nt, Artificial Sequence
  derived and/or modified sequence opt2 from GPHN__Homo_sapiens__NP_001019389
auggccaccgagggcaugauccucaccaaccacgaccaccagauccgcgucggcguccucaccgucuccgacuccugcuuccgcaaccucgccgaggaccgcuccggcaucaaccucaaggaccucguccaggaccccucccuccucggcggcaccaucuccgccuacaagaucguccccgacgagaucgaggagaucaaggagacccucaucgacuggugcgacgagaaggagcucaaccucauccucaccaccggcggcaccggcuucgccccccgcgacgucacccccgaggccaccaaggaggucaucgagcgcgaggcccccggcauggcccucgccaugcucaugggcucccucaacgucaccccccucggcaugcucucccgccccgucugcggcauccgcggcaagacccucaucaucaaccuccccggcuccaagaagggcucccaggagugcuuccaguucauccuccccgcccucccccacgccaucgaccuccuccgcgacgccaucgucaaggucaaggagguccacgacgagcucgaggaccuccccucccccccccccccccucucccccccccccaccaccuccccccacaagcagaccgaggacaagggcguccagugcgaggaggaggaggaggagaagaaggacuccggcgucgccuccaccgaggacuccuccuccucccacaucaccgccgccgccaucgccgccaagauccccgacuccaucaucucccgcggcguccagguccucccccgcgacaccgccucccucuccaccacccccuccgaguccccccgcgcccaggccaccucccgccucuccaccgccuccugccccacccccaagguccagucccgcugcuccuccaaggagaacauccuccgcgccucccacuccgccgucgacaucaccaaggucgcccgccgccaccgcaugucccccuucccccucaccuccauggacaaggccuucaucaccguccucgagaugacccccguccucggcaccgagaucaucaacuaccgcgacggcaugggccgcguccucgcccaggacgucuacgccaaggacaaccucccccccuuccccgccuccgucaaggacggcuacgccguccgcgccgccgacggccccggcgaccgcuucaucaucggcgagucccaggccggcgagcagcccacccagaccgucaugcccggccaggucaugcgcgucaccaccggcgcccccauccccugcggcgccgacgccgucguccaggucgaggacaccgagcucauccgcgaguccgacgacggcaccgaggagcucgagguccgcauccucguccaggcccgccccggccaggacauccgccccaucggccacgacaucaagcgcggcgagugcguccucgccaagggcacccacaugggccccuccgagaucggccuccucgccaccgucggcgucaccgaggucgaggucaacaaguuccccgucgucgccgucauguccaccggcaacgagcuccucaaccccgaggacgaccuccuccccggcaagauccgcgacuccaaccgcuccacccuccucgccaccauccaggagcacggcuaccccaccaucaaccucggcaucgucggcgacaaccccgacgaccuccucaacgcccucaacgagggcaucucccgcgccgacgucaucaucaccuccggcggcgucuccaugggcgagaaggacuaccucaagcagguccucgacaucgaccuccacgcccagauccacuucggccgcgucuucaugaagcccggccuccccaccaccuucgccacccucgacaucgacggcguccgcaagaucaucuucgcccuccccggcaaccccgucuccgccgucgucaccugcaaccucuucgucguccccgcccuccgcaagaugcagggcauccucgacccccgccccaccaucaucaaggcccgccucuccugcgacgucaagcucgacccccgccccgaguaccaccgcugcauccucaccuggcaccaccaggagccccuccccugggcccaguccaccggcaaccagauguccucccgccucauguccaugcgcuccgccaacggccuccucaugcucccccccaagaccgagcaguacgucgagcuccacaagggcgaggucgucgacgucauggucaucggccgccucuga

SEQ ID NO: 43795 - RNA, 555 nt, Artificial Sequence
  derived and/or modified sequence opt2 from GPIHBP1__Homo_sapiens__NP_835466
augaaggcccucggcgccguccuccucgcccuccuccucuucggccgccccggccgcggccagacccagcaggaggaggaggaggaggacgaggaccacggccccgacgacuacgacgaggaggacgaggacgaggucgaggaggaggagaccaaccgccuccccggcggccgcucccgcguccuccuccgcugcuacaccugcaagucccucccccgcgacgagcgcugcaaccucacccagaacugcucccacggccagaccugcaccacccucaucgcccacggcaacaccgaguccggccuccucaccacccacuccaccuggugcaccgacuccugccagcccaucaccaagaccgucgagggcacccaggucaccaugaccugcugccaguccucccucugcaacgucccccccuggcaguccucccgcguccaggaccccaccggcaagggcgccggcggcccccgcggcuccuccgagaccgucggcgccgcccuccuccucaaccuccucgccggccucggcgccaugggcgcccgccgccccuga

SEQ ID NO: 43796 - RNA, 1710 nt, Artificial Sequence
  derived and/or modified sequence opt2 from GPI__Homo_sapiens__NP_001171651
auggucgcccucugcucccuccagcaccucggcuccuccgacccccgcgcccuccccacccuccccaccgccaccuccggccagcgccccgccaagcgccgccgcaagucccccgccauggccgcccucacccgcgacccccaguuccagaagcuccagcagugguaccgcgagcaccgcuccgagcucaaccuccgccgccucuucgacgccaacaaggaccgcuucaaccacuucucccucacccucaacaccaaccacggccacauccucgucgacuacuccaagaaccucgucaccgaggacgucaugcgcaugcucgucgaccucgccaagucccgcggcgucgaggccgcccgcgagcgcauguucaacggcgagaagaucaacuacaccgagggccgcgccguccuccacgucgcccuccgcaaccgcuccaacacccccauccucgucgacggcaaggacgucaugcccgaggucaacaagguccucgacaagaugaaguccuucugccagggcccccucauggucaccgaggcccucaagcccuacuccuccggcggcccccgcgucugguacgucuccaacaucgacggcacccacaucgccaagacccucgcccagcucaaccccgaguccucccucuucaucaucgccuccaagaccuucaccacccaggagaccaucaccaacgccgagaccgccaaggagugguuccuccaggccgccaaggaccccuccgccgucgccaagcacuucgucgcccucuccaccaacaccaccaaggucaaggaguucggcaucgacccccagaacauguucgaguucugggacugggucggcggccgcuacucccucugguccgccaucggccucuccaucgcccuccacgucggcuucgacaacuucgagcagcuccucuccggcgcccacuggauggaccagcacuuccgcaccaccccccucgagaagaacgcccccguccuccucgcccuccucggcaucugguacaucaacugcuucggcugcgagacccacgccaugcuccccuacgaccaguaccuccaccgcuucgccgccuacuuccagcagggcgacauggaguccaacggcaaguacaucaccaaguccggcacccgcgucgaccaccagaccggccccaucgucuggggcgagcccggcaccaacggccagcacgccuucuaccagcucauccaccagggcaccaagaugauccccugcgacuuccucauccccguccagacccagcaccccauccgcaagggccuccaccacaagauccuccucgccaacuuccucgcccagaccgaggcccucaugcgcggcaaguccaccgaggaggcccgcaaggagcuccaggccgccggcaagucccccgaggaccucgagcgccuccucccccacaaggucuucgagggcaaccgccccaccaacuccaucgucuucaccaagcucacccccuucaugcucggcgcccucgucgccauguacgagcacaagaucuucguccagggcaucaucugggacaucaacuccuucgaccaguggggcgucgagcucggcaagcagcucgccaagaagaucgagcccgagcucgacggcuccgcccaggucaccucccacgacgccuccaccaacggccucaucaacuucaucaagcagcagcgcgaggcccgcguccaguga

SEQ ID NO: 43797 - RNA, 1431 nt, Artificial Sequence
  derived and/or modified sequence opt2 from GPKOW__Homo_sapiens__NP_056513
auggccgacuccaaggagggcguccucccccucaccgccgccuccaccgcccccaucuccuucggcuucacccgcaccuccgcccgccgccgccucgccgacuccggcgacggcgccggccccucccccgaggagaaggacuuccucaagaccgucgagggccgcgagcuccaguccgucaagccccaggaggcccccaaggagcucgucaucccccucauccagaacggccaccgccgccagccccccgcccgcccccccggccccuccaccgacaccggcgcccucgccgacggcgucgucucccaggccgucaaggagcucaucgccgaguccaagaagucccucgaggagcgcgagaacgccggcgucgaccccacccucgccauccccaugauccagaagggcugcacccccuccggcgagggcgccgacuccgagccccgcgccgagaccguccccgaggaggccaacuacgaggccguccccgucgaggccuacggccucgccaugcuccgcggcaugggcuggaagcccggcgagggcaucggccgcaccuucaaccaggucgucaagccccgcgucaacucccuccgccccaagggccucggccucggcgccaaccucaccgaggcccaggcccucacccccaccggccccucccgcaugccccgccccgacgaggagcaggagaaggacaaggaggaccagccccagggccucguccccggcggcgccgucgucguccucuccggcccccaccgcggccucuacggcaaggucgagggccucgaccccgacaacguccgcgccaugguccgccucgccgucggcucccgcgucgucaccgucuccgaguacuaccuccgccccgucucccagcaggaguucgacaagaacacccucgaccuccgccagcagaacggcaccgccuccucccgcaagacccucuggaaccaggagcucuacauccagcaggacaacuccgagcgcaagcgcaagcaccuccccgaccgccaggacggccccgccgccaaguccgagaaggccgccccccgcucccagcacuggcuccaccgcgaccuccgcguccgcuucgucgacaacauguacaagggcggccaguacuacaacaccaagaugaucaucgaggacguccucucccccgacaccugcgucugccgcaccgacgagggccgcguccucgagggccuccgcgaggacaugcucgagacccucguccccaaggccgagggcgaccgcgucauggucguccucggcccccagaccggccgcgucggccaccuccucucccgcgaccgcgcccgcucccgcgcccucguccagcucccccgcgagaaccaggucgucgagcuccacuacgacgccaucugccaguacaugggccccuccgacaccgacgacgacuga

SEQ ID NO: 43798 - RNA, 2523 nt, Artificial Sequence
  derived and/or modified sequence opt2 from GPLD1__Homo_sapiens__NP_001494
auguccgccuuccgccucuggcccggccuccucaucaugcucggcucccucugccaccgcggcucccccugcggccucuccacccacgucgagaucggccaccgcgcccucgaguuccuccagcuccacaacggccgcgucaacuaccgcgagcuccuccucgagcaccaggacgccuaccaggccggcaucgucuuccccgacugcuucuaccccuccaucugcaagggcggcaaguuccacgacgucuccgaguccacccacuggacccccuuccucaacgccuccguccacuacauccgcgagaacuacccccuccccugggagaaggacaccgagaagcucgucgccuuccucuucggcaucaccucccacauggccgccgacgucuccuggcacucccucggccucgagcagggcuuccuccgcaccaugggcgccaucgacuuccacggcuccuacuccgaggcccacuccgccggcgacuucggcggcgacguccucucccaguucgaguucaacuucaacuaccucgcccgccgcugguacguccccgucaaggaccuccucggcaucuacgagaagcucuacggccgcaaggucaucaccgagaacgucaucgucgacugcucccacauccaguuccucgagauguacggcgagaugcucgccgucuccaagcucuaccccaccuacuccaccaagucccccuuccucgucgagcaguuccaggaguacuuccucggcggccucgacgacauggccuucugguccaccaacaucuaccaccucaccuccuucaugcucgagaacggcaccuccgacugcaaccuccccgagaacccccucuucaucgccugcggcggccagcagaaccacacccagggcuccaagaugcagaagaacgacuuccaccgcaaccucaccaccucccucaccgaguccgucgaccgcaacaucaacuacaccgagcgcggcgucuucuucuccgucaacuccuggacccccgacuccauguccuucaucuacaaggcccucgagcgcaacauccgcaccauguucaucggcggcucccagcucucccagaagcacgucuccuccccccucgccuccuacuuccucuccuuccccuacgcccgccucggcugggccaugaccuccgccgaccucaaccaggacggccacggcgaccucgucgucggcgcccccggcuacucccgccccggccacauccacaucggccgcgucuaccucaucuacggcaacgaccucggccucccccccgucgaccucgaccucgacaaggaggcccaccgcauccucgagggcuuccagcccuccggccgcuucggcuccgcccucgccguccucgacuucaacgucgacggcguccccgaccucgccgucggcgcccccuccgucggcuccgagcagcucaccuacaagggcgccgucuacgucuacuucggcuccaagcagggcggcauguccuccucccccaacaucaccaucuccugccaggacaucuacugcaaccucggcuggacccuccucgccgccgacgucaacggcgacuccgagcccgaccucgucaucggcucccccuucgcccccggcggcggcaagcagaagggcaucgucgccgccuucuacuccggccccucccucuccgacaaggagaagcucaacgucgaggccgccaacuggaccguccgcggcgaggaggacuucuccugguucggcuacucccuccacggcgucaccgucgacaaccgcacccuccuccucgucggcucccccaccuggaagaacgccucccgccucggccaccuccuccacauccgcgacgagaagaagucccucggccgcgucuacggcuacuucccccccaacggccaguccugguucaccaucuccggcgacaaggccaugggcaagcucggcaccucccucuccuccggccacguccucaugaacggcacccucaagcagguccuccucgucggcgcccccaccuacgacgacgucuccaaggucgccuuccucaccgucacccuccaccagggcggcgccacccgcauguacgcccucaccuccgacgcccagccccuccuccucuccaccuucuccggcgaccgccgcuucucccgcuucggcggcguccuccaccucuccgaccucgacgacgacggccucgacgagaucaucauggccgccccccuccgcaucgccgacgucaccuccggccucaucggcggcgaggacggccgcgucuacgucuacaacggcaaggagaccacccucggcgacaugaccggcaagugcaaguccuggaucacccccugccccgaggagaaggcccaguacguccucaucucccccgaggccuccucccgcuucggcuccucccucaucaccguccgcuccaaggccaagaaccaggucgucaucgccgccggccgcuccucccucggcgcccgccucuccggcgcccuccacgucuacucccucggcuccgacuga

SEQ ID NO: 43799 - RNA, 816 nt, Artificial Sequence
  derived and/or modified sequence opt2 from GPM6A__Homo_sapiens__NP_001248377
augaccgaccucgagggcugcuucgagugcugcaucaagugccucggcggcauccccuacgccucccucaucgccaccauccuccucuacgccggcgucgcccucuucugcggcugcggccacgaggcccucuccggcaccgucaacauccuccagaccuacuucgagauggcccgcaccgccggcgacacccucgacgucuucaccaugaucgacaucuucaaguacgucaucuacggcaucgccgccgccuucuucgucuacggcauccuccucauggucgagggcuucuucaccaccggcgccaucaaggaccucuacggcgacuucaagaucaccaccugcggccgcugcgucuccgccugguucaucaugcucaccuaccucuucaugcucgccuggcucggcgucaccgccuucaccucccuccccgucuacauguacuucaaccucuggaccaucugccgcaacaccacccucgucgagggcgccaaccucugccucgaccuccgccaguucggcaucgucaccaucggcgaggagaagaagaucugcaccgucuccgagaacuuccuccgcaugugcgaguccaccgagcucaacaugaccuuccaccucuucaucgucgcccucgccggcgccggcgccgccgucaucgccaugguccacuaccucaugguccucuccgccaacugggccuacgucaaggacgccugccgcaugcagaaguacgaggacaucaaguccaaggaggagcaggagcuccacgacauccacuccacccgcuccaaggagcgccucaacgccuacaccuga

SEQ ID NO: 43800 - RNA, 741 nt, Artificial Sequence
  derived and/or modified sequence opt2 from GPM6B__Homo_sapiens__NP_001001994
augggcugcuucgagugcugcaucaagugccucggcggcguccccuacgccucccucgucgccaccauccucugcuucuccggcgucgcccucuucugcggcugcggccacgucgcccucgccggcaccgucgccauccucgagcagcacuucuccaccaacgccuccgaccacgcccuccucuccgaggucauccagcucaugcaguacgucaucuacggcaucgccuccuucuucuuccucuacggcaucauccuccucgccgagggcuucuacaccaccuccgccgucaaggagcuccacggcgaguucaagaccaccgccugcggccgcugcaucuccggcauguucgucuuccucaccuacguccucggcgucgccuggcucggcgucuucggcuucuccgccguccccgucuucauguucuacaacaucugguccaccugcgaggucaucaaguccccccagaccaacggcaccaccggcgucgagcagaucugcgucgacauccgccaguacggcaucauccccuggaacgccuuccccggcaagaucugcggcuccgcccucgagaacaucugcaacaccaacgaguucuacauguccuaccaccucuucaucgucgccugcgccggcgccggcgccaccgucaucgcccuccucaucuacaugauggccaccaccuacaacuacgccguccucaaguucaagucccgcgaggacugcugcaccaaguucuga

SEQ ID NO: 43801 - RNA, 1089 nt, Artificial Sequence
  derived and/or modified sequence opt2 from GPN1__Homo_sapiens__NP_001138519
augaccggccacacccgcuccucccucccccgcugcaccggcaucguccuccucaucaagcuccgcuucuccgagcgccucaccggccaccuccacgcccagggcaccccccccuacgucaucaaccucgaccccgccguccacgagguccccuuccccgccaacaucgacauccgcgacaccgucaaguacaaggaggucaugaagcaguacggccucggccccaacggcggcaucgucaccucccucaaccucuucgccacccgcuucgaccaggucaugaaguucaucgagaaggcccagaacauguccaaguacguccucaucgacacccccggccagaucgaggucuucaccugguccgccuccggcaccaucaucaccgaggcccucgccuccuccuuccccaccgucgucaucuacgucauggacaccucccgcuccaccaaccccgucaccuucauguccaacaugcucuacgccugcuccauccucuacaagaccaagcuccccuucaucgucgucaugaacaagaccgacaucaucgaccacuccuucgccgucgaguggaugcaggacuucgaggccuuccaggacgcccucaaccaggagaccaccuacgucuccaaccucacccgcuccaugucccucguccucgacgaguucuacuccucccuccgcgucgucggcgucuccgccguccucggcaccggccucgacgagcucuucguccaggucaccuccgccgccgaggaguacgagcgcgaguaccgccccgaguacgagcgccucaagaagucccucgccaacgccgagucccagcagcagcgcgagcagcucgagcgccuccgcaaggacaugggcuccgucgcccucgacgccggcaccgccaaggacucccucucccccguccuccaccccuccgaccucauccucacccgcggcacccucgacgaggaggacgaggaggccgacuccgacaccgacgacaucgaccaccgcgucaccgaggagucccacgaggagcccgccuuccagaacuucaugcaggaguccauggcccaguacuggaagcgcaacaacaaguga

SEQ ID NO: 43802 - RNA, 1719 nt, Artificial Sequence
  derived and/or modified sequence opt2 from GPNMB__Homo_sapiens__NP_001005340
auggagugccucuacuacuuccucggcuuccuccuccucgccgcccgccucccccucgacgccgccaagcgcuuccacgacguccucggcaacgagcgccccuccgccuacaugcgcgagcacaaccagcucaacggcugguccuccgacgagaacgacuggaacgagaagcucuaccccgucuggaagcgcggcgacaugcgcuggaagaacuccuggaagggcggccgcguccaggccguccucaccuccgacucccccgcccucgucggcuccaacaucaccuucgccgucaaccucaucuucccccgcugccagaaggaggacgccaacggcaacaucgucuacgagaagaacugccgcaacgaggccggccucuccgccgaccccuacgucuacaacuggaccgccugguccgaggacuccgacggcgagaacggcaccggccagucccaccacaacgucuuccccgacggcaagcccuucccccaccaccccggcuggcgccgcuggaacuucaucuacgucuuccacacccucggccaguacuuccagaagcucggccgcugcuccguccgcgucuccgucaacaccgccaacgucacccucggcccccagcucauggaggucaccgucuaccgccgccacggccgcgccuacguccccaucgcccaggucaaggacgucuacgucgucaccgaccagauccccgucuucgucaccauguuccagaagaacgaccgcaacuccuccgacgagaccuuccucaaggaccuccccaucauguucgacguccucauccacgaccccucccacuuccucaacuacuccaccaucaacuacaagugguccuucggcgacaacaccggccucuucgucuccaccaaccacaccgucaaccacaccuacguccucaacggcaccuucucccucaaccucaccgucaaggccgccgcccccggccccugcccccccccccccccccccccccgccccuccaagcccacccccucccucgccaccacccucaaguccuacgacuccaacacccccggccccgccggcgacaacccccucgagcucucccgcauccccgacgagaacugccagaucaaccgcuacggccacuuccaggccaccaucaccaucgucgagggcauccucgaggucaacaucauccagaugaccgacguccucaugcccguccccuggcccgaguccucccucaucgacuucgucgucaccugccagggcuccauccccaccgaggucugcaccaucaucuccgaccccaccugcgagaucacccagaacaccgucugcucccccgucgacgucgacgagaugugccuccucaccguccgccgcaccuucaacggcuccggcaccuacugcgucaaccucacccucggcgacgacaccucccucgcccucaccuccacccucaucuccguccccgaccgcgaccccgccuccccccuccgcauggccaacuccgcccucaucuccgucggcugccucgccaucuucgucaccgucaucucccuccucgucuacaagaagcacaaggaguacaaccccaucgagaacucccccggcaacgucguccgcuccaagggccucuccgucuuccucaaccgcgccaaggccgucuucuuccccggcaaccaggagaaggacccccuccucaagaaccaggaguucaagggcgucuccuga

SEQ ID NO: 43803 - RNA, 1527 nt, Artificial Sequence
  derived and/or modified sequence opt2 from GPR101__Homo_sapiens__NP_473362
augaccuccaccugcaccaacuccacccgcgaguccaacuccucccacaccugcaugccccucuccaagaugcccaucucccucgcccacggcaucauccgcuccaccguccucgucaucuuccucgccgccuccuucgucggcaacaucguccucgcccucguccuccagcgcaagccccagcuccuccaggucaccaaccgcuucaucuucaaccuccucgucaccgaccuccuccagaucucccucgucgcccccugggucgucgccaccuccgucccccucuucuggccccucaacucccacuucugcaccgcccucgucucccucacccaccucuucgccuucgccuccgucaacaccaucgucgucgucuccgucgaccgcuaccucuccaucauccacccccucuccuaccccuccaagaugacccagcgccgcggcuaccuccuccucuacggcaccuggaucgucgccauccuccaguccacccccccccucuacggcuggggccaggccgccuucgacgagcgcaacgcccucugcuccaugaucuggggcgccucccccuccuacaccauccucuccgucgucuccuucaucgucaucccccucaucgucaugaucgccugcuacuccgucgucuucugcgccgcccgccgccagcacgcccuccucuacaacgucaagcgccacucccucgagguccgcgucaaggacugcgucgagaacgaggacgaggagggcgccgagaagaaggaggaguuccaggacgaguccgaguuccgccgccagcacgagggcgaggucaaggccaaggagggccgcauggaggccaaggacggcucccucaaggccaaggagggcuccaccggcaccuccgaguccuccgucgaggcccgcggcuccgaggagguccgcgaguccuccaccgucgccuccgacggcuccauggagggcaaggagggcuccaccaaggucgaggagaacuccaugaaggccgacaagggccgcaccgaggucaaccagugcuccaucgaccucggcgaggacgacauggaguucggcgaggacgacaucaacuucuccgaggacgacgucgaggccgucaacauccccgagucccucccccccucccgccgcaacuccaacuccaaccccccccucccccgcugcuaccagugcaaggccgccaaggucaucuucaucaucaucuucuccuacguccucucccucggccccuacugcuuccucgccguccucgccgucugggucgacgucgagacccaggucccccagugggucaucaccaucaucaucuggcucuucuuccuccagugcugcauccaccccuacgucuacggcuacaugcacaagaccaucaagaaggagauccaggacaugcucaagaaguucuucugcaaggagaagccccccaaggaggacucccaccccgaccuccccggcaccgagggcggcaccgagggcaagaucguccccuccuacgacuccgccaccuuccccuga

SEQ ID NO: 43804 - RNA, 1008 nt, Artificial Sequence
  derived and/or modified sequence opt2 from GPR119__Homo_sapiens__NP_848566
auggaguccuccuucuccuucggcgucauccucgccguccucgccucccucaucaucgccaccaacacccucgucgccgucgccguccuccuccucauccacaagaacgacggcgucucccucugcuucacccucaaccucgccgucgccgacacccucaucggcgucgccaucuccggccuccucaccgaccagcucuccucccccucccgccccacccagaagacccucugcucccuccgcauggccuucgucaccuccuccgccgccgccuccguccucaccgucaugcucaucaccuucgaccgcuaccucgccaucaagcagcccuuccgcuaccucaagaucauguccggcuucgucgccggcgccugcaucgccggccucuggcucgucuccuaccucaucggcuuccucccccucggcauccccauguuccagcagaccgccuacaagggccagugcuccuucuucgccgucuuccacccccacuucguccucacccucuccugcgucggcuucuuccccgccaugcuccucuucgucuucuucuacugcgacaugcucaagaucgccuccaugcacucccagcagauccgcaagauggagcacgccggcgccauggccggcggcuaccgcuccccccgcacccccuccgacuucaaggcccuccgcaccgucuccguccucaucggcuccuucgcccucuccuggacccccuuccucaucaccggcaucguccaggucgccugccaggagugccaccucuaccucguccucgagcgcuaccucuggcuccucggcgucggcaacucccuccucaacccccucaucuacgccuacuggcagaaggagguccgccuccagcucuaccacauggcccucggcgucaagaagguccucaccuccuuccuccucuuccucuccgcccgcaacugcggccccgagcgcccccgcgaguccuccugccacaucgucaccaucuccuccuccgaguucgacggcuga

SEQ ID NO: 43805 - RNA, 1005 nt, Artificial Sequence
  derived and/or modified sequence opt2 from GPR12__Homo_sapiens__NP_005279
augaacgaggaccucaaggucaaccucuccggccucccccgcgacuaccucgacgccgccgccgccgagaacaucuccgccgccgucuccucccgcguccccgccgucgagcccgagcccgagcucgucgucaaccccugggacaucguccucugcaccuccggcacccucaucuccugcgagaacgccaucgucguccucaucaucuuccacaaccccucccuccgcgcccccauguuccuccucaucggcucccucgcccucgccgaccuccucgccggcaucggccucaucaccaacuucgucuucgccuaccuccuccaguccgaggccaccaagcucgucaccaucggccucaucgucgccuccuucuccgccuccgucugcucccuccucgccaucaccgucgaccgcuaccucucccucuacuacgcccucaccuaccacuccgagcgcaccgucaccuucaccuacgucaugcucgucaugcucuggggcaccuccaucugccucggccuccuccccgucaugggcuggaacugccuccgcgacgaguccaccugcuccgucguccgcccccucaccaagaacaacgccgccauccucuccgucuccuuccucuucauguucgcccucaugcuccagcucuacauccagaucugcaagaucgucaugcgccacgcccaccagaucgcccuccagcaccacuuccucgccaccucccacuacgucaccacccgcaagggcgucuccacccucgccaucauccucggcaccuucgccgccugcuggaugcccuucacccucuacucccucaucgccgacuacaccuaccccuccaucuacaccuacgccacccuccuccccgccaccuacaacuccaucaucaaccccgucaucuacgccuuccgcaaccaggagauccagaaggcccucugccucaucugcugcggcugcauccccuccucccucgcccagcgcgcccgcucccccuccgacgucuga

SEQ ID NO: 43806 - RNA, 1143 nt, Artificial Sequence
  derived and/or modified sequence opt2 from GPR132__Homo_sapiens__NP_001265623
augugccccaugcuccucaagaacggcuacaacggcaacgccacccccgucaccaccaccgcccccugggccucccucggccucuccgccaagaccugcaacaacgucuccuucgaggagucccgcaucguccucgucgucgucuacuccgccgucugcacccucggcguccccgccaacugccucaccgccuggcucgcccuccuccagguccuccagggcaacguccucgccgucuaccuccucugccucgcccucugcgagcuccucuacaccggcacccucccccucugggucaucuacauccgcaaccagcaccgcuggacccucggccuccucgccugcaaggucaccgccuacaucuucuucugcaacaucuacgucuccauccucuuccucugcugcaucuccugcgaccgcuucgucgccgucgucuacgcccucgagucccgcggccgccgccgccgccgcaccgccauccucaucuccgccugcaucuucauccucgucggcaucguccacuaccccgucuuccagaccgaggacaaggagaccugcuucgacaugcuccagauggacucccgcaucgccggcuacuacuacgcccgcuucaccgucggcuucgccaucccccucuccaucaucgccuucaccaaccaccgcaucuuccgcuccaucaagcaguccaugggccucuccgccgcccagaaggccaaggucaagcacuccgccaucgccgucgucgucaucuuccucgucugcuucgcccccuaccaccucguccuccucgucaaggccgccgccuucuccuacuaccgcggcgaccgcaacgccaugugcggccucgaggagcgccucuacaccgccuccgucgucuuccucugccucuccaccgucaacggcgucgccgaccccaucaucuacguccucgccaccgaccacucccgccaggaggucucccgcauccacaagggcuggaaggagugguccaugaagaccgacgucacccgccucacccacucccgcgacaccgaggagcuccagucccccgucgcccucgccgaccacuacaccuucucccgccccguccacccccccggcucccccugccccgccaagcgccucaucgaggaguccugcuga

SEQ ID NO: 43807 - RNA, 1485 nt, Artificial Sequence
  derived and/or modified sequence opt2 from GPR135__Homo_sapiens__NP_072093
auggaggagccccagcccccccgcccccccgccuccauggcccuccucggcucccagcacuccggcgcccccuccgccgccggcccccccggcggcaccuccuccgccgccaccgccgccguccucuccuucuccaccgucgccaccgccgcccucggcaaccucuccgacgccuccggcggcggcaccgccgccgcccccggcggcggcggccucggcggcuccggcgccgcccgcgaggccggcgccgccguccgccgcccccucggccccgaggccgccccccuccucucccacggcgccgccgucgccgcccaggcccucguccuccuccucaucuuccuccucuccucccucggcaacugcgccgucaugggcgucaucgucaagcaccgccagcuccgcaccgucaccaacgccuucauccucucccucucccucuccgaccuccucaccgcccuccucugccuccccgccgccuuccucgaccucuucaccccccccggcggcuccgcccccgccgccgccgccggccccuggcgcggcuucugcgccgccucccgcuucuucuccuccugcuucggcaucgucuccacccucuccgucgcccucaucucccucgaccgcuacugcgccaucguccgccccccccgcgagaagaucggccgccgccgcgcccuccagcuccucgccggcgccuggcucaccgcccucggcuucucccuccccugggagcuccucggcgccccccgcgagcucgccgccgcccaguccuuccacggcugccucuaccgcaccucccccgaccccgcccagcucggcgccgccuucuccgucggccucgucgucgccugcuaccuccuccccuuccuccucaugugcuucugccacuaccacaucugcaagaccguccgccucuccgacguccgcguccgccccgucaacaccuacgcccgcguccuccgcuucuucuccgagguccgcaccgccaccaccguccucaucaugaucgucuucgucaucugcugcuggggccccuacugcuuccucguccuccucgccgccgcccgccaggcccagaccaugcaggcccccucccuccucuccgucgucgccgucuggcucaccugggccaacggcgccaucaaccccgucaucuacgccauccgcaaccccaacaucuccaugcuccucggccgcaaccgcgaggagggcuaccgcacccgcaacgucgacgccuuccuccccucccagggccccggccuccaggcccgcucccgcucccgccuccgcaaccgcuacgccaaccgccucggcgccugcaaccgcauguccuccuccaaccccgccuccggcgucgccggcgacgucgccaugugggcccgcaagaaccccgucguccucuucugccgcgagggcccccccgagcccgucaccgccgucaccaagcagcccaaguccgaggccggcgacaccucccucuga

SEQ ID NO: 43808 - RNA, 1290 nt, Artificial Sequence
  derived and/or modified sequence opt2 from GPR137C__Homo_sapiens__NP_001093122
augcgcgucuccguccccggccccgccgccgccgccgcccccgccgccggccgcgagcccuccacccccggcggcggcuccggcggcggcggcgccgucgccgccgccuccggcgccgccguccccggcuccguccagcucgcccucuccguccuccacgcccuccucuacgccgcccucuucgccuucgccuaccuccagcucuggcgccuccuccucuaccgcgagcgccgccucuccuaccagucccucugccucuuccucugccuccucugggccgcccuccgcaccacccucuucuccgccgccuucucccucuccggcucccucccccuccuccgcccccccgcccaccuccacuucuucccccacuggcuccucuacugcuuccccuccugccuccaguucuccacccucugccuccucaaccucuaccucgccgaggucaucugcaagguccgcugcgccaccgagcucgaccgccacaagauccuccuccaccucggcuucaucauggccucccuccucuuccucgucgucaaccucaccugcgccaugcucguccacggcgacguccccgagaaccagcucaaguggaccgucuucguccgcgcccucaucaacgacucccucuucauccucugcgccaucucccucgucugcuacaucugcaagaucaccaagauguccuccgccaacgucuaccucgaguccaagggcaugucccucugccagaccgucgucgucggcuccgucgucauccuccucuacuccucccgcgccugcuacaaccucgucgucgucaccaucucccaggacacccucgagucccccuucaacuacggcugggacaaccucuccgacaaggcccacgucgaggacaucuccggcgaggaguacaucgucuucggcaugguccucuuccucugggagcacguccccgccugguccgucguccucuucuuccgcgcccagcgccucaaccagaaccucgcccccgccggcaugaucaacucccacuccuacuccucccgcgccuacuucuucgacaacccccgccgcuacgacuccgacgacgaccucccccgccucggcuccucccgcgagggcucccuccccaacucccagucccucggcugguacggcaccaugaccggcugcggcuccuccuccuacaccgucaccccccaccucaacggccccaugaccgacaccgccccccuccucuucaccugcuccaaccucgaccucaacaaccaccacucccucuacgucaccccccagaacuga

SEQ ID NO: 43809 - RNA, 1062 nt, Artificial Sequence
  derived and/or modified sequence opt2 from GPR139__Homo_sapiens__NP_001002911
auggagcacacccacgcccaccucgccgccaacuccucccucuccugguggucccccggcuccgccugcggccucggcuucguccccgucgucuacuacucccuccuccucugccucggccuccccgccaacauccucaccgucaucauccucucccagcucgucgcccgccgccagaaguccuccuacaacuaccuccucgcccucgccgccgccgacauccucguccucuucuucaucgucuucgucgacuuccuccucgaggacuucauccucaacaugcagaugccccagguccccgacaagaucaucgagguccucgaguucuccuccauccacaccuccaucuggaucaccgucccccucaccaucgaccgcuacaucgccgucugccacccccucaaguaccacaccgucuccuaccccgcccgcacccgcaaggucaucgucuccgucuacaucaccugcuuccucaccuccauccccuacuacugguggcccaacaucuggaccgaggacuacaucuccaccuccguccaccacguccucaucuggauccacugcuucaccgucuaccucguccccugcuccaucuucuucauccucaacuccaucaucgucuacaagcuccgccgcaaguccaacuuccgccuccgcggcuacuccaccggcaagaccaccgccauccucuucaccaucaccuccaucuucgccacccucugggccccccgcaucaucaugauccucuaccaccucuacggcgcccccauccagaaccgcuggcucguccacaucauguccgacaucgccaacaugcucgcccuccucaacaccgccaucaacuucuuccucuacugcuucaucuccaagcgcuuccgcaccauggccgccgccacccucaaggccuucuucaagugccagaagcagcccguccaguucuacaccaaccacaacuucuccaucaccuccucccccuggaucucccccgccaacucccacugcaucaagaugcucgucuaccaguacgacaagaacggcaagcccaucaaggucucccccuga

SEQ ID NO: 43810 - RNA, 1215 nt, Artificial Sequence
  derived and/or modified sequence opt2 from GPR143__Homo_sapiens__NP_000264
auggccuccccccgccucggcaccuucugcugccccacccgcgacgccgccacccagcucguccucuccuuccagccccgcgccuuccacgcccucugccucggcuccggcggccuccgccucgcccucggccuccuccagcuccuccccggccgccgccccgccggccccggcucccccgccaccuccccccccgccuccguccgcauccuccgcgccgccgccgccugcgaccuccucggcugccucggcauggucauccgcuccaccgucuggcucggcuuccccaacuucgucgacuccgucuccgacaugaaccacaccgagaucuggcccgccgccuucugcgucggcuccgccauguggauccagcuccucuacuccgccugcuucugguggcucuucugcuacgccgucgacgccuaccucgucauccgccgcuccgccggccucuccaccauccuccucuaccacaucauggccuggggccucgccacccuccucugcgucgagggcgccgccaugcucuacuaccccuccgucucccgcugcgagcgcggccucgaccacgccaucccccacuacgucaccauguaccucccccuccuccucguccucgucgccaaccccauccucuuccagaagaccgucaccgccgucgccucccuccucaagggccgccagggcaucuacaccgagaacgagcgccgcaugggcgccgucaucaagauccgcuucuucaagaucaugcucguccucaucaucugcuggcucuccaacaucaucaacgagucccuccucuucuaccucgagaugcagaccgacaucaacggcggcucccucaagcccguccgcaccgccgccaagaccaccugguucaucaugggcauccucaaccccgcccagggcuuccuccucucccucgccuucuacggcuggaccggcugcucccucggcuuccaguccccccgcaaggagauccagugggagucccucaccaccuccgccgccgagggcgcccaccccuccccccucaugccccacgagaaccccgccuccggcaaggucucccaggucggcggccagaccuccgacgaggcccucuccaugcucuccgagggcuccgacgccuccaccaucgagauccacaccgccuccgaguccugcaacaagaacgagggcgaccccgcccuccccacccacggcgaccucuga

SEQ ID NO: 43811 - RNA, 1044 nt, Artificial Sequence
  derived and/or modified sequence opt2 from GPR148__Homo_sapiens__NP_997247
augggcgacgagcucgcccccugccccgucggcaccaccgccuggcccgcccucauccagcucaucuccaagacccccugcaugccccaggccgccuccaacaccucccucggccucggcgaccuccgcguccccuccuccaugcucuacuggcucuuccuccccuccucccuccucgccgccgccacccucgccgucuccccccuccuccucgucaccauccuccgcaaccagcgccuccgccaggagccccacuaccuccuccccgccaacauccuccucuccgaccucgccuacauccuccuccacaugcucaucuccuccuccucccucggcggcugggagcucggccgcauggccugcggcauccucaccgacgccgucuucgccgccugcaccuccaccauccucuccuucaccgccaucguccuccacaccuaccucgccgucauccacccccuccgcuaccucuccuucaugucccacggcgccgccuggaaggccgucgcccucaucuggcucgucgccugcugcuuccccaccuuccucaucuggcucuccaaguggcaggacgcccagcucgaggagcagggcgccuccuacauccucccccccuccaugggcacccagcccggcugcggccuccucgucaucgucaccuacaccuccauccucugcguccucuuccucugcaccgcccucaucgccaacugcuucuggcgcaucuacgccgaggccaagaccuccggcaucuggggccagggcuacucccgcgcccgcggcacccuccucauccacuccguccucaucacccucuacgucuccaccggcgucgucuucucccucgacaugguccucacccgcuaccaccacaucgacuccggcacccacaccuggcuccucgccgccaacuccgagguccucaugaugcucccccgcgccaugcucaccuaccucuaccuccuccgcuaccgccagcuccucggcaugguccgcggccaccuccccucccgccgccaccaggccaucuucaccaucuccuga

SEQ ID NO: 43812 - RNA, 2196 nt, Artificial Sequence
  derived and/or modified sequence opt2 from GPR149__Homo_sapiens__NP_001033794
augucccucuuccucuccaaccucuccaccaacgacuccucccucuggaaggagaaccacaacuccaccgaccuccucaacccccccggcacccucaacaucuaccucuucugccucaccugccucaugaccuucgccgcccucgucggcuccaucuacucccucaucucccuccucaagaugcagaaccgcaccgucgucuccaugcucgucgccuccugguccgucgacgaccucauguccguccucuccgucaccaucuucauguuccuccaguggcccaacgagguccccggcuacuuccaguuccucugcaccaccuccgcccucauguaccucugccagggccucuccuccaaccucaaggccacccuccucgucuccuacaacuucuacaccaugcaccgcggcgucggcucccagaccgccucccgccgcuccggccagguccucggcgucguccucaccgucugggccgccucccuccuccucuccgcccucccccucugcggcuggggcgccuucguccgcacccccuggggcugccucgucgacugcuccuccuccuacguccucuuccucuccaucgucuacgcccucgccuucggccuccucgucggccucuccgucccccucacccaccgccuccucugcuccgaggagcccccccgccuccacuccaacuaccaggagaucucccgcggcgccuccauccccggcaccccccccaccgccggccgcgucgucucccucucccccgaggacgcccccggccccucccuccgccgcuccggcggcugcucccccuccuccgacaccgucuucggccccggcgcccccgccgccgccggcgccgaggccugccgccgcgagaaccgcggcacccucuacggcacccgcuccuucaccgucuccgucgcccagaagcgcuucgcccucauccucgcccucaccaaggucguccucuggcuccccaugaugaugcacauggucguccagaacgucgucggcuuccagucccucccccucgagaccuucuccuuccuccucacccuccucgccaccaccgucacccccgucuucguccucuccaagcgcuggacccaccuccccugcggcugcaucaucaacugccgccagaacgccuacgccgucgccuccgacggcaagaagaucaagcgcaagggcuucgaguucaaccucuccuuccagaaguccuacggcaucuacaagaucgcccacgaggacuacuacgacgacgacgagaacuccaucuucuaccacaaccucaugaacuccgagugcgagaccaccaaggacccccagcgcgacaaccgcaacaucuucaacgccaucaaggucgagaucuccaccacccccucccucgacuccuccacccagcgcggcaucaacaagugcaccaacaccgacaucaccgaggccaagcaggacuccaacaacaagaaggacgccuucuccgacaagaccggcggcgacaucaacuacgaggagaccaccuucuccgagggccccgagcgccgccucucccacgaggagucccagaagcccgaccucuccgacugggaguggugccgcuccaaguccgagcgcaccccccgccagcgcuccggcuacgcccucgccaucccccucugcgccuuccagggcaccgucucccuccacgcccccaccggcaagacccucucccucuccaccuacgaggucuccgccgagggccagaagaucacccccgccuccaagaagaucgaggucuaccgcuccaaguccgucggccacgagcccaacuccgaggacuccuccuccaccuucgucgacaccuccgucaagauccaccucgagguccucgagaucugcgacaacgaggaggcccucgacaccgucuccaucaucuccaacaucucccaguccuccacccagguccgcucccccucccuccgcuacucccgcaaggagaaccgcuucgucuccugcgaccucggcgagaccgccuccuacucccucuuccuccccaccuccaaccccgacggcgacaucaacaucuccauccccgacaccgucgaggcccaccgccagaacuccaagcgccagcaccaggagcgcgacggcuaccaggaggagauccagcuccucaacaaggccuaccgcaagcgcgaggaggaguccaagggcuccuga

SEQ ID NO: 43813 - RNA, 1305 nt, Artificial Sequence
  derived and/or modified sequence opt2 from GPR150__Homo_sapiens__NP_954713
auggaggaccucuucucccccuccauccucccccccgcccccaacaucuccguccccauccuccucggcuggggccucaaccucacccucggccagggcgcccccgccuccggcccccccucccgccgcguccgccucgucuuccucggcgucauccucgucgucgccgucgccggcaacaccaccguccucugccgccucugcggcggcggcggccccugggccggccccaagcgccgcaagauggacuuccuccucguccagcucgcccucgccgaccucuacgccugcggcggcaccgcccucucccagcucgccugggagcuccucggcgagccccgcgccgccaccggcgaccucgccugccgcuuccuccagcuccuccaggccuccggccgcggcgccuccgcccaccucgucguccucaucgcccucgagcgccgccgcgccguccgccucccccacggccgcccccuccccgcccgcgcccucgccgcccucggcuggcuccucgcccuccuccucgcccucccccccgccuucgucguccgcggcgacucccccuccccccucccccccccccccccccccaccucccuccagcccggcgccccccccgccgcccgcgccuggcccggcgagcgccgcugccacggcaucuucgccccccucccccgcuggcaccuccaggucuacgccuucuacgaggccgucgccggcuucgucgcccccgucaccguccucggcgucgccugcggccaccuccucuccgucugguggcgccaccgcccccaggcccccgccgccgccgcccccugguccgccucccccggccgcgcccccgcccccuccgcccucccccgcgccaagguccagucccucaagaugucccuccuccucgcccuccucuucgucggcugcgagcuccccuacuucgccgcccgccucgccgccgccugguccuccggccccgccggcgacugggagggcgagggccucuccgccgcccuccgcgucgucgccauggccaacuccgcccucaaccccuucgucuaccucuucuuccaggccggcgacugccgccuccgccgccagcuccgcaagcgccucggcucccucugcugcgccccccagggcggcgccgaggacgaggagggcccccgcggccaccaggcccucuaccgccagcgcuggccccacccccacuaccaccacgcccgccgcgagccccucgacgagggcggccuccgccccccccccccccgcccccgcccccuccccugcuccugcgaguccgccuucuga

SEQ ID NO: 43814 - RNA, 1260 nt, Artificial Sequence
  derived and/or modified sequence opt2 from GPR151__Homo_sapiens__NP_919227
augcucgccgccgccuucgccgacuccaacuccuccuccaugaacgucuccuucgcccaccuccacuucgccggcggcuaccuccccuccgacucccaggacuggcgcaccaucauccccgcccuccucgucgccgucugccucgucggcuucgucggcaaccucugcgucaucggcauccuccuccacaacgccuggaagggcaagcccuccaugauccacucccucauccucaaccucucccucgccgaccucucccuccuccucuucuccgcccccauccgcgccaccgccuacuccaaguccgucugggaccucggcugguucgucugcaaguccuccgacugguucauccacaccugcauggccgccaagucccucaccaucgucgucgucgccaaggucugcuucauguacgccuccgaccccgccaagcaggucuccauccacaacuacaccaucugguccguccucgucgccaucuggaccgucgccucccuccucccccuccccgagugguucuucuccaccauccgccaccacgagggcgucgagaugugccucgucgacguccccgccgucgccgaggaguucauguccauguucggcaagcucuacccccuccucgccuucggccucccccucuucuucgccuccuucuacuucuggcgcgccuacgaccagugcaagaagcgcggcaccaagacccagaaccuccgcaaccagauccgcuccaagcaggucaccgucaugcuccucuccaucgccaucaucuccgcccuccucuggcuccccgagugggucgccuggcucugggucuggcaccucaaggccgccggccccgcccccccccagggcuucaucgcccucucccagguccucauguucuccaucuccuccgccaacccccucaucuuccucgucauguccgaggaguuccgcgagggccucaagggcgucuggaaguggaugaucaccaagaagccccccaccgucuccgagucccaggagacccccgccggcaacuccgagggccuccccgacaagguccccucccccgagucccccgccuccauccccgagaaggagaagcccuccucccccuccuccggcaagggcaagaccgagaaggccgagauccccauccuccccgacgucgagcaguucuggcacgagcgcgacaccguccccuccguccaggacaacgaccccauccccugggagcacgaggaccaggagaccggcgagggcgucaaguga

SEQ ID NO: 43815 - RNA, 1413 nt, Artificial Sequence
  derived and/or modified sequence opt2 from GPR152__Homo_sapiens__NP_996880
auggacaccaccauggaggccgaccucggcgccaccggccaccgcccccgcaccgagcucgacgacgaggacuccuacccccagggcggcugggacaccgucuuccucgucgcccuccuccuccucggccuccccgccaacggccucauggccuggcucgccggcucccaggcccgccacggcgccggcacccgccucgcccuccuccuccucucccucgcccucuccgacuuccucuuccucgccgccgccgccuuccagauccucgagauccgccacggcggccacuggccccucggcaccgccgccugccgcuucuacuacuuccucuggggcgucuccuacuccuccggccucuuccuccucgccgcccucucccucgaccgcugccuccucgcccucugcccccacugguaccccggccaccgccccguccgccucccccucugggucugcgccggcgucuggguccucgccacccucuucuccguccccuggcucgucuuccccgaggccgccgucuggugguacgaccucgucaucugccucgacuucugggacuccgaggagcucucccuccgcaugcucgagguccucggcggcuuccuccccuuccuccuccuccucgucugccacguccucacccaggccaccgccugccgcaccugccaccgccagcagcagcccgccgccugccgcggcuucgcccgcgucgcccgcaccauccucuccgccuacgucguccuccgccuccccuaccagcucgcccagcuccucuaccucgccuuccucugggacgucuacuccggcuaccuccucugggaggcccucgucuacuccgacuaccucauccuccucaacuccugccucucccccuuccucugccucauggccuccgccgaccuccgcacccuccuccgcuccguccucuccuccuucgccgccgcccucugcgaggagcgccccggcuccuucacccccaccgagccccagacccagcucgacuccgagggccccacccuccccgagcccauggccgaggcccagucccagauggaccccgucgcccagccccaggucaaccccacccuccagccccgcuccgaccccaccgcccagccccagcucaaccccaccgcccagccccaguccgaccccaccgcccagccccagcucaaccucauggcccagccccaguccgacuccgucgcccagccccaggccgacaccaacguccagacccccgcccccgccgccuccuccguccccucccccugcgacgaggccucccccacccccuccucccaccccacccccggcgcccucgaggaccccgccaccccccccgccuccgagggcgagucccccuccuccaccccccccgaggccgcccccggcgccggccccaccuga

SEQ ID NO: 43816 - RNA, 1830 nt, Artificial Sequence
  derived and/or modified sequence opt2 from GPR153__Homo_sapiens__XP_011539736
auguccgacgagcgccgccuccccggcuccgccgucggcuggcucgucugcggcggccucucccuccucgccaacgccuggggcauccucuccgucggcgccaagcagaagaaguggaagccccucgaguuccuccucugcacccucgccgccacccacaugcucaacgucgccguccccaucgccaccuacuccgucguccagcuccgccgccagcgccccgacuucgaguggaacgagggccucugcaaggucuucgucuccaccuucuacacccucacccucgccaccugcuucuccgucaccucccucuccuaccaccgcauguggauggucugcuggcccgucaacuaccgccucuccaacgccaagaagcaggccguccacaccgucaugggcaucuggauggucuccuucauccucuccgcccuccccgccgucggcuggcacgacaccuccgagcgcuucuacacccacggcugccgcuucaucgucgccgagaucggccucggcuucggcgucugcuuccuccuccucgucggcggcuccgucgccaugggcgucaucugcaccgccaucgcccucuuccagacccucgccguccaggucggccgccaggccgaccgccgcgccuucaccguccccaccaucgucgucgaggacgcccagggcaagcgccgcuccuccaucgacggcuccgagcccgccaagaccucccuccagaccaccggccucgucaccaccaucgucuucaucuacgacugccucaugggcuuccccguccucgucgucuccuucuccucccuccgcgccgacgccuccgcccccuggauggcccucugcguccucuggugcuccgucgcccaggcccuccuccuccccgucuuccucugggccugcgaccgcuaccgcgccgaccucaaggccguccgcgagaagugcauggcccucauggccaacgacgaggaguccgacgacgagaccucccucgagggcggcaucucccccgaccucguccucgagcgcucccucgacuacggcuacggcggcgacuucgucgcccucgaccgcauggccaaguacgagaucuccgcccucgagggcggccucccccagcucuacccccuccgcccccuccaggaggacaagaugcaguaccuccaggucccccccacccgccgcuucucccacgacgacgccgacgucugggccgccgucccccuccccgccuuccucccccgcuggggcuccggcgaggaccucgccgcccucgcccaccucguccuccccgccggccccgagcgccgccgcgccucccuccucgccuucgccgaggacgccccccccucccgcgcccgccgccgcuccgccgagucccuccucucccuccgccccuccgcccucgacuccggcccccgcggcgcccgcgacuccccccccggcuccccccgccgccgccccggccccggcccccgcuccgccuccgccucccuccuccccgacgccuucgcccucaccgccuucgagugcgagccccaggcccuccgccgcccccccggccccuuccccgccgcccccgccgcccccgacggcgccgaccccggcgaggcccccaccccccccuccuccgcccagcgcucccccggcccccgccccuccgcccacucccacgccggcucccuccgccccggccucuccgccuccuggggcgagcccggcggccuccgcgccgccggcggcggcggcuccaccuccuccuuccucuccucccccuccgaguccuccggcuacgccacccuccacuccgacucccucggcuccgccuccuga

SEQ ID NO: 43817 - RNA, 2529 nt, Artificial Sequence
  derived and/or modified sequence opt2 from GPR155__Homo_sapiens__NP_001253980
augaacuccaaccuccccgccgagaaccucaccaucgccgucaacaugaccaagacccuccccaccgccgucacccacggcuucaacuccaccaacgacccccccuccauguccaucacccgccucuuccccgcccuccucgagugcuucggcaucguccucugcggcuacaucgccggccgcgccaacgucaucaccuccacccaggccaagggccucggcaacuucgucucccgcuucgcccuccccgcccuccucuucaagaacauggucguccucaacuucuccaacgucgacugguccuuccucuacuccauccucaucgccaaggccuccgucuucuucaucgucugcguccucacccuccucgucgccucccccgacucccgcuucuccaaggccggccucuuccccaucuucgccacccaguccaacgacuucgcccucggcuaccccaucgucgaggcccucuaccagaccaccuaccccgaguaccuccaguacaucuaccucgucgcccccaucucccucaugaugcucaaccccaucggcuucaucuucugcgagauccagaaguggaaggacacccagaacgccucccagaacaagaucaagaucgucggccucggccuccuccgcguccuccagaaccccaucgucuucauggucuucaucggcaucgccuucaacuucauccucgaccgcaagguccccgucuacgucgagaacuuccucgacggccucggcaacuccuucuccggcuccgcccucuucuaccucggccucaccauggucggcaagaucaagcgccucaagaaguccgccuucgucguccucauccuccucaucaccgccaagcuccucguccucccccuccucugccgcgagauggucgagcuccucgacaagggcgacuccgucgucaaccacaccucccucuccaacuacgccuuccucuacggcgucuuccccgucgcccccggcgucgccaucuucgccacccaguucaacauggaggucgagaucaucaccuccggcauggucaucuccaccuucgucuccgcccccaucauguacgucuccgccuggcuccucaccuuccccaccauggaccccaagccccucgccuacgccauccagaacgucuccuucgacaucuccaucgucucccucaucucccucuccaucgucugcgccggcaugaugaucuggaacuucgucaaggagaagaacuucgucggccagauccucgucuucguccuccucuacuccucccucuacuccaccuaccucuggaccggccuccucgccaucucccucuuccuccucaagaagcgcgagcgcguccagauccccgucggcaucaucaucaucuccggcuggggcauccccgcccuccucgucggcguccuccucaucaccggcaagcacaacggcgacuccaucgacuccgccuucuucuacggcaaggagcagaugaucaccaccgccgucacccucuucugcuccauccucaucgccggcaucucccucaugugcaugaaccagaccgcccaggccggcuccuacgagggcuucgaccagucccagucccacaaggucgucgagcccggcaacaccgccuucgaggagucccccgcccccgucaacgagcccgagcucuucaccuccuccauccccgagaccuccugcugcuccugcuccaugggcaacggcgagcuccacugccccuccaucgagcccaucgccaacaccuccaccuccgagcccgucauccccuccuucgagaagaacaaccacugcgucucccgcugcaacucccaguccugcauccucgcccaggaggaggagcaguaccuccaguccggcgaccagcagcucacccgccacguccuccucugccuccuccucaucaucggccucuucgccaaccucuccuccugccucugguggcucuucaaccaggagcccggccgccucuacgucgagcuccaguucuucugcgccgucuucaacuucggccagggcuucaucuccuucggcaucuucggccucgacaagcaccucaucauccuccccuucaagcgccgccucgaguuccucuggaacaacaaggacaccgccgagaaccgcgacucccccgucuccgaggagaucaagaugaccugccagcaguucauccacuaccaccgcgaccucugcauccgcaacaucgucaaggagcgccgcugcggcgccaagaccuccgccggcaccuucugcggcugcgaccucgucuccuggcucaucgaggucggccucgccuccgaccgcggcgaggccgucaucuacggcgaccgccucguccagggcggcgucauccagcacaucaccaacgaguacgaguuccgcgacgaguaccucuucuaccgcuuccuccagaagucccccgagcaguccccccccgccaucaacgccaacacccuccagcaggagcgcuacaaggagaucgagcacuccuccccccccucccacucccccaagaccuga

SEQ ID NO: 43818 - RNA, 2433 nt, Artificial Sequence
  derived and/or modified sequence opt2 from GPR156__Homo_sapiens__NP_001161743
auggagcccgagaucaacugcuccgagcucugcgacuccuuccccggccaggagcucgaccgccgcccccuccacgaccucugcaagaccaccaucaccuccucccaccacuccuccaagaccaucuccucccucucccccguccuccucggcaucgucuggaccuuccucuccugcggccuccuccucauccucuucuuccucgccuucaccauccacugccgcaagaaccgcaucgucaagauguccucccccaaccucaacaucgucacccuccucggcuccugccucaccuacuccuccgccuaccucuucggcauccaggacguccucgucggcuccuccauggagacccucauccagacccgccucuccaugcucugcaucggcaccucccucgucuucggccccauccucggcaaguccuggcgccucuacaaggucuucacccagcgcguccccgacaagcgcgucaucaucaaggaccuccagcuccucggccucgucgccgcccuccucauggccgacgucauccuccucaugaccuggguccucaccgaccccauccagugccuccagauccucuccgucaccggcaaggacgucuccugcaccuccaccuccacccacuucugcgccucccgcuacuccgacgucuggaucgcccucaucuggggcugcaagggccuccuccuccucuacggcgccuaccucgccggccucaccggccacgucuccuccccccccgucaaccagucccucaccaucauggucggcgucaaccuccucguccucgccgccggccuccucuucgucgucacccgcuaccuccacuccuggcccaaccucgucuucggccucaccuccggcggcaucuucgucugcaccaccaccaucaacugcuucaucuucaucccccagcucaagcaguggaaggccuucgaggaggagaaccagaccauccgccgcauggccaaguacuucuccacccccaacaaguccuuccacacccaguacggcgaggaggagaacugccacccccgcggcgagaaguccuccauggagcgccuccucaccgagaagaacgccgucaucgagucccuccaggagcaggucaacaacgccaaggagaagaucguccgccucauguccgccgagugcaccuacgaccuccccgagggcgccgccccccccgccuccucccccaacaaggacguccaggccgucgccuccguccacacccucgccgccgcccagggccccuccggccaccucuccgacuuccagaacgaccccggcauggccgcccgcgacucccagugcaccuccggccccuccuccuacgcccagucccucgagggccccggcaaggacuccuccuucucccccggcaaggaggagaagaucuccgacuccaaggacuucuccgaccaccucgacuccggcugcucccagaagcccuggaccgagcagucccucggccccgagcgcggcgaccagguccccaugaaccccucccagucccuccuccccgagcgcggcggcuccgacccccagcgccagcgccaccucgagaacuccgaggagccccccgagcgccgcucccgcgucuccuccgucauccgcgagaagcuccaggagguccuccaggaccucggccucggccccgaggccucccucuccaccgcccccuccugccaccagcagaccuggaagaacuccgccgccuucuccccccagaagaugccccucuccaaggagcucggcuucucccccuacaugguccgccgccgccgcgccgcccagcgcgcccgcucccacuuccccggcuccgcccccuccuccgucggccaccgcgccaaccgcaccguccccggcgcccacucccgccuccacguccagaacggcgacucccccucccucgccccccagaccaccgacucccgcguccgccgccccuccucccgcaagcccucccuccccuccgacccccaggaccgccccggcacccucgagggcuccaagcagucccagaccgagcccgagggcgcccgcggcuccaaggccgccuuccuccgccagcccuccggcuccggccgcgcccccucccccgccgcccccugccucuccaaggccucccccgaccuccccgagcaguggcagcucuggccccccguccccuccggcugcgccucccucuccucccagcacuccuacuucgacaccgaguccuccuccuccgacgaguucuucugccgcugccaccgccccuacugcgagaucugcuuccaguccuccuccgacuccuccgacuccggcaccuccgacaccgaccccgagcccaccggcggccucgccuccugggagaagcucugggcccgcuccaagcccaucgucaacuucaaggacgaccucaagcccacccucgucuga

SEQ ID NO: 43819 - RNA, 3648 nt, Artificial Sequence
  derived and/or modified sequence opt2 from GPR158__Homo_sapiens__NP_065803
augggcgccauggccuacccccuccuccucugccuccuccucgcccagcucggccucggcgccgucggcgccucccgcgacccccagggccgccccgacuccccccgcgagcgcacccccaagggcaagccccacgcccagcagcccggccgcgccuccgccuccgacuccuccgcccccuggucccgcuccaccgacggcaccauccucgcccagaagcucgccgaggagguccccauggacgucgccuccuaccucuacaccggcgacucccaccagcucaagcgcgccaacugcuccggccgcuacgagcucgccggccuccccggcaaguggcccgcccucgccuccgcccaccccucccuccaccgcgcccucgacacccucacccacgccaccaacuuccucaacgucaugcuccaguccaacaagucccgcgagcagaaccuccaggacgaccucgacugguaccaggcccucgucuggucccuccucgagggcgagcccuccaucucccgcgccgccaucaccuucuccaccgacucccucuccgcccccgccccccaggucuuccuccaggccacccgcgaggagucccgcauccuccuccaggaccucuccuccuccgccccccaccucgccaacgccacccucgagaccgagugguuccacggccuccgccgcaaguggcgcccccaccuccaccgccgcggccccaaccagggcccccgcggccucggccacuccuggcgccgcaaggacggccucggcggcgacaagucccacuucaagugguccccccccuaccucgagugcgagaacggcuccuacaagcccggcuggcucgucacccucuccuccgccaucuacggccuccagcccaaccucguccccgaguuccgcggcgucaugaaggucgacaucaaccuccagaaggucgacaucgaccagugcuccuccgacggcugguucuccggcacccacaagugccaccucaacaacuccgagugcaugcccaucaagggccucggcuucguccucggcgccuacgagugcaucugcaaggccggcuucuaccaccccggcguccuccccgucaacaacuuccgccgccgcggccccgaccagcacaucuccggcuccaccaaggacgucuccgaggaggccuacgucugccuccccugccgcgagggcugccccuucugcgccgacgacucccccugcuucguccaggaggacaaguaccuccgccucgccaucaucuccuuccaggcccucugcaugcuccucgacuucgucuccaugcucgucgucuaccacuuccgcaaggccaaguccauccgcgccuccggccucauccuccucgagaccauccucuucggcucccuccuccucuacuuccccgucgucauccucuacuucgagcccuccaccuuccgcugcauccuccuccgcugggcccgccuccucggcuucgccaccgucuacggcaccgucacccucaagcuccaccgcguccucaaggucuuccucucccgcaccgcccagcgcauccccuacaugaccggcggccgcgucaugcgcaugcucgccgucauccuccucgucgucuucugguuccucaucggcuggaccuccuccgucugccagaaccucgagaagcagaucucccucaucggccagggcaagaccuccgaccaccucaucuucaacaugugccucaucgaccgcugggacuacaugaccgccgucgccgaguuccucuuccuccucuggggcgucuaccucugcuacgccguccgcaccguccccuccgccuuccacgagccccgcuacauggccgucgccguccacaacgagcucaucaucuccgccaucuuccacaccauccgcuucguccucgccucccgccuccaguccgacuggaugcucaugcucuacuucgcccacacccaccucaccgucaccgucaccaucggccuccuccucauccccaaguucucccacuccuccaacaacccccgcgacgacaucgccaccgaggccuacgaggacgagcucgacaugggccgcuccggcuccuaccucaacuccuccaucaacuccgccugguccgagcacucccucgaccccgaggacauccgcgacgagcucaagaagcucuacgcccagcucgagaucuacaagcgcaagaagaugaucaccaacaacccccaccuccagaagaagcgcugcuccaagaagggccucggccgcuccaucaugcgccgcaucaccgagauccccgagaccgucucccgccagugcuccaaggaggacaaggagggcgccgaccacggcaccgccaagggcaccgcccucauccgcaagaacccccccgaguccuccggcaacaccggcaaguccaaggaggagacccucaagaaccgcgucuucucccucaagaagucccacuccaccuacgaccacguccgcgaccagaccgaggaguccuccucccuccccaccgagucccaggaggaggagaccaccgagaacuccacccucgagucccucuccggcaagaagcucacccagaagcucaaggaggacuccgaggccgaguccaccgaguccgucccccucgucugcaaguccgccuccgcccacaaccucuccuccgagaagaagaccggccacccccgcaccuccaugcuccagaagucccucuccgucaucgccuccgccaaggagaagacccucggccucgccggcaagacccagaccgccggcgucgaggagcgcaccaagucccagaagccccuccccaaggacaaggagaccaaccgcaaccacuccaacuccgacaacaccgagaccaaggaccccgccccccagaacuccaaccccgccgaggagccccgcaagccccagaaguccggcaucaugaagcagcagcgcgucaaccccaccaccgccaacuccgaccucaaccccggcaccacccagaugaaggacaacuucgacaucggcgaggucugccccugggaggucuacgaccucacccccggccccguccccuccgaguccaagguccagaagcacgucuccaucgucgccuccgagauggagaagaaccccaccuucucccucaaggagaagucccaccacaagcccaaggccgccgaggucugccagcaguccaaccagaagcgcaucgacaaggccgaggucugccucugggagucccagggccaguccauccucgaggacgagaagcuccucaucuccaagacccccguccuccccgagcgcgccaaggaggagaacggcggccagccccgcgccgccaacgucugcgccggccaguccgaggagcucccccccaaggccgucgccuccaagaccgagaacgagaaccucaaccagaucggccaccaggagaagaagaccuccuccuccgaggagaacguccgcggcuccuacaacuccuccaacaacuuccagcagccccucaccucccgcgccgaggucugccccugggaguucgagacccccgcccagcccaacgccggccgcuccgucgcccuccccgccuccuccgcccucuccgccaacaagaucgccggcccccgcaaggaggagaucugggacuccuucaaggucuga

SEQ ID NO: 43820 - RNA, 1083 nt, Artificial Sequence
  derived and/or modified sequence opt2 from GPR15__Homo_sapiens__NP_005281
auggaccccgaggagaccuccgucuaccucgacuacuacuacgccaccucccccaacuccgacauccgcgagacccacucccacguccccuacaccuccgucuuccuccccgucuucuacaccgccgucuuccucaccggcguccucggcaaccucguccucaugggcgcccuccacuucaagcccggcucccgccgccucaucgacaucuucaucaucaaccucgccgccuccgacuucaucuuccucgucacccucccccucugggucgacaaggaggccucccucggccucuggcgcaccggcuccuuccucugcaagggcuccuccuacaugaucuccgucaacaugcacugcuccguccuccuccucaccugcauguccgucgaccgcuaccucgccaucgucuggcccgucgucucccgcaaguuccgccgcaccgacugcgccuacgucgucugcgccuccaucugguucaucuccugccuccucggccuccccacccuccucucccgcgagcucacccucaucgacgacaagcccuacugcgccgagaagaaggccacccccaucaagcucaucuggucccucgucgcccucaucuucaccuucuucgucccccuccucuccaucgucaccugcuacugcugcaucgcccgcaagcucugcgcccacuaccagcaguccggcaagcacaacaagaagcucaagaaguccaucaagaucaucuucaucgucgucgccgccuuccucgucuccuggcuccccuucaacaccuucaaguuccucgccaucgucuccggccuccgccaggagcacuaccuccccuccgccauccuccagcucggcauggaggucuccggcccccucgccuucgccaacuccugcgucaaccccuucaucuacuacaucuucgacuccuacauccgccgcgccaucguccacugccucugccccugccucaagaacuacgacuucggcuccuccaccgagaccuccgacucccaccucaccaaggcccucuccaccuucauccacgccgaggacuucgcccgccgccgcaagcgcuccgucucccucuga

SEQ ID NO: 43821 - RNA, 1017 nt, Artificial Sequence
  derived and/or modified sequence opt2 from GPR160__Homo_sapiens__NP_055188
augaccgcccucuccuccgagaacugcuccuuccaguaccagcuccgccagaccaaccagccccucgacgucaacuaccuccucuuccucaucauccucggcaagauccuccucaacauccucacccucggcaugcgccgcaagaacaccugccagaacuucauggaguacuucugcaucucccucgccuucgucgaccuccuccuccucgucaacaucuccaucauccucuacuuccgcgacuucguccuccucuccauccgcuucaccaaguaccacaucugccucuucacccagaucaucuccuucaccuacggcuuccuccacuaccccgucuuccucaccgccugcaucgacuacugccucaacuucuccaagaccaccaagcucuccuucaagugccagaagcucuucuacuucuucaccgucauccucaucuggaucuccguccucgccuacguccucggcgaccccgccaucuaccagucccucaaggcccagaacgccuacucccgccacugccccuucuacgucuccauccaguccuacuggcucuccuucuucauggucaugauccucuucgucgccuucaucaccugcugggaggaggucaccacccucguccaggccauccgcaucaccuccuacaugaacgagaccauccucuacuuccccuucuccucccacuccuccuacaccguccgcuccaagaagaucuuccucuccaagcucaucgucugcuuccucuccaccuggcuccccuucguccuccuccaggucaucaucguccuccucaagguccagauccccgccuacaucgagaugaacauccccuggcucuacuucgucaacuccuuccucaucgccaccgucuacugguucaacugccacaagcucaaccucaaggacaucggccucccccucgaccccuucgucaacuggaagugcugcuucaucccccucaccauccccaaccucgagcagaucgagaagcccaucuccaucaugaucugcuga

SEQ ID NO: 43822 - RNA, 1641 nt, Artificial Sequence
  derived and/or modified sequence opt2 from GPR161__Homo_sapiens__NP_001254540
augaaggucguccagcacgcccuccccaccccccgccgcggcgcccucaccaugucccucaacuccucccucuccugccgcaaggagcucuccaaccucaccgaggaggagggcggcgagggcggcgucaucaucacccaguucaucgccaucaucgucaucaccaucuucgucugccucggcaaccucgucaucgucgucacccucuacaagaaguccuaccuccucacccucuccaacaaguucgucuucucccucacccucuccaacuuccuccucuccguccucguccuccccuucgucgucaccuccuccauccgccgcgaguggaucuucggcgucgucuggugcaacuucuccgcccuccucuaccuccucaucuccuccgccuccaugcucacccucggcgucaucgccaucgaccgcuacuacgccguccucuaccccauggucuaccccaugaagaucaccggcaaccgcgccgucauggcccucgucuacaucuggcuccacucccucaucggcugccuccccccccucuucggcugguccuccgucgaguucgacgaguucaaguggaugugcgucgccgccuggcaccgcgagcccggcuacaccgccuucuggcagaucuggugcgcccucuuccccuuccucgucaugcucgucugcuacggcuucaucuuccgcgucgcccgcgucaaggcccgcaagguccacugcggcaccgucgucaucgucgaggaggacgcccagcgcaccggccgcaagaacuccuccaccuccaccuccuccuccggcucccgccgcaacgccuuccagggcgucgucuacuccgccaaccagugcaaggcccucaucaccauccucgucguccucggcgccuucauggucaccuggggccccuacauggucgucaucgccuccgaggcccucuggggcaaguccuccgucucccccucccucgagaccugggccaccuggcucuccuucgccuccgccgucugccacccccucaucuacggccucuggaacaagaccguccgcaaggagcuccucggcaugugcuucggcgaccgcuacuaccgcgagcccuucguccagcgccagcgcaccucccgccucuucuccaucuccaaccgcaucaccgaccucggccucuccccccaccucaccgcccucauggccggcggccagccccucggccacuccuccuccaccggcgacaccggcuucuccugcucccaggacuccggcaccgacaugaugcuccucgaggacuacaccuccgacgacaacccccccucccacugcaccugcccccccaagcgccgcuccuccgucaccuucgaggacgaggucgagcagaucaaggaggccgccaagaacuccauccuccacgucaaggccgagguccacaagucccucgacuccuacgccgccucccucgccaaggccaucgaggccgaggccaagaucaaccucuucggcgaggaggcccuccccggcguccucgucaccgcccgcaccguccccggcggcggcuucggcggccgccgcggcucccgcacccucgucucccagcgccuccagcuccaguccaucgaggagggcgacguccucgccgccgagcagcgcuga

SEQ ID NO: 43823 - RNA, 915 nt, Artificial Sequence
  derived and/or modified sequence opt2 from GPR162__Homo_sapiens__NP_055264
augcucuccaccggcgucgucuccuucuucucccucaaguccgacuccgccccccccuggaugguccucgccguccucuggugcuccauggcccagacccuccuccuccccuccuucaucugguccugcgagcgcuaccgcgccgacguccgcaccgucugggagcagugcgucgccaucauguccgaggaggacggcgacgacgacggcggcugcgacgacuacgccgagggccgcgucugcaagguccgcuucgacgccaacggcgccaccggccccggcucccgcgaccccgcccaggucaagcuccuccccggccgccacaugcucuuccccccccucgagcgcguccacuaccuccaggucccccucucccgccgccucucccacgacgagaccaacaucuucuccaccccccgcgagcccggcuccuuccuccacaagugguccuccuccgacgacauccgcguccuccccgcccagucccgcgcccucggcggcccccccgaguaccucggccagcgccaccgccucgaggacgaggaggacgaggaggaggccgagggcggcggccucgccucccuccgccaguuccucgaguccggcguccucggcuccggcggcggccccccccgcggccccggcuucuuccgcgaggagaucaccaccuucaucgacgagaccccccuccccucccccaccgccucccccggccacuccccccgccgcccccgcccccucggccucuccccccgccgccucucccucggcucccccgagucccgcgccgucggccucccccucggccucuccgccggccgccgcugcucccucaccggcggcgaggaguccgcccgcgccuggggcggcuccuggggccccggcaaccccaucuucccccagcucacccucuga

SEQ ID NO: 43824 - RNA, 960 nt, Artificial Sequence
  derived and/or modified sequence opt2 from GPR171__Homo_sapiens__NP_037440
augaccaacuccuccuucuucugccccgucuacaaggaccucgagcccuucaccuacuucuucuaccucgucuuccucgucggcaucaucggcuccugcuucgccaccugggccuucauccagaagaacaccaaccaccgcugcgucuccaucuaccucaucaaccuccucaccgccgacuuccuccucacccucgcccuccccgucaagaucgucgucgaccucggcgucgcccccuggaagcucaagaucuuccacugccaggucaccgccugccucaucuacaucaacauguaccucuccaucaucuuccucgccuucgucuccaucgaccgcugccuccagcucacccacuccugcaagaucuaccgcauccaggagcccggcuucgccaagaugaucuccaccgucgucuggcucaugguccuccucaucaugguccccaacaugaugauccccaucaaggacaucaaggagaaguccaacgucggcugcauggaguucaagaaggaguucggccgcaacuggcaccuccucaccaacuucaucugcgucgccaucuuccucaacuucuccgccaucauccucaucuccaacugccucgucauccgccagcucuaccgcaacaaggacaacgagaacuaccccaacgucaagaaggcccucaucaacauccuccucgucaccaccggcuacaucaucugcuucguccccuaccacaucguccgcauccccuacacccucucccagaccgaggucaucaccgacugcuccacccgcaucucccucuucaaggccaaggaggccacccuccuccucgccgucuccaaccucugcuucgaccccauccucuacuaccaccucuccaaggccuuccgcuccaaggucaccgagaccuucgccucccccaaggagaccaaggcccagaaggagaagcuccgcugcgagaacaacgccuga

SEQ ID NO: 43825 - RNA, 1002 nt, Artificial Sequence
  derived and/or modified sequence opt2 from GPR174__Homo_sapiens__NP_115942
augcccgccaacuacaccugcacccgccccgacggcgacaacaccgacuuccgcuacuucaucuacgccgucaccuacaccgucauccucguccccggccucaucggcaacauccucgcccucugggucuucuacggcuacaugaaggagaccaagcgcgccgucaucuucaugaucaaccucgccaucgccgaccuccuccagguccucucccucccccuccgcaucuucuacuaccucaaccacgacuggcccuucggccccggccucugcauguucugcuucuaccucaaguacgucaacauguacgccuccaucuacuuccucgucugcaucuccguccgccgcuucugguuccucauguaccccuuccgcuuccacgacugcaagcagaaguacgaccucuacaucuccaucgccggcuggcucaucaucugccucgccugcguccucuucccccuccuccgcaccuccgacgacaccuccggcaaccgcaccaagugcuucgucgaccuccccacccgcaacgucaaccucgcccaguccgucgucaugaugaccaucggcgagcucaucggcuucgucaccccccuccucaucguccucuacugcaccuggaagaccguccucucccuccaggacaaguaccccauggcccaggaccucggcgagaagcagaaggcccucaagaugauccucaccugcgccggcgucuuccucaucugcuucgcccccuaccacuucuccuucccccucgacuuccucgucaaguccaacgagaucaaguccugccucgcccgccgcgucauccucaucuuccacuccgucgcccucugccucgccucccucaacuccugccucgaccccgucaucuacuacuucuccaccaacgaguuccgccgccgccucucccgccaggaccuccacgacuccauccagcuccacgccaaguccuucgucuccaaccacaccgccuccaccaugacccccgagcucugcuga

SEQ ID NO: 43826 - RNA, 1413 nt, Artificial Sequence
  derived and/or modified sequence opt2 from GPR176__Homo_sapiens__NP_001258784
augcccgccccccuccuccucaucucccgcacccucggcaacuucaugguccucugguccaccugccgcaccaccgucuucaaguccgucaccaaccgcuucaucaagaaccucgccugcuccggcaucugcgccucccucgucugcguccccuucgacaucauccucuccaccuccccccacugcugcugguggaucuacaccaugcucuucugcaaggucgucaaguuccuccacaaggucuucugcuccgucaccauccucuccuuccccgccaucgcccucgaccgcuacuacuccguccucuacccccucgagcgcaagaucuccgacgccaagucccgcgagcucgucauguacaucugggcccacgccgucgucgccuccguccccgucuucgccgucaccaacgucgccgacaucuacgccaccuccaccugcaccgaggucugguccaacucccucggccaccucgucuacguccucgucuacaacaucaccaccgucaucguccccgucgucgucgucuuccucuuccucauccucauccgccgcgcccucuccgccucccagaagaagaaggucaucaucgccgcccuccgcaccccccagaacaccaucuccauccccuacgccucccagcgcgaggccgagcuccacgccacccuccucuccauggucauggucuucauccucugcuccguccccuacgccacccucgucgucuaccagaccguccucaacguccccgacaccuccgucuuccuccuccucaccgccgucuggcuccccaaggucucccuccucgccaaccccguccucuuccucaccgucaacaaguccguccgcaagugccucaucggcacccucguccagcuccaccaccgcuacucccgccgcaacgucgucuccaccggcuccggcauggccgaggccucccucgagcccuccauccgcuccggcucccagcuccucgagauguuccacaucggccagcagcagaucuucaagcccaccgaggacgaggaggaguccgaggccaaguacaucggcuccgccgacuuccaggccaaggagaucuucuccaccugccucgagggcgagcagggcccccaguucgcccccuccgcccccccccucuccaccgucgacuccgucucccaggucgcccccgccgcccccgucgagcccgagaccuuccccgacaaguacucccuccaguucggcuucggccccuucgagcuccccccccaguggcucuccgagacccgcaacuccaagaagcgccuccuccccccccucggcaacacccccgaggagcucauccagaccaagguccccaaggucggccgcgucgagcgcaagaugucccgcaacaacaaggucuccaucuuccccaaggucgacuccuga

SEQ ID NO: 43827 - RNA, 7104 nt, Artificial Sequence
  derived and/or modified sequence opt2 from GPR179__Homo_sapiens__NP_001004334
augggcacccgcggcgccgucaugcccccccccauguggggccuccucggcugcugcuucgucugcgccugggcccucggcggcccccgccccauccgcucccuccccccccucuccucccaggucaagcccggcuccguccccaugcaggucccccucgagggcgccgaggccgcccucgccuaccucuacuccggcgacgcccagcagcucucccaggucaacugcuccgagcgcuacgaggcccgcggcgccggcgccaugcccggccucccccccucccuccagggcgccgccggcacccucgcccaggccgccaacuuccucaacaugcuccuccaggccaacgacauccgcgaguccuccgucgaggaggacgucgagugguaccaggcccucguccgcuccgucgccgagggcgacccccgcgucuaccgcgcccuccucaccuucaaccccccccccggcgccucccaccuccagcucgcccuccaggccacccgcaccggcgaggagaccauccuccaggaccucuccggcaacuggguccaggaggagaacccccccggcgaccucgacacccccgcccucaagaagcgcguccucaccaacgaccucggcucccucggcucccccaaguggccccaggccgacggcuacgucggcgacacccagcagguccgccucuccccccccuuccucgagugccaggagggccgccuccgccccggcuggcucaucacccucuccgccaccuucuacggccucaagcccgaccucucccccgagguccgcggccagguccagauggacgucgaccuccaguccgucgacaucaaccagugcgccuccggccccggcugguacuccaacacccaccucugcgaccucaacuccacccagugcgucccccucgagucccagggcuucguccucggccgcuaccucugccgcugccgccccggcuucuacggcgccucccccuccggcggccucgaggaguccgacuuccagaccaccggccaguucggcuuccccgagggccgcuccggccgccuccuccagugccuccccugccccgagggcugcaccuccugcauggacgccacccccugccucgucgaggaggccgccguccuccgcgccgccguccucgccugccaggccugcugcaugcucgccaucuuccucuccaugcucgucuccuaccgcugccgccgcaacaagcgcaucugggccuccggcgucguccuccucgagaccguccucuucggcuuccuccuccucuacuuccccgucuucauccucuacuucaagcccuccgucuuccgcugcaucgcccuccgcuggguccgccuccucggcuucgccaucgucuacggcaccaucauccucaagcucuaccgcguccuccagcucuuccucucccgcaccgcccagcgcuccgcccuccucuccuccggccgccuccuccgccaccucggccuccuccuccuccccguccucggcuuccucgccgucuggaccgucggcgcccucgagcgcggcauccagcacgccccccucgucauccgcggccacacccccuccggccgccacuucuaccucugccaccacgaccgcugggacuacaucauggucgucgccgagcuccuccuccucugcuggggcuccuuccucugcuacgccacccgcgccguccucuccgccuuccacgagccccgcuacaugggcaucgcccuccacaacgagcuccuccucuccgccgccuuccacaccgcccgcuucguccucguccccucccuccaccccgacuggacccuccuccucuucuucuuccacacccacuccaccgucaccaccacccucgcccucaucuucauccccaaguucuggaagcucggcgcccccccccgcgaggagauggucgacgaggucugcgaggacgagcucgaccuccagcacuccggcuccuaccucggcuccuccaucgccuccgccugguccgagcacucccucgaccccggcgacauccgcgacgagcucaagaagcucuacgcccagcucgagguccacaagaccaaggagauggccgccaacaacccccaccuccccaagaagcgcggcuccuccugccagggccucggccgcuccuucaugcgcuaccucgccgaguuccccgaggcccucgcccgccagcacucccgcgacuccggcucccccggccacggcucccuccccggcuccucccgccgccgccuccucuccuccucccuccaggagcccgagggcacccccgcccuccacaagucccgcuccaccuacgaccagcgccgcgagcaggaccccccccuccucgacucccuccuccgccgcaagcucgccaagaaggccucccgcaccgagucccgcgaguccgucgagggcccccccgcccucggcuuccgcuccgccuccgcccacaaccucaccgucggcgagcgccucccccgcgcccgccccgccucccuccagaagucccucuccgucgccuccucccgcgagaaggcccuccucauggccucccaggccuaccucgaggagaccuaccgccaggccaaggagcgcgaggagcgcaagaaggccaaggccgccauggccucccucguccgccgccccuccgcccgccgccucgagcgcccccgcggcgccccccucuccgccccccccucccccgccaaguccuccuccgucgacuccucccacaccuccggccgccuccacgaggaggcccgccgccgccucccccacccccccauccgccaccaggucuccacccccauccucgcccucuccggcggccucggcgagccccgcaugcucucccccaccuccacccucgcccccgcccuccuccccgcccucgcccccacccccgcccccgcccucgcccccguccccgucuccccccagucccccaaccuccucaccuacaucugccccugggagaacgccgagcuccccgccaagcaggagaacgucccccaggagggccccuccggccccgagcgcggccaccacucccccgcccccgcccgcgcccgccucuggcgcgcccucuccgucgccgucgagaagucccgcgccggcgagaacgagauggacgccgaggacgcccaccaccagcgcgaggccaacgacgucgacgaggaccgccccaagaucuuccccaagucccacucccucaaggcccccguccagcagggcuccaugcgcucccucggccucgccaucaaggcccucacccgcucccgcuccaccuaccgcgagaaggaguccgucgaggagucccccgagggccagaacuccggcaccgccggcgaguccaugggcgcccccucccgcuccccccgccucggccgccccaaggccgucuccaagcaggccgcccucauccccuccgacgacaaggagucccuccagaaccagcagaacgcccacaccucccgcaugcuccaggucugccagcgcgagggcucccgcgagcaggaggaccgcggccgccgcaugacccagggccucggcgagcgcaaggccgagcgcgccggcaagaccggccucgccaugcuccgccaggucucccgcgacaagaacaucaagcaguccaaggagacccccgucggcuggcaggagcuccccaaggccggccuccagucccucggcuccgccgaccaccgcgucgccgaggucugccccugggaggucaccgaguccgagacccgccagcccgacuccggcaacaaggccgagaucugccccugggagaccuccgagggcgcccccgagucccgcgcccuccgccaggaccccggcgacucccagaagaagcgcggcgaggcccgcggcaaguccgagcccaucgacgucguccccaugaugcgcaagaagcccgagcgccucguccgcgagcaggaggccgucugccccugggaguccgccgaccgcggcggccucucccccggcuccgccccccaggaccccggccgcauccgcgacaaguccgaggccggcgacuccgucgaggcccgcaaggucgagaagcccggcugggaggccgccggccccgaggcccacacccccgacaucaccaaggccgagcccugccccugggaggccuccgagggcggcgaggacggcaagcccgcccaggaggccgucaaggaccucccccaggagaagcagaagacccgcaaggccaccuucuggaaggagcagaagcccggcggcgaccucgagucccucugccccugggaguccaccgacuuccgcggccccuccgccgucuccauccaggcccccggcuccuccgagugcuccggcucccucggcuccggcaucgccgaggucugccucugggaggccggcgacgcccccgccauccagaaggccgagaucugccccugggagcucgacgacaacgucaugggccaggagaugcucucccucggcaccggccgcgagucccuccaggagaaggagaaggccucccgcaagggcuccuucggcgagaugggcgagcagaccgucaaggccguccagaagcucucccagcagcaggaguccgucugcccccgcgaguccaccguccccggccacuccucccccugccucgacaacuccuccuccaaggccggcucccaguuccucugcaacggcggcucccgcgccacccaggucugcccccaggaggaccuccgccccgaggcccaggaggccacccccgccaagaccgagaucugccccugggaggucaacgagcgcacccgcgaggaguggaccuccgcccaggucccccgcggcggcgagucccagaaggacaaggagaagaugcccggcaaguccgagaucgaggacgucaccgccugggagaagcccgagggccagauccagaagcaggaggccgucggccccugggaguccgucgaccccggcuccuucuccccccagccccgcccccaggacaccgagcgcccccagacccuccuccagauguccggcuccgucggcuccaaggccgccgacaucugcccccucgacgucgaggagaaccucaccgccggcaaggccgagaucugccccugggaggucggcgccggcgccggcgaggagcgcgcccucggcgccgaggccauccgcaagucccccaacgacaccggcaaggucuccgccgaccucggcccccgcgagcgcgccgucaccgcccccgagaagccccagaagcccacccccgagugggaggucgccugccccuggggcuccgucggccccggcgccugcucccagcaccccggcacccucgacgccgacggccccaaggccggcuuccaggagcucgaccacaugggcugccgccccggcgaggucugccccugggaggcccaggaggccgccaccuccgagaaggccaagaucugccccugggaggucuccgagggcaccaccggcaagggccucgaccagaaggccggcuccgaguccgccgagcagcgcgagaaggcccucgagaagggccgccucaccucccucggcgaggacgucuccaagggcauggccaagcucugccagcagcaggagaccaucugcaucugggagaacaaggaccuccgcgagucccccgcccaggcccccaagaucuccgaccuccccuccuccauguccuccgaggucgccgagggccacucccucgaggccaccgagaagggcgaccuccgccaggaccccaagaccggcuccuuccccgagcacaucacccaggagaaggcccccgccgccgacaccgaggaguucaccaccgaggacggcgagaagaccucccacgagcuccaguccgucugccccugggagaccaccgcccccgccgacuccgucucccaccucgaccgccagcgccccgaccagcccaaggccuccucccagcgccucgucuccaccggcggccgcgccgccgacgucugccccugggacguccccgacgccggcgucuacaaguccgacuccuccgccaaggccgagaccugccccugggaggucaccgagcgcauccccgucaagggcgucucccgccaggacggcaagggcgacucccaggaggagaagggccgcgcccccgagaaguccgagcccaagggcguccccguccagaagaagcccgagauggccgacuuccgccagcaggaggccgucugccccugggagucccaggacggcaagggccucuccccccagcccgcccccgacgccuccgaccgcucccgcggcuccuccgaggccgccggcuccgucgagacccgcgucgccgaggucugccucugggaggucgucgaggcccccuccgccaagaaggccgagaucugccccugggaggccggcggcggcgccgccgaggagggcgagcaggagcgcgagucccagggccagggcgagauguuccuccagaaggccggccccggcggcaccgaggagcacuucuccaaggccgccgccaagccccgcgagcaggaggccgucugccccggcgagggcaccggcuccggcggccuccucccccaguccggcgcccucgaccccgagcucaaggucucccccaaggaggccggcuccaugggcucccgcauggccgagcucugccagugggagaucaccgaccccgagggcaacaagaucaagggcaccauggccgacaucugccccggcgaggagaccggcguccccuccgaggaguccggccuccucgcccucaccgccacccgccgcgaguucuuccccaccgcccccgagaagccccucugccuccucguccacggcccccucgaccacuucuuccccgaguccaagauccccugccccaaggucucccgccccgccuccaccuucacccucgagggcguccgcgagcuccagggccccuccggccucgagccccgcaccucccucgcccccgagcccucccuccaggaggccgagucccaguccuccucccucaccgaggacuccggccaggucgccuucgaggcccaguacgaggaguucaccccccccaccgucuaccccugggacugggaguga

SEQ ID NO: 43828 - RNA, 1020 nt, Artificial Sequence
  derived and/or modified sequence opt2 from GPR17__Homo_sapiens__NP_001154889
augaacggccucgaggucgccccccccggccucaucaccaacuucucccucgccaccgccgagcagugcggccaggagaccccccucgagaacaugcucuucgccuccuucuaccuccucgacuucauccucgcccucgucggcaacacccucgcccucuggcucuucauccgcgaccacaaguccggcacccccgccaacgucuuccucaugcaccucgccgucgccgaccucuccugcguccucguccuccccacccgccucgucuaccacuucuccggcaaccacuggcccuucggcgagaucgccugccgccucaccggcuuccucuucuaccucaacauguacgccuccaucuacuuccucaccugcaucuccgccgaccgcuuccucgccaucguccaccccgucaagucccucaagcuccgccgcccccucuacgcccaccucgccugcgccuuccucugggucgucgucgccgucgccauggccccccuccucgucuccccccagaccguccagaccaaccacaccgucgucugccuccagcucuaccgcgagaaggccucccaccacgcccucgucucccucgccgucgccuucaccuuccccuucaucaccaccgucaccugcuaccuccucaucauccgcucccuccgccagggccuccgcgucgagaagcgccucaagaccaaggccguccgcaugaucgccaucguccucgccaucuuccucgucugcuucguccccuaccacgucaaccgcuccgucuacguccuccacuaccgcucccacggcgccuccugcgccacccagcgcauccucgcccucgccaaccgcaucaccuccugccucaccucccucaacggcgcccucgaccccaucauguacuucuucgucgccgagaaguuccgccacgcccucugcaaccuccucugcggcaagcgccucaagggccccccccccuccuucgagggcaagaccaacgaguccucccucuccgccaaguccgagcucuga

SEQ ID NO: 43829 - RNA, 1323 nt, Artificial Sequence
  derived and/or modified sequence opt2 from GPR180__Homo_sapiens__NP_851320
augggcggccuccgccuccucgccgucgcccucaccugcugcugguggccccagggcucccagggcaagacccuccgcggcuccuucuccuccaccgccgcccaggacgcccagggccagcgcaucggccacuucgaguuccacggcgaccacgcccuccucugcguccgcaucaacaacaucgccgucgccgucggcaaggaggccaagcucuaccucuuccaggcccaggaguggcucaagcuccagcaguccucccacggcuacuccugcuccgagaagcucuccaaggcccagcucaccaugaccaugaaccagaccgagcacaaccucaccgucucccagauccccuccccccagaccuggcacgucuucuacgccgacaaguacaccugccaggacgacaaggagaacucccaggucgaggacauccccuucgagaugguccuccucaaccccgacgccgagggcaaccccuucgaccacuucuccgccggcgaguccggccuccacgaguucuucuuccuccucguccucgucuacuucgucaucgccugcaucuacgcccagucccucuggcaggccaucaagaagggcggccccaugcacaugauccucaagguccucaccaccgcccuccuccuccaggccggcuccgcccucgccaacuacauccacuucuccuccuacuccaaggacggcaucggcguccccuucaugggcucccucgccgaguucuucgacaucgccucccagauccagaugcucuaccuccuccucucccucugcaugggcuggaccaucguccgcaugaagaagucccagucccgcccccuccagugggacuccacccccgccuccaccggcaucgccgucuucaucgucaugacccaguccguccuccuccucugggagcaguucgaggacaucucccaccacuccuaccacucccaccacaaccucgccggcauccuccucaucguccuccgcaucugccucgcccucucccucggcugcggccucuaccagaucaucaccgucgagcgcuccacccucaagcgcgaguucuacaucaccuucgccaagggcugcauccucugguuccucugccaccccguccucgccugcaucuccgucaucuucuccgacuaccagcgcgacaaggucaucaccaucggcgucauccucugccaguccgucuccauggucauccucuaccgccucuuccucucccacucccucuacugggaggucuccucccucuccuccgucacccucccccucaccaucuccuccggccacaagucccgcccccacuucuga

SEQ ID NO: 43830 - RNA, 1215 nt, Artificial Sequence
  derived and/or modified sequence opt2 from GPR182__Homo_sapiens__XP_011536129
auguccgucaagcccuccuggggccccggccccuccgagggcgucaccgccguccccaccuccgaccucggcgagauccacaacuggaccgagcuccucgaccucuucaaccacacccucuccgagugccacgucgagcucucccaguccaccaagcgcgucguccucuucgcccucuaccucgccauguucgucgucggccucgucgagaaccuccucgucaucugcgucaacuggcgcggcuccggccgcgccggccucaugaaccucuacauccucaacauggccaucgccgaccucggcaucguccucucccuccccgucuggaugcucgaggucacccucgacuacaccuggcucuggggcuccuucuccugccgcuucacccacuacuucuacuucgucaacauguacuccuccaucuucuuccucgucugccucuccgucgaccgcuacgucacccucaccuccgccucccccuccuggcagcgcuaccagcaccgcguccgccgcgccaugugcgccggcaucuggguccucuccgccaucaucccccuccccgaggucguccacauccagcucgucgagggccccgagcccaugugccucuucauggcccccuucgagaccuacuccaccugggcccucgccgucgcccucuccaccaccauccucggcuuccuccuccccuucccccucaucaccgucuucaacguccucaccgccugccgccuccgccagcccggccagcccaagucccgccgccacugccuccuccucugcgccuacgucgccgucuucgucaugugcuggcuccccuaccacgucacccuccuccuccucacccuccacggcacccacaucucccuccacugccaccucguccaccuccucuacuucuucuacgacgucaucgacugcuucuccaugcuccacugcgucaucaaccccauccucuacaacuuccucuccccccacuuccgcggccgccuccucaacgccgucguccacuaccuccccaaggaccagaccaaggccggcaccugcgccuccuccuccuccugcuccacccagcacuccaucaucaucaccaagggcgacucccagcccgccgccgccgccccccaccccgagcccucccucuccuuccaggcccaccaccuccuccccaacaccucccccaucucccccacccagccccucacccccuccuga

SEQ ID NO: 43831 - RNA, 1086 nt, Artificial Sequence
  derived and/or modified sequence opt2 from GPR183__Homo_sapiens__NP_004942
auggacauccagauggccaacaacuucaccccccccuccgccaccccccagggcaacgacugcgaccucuacgcccaccacuccaccgcccgcaucgucaugccccuccacuacucccucgucuucaucaucggccucgucggcaaccuccucgcccucgucgucaucguccagaaccgcaagaagaucaacuccaccacccucuacuccaccaaccucgucaucuccgacauccucuucaccaccgcccuccccacccgcaucgccuacuacgccaugggcuucgacuggcgcaucggcgacgcccucugccgcaucaccgcccucgucuucuacaucaacaccuacgccggcgucaacuucaugaccugccucuccaucgaccgcuucaucgccgucguccacccccuccgcuacaacaagaucaagcgcaucgagcacgccaagggcgucugcaucuucgucuggauccucgucuucgcccagacccucccccuccucaucaaccccauguccaagcaggaggccgagcgcaucaccugcauggaguaccccaacuucgaggagaccaagucccuccccuggauccuccucggcgccugcuucaucggcuacguccucccccucaucaucauccucaucugcuacucccagaucugcugcaagcucuuccgcaccgccaagcagaacccccucaccgagaaguccggcgucaacaagaaggcccucaacaccaucauccucaucaucgucgucuucguccucugcuucacccccuaccacgucgccaucauccagcacaugaucaagaagcuccgcuucuccaacuuccucgagugcucccagcgccacuccuuccagaucucccuccacuucaccgucugccucaugaacuucaacugcugcauggaccccuucaucuacuucuucgccugcaagggcuacaagcgcaaggucaugcgcaugcucaagcgccaggucuccgucuccaucuccuccgccgucaaguccgcccccgaggagaacucccgcgagaugaccgagacccagaugaugauccacuccaaguccuccaacggcaaguga

SEQ ID NO: 43832 - RNA, 1305 nt, Artificial Sequence
  derived and/or modified sequence opt2 from GPR19__Homo_sapiens__XP_011518926
augaaggaggccuccuucuucuucucccccacccgcaucaagcgcaagaaggucaacauggucuucgcccaccgcauggacaacuccaagccccaccucaucauccccacccuccucgucccccuccagaaccgcuccugcaccgagaccgccaccccccuccccucccaguaccucauggagcucuccgaggagcacuccuggauguccaaccagaccgaccuccacuacguccucaagcccggcgaggucgccaccgccuccaucuucuucggcauccucuggcucuucuccaucuucggcaacucccucgucugccucgucauccaccgcucccgccgcacccaguccaccaccaacuacuucgucgucuccauggccugcgccgaccuccucaucuccgucgccuccacccccuucguccuccuccaguucaccaccggccgcuggacccucggcuccgccaccugcaaggucguccgcuacuuccaguaccucacccccggcguccagaucuacguccuccucuccaucugcaucgaccgcuucuacaccaucgucuacccccucuccuucaaggucucccgcgagaaggccaagaagaugaucgccgccuccugggucuucgacgccggcuucgucacccccguccucuucuucuacggcuccaacugggacucccacugcaacuacuuccuccccuccuccugggagggcaccgccuacaccgucauccacuuccucgucggcuucgucauccccuccguccucaucauccucuucuaccagaaggucaucaaguacaucuggcgcaucggcaccgacggccgcaccguccgccgcaccaugaacaucgucccccgcaccaaggucaagaccaucaagauguuccucauccucaaccuccucuuccuccucuccuggcuccccuuccacgucgcccagcucuggcacccccacgagcaggacuacaagaaguccucccucgucuucaccgccaucaccuggaucuccuucuccuccuccgccuccaagcccacccucuacuccaucuacaacgccaacuuccgccgcggcaugaaggagaccuucugcauguccuccaugaagugcuaccgcuccaacgccuacaccaucaccaccuccucccgcauggccaagaagaacuacgucggcaucuccgagauccccuccauggccaagaccaucaccaaggacuccaucuacgacuccuucgaccgcgaggccaaggagaagaagcucgccuggcccaucaacuccaacccccccaacaccuucgucuga

SEQ ID NO: 43833 - RNA, 1068 nt, Artificial Sequence
  derived and/or modified sequence opt2 from GPR1__Homo_sapiens__NP_001091669
auggaggaccucgaggagacccucuucgaggaguucgagaacuacuccuacgaccucgacuacuacucccucgaguccgaccucgaggagaagguccagcucggcgucguccacugggucucccucguccucuacugccucgccuucguccucggcauccccggcaacgccaucgucaucugguucaccggcuucaaguggaagaagaccgucaccacccucugguuccucaaccucgccaucgccgacuucaucuuccuccucuuccucccccucuacaucuccuacgucgccaugaacuuccacuggcccuucggcaucuggcucugcaaggccaacuccuucaccgcccagcucaacauguucgccuccgucuucuuccucaccgucaucucccucgaccacuacauccaccucauccaccccguccucucccaccgccaccgcacccucaagaacucccucaucgucaucaucuucaucuggcuccucgccucccucaucggcggccccgcccucuacuuccgcgacaccgucgaguucaacaaccacacccucugcuacaacaacuuccagaagcacgaccccgaccucacccucauccgccaccacguccucaccugggucaaguucaucaucggcuaccucuucccccuccucaccauguccaucugcuaccucugccucaucuucaaggucaagaagcgcuccauccucaucuccucccgccacuucuggaccauccucgucgucgucgucgccuucgucgucugcuggacccccuaccaccucuucuccaucugggagcucaccauccaccacaacuccuacucccaccacgucaugcaggccggcaucccccucuccaccggccucgccuuccucaacuccugccucaaccccauccucuacguccucaucuccaagaaguuccaggcccgcuuccgcuccuccgucgccgagauccucaaguacacccucugggaggucuccugcuccggcaccgucuccgagcagcuccgcaacuccgagaccaagaaccucugccuccucgagaccgcccaguga

SEQ ID NO: 43834 - RNA, 1077 nt, Artificial Sequence
  derived and/or modified sequence opt2 from GPR20__Homo_sapiens__NP_005284
augcccuccgucucccccgccggccccuccgccggcgccguccccaacgccaccgccgucaccaccguccgcaccaacgccuccggccucgaggucccccucuuccaccucuucgcccgccucgacgaggagcuccacggcaccuuccccggccucuggcucgcccucauggccguccacggcgccaucuuccucgccggccucguccucaacggccucgcccucuacgucuucugcugccgcacccgcgccaagacccccuccgucaucuacaccaucaaccucgucgucaccgaccuccucgucggccucucccuccccacccgcuucgccgucuacuacggcgcccgcggcugccuccgcugcgccuucccccacguccucggcuacuuccucaacaugcacugcuccauccucuuccucaccugcaucugcgucgaccgcuaccucgccaucguccgccccgagggcucccgccgcugccgccagcccgccugcgcccgcgccgucugcgccuucgucuggcucgccgccggcgccgucacccucuccguccucggcgucaccggcucccgccccugcugccgcgucuucgcccucaccguccucgaguuccuccucccccuccucgucaucuccgucuucaccggccgcaucaugugcgcccucucccgccccggccuccuccaccagggccgccagcgccgcguccgcgccaugcagcuccuccucaccguccucaucaucuuccucgucugcuucacccccuuccacgcccgccaggucgccgucgcccucuggcccgacaugccccaccacaccucccucgucgucuaccacgucgccgucacccucuccucccucaacuccugcauggaccccaucgucuacugcuucgucaccuccggcuuccaggccaccguccgcggccucuucggccagcacggcgagcgcgagcccuccuccggcgacgucgucuccaugcaccgcuccuccaagggcuccggccgccaccacauccucuccgccggcccccacgcccucacccaggcccucgccaacggccccgaggccuga

SEQ ID NO: 43835 - RNA, 1302 nt, Artificial Sequence
  derived and/or modified sequence opt2 from GPR22__Homo_sapiens__XP_011514358
augugcuucucccccauccucgagaucaacaugcaguccgaguccaacaucaccguccgcgacgacaucgacgacaucaacaccaacauguaccagccccucuccuacccccucuccuuccaggucucccucaccggcuuccucaugcucgagaucguccucggccucggcuccaaccucaccguccucguccucuacugcaugaaguccaaccucaucaacuccgucuccaacaucaucaccaugaaccuccacguccucgacgucaucaucugcgucggcugcaucccccucaccaucgucauccuccuccucucccucgaguccaacaccgcccucaucugcugcuuccacgaggccugcgucuccuucgccuccgucuccaccgccaucaacgucuucgccaucacccucgaccgcuacgacaucuccgucaagcccgccaaccgcauccucaccaugggccgcgccgucaugcucaugaucuccaucuggaucuucuccuucuucuccuuccucauccccuucaucgaggucaacuucuucucccuccaguccggcaacaccugggagaacaagacccuccucugcgucuccaccaacgaguacuacaccgagcucggcauguacuaccaccuccucguccagauccccaucuucuucuucaccgucgucgucaugcucaucaccuacaccaagauccuccaggcccucaacauccgcaucggcacccgcuucuccaccggccagaagaagaaggcccgcaagaagaagaccaucucccucaccacccagcacgaggccaccgacaugucccaguccuccggcggccgcaacgucgucuucggcguccgcaccuccgucuccgucaucaucgcccuccgccgcgccgucaagcgccaccgcgagcgccgcgagcgccagaagcgcgucuuccgcaugucccuccucaucaucuccaccuuccuccucugcuggacccccaucuccguccucaacaccaccauccucugccucggccccuccgaccuccucgucaagcuccgccucugcuuccucgucauggccuacggcaccaccaucuuccacccccuccucuacgccuucacccgccagaaguuccagaagguccucaaguccaagaugaagaagcgcgucgucuccaucgucgaggccgacccccuccccaacaacgccgucauccacaacuccuggaucgaccccaagcgcaacaagaagaucaccuucgaggacuccgagauccgcgagaagugccucgucccccaggucgucaccgacuga

SEQ ID NO: 43836 - RNA, 1014 nt, Artificial Sequence
  derived and/or modified sequence opt2 from GPR26__Homo_sapiens__NP_703143
augaacuccugggacgccggccucgccggccuccucgucggcaccaugggcgucucccuccucuccaacgcccucguccuccucugccuccuccacuccgccgacauccgccgccaggcccccgcccucuucacccucaaccucaccugcggcaaccuccucugcaccgucgucaacaugccccucacccucgccggcgucgucgcccagcgccagcccgccggcgaccgccucugccgccucgccgccuuccucgacaccuuccucgccgccaacuccaugcucuccauggccgcccucuccaucgaccgcugggucgccgucgucuucccccucuccuaccgcgccaagaugcgccuccgcgacgccgcccucauggucgccuacaccuggcuccacgcccucaccuuccccgccgccgcccucgcccucuccuggcucggcuuccaccagcucuacgccuccugcacccucugcucccgccgccccgacgagcgccuccgcuucgccgucuucaccggcgccuuccacgcccucuccuuccuccucuccuucgucguccucugcugcaccuaccucaagguccucaaggucgcccgcuuccacugcaagcgcaucgacgucaucaccaugcagacccucguccuccucgucgaccuccaccccuccguccgcgagcgcugccucgaggagcagaagcgccgccgccagcgcgccaccaagaagaucuccaccuucaucggcaccuuccucgucugcuucgcccccuacgucaucacccgccucgucgagcucuucuccaccguccccaucggcucccacuggggcguccucuccaagugccucgccuacuccaaggccgccuccgaccccuucgucuacucccuccuccgccaccaguaccgcaaguccugcaaggagauccucaaccgccuccuccaccgccgcuccauccacuccuccggccucaccggcgacucccacucccagaacauccuccccgucuccgaguga

SEQ ID NO: 43837 - RNA, 1146 nt, Artificial Sequence
  derived and/or modified sequence opt2 from GPR34__Homo_sapiens__NP_001091048
augcgcucccacaccaucaccaugaccaccaccuccgucuccuccuggcccuacuccucccaccgcaugcgcuucaucaccaaccacuccgaccagcccccccagaacuucuccgccacccccaacgucaccaccugccccauggacgagaagcuccucuccaccguccucaccaccuccuacuccgucaucuucaucgucggccucgucggcaacaucaucgcccucuacgucuuccucggcauccaccgcaagcgcaacuccauccagaucuaccuccucaacgucgccaucgccgaccuccuccucaucuucugccuccccuuccgcaucauguaccacaucaaccagaacaaguggacccucggcgucauccucugcaaggucgucggcacccucuucuacaugaacauguacaucuccaucauccuccucggcuucaucucccucgaccgcuacaucaagaucaaccgcuccauccagcagcgcaaggccaucaccaccaagcaguccaucuacgucugcugcaucgucuggaugcucgcccucggcggcuuccucaccaugaucauccucacccucaagaagggcggccacaacuccaccaugugcuuccacuaccgcgacaagcacaacgccaagggcgaggccaucuucaacuucauccucgucgucauguucuggcucaucuuccuccucaucauccucuccuacaucaagaucggcaagaaccuccuccgcaucuccaagcgccgcuccaaguuccccaacuccggcaaguacgccaccaccgcccgcaacuccuucaucguccucaucaucuucaccaucugcuucguccccuaccacgccuuccgcuucaucuacaucuccucccagcucaacgucuccuccugcuacuggaaggagaucguccacaagaccaacgagaucaugcucguccucuccuccuucaacuccugccucgaccccgucauguacuuccucauguccuccaacauccgcaagaucaugugccagcuccucuuccgccgcuuccagggcgagcccucccgcuccgaguccaccuccgaguucaagcccggcuacucccuccacgacaccuccgucgccgucaagauccaguccuccuccaaguccaccuga

SEQ ID NO: 43838 - RNA, 1023 nt, Artificial Sequence
  derived and/or modified sequence opt2 from GPR35__Homo_sapiens__NP_001182311
augcucuccggcucccgcgccguccccaccccccaccgcggcuccgaggagcuccucaaguacaugcuccacucccccugcgucucccucaccaugaacggcaccuacaacaccugcggcuccuccgaccucaccuggccccccgccaucaagcucggcuucuacgccuaccucggcguccuccucguccucggccuccuccucaacucccucgcccucugggucuucugcugccgcaugcagcaguggaccgagacccgcaucuacaugaccaaccucgccgucgccgaccucugccuccucugcacccuccccuucguccuccacucccuccgcgacaccuccgacaccccccucugccagcucucccagggcaucuaccucaccaaccgcuacauguccaucucccucgucaccgccaucgccgucgaccgcuacgucgccguccgccacccccuccgcgcccgcggccuccgcuccccccgccaggccgccgccgucugcgccguccucuggguccucgucaucggcucccucgucgcccgcuggcuccucggcauccaggagggcggcuucugcuuccgcuccacccgccacaacuucaacuccauggccuucccccuccucggcuucuaccucccccucgccgucgucgucuucugcucccucaaggucgucaccgcccucgcccagcgcccccccaccgacgucggccaggccgaggccacccgcaaggccgcccgcauggucugggccaaccuccucgucuucgucgucugcuuccucccccuccacgucggccucaccguccgccucgccgucggcuggaacgccugcgcccuccucgagaccauccgccgcgcccucuacaucaccuccaagcucuccgacgccaacugcugccucgacgccaucugcuacuacuacauggccaaggaguuccaggaggccuccgcccucgccgucgcccccuccgccaaggcccacaagucccaggacucccucugcgucacccucgccuga

SEQ ID NO: 43839 - RNA, 1842 nt, Artificial Sequence
  derived and/or modified sequence opt2 from GPR37__Homo_sapiens__NP_005293
augcgcgcccccggcgcccuccucgcccgcaugucccgccuccuccuccuccuccuccucaaggucuccgccuccuccgcccucggcgucgcccccgccucccgcaacgagaccugccucggcgaguccugcgcccccaccgucauccagcgccgcggccgcgacgccuggggccccggcaacuccgcccgcgacguccuccgcgcccgcgccccccgcgaggagcagggcgccgccuuccucgccggccccuccugggaccuccccgccgcccccggccgcgaccccgccgccggccgcggcgccgaggccuccgccgccggcccccccggcccccccacccgcccccccggccccuggcgcuggaagggcgcccgcggccaggagcccuccgagacccucggccgcggcaaccccaccgcccuccagcucuuccuccagaucuccgaggaggaggagaagggcccccgcggcgccggcaucuccggccgcucccaggagcaguccgucaagaccguccccggcgccuccgaccucuucuacuggccccgccgcgccggcaagcuccagggcucccaccacaagccccucuccaagaccgccaacggccucgccggccacgagggcuggaccaucgcccuccccggccgcgcccucgcccagaacggcucccucggcgagggcauccacgagcccggcggcccccgccgcggcaacuccaccaaccgccgcguccgccucaagaaccccuucuacccccucacccaggaguccuacggcgccuacgccgucaugugccucuccgucgucaucuucggcaccggcaucaucggcaaccucgccgucaugugcaucgucugccacaacuacuacaugcgcuccaucuccaacucccuccucgccaaccucgccuucugggacuuccucaucaucuucuucugccucccccucgucaucuuccacgagcucaccaagaaguggcuccucgaggacuucuccugcaagaucguccccuacaucgaggucgccucccucggcgucaccaccuucacccucugcgcccucugcaucgaccgcuuccgcgccgccaccaacguccagauguacuacgagaugaucgagaacugcuccuccaccaccgccaagcucgccgucaucugggucggcgcccuccuccucgcccuccccgaggucguccuccgccagcucuccaaggaggaccucggcuucuccggccgcgcccccgccgagcgcugcaucaucaagaucucccccgaccuccccgacaccaucuacguccucgcccucaccuacgacuccgcccgccucuggugguacuucggcugcuacuucugccuccccacccucuucaccaucaccugcucccucgucaccgcccgcaagauccgcaaggccgagaaggccugcacccgcggcaacaagcgccagauccagcucgagucccagaugaacugcaccgucgucgcccucaccauccucuacggcuucugcaucauccccgagaacaucugcaacaucgucaccgccuacauggccaccggcgucucccagcagaccauggaccuccucaacaucaucucccaguuccuccucuucuucaaguccugcgucacccccguccuccucuucugccucugcaagcccuucucccgcgccuucauggagugcugcugcugcugcugcgaggagugcauccagaaguccuccaccgucaccuccgacgacaacgacaacgaguacaccaccgagcucgagcucucccccuucuccaccauccgccgcgagauguccaccuucgccuccgucggcacccacugcuga

SEQ ID NO: 43840 - RNA, 1446 nt, Artificial Sequence
  derived and/or modified sequence opt2 from GPR37L1__Homo_sapiens__NP_004758
augcgcuggcucuggccccucgccgucucccucgccgucauccucgccgucggccucucccgcgucuccggcggcgccccccuccaccucggccgccaccgcgccgagacccaggagcagcagucccgcuccaagcgcggcaccgaggacgaggaggccaagggcguccagcaguacguccccgaggagugggccgaguacccccgccccauccaccccgccggccuccagcccaccaagccccucgucgccaccucccccaaccccggcaaggacggcggcacccccgacuccggccaggagcuccgcggcaaccucaccggcgcccccggccagcgccuccagauccagaacccccucuaccccgucaccgaguccuccuacuccgccuacgccaucaugcuccucgcccucgucgucuucgccgucggcaucgucggcaaccucuccgucaugugcaucgucuggcacuccuacuaccucaaguccgccuggaacuccauccucgccucccucgcccucugggacuuccucguccucuucuucugccuccccaucgucaucuucaacgagaucaccaagcagcgccuccucggcgacgucuccugccgcgccguccccuucauggaggucuccucccucggcgucaccaccuucucccucugcgcccucggcaucgaccgcuuccacgucgccaccuccacccuccccaagguccgccccaucgagcgcugccaguccauccucgccaagcucgccgucaucugggucggcuccaugacccucgccguccccgagcuccuccucuggcagcucgcccaggagcccgcccccaccaugggcacccucgacuccugcaucaugaagcccuccgccucccuccccgagucccucuacucccucgucaugaccuaccagaacgcccgcauguggugguacuucggcugcuacuucugccuccccauccucuucaccgucaccugccagcucgucaccuggcgcguccgcggcccccccggccgcaaguccgagugccgcgccuccaagcacgagcagugcgagucccagcucaacuccaccgucgucggccucaccgucgucuacgccuucugcacccuccccgagaacgucugcaacaucgucgucgccuaccucuccaccgagcucacccgccagacccucgaccuccucggccucaucaaccaguucuccaccuucuucaagggcgccaucacccccguccuccuccucugcaucugccgcccccucggccaggccuuccucgacugcugcugcugcugcugcugcgaggagugcggcggcgccuccgaggccuccgccgccaacggcuccgacaacaagcucaagaccgaggucuccuccuccaucuacuuccacaagccccgcgagucccccccccuccucccccucggcacccccugcuga

SEQ ID NO: 43841 - RNA, 1362 nt, Artificial Sequence
  derived and/or modified sequence opt2 from GPR39__Homo_sapiens__NP_001499
auggccucccccucccuccccggcuccgacugcucccagaucaucgaccacucccacguccccgaguucgaggucgccaccuggaucaagaucacccucauccucgucuaccucaucaucuucgucaugggccuccucggcaacuccgccaccauccgcgucacccagguccuccagaagaagggcuaccuccagaaggaggucaccgaccacauggucucccucgccugcuccgacauccucgucuuccucaucggcaugcccauggaguucuacuccaucaucuggaacccccucaccaccuccuccuacacccucuccugcaagcuccacaccuuccucuucgaggccugcuccuacgccacccuccuccacguccucacccucuccuucgagcgcuacaucgccaucugccaccccuuccgcuacaaggccgucuccggccccugccaggucaagcuccucaucggcuucgucugggucaccuccgcccucgucgcccucccccuccucuucgccaugggcaccgaguacccccucgucaacguccccucccaccgcggccucaccugcaaccgcuccuccacccgccaccacgagcagcccgagaccuccaacauguccaucugcaccaaccucuccucccgcuggaccgucuuccaguccuccaucuucggcgccuucgucgucuaccucgucguccuccucuccgucgccuucaugugcuggaacaugaugcagguccucaugaagucccagaagggcucccucgccggcggcacccgccccccccagcuccgcaaguccgaguccgaggagucccgcaccgcccgccgccagaccaucaucuuccuccgccucaucgucgucacccucgccgucugcuggaugcccaaccagauccgccgcaucauggccgccgccaagcccaagcacgacuggacccgcuccuacuuccgcgccuacaugauccuccuccccuucuccgagaccuucuucuaccucuccuccgucaucaacccccuccucuacaccgucuccucccagcaguuccgccgcgucuucguccagguccucugcugccgccucucccuccagcacgccaaccacgagaagcgccuccgcguccacgcccacuccaccaccgacuccgcccgcuucguccagcgcccccuccucuucgccucccgccgccaguccuccgcccgccgcaccgagaagaucuuccucuccaccuuccaguccgaggccgagccccaguccaagucccagucccucucccucgagucccucgagcccaacuccggcgccaagcccgccaacuccgccgccgagaacggcuuccaggagcacgaggucuga

SEQ ID NO: 43842 - RNA, 1089 nt, Artificial Sequence
  derived and/or modified sequence opt2 from GPR4__Homo_sapiens__NP_005273
augggcaaccacaccugggagggcugccacgucgacucccgcgucgaccaccucuucccccccucccucuacaucuucgucaucggcgucggccuccccaccaacugccucgcccucugggccgccuaccgccagguccagcagcgcaacgagcucggcgucuaccucaugaaccucuccaucgccgaccuccucuacaucugcacccucccccucugggucgacuacuuccuccaccacgacaacuggauccacggccccggcuccugcaagcucuucggcuucaucuucuacaccaacaucuacaucuccaucgccuuccucugcugcaucuccgucgaccgcuaccucgccgucgcccacccccuccgcuucgcccgccuccgccgcgucaagaccgccgucgccgucuccuccgucgucugggccaccgagcucggcgccaacuccgccccccucuuccacgacgagcucuuccgcgaccgcuacaaccacaccuucugcuucgagaaguuccccauggagggcugggucgccuggaugaaccucuaccgcgucuucgucggcuuccucuuccccugggcccucaugcuccucuccuaccgcggcauccuccgcgccguccgcggcuccgucuccaccgagcgccaggagaaggccaagaucaagcgccucgcccucucccucaucgccaucguccucgucugcuucgcccccuaccacguccuccuccucucccgcuccgccaucuaccucggccgccccugggacugcggcuucgaggagcgcgucuucuccgccuaccacuccucccucgccuucaccucccucaacugcgucgccgaccccauccucuacugccucgucaacgagggcgcccgcuccgacgucgccaaggcccuccacaaccuccuccgcuuccucgccuccgacaagccccaggagauggccaacgccucccucacccucgagaccccccucaccuccaagcgcaacuccaccgccaaggccaugaccggcuccugggccgccaccccccccucccagggcgaccagguccagcucaagaugcucccccccgcccaguga

SEQ ID NO: 43843 - RNA, 1854 nt, Artificial Sequence
  derived and/or modified sequence opt2 from GPR50__Homo_sapiens__NP_004215
augggccccacccucgccguccccacccccuacggcugcaucggcugcaagcucccccagcccgaguacccccccgcccucaucaucuucauguucugcgccauggucaucaccaucgucgucgaccucaucggcaacuccauggucauccucgccgucaccaagaacaagaagcuccgcaacuccggcaacaucuucgucgucucccucuccgucgccgacaugcucgucgccaucuaccccuacccccucaugcuccacgccauguccaucggcggcugggaccucucccagcuccagugccagauggucggcuucaucaccggccucuccgucgucggcuccaucuucaacaucgucgccaucgccaucaaccgcuacugcuacaucugccacucccuccaguacgagcgcaucuucuccguccgcaacaccugcaucuaccucgucaucaccuggaucaugaccguccucgccguccuccccaacauguacaucggcaccaucgaguacgacccccgcaccuacaccugcaucuucaacuaccucaacaaccccgucuucaccgucaccaucgucugcauccacuucguccucccccuccucaucgucggcuucugcuacguccgcaucuggaccaagguccucgccgcccgcgaccccgccggccagaaccccgacaaccagcucgccgagguccgcaacuuccucaccauguucgucaucuuccuccucuucgccgucugcuggugccccaucaacguccucaccguccucgucgccgucucccccaaggagauggccggcaagauccccaacuggcucuaccucgccgccuacuucaucgccuacuucaacuccugccucaacgccgucaucuacggccuccucaacgagaacuuccgccgcgaguacuggaccaucuuccacgccaugcgccaccccaucaucuucuucuccggccucaucuccgacauccgcgagaugcaggaggcccgcacccucgcccgcgcccgcgcccacgcccgcgaccaggcccgcgagcaggaccgcgcccacgccugccccgccgucgaggagacccccaugaacguccgcaacgucccccuccccggcgacgccgccgccggccaccccgaccgcgccuccggccaccccaagccccacucccgcuccuccuccgccuaccgcaaguccgccuccacccaccacaaguccgucuucucccacuccaaggccgccuccggccaccucaagcccgucuccggccacuccaagcccgccuccggccaccccaaguccgccaccgucuaccccaagcccgccuccguccacuucaaggccgacuccguccacuucaagggcgacuccguccacuucaagcccgacuccguccacuucaagcccgccuccuccaaccccaagcccaucaccggccaccacgucuccgccggcucccacuccaaguccgccuucuccgccgccaccucccaccccaagcccaccaccggccacaucaagcccgccaccucccacgccgagcccaccaccgccgacuaccccaagcccgccaccaccucccaccccaagcccaccgccgccgacaaccccgagcucuccgccucccacugccccgagauccccgccaucgcccaccccgucuccgacgacuccgaccuccccgaguccgccuccucccccgccgccggccccaccaagcccgccgccucccagcucgaguccgacaccaucgccgaccuccccgaccccaccgucgucaccaccuccaccaacgacuaccacgacgucgucgucaucgacgucgaggacgaccccgacgagauggccgucuga

SEQ ID NO: 43844 - RNA, 1086 nt, Artificial Sequence
  derived and/or modified sequence opt2 from GPR52__Homo_sapiens__NP_005675
augaacgagucccgcuggaccgaguggcgcauccucaacauguccuccggcaucgucaacgucuccgagcgccacuccugcccccucggcuucggccacuacuccgucgucgacgucugcaucuucgagaccgucgucaucguccuccucaccuuccucaucaucgccggcaaccucaccgucaucuucgucuuccacugcgccccccuccuccaccacuacaccaccuccuacuucauccagaccauggccuacgccgaccucuucgucggcgucuccugccucguccccacccucucccuccuccacuacuccaccggcguccacgagucccucaccugccaggucuucggcuacaucaucuccguccucaaguccgucuccauggccugccucgccugcaucuccgucgaccgcuaccucgccaucaccaagccccucuccuacaaccagcucgucacccccugccgccuccgcaucugcaucauccucaucuggaucuacuccugccucaucuuccuccccuccuucuucggcuggggcaagcccggcuaccacggcgacaucuucgaguggugcgccaccuccuggcucaccuccgccuacuucaccggcuucaucgucugccuccucuacgcccccgccgccuucgucgucugcuucaccuacuuccacaucuucaagaucugccgccagcacaccaaggagaucaacgaccgccgcgcccgcuuccccucccacgaggucgacuccucccgcgagaccggccacucccccgaccgccgcuacgccaugguccucuuccgcaucaccuccgucuucuacaugcucuggcuccccuacaucaucuacuuccuccucgaguccucccgcguccucgacaaccccacccucuccuuccucaccaccuggcucgccaucuccaacuccuucugcaacugcgucaucuacucccucuccaacuccgucuuccgccucggccuccgccgccucuccgagaccaugugcaccuccugcaugugcgucaaggaccaggaggcccaggagcccaagccccgcaagcgcgccaacuccugcuccaucuga

SEQ ID NO: 43845 - RNA, 960 nt, Artificial Sequence
  derived and/or modified sequence opt2 from GPR55__Homo_sapiens__XP_011510479
augucccagcagaacaccuccggcgacugccucuucgacggcgucaacgagcucaugaagacccuccaguucgccguccacauccccaccuucguccucggccuccuccucaaccuccucgccauccacggcuucuccaccuuccucaagaaccgcuggcccgacuacgccgccaccuccaucuacaugaucaaccucgccgucuucgaccuccuccucguccucucccuccccuucaagaugguccucucccagguccagucccccuuccccucccucugcacccucgucgagugccucuacuucgucuccauguacggcuccgucuucaccaucugcuucaucuccauggaccgcuuccucgccauccgcuacccccuccucgucucccaccuccgcuccccccgcaagaucuucggcaucugcugcaccaucuggguccucgucuggaccggcuccauccccaucuacuccuuccacggcaaggucgagaaguacaugugcuuccacaacauguccgacgacaccugguccgccaaggucuucuucccccucgaggucuucggcuuccuccuccccaugggcaucaugggcuucugcugcucccgcuccauccacauccuccucggccgccgcgaccacacccaggacuggguccagcagaaggccugcaucuacuccaucgccgccucccucgccgucuucgucgucuccuuccuccccguccaccucggcuucuuccuccaguuccucguccgcaacuccuucaucgucgagugccgcgccaagcaguccaucuccuucuuccuccagcucuccaugugcuucuccaacgucaacugcugccucgacgucuucugcuacuacuucgucaucaaggaguuccgcaugaacauccgcgcccaccgccccucccgcguccagcucguccuccaggacaccaccaucucccgcggcuga

SEQ ID NO: 43846 - RNA, 1014 nt, Artificial Sequence
  derived and/or modified sequence opt2 from GPR65__Homo_sapiens__NP_003599
augaacuccaccugcaucgaggagcagcacgaccucgaccacuaccucuuccccaucgucuacaucuucgucaucaucgucuccauccccgccaacaucggcucccucugcgucuccuuccuccaggccaagaaggaguccgagcucggcaucuaccucuucucccucucccucuccgaccuccucuacgcccucacccucccccucuggaucgacuacaccuggaacaaggacaacuggaccuucucccccgcccucugcaagggcuccgccuuccucauguacaugaacuucuacuccuccaccgccuuccucaccugcaucgccgucgaccgcuaccucgccgucgucuacccccucaaguucuucuuccuccgcacccgccgcuucgcccucauggucucccucuccaucuggauccucgagaccaucuucaacgccgucaugcucugggaggacgagaccgucgucgaguacugcgacgccgagaaguccaacuucacccucugcuacgacaaguacccccucgagaaguggcagaucaaccucaaccucuuccgcaccugcaccggcuacgccaucccccucgucaccauccucaucugcaaccgcaaggucuaccaggccguccgccacaacaaggccaccgagaacaaggagaagaagcgcaucaucaagcuccucgucuccaucaccgucaccuucguccucugcuucacccccuuccacgucaugcuccucauccgcugcauccucgagcacgccgucaacuucgaggaccacuccaacuccggcaagcgcaccuacaccauguaccgcaucaccgucgcccucaccucccucaacugcgucgccgaccccauccucuacugcuucgucaccgagaccggccgcuacgacauguggaacauccucaaguucugcaccggccgcugcaacaccucccagcgccagcgcaagcgcauccucuccgucuccaccaaggacaccauggagcucgagguccucgaguga

SEQ ID NO: 43847 - RNA, 1098 nt, Artificial Sequence
  derived and/or modified sequence opt2 from GPR68__Homo_sapiens__NP_001171147
augggcaacaucaccgccgacaacuccuccauguccugcaccaucgaccacaccauccaccagacccucgcccccgucgucuacgucaccguccucgucgucggcuuccccgccaacugccucucccucuacuucggcuaccuccagaucaaggcccgcaacgagcucggcgucuaccucugcaaccucaccgucgccgaccucuucuacaucugcucccuccccuucuggcuccaguacguccuccagcacgacaacuggucccacggcgaccucuccugccaggucugcggcauccuccucuacgagaacaucuacaucuccgucggcuuccucugcugcaucuccgucgaccgcuaccucgccgucgcccaccccuuccgcuuccaccaguuccgcacccucaaggccgccgucggcgucuccgucgucaucugggccaaggagcuccucaccuccaucuacuuccucaugcacgaggaggucaucgaggacgagaaccagcaccgcgucugcuucgagcacuaccccauccaggccuggcagcgcgccaucaacuacuaccgcuuccucgucggcuuccucuuccccaucugccuccuccucgccuccuaccagggcauccuccgcgccguccgccgcucccacggcacccagaagucccgcaaggaccagauccagcgccucguccucuccaccgucgucaucuuccucgccugcuuccuccccuaccacguccuccuccucguccgcuccgucugggaggccuccugcgacuucgccaagggcgucuucaacgccuaccacuucucccuccuccucaccuccuucaacugcgucgccgaccccguccucuacugcuucgucuccgagaccacccaccgcgaccucgcccgccuccgcggcgccugccucgccuuccucaccugcucccgcaccggccgcgcccgcgaggccuacccccucggcgcccccgaggccuccggcaaguccggcgcccagggcgaggagcccgagcuccucaccaagcuccaccccgccuuccagacccccaacucccccggcuccggcggcuuccccaccggccgccucgccuga

SEQ ID NO: 43848 - RNA, 1134 nt, Artificial Sequence
  derived and/or modified sequence opt2 from GPR6__Homo_sapiens__NP_001273028
augacccuccucgccuggugcacccgcggcgccaaccccgccgccaugaacgccuccgccgccucccucaacgacucccaggucgucgucgucgccgccgagggcgccgccgccgccgccaccgccgccggcggccccgacaccggcgaguggggcccccccgccgccgccgcccucggcgccggcggcggcgccaacggcucccucgagcucuccucccagcucuccgccggcccccccggccuccuccuccccgccgucaaccccugggacguccuccucugcgucuccggcaccgucaucgccggcgagaacgcccucgucgucgcccucaucgccuccacccccgcccuccgcacccccauguucguccucgucggcucccucgccaccgccgaccuccucgccggcugcggccucauccuccacuucgucuuccaguaccucguccccuccgagaccgucucccuccucaccgucggcuuccucgucgccuccuucgccgccuccgucuccucccuccucgccaucaccgucgaccgcuaccucucccucuacaacgcccucaccuacuacucccgccgcacccuccucggcguccaccuccuccucgccgccaccuggaccgucucccucggccucggccuccuccccguccucggcuggaacugccucgccgagcgcgccgccugcuccgucguccgcccccucgcccgcucccacgucgcccuccucuccgccgccuucuucauggucuucggcaucaugcuccaccucuacguccgcaucugccaggucgucuggcgccacgcccaccagaucgcccuccagcagcacugccucgcccccccccaccucgccgccacccgcaagggcgucggcacccucgccgucguccucggcaccuucggcgccuccuggcuccccuucgccaucuacugcgucgucggcucccacgaggaccccgccgucuacaccuacgccacccuccuccccgccaccuacaacuccaugaucaaccccaucaucuacgccuuccgcaaccaggagauccagcgcgcccucuggcuccuccucugcggcugcuuccaguccaagguccccuuccgcucccgcucccccuccgaggucuga

SEQ ID NO: 43849 - RNA, 1623 nt, Artificial Sequence
  derived and/or modified sequence opt2 from GPR75__Homo_sapiens__NP_006785
augaacuccaccggccaccuccaggacgcccccaacgccaccucccuccacgucccccacucccaggagggcaacuccaccucccuccaggagggccuccaggaccucauccacaccgccacccucgucaccugcaccuuccuccucgccgucaucuucugccucggcuccuacggcaacuucaucgucuuccucuccuucuucgaccccgccuuccgcaaguuccgcaccaacuucgacuucaugauccucaaccucuccuucugcgaccucuucaucugcggcgucaccgcccccauguucaccuucguccucuucuucuccuccgccuccuccauccccgacgccuucugcuucaccuuccaccucaccuccuccggcuucaucaucaugucccucaagaccgucgccgucaucgcccuccaccgccuccgcaugguccucggcaagcagcccaaccgcaccgccuccuuccccugcaccguccuccucacccuccuccucugggccaccuccuucacccucgccacccucgccacccucaagaccuccaagucccaccucugccuccccauguccucccucaucgccggcaagggcaaggccauccucucccucuacgucgucgacuucaccuucugcgucgccgucgucuccgucuccuacaucaugaucgcccagacccuccgcaagaacgcccagguccgcaagugcccccccgucaucaccgucgacgccucccgcccccagcccuucaugggcguccccguccagggcggcggcgaccccauccagugcgccaugcccgcccucuaccgcaaccagaacuacaacaagcuccagcacguccagacccgcggcuacaccaagucccccaaccagcucgucacccccgccgccucccgccuccagcucgucuccgccaucaaccucuccaccgccaaggacuccaaggccgucgucaccugcgucaucaucguccucuccguccucgucugcugccucccccucggcaucucccucguccaggucguccucuccuccaacggcuccuucauccucuaccaguucgagcucuucggcuucacccucaucuucuucaaguccggccucaaccccuucaucuacucccgcaacuccgccggccuccgccgcaagguccucuggugccuccaguacaucggccucggcuucuucugcugcaagcagaagacccgccuccgcgccaugggcaagggcaaccucgaggucaaccgcaacaaguccucccaccacgagaccaacuccgccuacaugcucucccccaagccccagaagaaguucgucgaccaggccugcggccccucccacuccaaggaguccauggucucccccaagaucuccgccggccaccagcacugcggccaguccuccuccacccccaucaacacccgcaucgagcccuacuacuccaucuacaacuccucccccucccaggaggaguccucccccugcaaccuccagcccgucaacuccuucggcuucgccaacuccuacaucgccaugcacuaccacaccaccaacgaccucguccaggaguacgacuccaccuccgccaagcagauccccguccccuccgucuga

SEQ ID NO: 43850 - RNA, 1092 nt, Artificial Sequence
  derived and/or modified sequence opt2 from GPR78__Homo_sapiens__NP_543009
augggccccggcgaggcccuccucgccggccuccucgucaugguccucgccgucgcccuccucuccaacgcccucguccuccucugcugcgccuacuccgccgagcuccgcacccgcgccuccggcguccuccucgucaaccucucccucggccaccuccuccucgccgcccucgacaugcccuucacccuccucggcgucaugcgcggccgcacccccuccgcccccggcgccugccaggucaucggcuuccucgacaccuuccucgccuccaacgccgcccucuccgucgccgcccucuccgccgaccaguggcucgccgucggcuucccccuccgcuacgccggccgccuccgcccccgcuacgccggccuccuccucggcugcgccuggggccagucccucgccuucuccggcgccgcccucggcugcuccuggcucggcuacuccuccgccuucgccuccugcucccuccgccucccccccgagcccgagcgcccccgcuucgccgccuucaccgccacccuccacgccgucggcuucguccucccccucgccguccucugccucaccucccuccagguccaccgcgucgcccgccgccacugccagcgcauggacaccgucaccaugaaggcccucgcccuccucgccgaccuccaccccuccguccgccagcgcugccucauccagcagaagcgccgccgccaccgcgccacccgcaagaucggcaucgccaucgccaccuuccucaucugcuucgcccccuacgucaugacccgccucgccgagcucguccccuucgucaccgucaacgcccaguggggcauccucuccaagugccucaccuacuccaaggccgucgccgaccccuucaccuacucccuccuccgccgccccuuccgccagguccucgccggcaugguccaccgccuccucaagcgcaccccccgccccgccuccacccacgacuccucccucgacgucgccggcaugguccaccagcuccucaagcgcaccccccgccccgccuccacccacaacggcuccgucgacaccgagaacgacuccugccuccagcagacccacuga

SEQ ID NO: 43851 - RNA, 1272 nt, Artificial Sequence
  derived and/or modified sequence opt2 from GPR83__Homo_sapiens__NP_057624
auggucccccaccuccuccuccucugccuccucccccucguccgcgccaccgagccccacgagggccgcgccgacgagcaguccgccgaggccgcccucgccguccccaacgccucccacuucuucuccuggaacaacuacaccuucuccgacuggcagaacuucgucggccgccgccgcuacggcgccgagucccagaaccccaccgucaaggcccuccucaucgucgccuacuccuucaucaucgucuucucccucuucggcaacguccucgucugccacgucaucuucaagaaccagcgcaugcacuccgccaccucccucuucaucgucaaccucgccgucgccgacaucaugaucacccuccucaacacccccuucacccucguccgcuucgucaacuccaccuggaucuucggcaagggcaugugccacgucucccgcuucgcccaguacugcucccuccacgucuccgcccucacccucaccgccaucgccgucgaccgccaccaggucaucaugcacccccucaagccccgcaucuccaucaccaagggcgucaucuacaucgccgucaucuggaccauggccaccuucuucucccucccccacgccaucugccagaagcucuucaccuucaaguacuccgaggacaucguccgcucccucugccuccccgacuuccccgagcccgccgaccucuucuggaaguaccucgaccucgccaccuucauccuccucuacauccucccccuccucaucaucuccgucgccuacgcccgcgucgccaagaagcucuggcucugcaacaugaucggcgacgucaccaccgagcaguacuucgcccuccgccgcaagaagaagaagaccaucaagaugcucaugcucgucgucguccucuucgcccucugcugguucccccucaacugcuacguccuccuccucuccuccaaggucauccgcaccaacaacgcccucuacuucgccuuccacugguucgccauguccuccaccugcuacaaccccuucaucuacugcuggcucaacgagaacuuccgcaucgagcucaaggcccuccucuccaugugccagcgcccccccaagccccaggaggaccgcccccccucccccguccccuccuuccgcgucgccuggaccgagaagaacgacggccagcgcgccccccucgccaacaaccuccuccccaccucccagcuccaguccggcaagaccgaccucuccuccgucgagcccaucgucaccauguccuga

SEQ ID NO: 43852 - RNA, 1077 nt, Artificial Sequence
  derived and/or modified sequence opt2 from GPR87__Homo_sapiens__NP_076404
augggcuucaaccucacccucgccaagcuccccaacaacgagcuccacggccaggagucccacaacuccggcaaccgcuccgacggccccggcaagaacaccacccuccacaacgaguucgacaccaucguccuccccguccucuaccucaucaucuucgucgccuccauccuccucaacggccucgccgucuggaucuucuuccacauccgcaacaagaccuccuucaucuucuaccucaagaacaucgucgucgccgaccucaucaugacccucaccuuccccuuccgcaucguccacgacgccggcuucggccccugguacuucaaguucauccucugccgcuacaccuccguccucuucuacgccaacauguacaccuccaucgucuuccucggccucaucuccaucgaccgcuaccucaaggucgucaagcccuucggcgacucccgcauguacuccaucaccuucaccaagguccucuccgucugcgucugggucaucauggccguccucucccuccccaacaucauccucaccaacggccagcccaccgaggacaacauccacgacugcuccaagcucaaguccccccucggcgucaaguggcacaccgccgucaccuacgucaacuccugccucuucgucgccguccucgucauccucaucggcugcuacaucgccaucucccgcuacauccacaaguccucccgccaguucaucucccaguccucccgcaagcgcaagcacaaccaguccauccgcgucgucgucgccgucuucuucaccugcuuccuccccuaccaccucugccgcauccccuucaccuucucccaccucgaccgccuccucgacgaguccgcccagaagauccucuacuacugcaaggagaucacccucuuccucuccgccugcaacgucugccucgaccccaucaucuacuucuucaugugccgcuccuucucccgccgccucuucaagaaguccaacauccgcacccgcuccgaguccauccgcucccuccaguccguccgccgcuccgagguccgcaucuacuacgacuacaccgacgucuga

SEQ ID NO: 43853 - RNA, 4188 nt, Artificial Sequence
  derived and/or modified sequence opt2 from GPRASP1__Homo_sapiens__NP_001092881
augaccggcgccgagaucgaguccggcgcccaggucaagcccgagaagaagcccggcgaggaggucgucggcggcgccgagaucgagaacgacgucccccucgucguccgccccaagguccgcacccaggcccagaucaugcccggcgcccgccccaagaacaaguccaaggucaugcccggcgccuccaccaaggucgagaccuccgccgucggcggcgcccgccccaaguccaaggccaaggccauccccgucucccgcuucaaggaggaggcccagaugugggcccagccccgcuucggcgccgagcgccucuccaagaccgagcgcaacucccagaccaacaucaucgccuccccccucgucuccaccgacuccguccucgucgccaagaccaaguaccucuccgaggaccgcgagcucgucaacaccgacaccgaguccuucccccgccgcaaggcccacuaccaggccggcuuccagcccuccuuccgcuccaaggaggagaccaacaugggcuccuggugcugcccccgccccaccuccaagcaggaggccucccccaacuccgacuucaagugggucgacaaguccgucuccucccucuucugguccggcgacgaggucaccgccaaguuccaccccggcaaccgcgucaaggacuccaaccgcuccaugcacauggccaaccaggaggccaacaccaugucccgcucccagaccaaccaggagcucuacaucgccuccuccuccggcuccgaggacgaguccgucaagacccccugguucugggcccgcgacaagaccaacaccugguccggcccccgcgaggaccccaacucccgcucccgcuuccgcuccaagaaggaggucuacgucgaguccuccuccggcuccgagcacgaggaccaccucgaguccugguucggcgccggcaaggaggccaaguuccgcuccaagaugcgcgccggcaaggaggccaacaaccgcgcccgccaccgcgccaagcgcgaggccugcaucgacuucaugcccggcuccaucgacgucaucaagaaggaguccugcuucuggcccgaggagaacgccaacaccuucucccgccccaugaucaagaaggaggcccgcgcccgcgccaugaccaaggaggaggccaagaccaaggcccgcgcccgcgccaagcaggaggcccgcuccgaggaggaggcccucaucggcaccugguucugggccaccgacgaguccuccauggccgacgaggccuccaucgaguccucccuccaggucgaggacgaguccaucaucggcuccugguucuggaccgaggaggaggccuccaugggcaccggcgccuccuccaagucccgcccccgcaccgacggcgagcgcaucggcgacucccucuucggcgcccgcgagaagaccuccaugaagaccggcgccgaggccaccuccgaguccauccucgccgccgacgacgagcaggucaucaucggcuccugguucugggccggcgaggaggucaaccaggaggccgaggaggagaccaucuucggcuccugguucugggucaucgacgccgccuccgucgaguccggcgucggcgucuccugcgagucccgcacccgcuccgaggaggaggaggucaucggccccugguucugguccggcgagcaggucgacaucgaggccggcaucggcgaggaggcccgccccggcgccgaggaggagaccaucuucggcuccugguucugggccgagaaccagaccuacauggacugccgcgccgagaccuccugcgacaccaugcagggcgccgaggaggaggagcccaucaucggcuccugguucuggacccgcgucgaggccugcgucgagggcgacgucaacuccaaguccucccucgaggacaaggaggaggccaugauccccugcuucggcgccaaggaggaggucuccaugaagcacggcaccggcguccgcugccgcuucauggccggcgccgaggagaccaacaacaaguccugcuucugggccgagaaggagcccugcauguaccccgccggcggcggcuccuggaagucccgccccgaggaggaggaggacaucgucaacuccugguucuggucccgcaaguacaccaagcccgaggccaucaucggcuccuggcucugggccaccgaggaguccaacaucgacggcaccggcgagaaggccaagcuccucaccgaggaggagaccaucaucaacuccugguucuggaaggaggacgaggccaucuccgaggccaccgaccgcgaggagucccgccccgaggccgaggagggcgacaucaucggcuccugguucugggccggcgaggaggaccgccucgagcccgccgccgagacccgcgaggaggaccgccucgccgccgagaaggagggcaucgucggcuccugguucggcgcccgcgaggagaccauccgccgcgaggccggcuccugcuccaaguccucccccaaggccgaggaggaggaggucaucaucggcuccugguucugggaggaggaggccucccccgaggccgucgccggcgucggcuucgaguccaagcccggcaccgaggaggaggagaucaccgucggcuccugguucuggcccgaggaggaggccuccauccaggccggcucccaggccgucgaggagauggaguccgagaccgaggaggagaccaucuucggcuccugguucugggacggcaaggaggucuccgaggaggccggccccugcugcgucuccaagcccgaggacgacgaggagaugaucgucgaguccugguucuggucccgcgacaaggccaucaaggagaccggcaccgucgccaccugcgaguccaagcccgagaacgaggagggcgccaucgucggcuccugguucgaggccgaggacgaggucgacaaccgcaccgacaacggcuccaacugcggcucccgcacccucgccgacgaggacgaggccaucgucggcuccugguucugggccggcgacgaggcccacuucgaguccaaccccucccccgucuuccgcgccaucugccgcuccaccugcuccgucgagcaggagcccgaccccucccgccgcccccaguccugggaggaggucaccguccaguucaagcccggccccuggggccgcgucggcuuccccuccaucucccccuuccgcuuccccaaggaggccgccucccucuucugcgagauguucggcggcaagccccgcaacaugguccucucccccgagggcgaggaccaggagucccuccuccagcccgaccagcccucccccgaguuccccuuccaguacgaccccuccuaccgcuccguccaggagauccgcgagcaccuccgcgccaaggaguccaccgagcccgaguccuccuccugcaacugcauccagugcgagcucaagaucggcuccgaggaguucgaggagcuccuccuccucauggagaagauccgcgaccccuucauccacgagaucuccaagaucgccaugggcaugcgcuccgccucccaguucacccgcgacuucauccgcgacuccggcgucgucucccucaucgagacccuccucaacuaccccuccucccgcguccgcaccuccuuccucgagaacaugauccgcauggccccccccuaccccaaccucaacaucauccagaccuacaucugcaaggucugcgaggagacccucgccuacuccgucgacucccccgagcagcucuccggcauccgcaugauccgccaccucaccaccaccaccgacuaccacacccucgucgccaacuacauguccggcuuccucucccuccucgccaccggcaacgccaagacccgcuuccacguccucaagaugcuccucaaccucuccgagaaccucuucaugaccaaggagcuccucuccgccgaggccgucuccgaguucaucggccucuucaaccgcgaggagaccaacgacaacauccagaucguccucgccaucuucgagaacaucggcaacaacaucaagaaggagaccgucuucuccgacgacgacuucaacaucgagccccucaucuccgccuuccacaaggucgagaaguucgccaaggagcuccagggcaagaccgacaaccagaacgaccccgagggcgaccaggagaacuga

SEQ ID NO: 43854 - RNA, 1074 nt, Artificial Sequence
  derived and/or modified sequence opt2 from GPRC5A__Homo_sapiens__NP_003970
auggccaccaccguccccgacggcugccgcaacggccucaaguccaaguacuaccgccucugcgacaaggccgaggccuggggcaucguccucgagaccgucgccaccgccggcgucgucaccuccgucgccuucaugcucacccuccccauccucgucugcaagguccaggacuccaaccgccgcaagaugcuccccacccaguuccucuuccuccucggcguccucggcaucuucggccucaccuucgccuucaucaucggccucgacggcuccaccggccccacccgcuucuuccucuucggcauccucuucuccaucugcuucuccugccuccucgcccacgccgucucccucaccaagcucguccgcggccgcaagccccucucccuccucgucauccucggccucgccgucggcuucucccucguccaggacgucaucgccaucgaguacaucguccucaccaugaaccgcaccaacgucaacgucuucuccgagcucuccgccccccgccgcaacgaggacuucguccuccuccucaccuacguccucuuccucauggcccucaccuuccucauguccuccuucaccuucugcggcuccuucaccggcuggaagcgccacggcgcccacaucuaccucaccaugcuccucuccaucgccaucugggucgccuggaucacccuccucaugcuccccgacuucgaccgccgcugggacgacaccauccucuccuccgcccucgccgccaacggcugggucuuccuccucgccuacgucucccccgaguucuggcuccucaccaagcagcgcaaccccauggacuaccccgucgaggacgccuucugcaagccccagcucgucaagaaguccuacggcgucgagaaccgcgccuacucccaggaggagaucacccagggcuucgaggagaccggcgacacccucuacgcccccuacuccacccacuuccagcuccagaaccagcccccccagaaggaguucuccaucccccgcgcccacgccuggcccucccccuacaaggacuacgaggucaagaaggagggcuccuga

SEQ ID NO: 43855 - RNA, 1605 nt, Artificial Sequence
  derived and/or modified sequence opt2 from GPRC5B__Homo_sapiens__NP_001291700
augugcgccgucggcgucgucgccauccuccgccgcgacccccgcgagggcugcaccgacuggaccugcgucuuccgcggcgccaaggaggccggcgucggccccuccguccgcaagcgcaccaccaccuccggcuccugggccguccgccgcgagaaguccgucucccgccgcaaccuccccggcggcggccucgccgucugcguccgccucggcgucuaccgcggcgucggcgacuucgagcgccaccgcgccggcuccauccucuccgccuccuggaccuggugcuggugcgucuccggcaagcuccuccucaugaacccccccugguccgucgccuggggccaggagggcuuccgcgccggcacccccggcucccgcuaccucccccgcauguucgucgccuccgagcgcaagaugcgcgcccaccagguccucaccuuccuccuccucuucgucaucaccuccgucgccuccgagaacgccuccaccucccgcggcugcggccucgaccuccucccccaguacgucucccucugcgaccucgacgccaucuggggcaucgucgucgaggccgucgccggcgccggcgcccucaucacccuccuccucaugcucauccuccucguccgccuccccuucaucaaggagaaggagaagaagucccccgucggccuccacuuccucuuccuccucggcacccucggccucuucggccucaccuucgccuucaucauccaggaggacgagaccaucugcuccguccgccgcuuccucuggggcguccucuucgcccucugcuucuccugccuccucucccaggccuggcgcguccgccgccucguccgccacggcaccggccccgccggcuggcagcucgucggccucgcccucugccucaugcucguccaggucaucaucgccgucgaguggcucguccucaccguccuccgcgacacccgccccgccugcgccuacgagcccauggacuucgucauggcccucaucuacgacaugguccuccucgucgucacccucggccucgcccucuucacccucugcggcaaguucaagcgcuggaagcucaacggcgccuuccuccucaucaccgccuuccucuccguccucaucugggucgccuggaugaccauguaccucuucggcaacgucaagcuccagcagggcgacgccuggaacgaccccacccucgccaucacccucgccgccuccggcugggucuucgucaucuuccacgccauccccgagauccacugcacccuccuccccgcccuccaggagaacacccccaacuacuucgacaccucccagccccgcaugcgcgagaccgccuucgaggaggacguccagcucccccgcgccuacauggagaacaaggccuucuccauggacgagcacaacgccgcccuccgcaccgccggcuuccccaacggcucccucggcaagcgccccuccggcucccucggcaagcgccccuccgcccccuuccgcuccaacgucuaccagcccaccgagauggccgucguccucaacggcggcaccauccccaccgccccccccucccacaccggccgccaccucugguga

SEQ ID NO: 43856 - RNA, 1362 nt, Artificial Sequence
  derived and/or modified sequence opt2 from GPRC5C__Homo_sapiens__NP_061123
augggcacccagcccgagcccggccucggcgcccgcauggccauccacaaggcccucgucaugugccucggccucccccucuuccucuuccccggcgccugggcccagggccacgucccccccggcugcucccagggccucaacccccucuacuacaaccucugcgaccgcuccggcgccuggggcaucguccucgaggccgucgccggcgccggcaucgucaccaccuucguccucaccaucauccucgucgccucccuccccuucguccaggacaccaagaagcgcucccuccucggcacccaggucuucuuccuccucggcacccucggccucuucugccucgucuucgccugcgucgucaagcccgacuucuccaccugcgccucccgccgcuuccucuucggcguccucuucgccaucugcuucuccugccucgccgcccacgucuucgcccucaacuuccucgcccgcaagaaccacggcccccgcggcugggucaucuucaccgucgcccuccuccucacccucgucgaggucaucaucaacaccgaguggcucaucaucacccucguccgcggcuccggcgagggcggcccccagggcaacuccuccgccggcugggccgucgccucccccugcgccaucgccaacauggacuucgucauggcccucaucuacgucaugcuccuccuccucggcgccuuccucggcgccuggcccgcccucugcggccgcuacaagcgcuggcgcaagcacggcgucuucguccuccucaccaccgccaccuccgucgccaucugggucgucuggaucgucauguacaccuacggcaacaagcagcacaacucccccaccugggacgaccccacccucgccaucgcccucgccgccaacgccugggccuucguccucuucuacgucauccccgaggucucccaggucaccaaguccucccccgagcaguccuaccagggcgacauguaccccacccgcggcgucggcuacgagaccauccucaaggagcagaagggccaguccauguucgucgagaacaaggccuucuccauggacgagcccgucgccgccaagcgccccgucucccccuacuccggcuacaacggccagcuccucaccuccgucuaccagcccaccgagauggcccucaugcacaagguccccuccgagggcgccuacgacaucauccucccccgcgccaccgccaacucccaggucaugggcuccgccaacuccacccuccgcgccgaggacauguacuccgcccagucccaccaggccgccaccccccccaaggacggcaagaacucccaggucuuccgcaaccccuacgucugggacuga

SEQ ID NO: 43857 - RNA, 1038 nt, Artificial Sequence
  derived and/or modified sequence opt2 from GPRC5D__Homo_sapiens__NP_061124
auguacaaggacugcaucgaguccaccggcgacuacuuccuccucugcgacgccgagggccccuggggcaucauccucgagucccucgccauccucggcaucgucgucaccauccuccuccuccucgccuuccucuuccucaugcgcaagauccaggacugcucccaguggaacguccuccccacccagcuccucuuccuccucuccguccucggccucuucggccucgccuucgccuucaucaucgagcucaaccagcagaccgcccccguccgcuacuuccucuucggcguccucuucgcccucugcuucuccugccuccucgcccacgccuccaaccucgucaagcucguccgcggcugcgucuccuucuccuggaccaccauccucugcaucgccaucggcugcucccuccuccagaucaucaucgccaccgaguacgucacccucaucaugacccgcggcaugauguucgucaacaugacccccugccagcucaacgucgacuucgucguccuccucgucuacguccucuuccucauggcccucaccuucuucgucuccaaggccaccuucugcggccccugcgagaacuggaagcagcacggccgccucaucuucaucaccguccucuucuccaucaucaucugggucgucuggaucuccaugcuccuccgcggcaacccccaguuccagcgccagccccagugggacgaccccgucgucugcaucgcccucgucaccaacgccugggucuuccuccuccucuacaucguccccgagcucugcauccucuaccgcuccugccgccaggagugcccccuccagggcaacgccugccccgucaccgccuaccagcacuccuuccaggucgagaaccaggagcucucccgcgcccgcgacuccgacggcgccgaggaggacgucgcccucaccuccuacggcacccccauccagccccagaccgucgaccccacccaggagugcuucaucccccaggccaagcucuccccccagcaggacgccggcggcgucuga

SEQ ID NO: 43858 - RNA, 2256 nt, Artificial Sequence
  derived and/or modified sequence opt2 from GPRC6A__Homo_sapiens__NP_001273283
auggccuuccucaucauccucaucaccugcuucgucaucauccucgccaccucccagcccugccagacccccgacgacuucgucgccgccaccucccccggccacaucaucaucggcggccucuucgccauccacgagaagaugcucuccuccgaggacuccccccgccgcccccagauccaggagugcgucggcuucgagaucuccgucuuccuccagacccucgccaugauccacuccaucgagaugaucaacaacuccacccuccuccccggcgucaagcucggcuacgagaucuacgacaccugcaccgaggucaccgucgccauggccgccacccuccgcuuccucuccaaguucaacugcucccgcgagaccgucgaguucaagugcgacuacuccuccuacaugccccgcgucaaggccgucaucggcuccggcuacuccgagaucaccauggccgucucccgcaugcucaaccuccagcucaugccccaggucggcuacgaguccaccgccgagauccucuccgacaagauccgcuuccccuccuuccuccgcaccguccccuccgacuuccaccagaucaaggccauggcccaccucauccagaaguccggcuggaacuggaucggcaucaucaccaccgacgacgacuacggccgccucgcccucaacaccuucaucauccaggccgaggccaacaacgucugcaucgccuucaaggagguccuccccgccuuccucuccgacaacaccaucgagguccgcaucaaccgcacccucaagaagaucauccucgaggcccagcuccucggcguccucaagaacgucaccuucaccgacggcuggaacuccuuccacuucgacgcccacggcgaccucaacaccggcuacgacgucguccucuggaaggagaucaacggccacaugaccgucaccaagauggccgaguacgaccuccagaacgacgucuucaucauccccgaccaggagaccaagaacgaguuccgcaaccucaagcagauccaguccaagugcuccaaggagugcucccccggccagaugaagaagaccacccgcucccagcacaucugcugcuacgagugccagaacugccccgagaaccacuacaccaaccagaccgacaugccccacugccuccucugcaacaacaagacccacugggcccccguccgcuccaccaugugcuucgagaaggaggucgaguaccucaacuggaacgacucccucgccauccuccuccucauccucucccuccucggcaucaucuucguccucgucgucggcaucaucuucacccgcaaccucaacacccccgucgucaaguccuccggcggccuccgcgucugcuacgucauccuccucugccacuuccucaacuucgccuccaccuccuucuucaucggcgagccccaggacuucaccugcaagacccgccagaccauguucggcgucuccuucacccucugcaucuccugcauccucaccaagucccucaagauccuccucgccuucuccuucgaccccaagcuccagaaguuccucaagugccucuaccgccccauccucaucaucuucaccugcaccggcauccaggucgucaucugcacccucuggcucaucuucgccgcccccaccgucgaggucaacgucucccucccccgcgucaucauccucgagugcgaggagggcuccauccucgccuucggcaccaugcucggcuacaucgccauccucgccuucaucugcuucaucuucgccuucaagggcaaguacgagaacuacaacgaggccaaguucaucaccuucggcaugcucaucuacuucaucgccuggaucaccuucauccccaucuacgccaccaccuucggcaaguacguccccgccgucgagaucaucgucauccucaucuccaacuacggcauccucuacugcaccuucauccccaagugcuacgucaucaucugcaagcaggagaucaacaccaaguccgccuuccucaagaugaucuacuccuacuccucccacuccgucuccuccaucgcccucucccccgccucccucgacuccauguccggcaacgucaccaugaccaaccccuccuccuccggcaaguccgccaccuggcagaaguccaaggaccuccaggcccaggccuucgcccacaucugccgcgagaacgccaccuccgucuccaagacccucccccgcaagcgcauguccuccaucuga

SEQ ID NO: 43859 - RNA, 3027 nt, Artificial Sequence
  derived and/or modified sequence opt2 from GPRIN1__Homo_sapiens__XP_005265863
auggacaccgccgaggaccccgccuggcuccagcuccuccagaaggacuccuccccccccggcccccgccccaccgccuucuucugcccccaggacggcucccucggcgccggcuccuccgccaugcgcgacuacugccccucccagcagaaggccucccccgcccccccccgccacacccccgaccagucccccggcauggagucccgccaccgcucccccuccggcgccggcgagggcgccuccugcuccgacggcccccgcggcucccucgccugccccucccccaccugcuucuccccccaggagucccccuccaaggagacccucgaggcccacggcgccuccaucuccggcacccccgaggccaccaccuccggcaagcccgagcccgucuccuccgucaagaccgagcccaaguccuccgacgaccgcaaccccauguuccucgagaagauggacuucaaguccuccaagcaggccgacuccaccuccaucggcaaggaggaccccggcuccucccgcaaggccgaccccauguucaccggcaaggccgagcccgagauccucggcaagggcgaccccgucgcccccggccgcauggaccccaugaccguccgcaaggaggaccucggcucccucggcaaggucgacccccucugcuccuccaagaccuacaccgucuccccccgcaaggaggaccccggcucccuccgcaaggucgaccccgucuccuccgacaaggucgaccccgucuucccccgcaaggaggagccccgcuacuccggcaaggagcaccccgucuccuccgagaaggucgcccccaccuccgccgagaaggucgaccucguccucuccggcaagcgcgaccccggccccuccggcaaggccgaccccaugccccucgaguccauggacuccgccuccaccggcaagaccgagcccggccuccucggcaagcucauccccggcuccuccggcaagaacggccccgucuccuccggcaccggcgcccccggcucccucggccgccucgaccccaccugccucggcauggccgaccccgccuccgucggcaacgucgagaccguccccgccaccaaggaggacucccgcuuccucggcaagauggaccccgccuccuccggcgagggccgccccgucuccggccacaccgacaccaccgccuccgccaagaccgaccucaccucccucaagaacgucgaccccauguccuccggcaaggucgaccccgucucccucggcaagauggaccccaugugcuccggcaagcccgagcuccucucccccggccaggccgagcgcgucuccgucggcaaggccggcaccgucucccccggcaaggaggaccccgucuccucccgccgcgaggaccccaucuccgccggcucccgcaagaccuccuccgagaaggucaaccccgaguccuccggcaagaccaaccccgucuccuccggccccggcgacccccgcucccucggcaccgccggcccccccuccgccgucaaggccgagcccgccaccggcggcaagggcgacccccucuccuccgagaaggccggccucgucgccuccggcaaggccgcccccaccgccuccggcaaggccgagccccucgccgucggcaaggaggaccccgucuccaagggcaaggccgacgccggccccuccggccagggcgacuccgucuccaucggcaaggucgucuccacccccggcaagaccguccccguccccuccggcaaggucgaccccgucucccucggcaaggccgaggccauccccgagggcaaggucggcucccucccccucgagaagggcucccccgucaccaccaccaaggccgacccccgcgccuccggcaaggcccagccccaguccggcggcaaggccgagaccaagcuccccggccaggagggcgccgccgcccccggcgaggccggcgccgucugccucaagaaggagaccccccaggccuccgagaaggucgaccccggcuccugccgcaaggccgagccccucgccuccggcaagggcgagcccgucucccucggcaaggccgacuccgcccccucccgcaagaccgagucccccucccucggcaaggucgucccccucucccucgagaagaccaagcccuccuccuccucccgccagcucgaccgcaaggcccucggcuccgcccgcucccccgagggcgcccgcggcuccgagggccgcgucgagcccaaggccgagcccgucuccuccaccgaggccuccucccucggccagaaggaccucgaggccgccggcgccgagcgcucccccugccccgaggccgccgcccccccccccggcccccgcacccgcgacaacuucaccaaggcccccuccugggaggccuccgcccccccccccccccgcgaggacgccggcacccaggccggcgcccaggccugcgucuccgucgccgucucccccauguccccccaggacggcgccggcggcuccgccuucuccuuccaggccgccccccgcgcccccuccccccccucccgccgcgacgccggccuccaggucucccucggcgccgccgagacccgcuccgucgccaccggccccaugaccccccaggccgccgccccccccgccuuccccgagguccgcguccgccccggcuccgcccucgccgccgccgucgccccccccgagcccgccgagcccguccgcgacgucuccugggacgagaagggcaugaccugggaggucuacggcgccgccauggaggucgagguccucggcauggccauccagaagcaccucgagcgccagaucgaggagcacggccgccagggcgcccccgcccccccccccgccgcccgcgccggccccggccgcuccggcuccguccgcaccgccccccccgacggcgccgccaagcgcccccccggccucuuccgcgcccuccuccaguccguccgccgcccccgcugcugcucccgcgccggccccaccgccgaguga

SEQ ID NO: 43860 - RNA, 1449 nt, Artificial Sequence
  derived and/or modified sequence opt2 from GPRIN2__Homo_sapiens__XP_011538700
augcucaacgagucccucauggagaaggccgacgccuggggccucucccucccccucgagcucgaggccgccauguccuccucccgccccgagcccggccccugggccccccucuccccccgccuccagccccucucccaguccuccuccucccuccucggcgagggccgcgagcagcgccccgagcuccgcaagaccgccuccuccaccgucuggcaggcccagcucggcgaggccuccacccgcccccaggcccccgaggaggagggcaacccccccgaguccaugaagcccgcccgcgccuccggccccaaggcccgccccuccgccggcggccacuggugguccuccaccgucggcaacgucuccaccaugggcggcuccgaccucugccgccuccgcgcccccuccgccgccgccaugcagcgcucccacuccgaccucguccgcuccacccagaugcgcggccacuccggcgcccgcaaggccucccucuccugcuccgcccucggcuccucccccguccaccgcgcccagcuccagcccggcggcaccuccggccagggcggccaggcccccgccggccucgagcgcgaccucgcccccgaggacgagaccuccaacuccgccuggaugcucggcgccucccagcucuccguccccccccucgaccucggcgacaccaccgcccacuccuccuccgcccaggccgagcccaaggccgccgagcagcucgccaccaccaccugccacgcccucccccccgccgcccuccucugcggcaugcgcgagguccgcgccggcggcugcugccacgcccuccccgccaccggcauccucgccuuccccaagcucgucgccuccgucuccgaguccggccuccaggcccagcacggcgucaagauccacugccgccucuccggcggccuccccggccacucccacugcugcgcccaccucuggggccccgccggccucguccccgagcccggcucccgcaccaaggacgucuggaccaugaccuccgccaacgaccucgcccccgccgaggccuccccccucuccgcccaggacgccggcguccaggccgcccccgucgccgccugcaaggccgucgccaccucccccucccucgaggcccccgccgcccuccacgucuuccccgaggucacccucggcuccucccucgaggagguccccucccccguccgcgacguccgcugggacgccgagggcaugaccugggaggucuacggcgccgccgucgaccucgagguccucggcgucgccauccagaagcaccucgagaugcaguucgagcagcuccagcgcgcccccgccuccgaggacucccucuccgucgagggccgccgcggcccccuccgcgccgucaugcagucccuccgccgccccuccugcugcggcugcuccggcgccgcccccgaguga

SEQ ID NO: 43861 - RNA, 2331 nt, Artificial Sequence
  derived and/or modified sequence opt2 from GPRIN3__Homo_sapiens__XP_005262993
augggcaccguccccgacccccuccgcuccgccaagaccucccucaucgccgccuccggcaaggaggacgaccucggcgagccccaggccgccuccccccgccaccgccccgcccuccucugcaagaacgccaacggcuucuccggcgcccccgccgagcccgaccucuccccccgcgccgccgccgaggcccucaugcaggucugcgagcacgagaccacccagcccgacauguccucccccggcgucuucaacgagguccagaaggcccccgccaccuucaacucccccggcaacccccagcuccccggcuccucccagcccgccgccuccgcccccuccuccgccgccggccgcgaccucauccacaccccccucaccaugcccgccaaccagcacaccugccaguccauccccggcgaccagcccaacgccaucaccuccuccaugcccgaggacucccucaugcgcucccagcgcaccuccaaccgcgagcagcccgagaagcccuccugccccgucggcggcguccucuccuccuccaaggaccaggucuccugcgaguuccccucccccgagaccauccagggcaccguccagacccccgucaccgccgcccgcgucgucucccacuccuccucccccgucggcggccccgagggcgagcgccagggcgccaucugcgacuccgagaugcgcuccugcaagccccucacccgcgaguccggcugcuccgagaacaagcagcccuccgucaccgccuccggcccccagggcaccaccuccgucaccccccagcccaccccccucaccuccgagcccuccgccugcccccccggccccgagaaggucccccuccccgcccagcgccagaugucccgcuucaaggaggccuccaccaugaccaaccaggccgaguccgagaucaaggagguccccucccgcgccuggcaggacgccgagguccaggccgucgccuccgucgagucccgcuccgucuccaccucccccuccauccucaccgccuuccucaaggagucccgcgcccccgagcacuucgagcaggagcagcuccgcgucaucugccacuccuccggcucccacacccucgagcucuccgacuccacccucgccccccaggaguccucccagugccccggcaucaugccccagguccacauccaggccgccgccgccgaguccaccgccuuccagcgcgagaacaagcucgccucccuccccggcggcguccucaagaccuccuccaucaaccucgucuccuccaacgcccagcacaccugcaaggaggacggccgccucgccggcaugacccccguccgcgaggaguccaccgccaagaagcucgccggcaccaacuccuccucccucaaggccaccgccaucgaccagaucuccaucuccgccugcucccaggccgagaccuccuacggccucggcaaguucgagacccgccccuccgaguucgccgagaagaccaccaacggccacaagaccgaccccgacugcaagcucuccgacuccugcggcuccaucuccaaggccgaccacuccggcucccucgaccccaccaacaagggcgacgcccgcgagaagaagcccgccuccccccaggucgucaaggagaaggaguccaccggcaccgacaccuccgacgccaagacccuccuccucaaccccaagucccaggaguccggcggcaccgaguccgccgccaaccccacccccucccccauccgcaagaaccaggaguccacccucgaggagaaccgccagaccaagaccgccaccucccucucccuccccuccgaccccaugggcgacuccucccccggcuccggcaagaagacccccucccgcuccgucaaggccuccccccgccgccccucccgcgucuccgaguuccucaaggagcagaagcucaacgucaccgccgccgccgcccaggucggccucacccccggcgacaagaagaagcagcucggcgccgacuccaagcuccagcucaagcaguccaagcgcguccgcgacgucgucugggacgagcagggcaugaccugggaggucuacggcgccucccucgacgccgagucccucggcaucgccauccagaaccaccuccagcgccagauccgcgagcacgagaagcucaucaagacccagaacucccagacccgccgcuccaucuccuccgacaccuccuccaacaagaagcuccgcggccgccagcacuccgucuuccaguccaugcuccagaacuuccgccgccccaacugcugcguccgccccgcccccuccuccguccucgacuga

SEQ ID NO: 43862 - RNA, 984 nt, Artificial Sequence
  derived and/or modified sequence opt2 from GPS2__Homo_sapiens__NP_004480
augcccgcccuccucgagcgccccaagcucuccaacgccauggcccgcgcccuccaccgccacaucaugauggagcgcgagcgcaagcgccaggaggaggaggaggucgacaagaugauggagcagaagaugaaggaggagcaggagcgccgcaagaagaaggagauggaggagcgcaugucccucgaggagaccaaggagcagauccucaagcucgaggagaagcuccucgcccuccaggaggagaagcaccagcucuuccuccagcucaagaagguccuccacgaggaggagaagcgccgccgcaaggagcaguccgaccucaccacccucaccuccgccgccuaccagcagucccucaccguccacaccggcacccaccuccucuccaugcagggcucccccggcggccacaaccgccccggcacccucauggccgccgaccgcgccaagcagauguucggcccccagguccucaccacccgccacuacgucggcuccgccgccgccuucgccggcacccccgagcacggccaguuccagggcucccccggcggcgccuacggcaccgcccagccccccccccacuacggccccacccagcccgccuacucccccucccagcagcuccgcgcccccuccgccuuccccgccguccaguaccucucccagccccagccccagcccuacgccguccacggccacuuccagcccacccagaccggcuuccuccagcccggcggcgcccucucccuccagaagcagauggagcacgccaaccagcagaccggcuucuccgacuccuccucccuccgccccaugcacccccaggcccuccaccccgcccccggccuccucgccuccccccagcuccccguccagaugcagcccgccggcaaguccggcuucgccgccaccucccagcccggcccccgccuccccuucauccagcacucccagaacccccgcuucuaccacaaguga

SEQ ID NO: 43863 - RNA, 2028 nt, Artificial Sequence
  derived and/or modified sequence opt2 from GPSM1__Homo_sapiens__NP_001139110
auggccggccccgccccccccgccgccgacgagcuccccggccccgccgcccgccgccucuacucccgcauggaggccuccugccucgagcucgcccucgagggcgagcgccucugcaaggccggcgacuucaagaccggcgucgccuucuucgaggccgccguccaggucggcaccgaggaccucaagacccucuccgccaucuacucccagcucggcaacgccuacuucuaccucaaggagcacggccgcgcccucgaguaccacaagcacgaccuccuccucgcccgcaccaucggcgaccgcaugggcgaggccaaggccuccggcaaccucggcaacacccucaagguccucggccgcuucgacgaggccgccgucugcugccagcgccaccucuccaucgcccaggagcagggcgacaaggucggcgaggcccgcgcccucuacaacaucggcaacgucuaccacgccaagggcaagcagcucuccuggaacgccgccaacgccacccaggaccccggccaccucccccccgacguccgcgagacccucugcaaggccuccgaguucuacgagcgcaaccucucccucgucaaggagcucggcgaccgcgccgcccagggccgcgccuacggcaaccucggcaacacccacuaccuccucggcaacuucaccgaggccaccaccuuccacaaggagcgccucgccaucgccaaggaguucggcgacaaggccgccgagcgccgcgccuacuccaaccucggcaacgcccacgucuuccucggccgcuucgacgucgccgccgaguacuacaagaagacccuccagcucucccgccagcuccgcgaccaggccgucgaggcccaggccugcuacucccucggcaacaccuacacccuccuccaggacuacgagcgcgccgccgaguaccaccuccgccaccuccucaucgcccaggagcucgccgaccgcgucggcgagggccgcgccugcuggucccucggcaacgccuacgucuccaugggccgccccgcccaggcccucaccuucgccaagaagcaccuccagaucucccaggagaucggcgaccgccacggcgagcucaccgcccgcaugaacgucgcccagcuccagcucguccucggccgccucaccucccccgccgccuccgagaagcccgaccucgccggcuacgaggcccagggcgcccgccccaagcgcacccagcgccucuccgccgagaccugggaccuccuccgccucccccucgagcgcgagcagaacggcgacucccaccacuccggcgacuggcgcggccccucccgcgacucccucccccuccccguccgcucccgcaaguaccaggagggccccgacgccgagcgccgcccccgcgagggcucccacuccccccucgacuccgccgacguccgcguccacgucccccgcaccuccaucccccgcgcccccuccuccgacgaggagugcuucuucgaccuccucaccaaguuccaguccucccgcauggacgaccagcgcugcccccucgacgacggccaggccggcgccgccgaggccaccgccgcccccacccucgaggaccgcaucgcccagcccuccaugaccgccuccccccagaccgaggaguucuucgaccucaucgccuccucccagucccgccgccucgacgaccagcgcgccuccgucggcucccuccccggccuccgcaucacccacuccaacgccggccaccuccgcggccacggcgagccccaggagcccggcgacgacuucuucaacaugcucaucaaguaccaguccucccgcaucgacgaccagcgcugccccccccccgacguccucccccgcggccccaccaugcccgacgaggacuucuucucccucauccagcgcguccaggccaagcgcauggacgagcagcgcgucgaccucgccggcggccccgagcagggcgccggcggcccccccgagccccagcagcagugccagcccggcgccuccuga

SEQ ID NO: 43864 - RNA, 1377 nt, Artificial Sequence
  derived and/or modified sequence opt2 from GPSM2__Homo_sapiens__XP_011539605
auggaggagaaccucaucuccaugcgcgaggaccacuccuuccacguccgcuaccgcauggaggccuccugccucgagcucgcccucgagggcgagcgccucugcaaguccggcgacugccgcgccggcgucuccuucuucgaggccgccguccaggucggcaccgaggaccucaagacccucuccgccaucuacucccagcucggcaacgccuacuucuaccuccacgacuacgccaaggcccucgaguaccaccaccacgaccucacccucgcccgcaccaucggcgaccagcucggcgaggccaaggccuccggcaaccucggcaacacccucaagguccucggcaacuucgacgaggccaucgucugcugccagcgccaccucgacaucucccgcgagcucaacgacaaggucggcgaggcccgcgcccucuacaaccucggcaacgucuaccacgccaagggcaaguccuucggcugccccggcccccaggacgucggcgaguuccccgaggagguccgcgacgcccuccaggccgccgucgacuucuacgaggagaaccucucccucgucaccgcccucggcgaccgcgccgcccagggccgcgccuucggcaaccucggcaacacccacuaccuccucggcaacuuccgcgacgccgucaucgcccacgagcagcgccuccucaucgccaaggaguucggcgacaaggccgccgagcgccgcgccuacuccaaccucggcaacgccuacaucuuccucggcgaguucgagaccgccuccgaguacuacaagaagacccuccuccucgcccgccagcucaaggaccgcgccgucgaggcccaguccugcuacucccucggcaacaccuacacccuccuccaggacuacgagaaggccaucgacuaccaccucaagcaccucgccaucgcccaggagcucaacgaccgcaucggcgagggccgcgccugcuggucccucggcaacgccuacaccgcccucggcaaccacgaccaggccaugcacuucgccgagaagcaccucgagaucucccgcgaggucggcgacaaguccggcgagcucaccgcccgccucaaccucuccgaccuccagaugguccucggccucuccuacuccaccaacaacuccaucauguccgagaacaccgagaucgacuccucccucaacggcguccgccccaagcucggccgccgccacuccauggagaacauggagcucaugaagcucacccccgagaagguccucaagaaccagcacuucaacguccucaucaugcgcauccacuccaugcaccucguccagguccucaagaucguccaguacaccaagaaggacaucuucaaggagaucuga

SEQ ID NO: 43865 - RNA, 483 nt, Artificial Sequence
  derived and/or modified sequence opt2 from GPSM3__Homo_sapiens__NP_071390
auggaggccgagcgcccccaggaggaggaggacggcgagcagggccccccccaggacgaggagggcuggcccccccccaacuccaccacccgccccuggcgcuccgccccccccuccccccccccccccggcacccgccacaccgcccucggcccccgcuccgccucccuccucucccuccagaccgagcuccuccucgaccucgucgccgaggcccagucccgccgccucgaggagcagcgcgccaccuucuacaccccccagaaccccuccucccucgcccccgccccccuccgcccccucgaggaccgcgagcagcucuacuccaccauccucucccaccagugccagcgcauggaggcccagcgcuccgagcccccccucccccccggcggccaggagcuccucgagcuccuccuccgcguccagggcggcggccgcauggaggagcagcgcucccgcccccccacccacaccugcuga

SEQ ID NO: 43866 - RNA, 1272 nt, Artificial Sequence
  derived and/or modified sequence opt2 from GPT2__Homo_sapiens__NP_001135938
augggccagcagcccaucaccuuccuccgccaggucauggcccucugcaccuaccccaaccuccucgacucccccuccuuccccgaggacgccaagaagcgcgcccgccgcauccuccaggccugcggcggcaacucccucggcuccuacuccgccucccagggcgucaacugcauccgcgaggacgucgccgccuacaucacccgccgcgacggcggcguccccgccgaccccgacaacaucuaccucaccaccggcgccuccgacggcaucuccaccauccucaagauccucgucuccggcggcggcaagucccgcaccggcgucaugauccccaucccccaguacccccucuacuccgccgucaucuccgagcucgacgccauccaggucaacuacuaccucgacgaggagaacugcugggcccucaacgucaacgagcuccgccgcgccguccaggaggccaaggaccacugcgaccccaagguccucugcaucaucaaccccggcaaccccaccggccagguccagucccgcaagugcaucgaggacgucauccacuucgccugggaggagaagcucuuccuccucgccgacgaggucuaccaggacaacgucuacucccccgacugccgcuuccacuccuucaagaagguccucuacgagaugggccccgaguacuccuccaacgucgagcucgccuccuuccacuccaccuccaagggcuacaugggcgagugcggcuaccgcggcggcuacauggaggucaucaaccuccaccccgagaucaagggccagcucgucaagcuccucuccguccgccucugcccccccgucuccggccaggccgccauggacaucgucgucaacccccccgucgccggcgaggaguccuucgagcaguucucccgcgagaaggaguccguccucggcaaccucgccaagaaggccaagcucaccgaggaccucuucaaccagguccccggcauccacugcaacccccuccagggcgccauguacgccuucccccgcaucuucauccccgccaaggccgucgaggccgcccaggcccaccagauggcccccgacauguucuacugcaugaagcuccucgaggagaccggcaucugcgucguccccggcuccggcuucggccagcgcgagggcaccuaccacuuccgcaugaccauccucccccccgucgagaagcucaagaccguccuccagaaggucaaggacuuccacaucaacuuccucgagaaguacgccuga

SEQ ID NO: 43867 - RNA, 1491 nt, Artificial Sequence
  derived and/or modified sequence opt2 from GPT__Homo_sapiens__XP_011515295
auggccuccuccaccggcgaccgcucccaggccguccgccacggccuccgcgccaagguccucacccucgacggcaugaacccccgcguccgccgcgucgaguacgccguccgcggccccaucguccagcgcgcccucgagcucgagcaggagcuccgccagggcgucaagaagcccuucaccgaggucauccgcgccaacaucggcgacgcccaggccaugggccagcgccccaucaccuuccuccgccagguccucgcccucugcgucaaccccgaccuccucuccucccccaacuuccccgacgacgccaagaagcgcgccgagcgcauccuccaggccugcggcggccacucccucggcgccuacuccgucuccuccggcauccagcucauccgcgaggacgucgcccgcuacaucgagcgccgcgacggcggcauccccgccgaccccaacaacgucuuccucuccaccggcgccuccgacgccaucgucaccguccucaagcuccucgucgccggcgagggccacacccgcaccggcguccucauccccaucccccaguacccccucuacuccgccacccucgccgagcucggcgccguccaggucgacuacuaccucgacgaggagcgcgccugggcccucgacgucgccgagcuccaccgcgcccucggccaggcccgcgaccacugccgcccccgcgcccucugcgucaucaaccccggcaaccccaccggccagguccagacccgcgagugcaucgaggccgucauccgcuucgccuucgaggagcgccucuuccuccucgccgacgaggucuaccaggacaacgucuacgccgccggcucccaguuccacuccuucaagaagguccucauggagaugggcccccccuacgccggccagcaggagcucgccuccuuccacuccaccuccaagggcuacaugggcgagugcggcuuccgcggcggcuacgucgaggucgucaacauggacgccgccguccagcagcagaugcucaagcucauguccguccgccucugcccccccguccccggccaggcccuccucgaccucgucgucuccccccccgcccccaccgaccccuccuucgcccaguuccaggccgagaagcaggccguccucgccgagcucgccgccaaggccaagcucaccgagcaggucuucaacgaggcccccggcaucuccugcaaccccguccagggcgccauguacuccuucccccgcguccagcuccccccccgcgccgucgagcgcgcccaggagcucggccucgcccccgacauguucuucugccuccgccuccucgaggagaccggcaucugcgucguccccggcuccggcuucggccagcgcgagggcaccuaccacuuccgcaugaccauccuccccccccucgagaagcuccgccuccuccucgagaagcucucccgcuuccacgccaaguucacccucgaguacuccuga

SEQ ID NO: 43868 - RNA, 666 nt, Artificial Sequence
  derived and/or modified sequence opt2 from GPX5__Homo_sapiens__NP_001500
augaccacccagcuccgcgucguccaccuccucccccuccuccucgccugcuucguccagaccucccccaagcaggagaagaugaagauggacugccacaaggacgagaagggcaccaucuacgacuacgaggccaucgcccucaacaagaacgaguacgucuccuucaagcaguacgucggcaagcacauccucuucgucaacgucgccaccuacugcggccucaccgcccaguaccccgagcucaacgcccuccaggaggagcucaagcccuacggccucgucguccucggcuuccccugcaaccaguucggcaagcaggagcccggcgacaacaaggagauccuccccggccucaaguacguccgccccggcggcggcuucguccccuccuuccagcucuucgagaagggcgacgucaacggcgagaaggagcagaaggucuucuccuuccucaagcacuccugcccccaccccuccgagauccucggcaccuucaaguccaucuccugggaccccgucaagguccacgacauccgcuggaacuucgagaaguuccucgucggccccgacggcauccccgucaugcgcuggucccaccgcgccaccgucuccuccgucaagaccgacauccucgccuaccucaagcaguucaagaccaaguga

SEQ ID NO: 43869 - RNA, 2238 nt, Artificial Sequence
  derived and/or modified sequence opt2 from GRAMD1B__Homo_sapiens__NP_001273492
augaagggcuucaagcucuccugcaccgccuccaacuccaaccgcuccacccccgccugcucccccauccuccgcaagcgcucccgcucccccaccccccagaaccaggacggcgacaccauggucgagaagggcuccgaccacuccuccgacaagucccccuccacccccgagcagggcguccagcgcuccugcuccucccaguccggccgcuccggcggcaagaacuccaagucccacaagcgccucuccaagaagucccaguccugguacaacguccucucccccaccuacaagcagcgcaacgaggacuuccgcaagcucuucaagcagcuccccgacaccgagcgccucaucgucgacuacuccugcgcccuccagcgcgacauccuccuccagggccgccucuaccucuccgagaacuggaucugcuucuacuccaacaucuuccgcugggagacccuccucaccguccgccucaaggacaucugcuccaugaccaaggagaagaccgcccgccucauccccaacgccauccaggucugcaccgacuccgagaagcacuucuucaccuccuucggcgcccgcgaccgcaccuacaugaugauguuccgccucuggcagaacgcccuccucgagaagccccucugccccaaggagcucuggcacuucguccaccagugcuacggcaacgagcucggccucaccuccgacgacgaggacuacgucccccccgacgacgacuucaacaccaugggcuacugcgaggagauccccgucgaggagaacgaggucaacgacuccuccuccaaguccuccaucgagaccaagcccgacgccuccccccagcuccccaagaaguccaucaccaacuccacccucaccuccaccggcuccuccgaggcccccgucuccuucgacggccucccccucgaggaggaggcccucgagggcgacggcucccucgagaaggagcucgccaucgacaacaucaugggcgagaagaucgagaugaucgcccccgucaacucccccucccucgacuucaacgacaacgaggacauccccaccgagcucuccgacuccuccgacacccacgacgagggcgagguccaggccuucuacgaggaccucuccggccgccaguacgucaacgaggucuucaacuucuccgucgacaagcucuacgaccuccucuucaccaacucccccuuccagcgcgacuucauggagcagcgccgcuucuccgacaucaucuuccaccccuggaagaaggaggagaacggcaaccagucccgcgucauccucuacaccaucacccucaccaacccccucgcccccaagaccgccaccguccgcgagacccagaccauguacaaggccucccaggaguccgagugcuacgucaucgacgccgagguccucacccacgacguccccuaccacgacuacuucuacaccaucaaccgcuacacccucacccgcgucgcccgcaacaagucccgccuccgcgucuccaccgagcuccgcuaccgcaagcagcccuggggccucgucaagaccuucaucgagaagaacuucugguccggccucgaggacuacuuccgccaccucgaguccgagcucgccaagaccgaguccaccuaccucgccgagaugcaccgccagucccccaaggagaaggccuccaagaccaccaccguccgccgccgcaagcgcccccacgcccaccuccgcgucccccaccucgaggaggucaugucccccgucaccacccccaccgacgaggacgucggccaccgcaucaagcacgucgccggcuccacccagacccgccacauccccgaggacacccccaacggcuuccaccuccaguccgucuccaagcuccuccucgucaucuccugcgucaucugcuucucccucguccuccucgucauccucaacaugaugcucuucuacaagcucuggaugcucgaguacaccacccagacccucaccgccuggcagggccuccgccuccaggagcgccucccccagucccagaccgagugggcccagcuccucgagucccagcagaaguaccacgacaccgagcuccagaaguggcgcgagaucaucaaguccuccgucaugcuccucgaccagaugaaggacucccucaucaaccuccagaacggcauccgcucccgcgacuacaccuccgaguccgaggagaagcgcaaccgcuaccacuga

SEQ ID NO: 43870 - RNA, 1344 nt, Artificial Sequence
  derived and/or modified sequence opt2 from GRAMD3__Homo_sapiens__NP_001139791
augacccgccgccagcagguccuccaggccaagcgcuccauccagcagaccuuccaggcccagcucaugcccuggaaguccauguuccacggccgcgaggucaagcccgucggccccgaccucgagcucuccgaggccgagaacggcgucgaggagaagaagaaggccugccgcucccccaccgcccagucccccacccccuccgucgaggccgacucccccgaccagaagaagaucaucucccucugguccaaguccuccuucgacggcgccucccucgccuccgacaagaacgacugcaagaccgaguccaagaacgaccccaagaccgagcgcaagaaguccuccuccuccucccaguacaaggccaacaugcacuuccacaagcucuuccucuccguccccaccgaggagccccucaagcaguccuucaccugcgcccuccagaaggagauccucuaccagggcaagcucuucgucuccgagaacuggaucugcuuccacuccaaggucuucggcaaggacaccaagaucuccauccccgccuucuccgucacccucaucaagaagaccaagaccgcccuccucguccccaacgcccucaucaucgccaccgucaccgaccgcuacaucuucgucucccuccucucccgcgacuccaccuacaagcuccucaaguccgucugcggccaccucgagaacaccuccgucggcaacucccccaaccccuccuccgccgagaacuccuuccgcgccgaccgccccuccucccucccccucgacuucaacgacgaguucuccgaccucgacggcgucguccagcagcgccgccaggacauggagggcuacuccuccuccggcucccagacccccgaguccgagaacucccgcgacuuccacgccaccgagucccagaccguccucaacgucuccaagggcgaggccaagcccacccgcgccgacgcccacgucaaccgcguccccgagggcaaggccaagucccuccccguccagggccucuccgagaccgucggcauccuccacaaggucaagucccagaagugccccaugcuccaccacauccucaucuucuacgccaucgucgucugcgcccucaucaucuccaccuucuacaugcgcuaccgcaucaacacccucgaggagcagcucggccuccucaccuccaucgucgacacccacaacaccgagcaggccgcccccuccggccuccgcucccagguccaguucaacgucgagguccucugccaggagcucaccgccaacaucgucaagcucgagaagauccagaacaaccuccagaagcuccucgagaacggcgacuga

SEQ ID NO: 43871 - RNA, 1737 nt, Artificial Sequence
  derived and/or modified sequence opt2 from GRAMD4__Homo_sapiens__NP_055939
augcuccgccgccucgacaagauccgcuuccgcggccacaagcgcgacgacuuccucgaccucgccgagucccccaacgccuccgacaccgagugcuccgacgagaucccccucaaggucccccgcaccuccccccgcgacuccgaggagcuccgcgaccccgccggccccggcacccucaucauggccaccggcguccaggacuucaaccgcaccgaguucgaccgccucaacgagaucaagggccaccucgagaucgcccuccucgagaagcacuuccuccaggaggagcuccgcaagcuccgcgaggagaccaacgccgagaugcuccgccaggagcucgaccgcgagcgccagcgccgcauggagcucgagcagaagguccaggagguccucaaggcccgcaccgaggagcagauggcccagcagccccccaagggccaggcccaggccuccaacggcgccgagcgccgcucccagggccucuccucccgccuccagaagugguucuacgagcgcuucggcgaguacgucgaggacuuccgcuuccagcccgaggagaacaccgucgagaccgaggagccccucuccgcccgccgccucaccgagaacaugcgccgccucaagcgcggcgccaagcccgucaccaacuucgucaagaaccucuccgcccucuccgacugguacuccgucuacaccuccgccaucgccuucaccgucuacaugaacgccgucuggcacggcugggccaucccccucuuccucuuccucgccauccuccgccucucccucaacuaccucaucgcccgcggcuggcgcauccagugguccaucguccccgaggucuccgagcccgucgagccccccaaggaggaccucaccgucuccgagaaguuccagcucguccucgacgucgcccagaaggcccagaaccucuucggcaagauggccgacauccucgagaagaucaagaaccucuucauguggguccagcccgagaucacccagaagcucuacgucgcccucugggccgccuuccucgccuccugcuucuuccccuaccgccucgucggccucgccgucggccucuacgccggcaucaaguucuuccucaucgacuucaucuucaagcgcugcccccgccuccgcgccaaguacgacacccccuacaucaucuggcgcucccuccccaccgacccccagcucaaggagcgcuccuccgccgccgucucccgccgccuccagaccaccuccucccgcuccuacguccccuccgcccccgccggccucggcaaggaggaggacgccggccgcuuccacuccaccaagaagggcaacuuccacgagaucuucaaccucaccgagaacgagcgcccccucgccgucugcgagaacggcuggcgcugcugccucaucaaccgcgaccgcaagaugcccaccgacuacauccgcaacggcguccucuacgucaccgagaacuaccucugcuucgaguccuccaaguccggcuccuccaagcgcaacaaggucaucaagcucgucgacaucaccgacauccagaaguacaagguccucuccguccuccccggcuccggcaugggcaucgccgucuccacccccuccacccagaagccccucgucuucggcgccaugguccaccgcgacgaggccuucgagaccauccucucccaguacaucaagaucaccuccgccgccgccuccggcggcgacuccuga

SEQ ID NO: 43872 - RNA, 993 nt, Artificial Sequence
  derived and/or modified sequence opt2 from GRAP2__Homo_sapiens__NP_001278754
auggaggccgucgccaaguucgacuucaccgccuccggcgaggacgagcucuccuuccacaccggcgacguccucaagauccucuccaaccaggaggagugguucaaggccgagcucggcucccaggagggcuacguccccaagaacuucaucgacauccaguuccccaagugguuccacgagggccucucccgccaccaggccgagaaccuccucaugggcaaggaggucggcuucuucaucauccgcgccucccaguccucccccggcgacuucuccaucuccguccgccacgaggacgacguccagcacuucaaggucaugcgcgacaacaagggcaacuacuuccucuggaccgagaaguuccccucccucaacaagcucgucgacuacuaccgcaccaacuccaucucccgccagaagcagaucuuccuccgcgaccgcacccgcgaggaccagggccaccgcggcaacucccucgaccgccgcucccagggcggcccccaccucuccggcgccgucggcgaggagauccgccccuccaugaaccgcaagcucuccgaccacccccccacccucccccuccagcagcaccagcaccagccccagcccccccaguacgcccccgccccccagcagcuccagcagcccccccagcagcgcuaccuccagcaccaccacuuccaccaggagcgccgcggcggcucccucgacaucaacgacggccacugcggcaccggccucggcuccgagaugaacgccgcccucaugcaccgccgccacaccgaccccguccagcuccaggccgccggccgcguccgcugggcccgcgcccucuacgacuucgaggcccucgaggacgacgagcucggcuuccacuccggcgaggucgucgagguccucgacuccuccaaccccuccugguggaccggccgccuccacaacaagcucggccucuuccccgccaacuacgucgcccccaugacccgcuga

SEQ ID NO: 43873 - RNA, 654 nt, Artificial Sequence
  derived and/or modified sequence opt2 from GRAP__Homo_sapiens__NP_006604
auggaguccgucgcccucuacuccuuccaggccaccgaguccgacgagcucgccuucaacaagggcgacacccucaagauccucaacauggaggacgaccagaacugguacaaggccgagcuccgcggcgucgagggcuucauccccaagaacuacauccgcgucaagccccaccccugguacuccggccgcaucucccgccagcucgccgaggagauccucaugaagcgcaaccaccucggcgccuuccucauccgcgaguccgaguccucccccggcgaguucuccgucuccgucaacuacggcgaccagguccagcacuucaagguccuccgcgaggccuccggcaaguacuuccucugggaggagaaguucaacucccucaacgagcucgucgacuucuaccgcaccaccaccaucgccaagaagcgccagaucuuccuccgcgacgaggagccccuccucaagucccccggcgccugcuucgcccaggcccaguucgacuucuccgcccaggaccccucccagcucuccuuccgccgcggcgacaucaucgagguccucgagcgccccgacccccacugguggcgcggccgcuccugcggccgcgucggcuucuucccccgcuccuacguccagcccguccaccucuga

SEQ ID NO: 43874 - RNA, 759 nt, Artificial Sequence
  derived and/or modified sequence opt2 from GRASP__Homo_sapiens__NP_001258785
augacccuccuccccuccaagggcggcgacaccaucgccuccgucaacggccucaacgucgagggcauccgccaccgcgagaucgucgacaucaucaaggccuccggcaacguccuccgccucgagacccucuacggcaccuccauccgcaaggccgagcucgaggcccgccuccaguaccucaagcagacccucuacgagaaguggggcgaguaccgcucccucaugguccaggagcagcgccucguccacggccucgucgucaaggaccccuccaucuacgacacccucgaguccguccgcuccugccucuacggcgccggccuccuccccggcucccuccccuucggcccccuccucgccguccccggccgcccccgcggcggcgcccgccgcgcccgcggcgacgccgacgacgccgucuaccacaccugcuucuucggcgacuccgagccccccgcccucccccccccccccccccccgcccgcgccuucggccccggccccgccgagacccccgccgucggccccggccccggcccccgcgccgcccucucccgcuccgccuccguccgcugcgccggccccggcggcggcggcggcggcggcgcccccggcgcccucuggaccgaggcccgcgagcaggcccucugcggccccggccuccgcaagaccaaguaccgcuccuuccgccgccgccuccucaaguucauccccggccucaaccgcucccucgaggaggaggagucccagcucuga

SEQ ID NO: 43875 - RNA, 1647 nt, Artificial Sequence
  derived and/or modified sequence opt2 from GRB10__Homo_sapiens__NP_001001549
auggcccucgccggcugccccgacuccuuccuccaccaccccuacuaccaggacaaggucgagcagaccccccgcucccagcaggaccccgccggccccggccuccccgcccaguccgaccgccucgccaaccaccaggaggacgacgucgaccucgaggcccucgucaacgacaugaacgccucccucgagucccucuacuccgccugcuccaugcaguccgacaccgucccccuccuccagaacggccagcacgcccgcucccagccccgcgccuccggccccccccgcuccauccagccccaggucuccccccgccagcgcguccagcgcucccagcccguccacauccucgccguccgccgccuccaggaggaggaccagcaguuccgcaccuccucccuccccgccauccccaaccccuuccccgagcucugcggccccggcuccccccccguccucacccccggcucccucccccccucccaggccgccgccaagcaggacgucaaggucuucuccgaggacggcaccuccaaggucgucgagauccucgccgacaugaccgcccgcgaccucugccagcuccucgucuacaagucccacugcgucgacgacaacuccuggacccucgucgagcaccacccccaccucggccucgagcgcugccucgaggaccacgagcucgucguccaggucgaguccaccauggccuccgaguccaaguuccucuuccgcaagaacuacgccaaguacgaguucuucaagaaccccaugaacuucuuccccgagcagauggucaccuggugccagcaguccaacggcucccagacccagcuccuccaggagccccgccaccuccagcuccucgccgaccucgaggacuccaacaucuucucccucaucgccggccgcaagcaguacaacgcccccaccgaccacggccucugcaucaagcccaacaagguccgcaacgagaccaaggagcuccgccuccucugcgccgaggacgagcagacccgcaccugcuggaugaccgccuuccgccuccucaaguacggcaugcuccucuaccagaacuaccgcaucccccagcagcgcaaggcccuccucucccccuucuccacccccguccgcuccgucuccgagaacucccucgucgccauggacuucuccggccagaccggccgcgucaucgagaaccccgccgaggcccaguccgccgcccucgaggagggccacgccuggcgcaagcgcuccacccgcaugaacauccucggcucccaguccccccuccaccccuccacccucuccaccgucauccaccgcacccagcacugguuccacggccgcaucucccgcgaggagucccaccgcaucaucaagcagcagggccucgucgacggccucuuccuccuccgcgacucccaguccaaccccaaggccuucguccucacccucugccaccaccagaagaucaagaacuuccagauccuccccugcgaggacgacggccagaccuucuucucccucgacgacggcaacaccaaguucuccgaccucauccagcucgucgacuucuaccagcucaacaagggcguccuccccugcaagcucaagcaccacugcauccgcgucgcccucuga

SEQ ID NO: 43876 - RNA, 1362 nt, Artificial Sequence
  derived and/or modified sequence opt2 from GRB14__Homo_sapiens__NP_001290351
augucccucuccgcccgccgcgucacccuccccgccaucacccccaucauccuccagaagcgcgucaucaaggucuacuccgaggacgagaccucccgcgcccucgacguccccuccgacaucaccgcccgcgacgucugccagcuccucauccucaagaaccacuacaucgacgaccacuccuggacccucuucgagcaccucccccacaucggcgucgagcgcaccaucgaggaccacgagcucgucaucgagguccucuccaacuggggcaucgaggaggagaacaagcucuacuuccgcaagaacuacgccaaguacgaguucuucaagaaccccauguacuucuuccccgagcacauggucuccuucgccaccgagaccaacggcgagaucucccccacccagauccuccagauguuccucuccuccuccaccuaccccgagauccacggcuuccuccacgccaaggagcagggcaagaaguccuggaagaagaucuacuucuuccuccgccgcuccggccucuacuucuccaccaagggcaccuccaaggagccccgccaccuccaguucuucuccgaguucggcaacuccgacaucuacgucucccucgccggcaagaagaagcacggcgcccccaccaacuacggcuucugcuucaagcccaacaaggccggcggcccccgcgaccucaagaugcucugcgccgaggaggagcagucccgcaccugcugggucaccgccauccgccuccucaaguacggcaugcagcucuaccagaacuacaugcaccccuaccagggccgcuccggcugcuccucccaguccaucucccccaugcgcuccaucuccgagaacucccucgucgccauggacuucuccggccagaagucccgcgucaucgagaaccccaccgaggcccucuccgucgccgucgaggagggccucgccuggcgcaagaagggcugccuccgccucggcacccacggcucccccaccgccuccucccaguccuccgccaccaacauggccauccaccgcucccagcccugguuccaccacaagaucucccgcgacgaggcccagcgccucaucauccagcagggccucgucgacggcgucuuccucguccgcgacucccaguccaaccccaagaccuucguccucuccaugucccacggccagaagaucaagcacuuccagaucauccccgucgaggacgacggcgagauguuccacacccucgacgacggccacacccgcuucaccgaccucauccagcucgucgaguucuaccagcucaacaagggcguccuccccugcaagcucaagcacuacugcgcccgcaucgcccucuga

SEQ ID NO: 43877 - RNA, 654 nt, Artificial Sequence
  derived and/or modified sequence opt2 from GRB2__Homo_sapiens__NP_002077
auggaggccaucgccaaguacgacuucaaggccaccgccgacgacgagcucuccuucaagcgcggcgacauccucaagguccucaacgaggagugcgaccagaacugguacaaggccgagcucaacggcaaggacggcuucauccccaagaacuacaucgagaugaagccccaccccugguucuucggcaagaucccccgcgccaaggccgaggagaugcucuccaagcagcgccacgacggcgccuuccucauccgcgaguccgaguccgcccccggcgacuucucccucuccgucaaguucggcaacgacguccagcacuucaagguccuccgcgacggcgccggcaaguacuuccucugggucgucaaguucaacucccucaacgagcucgucgacuaccaccgcuccaccuccgucucccgcaaccagcagaucuuccuccgcgacaucgagcaggucccccagcagcccaccuacguccaggcccucuucgacuucgacccccaggaggacggcgagcucggcuuccgccgcggcgacuucauccacgucauggacaacuccgaccccaacugguggaagggcgccugccacggccagaccggcauguucccccgcaacuacgucacccccgucaaccgcaacgucuga

SEQ ID NO: 43878 - RNA, 1668 nt, Artificial Sequence
  derived and/or modified sequence opt2 from GRB7__Homo_sapiens__NP_001229371
augggcaaguggcgccccggccagggccacaccaccggcuccgucaagccccucucccgcuccgacgccauggagcucgaccucucccccccccaccucuccuccucccccgaggaccucugccccgcccccggcaccccccccggcaccccccgcccccccgacaccccccuccccgaggaggucaagcgcucccagccccuccucauccccaccaccggccgcaagcuccgcgaggaggagcgccgcgccaccucccuccccuccauccccaaccccuuccccgagcucugcuccccccccucccagucccccauccucggcggccccuccuccgcccgcggccuccucccccgcgacgccucccgcccccacgucgucaaggucuacuccgaggacggcgccugccgcuccgucgaggucgccgccggcgccaccgcccgccacgucugcgagaugcucguccagcgcgcccacgcccucuccgacgagaccuggggccucgucgagugccacccccaccucgcccucgagcgcggccucgaggaccacgaguccgucgucgagguccaggccgccuggcccgucggcggcgacucccgcuucgucuuccgcaagaacuucgccaaguacgagcucuucaaguccuccccccacucccucuuccccgagaagauggucuccuccugccucgacgcccacaccggcaucucccacgaggaccucauccagaacuuccucaacgccggcuccuuccccgagauccagggcuuccuccagcuccgcggcuccggccgcaagcucuggaagcgcuucuucugcuuccuccgccgcuccggccucuacuacuccaccaagggcaccuccaaggacccccgccaccuccaguacgucgccgacgucaacgaguccaacgucuacgucgucacccagggccgcaagcucuacggcaugcccaccgacuucggcuucugcgucaagcccaacaagcuccgcaacggccacaagggccuccgcaucuucugcuccgaggacgagcagucccgcaccugcuggcucgccgccuuccgccucuucaaguacggcguccagcucuacaagaacuaccagcaggcccagucccgccaccuccaccccuccugccucggcucccccccccuccgcuccgccuccgacaacacccucgucgccauggacuucuccggccacgccggccgcgucaucgagaacccccgcgaggcccucuccgucgcccucgaggaggcccaggccuggcgcaagaagaccaaccaccgccucucccuccccaugcccgccuccggcaccucccucuccgccgccauccaccgcacccagcucugguuccacggccgcaucucccgcgaggagucccagcgccucaucggccagcagggccucgucgacggccucuuccucguccgcgagucccagcgcaacccccagggcuucguccucucccucugccaccuccagaaggucaagcacuaccucauccuccccuccgaggaggagggccgccucuacuucuccauggacgacggccagacccgcuucaccgaccuccuccagcucgucgaguuccaccagcucaaccgcggcauccuccccugccuccuccgccacugcugcacccgcgucgcccucuga

SEQ ID NO: 43879 - RNA, 1230 nt, Artificial Sequence
  derived and/or modified sequence opt2 from GREB1__Homo_sapiens__NP_683701
augggcaacuccuacgccggccagcucaagaccacccgcuucgaggagguccuccacaacuccaucgaggccucccuccgcuccaacaaccucgucccccgccccaucuucucccagcucuaccucgaggccgagcagcagcucgccgcccucgagggcggcucccgcgucgacaacgaggaggaggaggaggagggcgagggcggccucgagaccaacggcccccccaaccccuuccagcuccacccccuccccgagggcugcugcaccaccgacggcuucugccaggccggcaaggaccuccgccucgucuccaucuccaacgagcccauggacguccccgccggcuuccuccucgucggcgucaagucccccucccuccccgaccaccuccucgucugcgccgucgacaagcgcuuccuccccgacgacaacggccacaacgcccuccucggcuucuccggcaacugcgucggcugcggcaagaagggcuucugcuacuucaccgaguucuccaaccacaucaaccucaagcucaccacccagcccaagaagcagaagcaccucaaguacuaccucguccgcaacgcccagggcacccucaccaagggcccccucaucugcuggaagggcuccgaguuccgcucccgccagauccccgccuccaccugcuccuccucccucuuccccgcccucgaguccaccgccgccuuccccuccgagcccguccccggcaccaaccccuccauccucaugggcgcccagcaggccggccccgccuccgaccaccccucccucaacgccgccaugggccccgccgucuucaacggcaaggacucccccaagugccagcagcucgccaagaacaaccuccucgcccucccccgccccuccgcccucggcauccucuccaacuccggcccccccaagaagcgccacaagggcuggucccccgagucccccuccgcccccgacggcggcugcccccagggcggcggcaaccgcgccaaguacgaguccgccggcauguccugcgucccccaggucggccucgucggccccgccuccgucaccuuccccgucgucgccuccggcgagcccgucuccguccccgacaaccuccucaagaucugcaaggccaagcccgucaucuucaaggucuucgucaacggcgccacccagauggucgcccucggccccgccgagcccgccuccccccgcucccucuga

SEQ ID NO: 43880 - RNA, 432 nt, Artificial Sequence
  derived and/or modified sequence opt2 from GREM1__Homo_sapiens__NP_001178252
augucccgcaccgccuacaccgucggcgcccuccuccuccuccucggcacccuccuccccgccgccgagggcaagaagaagggcucccagggcgccauccccccccccgacaaggcccuccacgucaccgagcgcaaguaccucaagcgcgacuggugcaagacccagccccucaagcagaccauccacgaggagggcugcaacucccgcaccaucaucaaccgcuucugcuacggccagugcaacuccuucuacaucccccgccacauccgcaaggaggagggcuccuuccaguccugcuccuucugcaagcccaagaaguucaccaccaugauggucacccucaacugccccgagcuccagccccccaccaagaagaagcgcgucacccgcgucaagcagugccgcugcaucuccaucgaccucgacuga

SEQ ID NO: 43881 - RNA, 561 nt, Artificial Sequence
  derived and/or modified sequence opt2 from GREM2__Homo_sapiens__XP_005273283
augcgcgcccuccgcgccgaguccaccuccggcucccgccagacccccugccgcauguucuggaagcucucccucucccucuuccucgucgccguccucgucaaggucgccgaggcccgcaagaaccgccccgccggcgccauccccucccccuacaaggacggcuccuccaacaacuccgagcgcuggcagcaccagaucaaggagguccucgccuccucccaggaggcccucgucgucaccgagcgcaaguaccucaaguccgacuggugcaagacccagccccuccgccagaccgucuccgaggagggcugccgcucccgcaccauccucaaccgcuucugcuacggccagugcaacuccuucuacaucccccgccacgucaagaaggaggaggaguccuuccaguccugcgccuucugcaagccccagcgcgucaccuccguccucgucgagcucgagugccccggccucgacccccccuuccgccucaagaagauccagaaggucaagcagugccgcugcauguccgucaaccucuccgacuccgacaagcaguga

SEQ ID NO: 43882 - RNA, 1857 nt, Artificial Sequence
  derived and/or modified sequence opt2 from GRHL1__Homo_sapiens__NP_937825
augacccaggaguacgacaacaagcgccccguccucguccuccagaacgaggcccucuacccccagcgccgcuccuacaccuccgaggacgaggccuggaaguccuuccucgagaacccccucaccgccgccaccaaggccaugauguccaucaacggcgacgaggacuccgccgccgcccucggccuccucuacgacuacuacaaggucccccgcgagcgccgcuccuccaccgccaagcccgaggucgagcaccccgagcccgaccacuccaagcgcaacuccauccccaucgucaccgagcagccccucaucuccgccggcgagaaccgcguccagguccucaagaacguccccuucaacaucguccucccccacggcaaccagcucggcaucgacaagcgcggccaccucaccgcccccgacaccaccgucaccgucuccaucgccaccaugcccacccacuccaucaagaccgagacccagccccacggcuucgccgucggcaucccccccgccgucuaccaccccgagcccaccgagcgcgucgucgucuucgaccgcaaccucaacaccgaccaguucuccuccggcgcccaggcccccaacgcccagcgccgcacccccgacuccaccuucuccgagaccuucaaggagggcguccaggaggucuucuuccccuccgaccucucccuccgcaugcccggcaugaacuccgaggacuacgucuucgacuccgucuccggcaacaacuucgaguacacccucgaggccuccaagucccuccgccagaagcccggcgacuccaccaugaccuaccucaacaagggccaguucuaccccaucacccucaaggaggucuccuccuccgagggcauccaccaccccaucuccaagguccgcuccgucaucauggucgucuucgccgaggacaagucccgcgaggaccagcuccgccacuggaaguacuggcacucccgccagcacaccgccaagcagcgcugcaucgacaucgccgacuacaaggaguccuucaacaccaucuccaacaucgaggagaucgccuacaacgccaucuccuucaccugggacaucaacgacgaggccaaggucuucaucuccgucaacugccucuccaccgacuucuccucccagaagggcgucaagggccucccccucaacauccaggucgacaccuacuccuacaacaaccgcuccaacaagcccguccaccgcgccuacugccagaucaaggucuucugcgacaagggcgccgagcgcaagauccgcgacgaggagcgcaagcaguccaagcgcaaggucuccgacgucaaggucccccuccuccccucccacaagcgcauggacaucaccgucuucaagcccuucaucgaccucgacacccagcccguccucuucauccccgacguccacuucgccaaccuccagcgcggcacccacguccuccccaucgccuccgaggagcucgagggcgagggcuccguccucaagcgcggccccuacggcaccgaggacgacuucgccgucccccccuccaccaagcucgcccgcaucgaggagcccaagcgcguccuccucuacguccgcaaggaguccgaggaggucuucgacgcccucaugcucaagacccccucccucaagggccucauggaggccaucuccgacaaguacgacgucccccacgacaagaucggcaagaucuucaagaagugcaagaagggcauccucgucaacauggacgacaacaucgucaagcacuacuccaacgaggacaccuuccagcuccagaucgaggaggccggcggcuccuacaagcucacccucaccgagaucuga

SEQ ID NO: 43883 - RNA, 1878 nt, Artificial Sequence
  derived and/or modified sequence opt2 from GRHL2__Homo_sapiens__NP_079191
augucccaggaguccgacaacaacaagcgccucgucgcccucguccccaugcccuccgacccccccuucaacacccgccgcgccuacaccuccgaggacgaggccuggaaguccuaccucgagaacccccucaccgccgccaccaaggccaugauguccaucaacggcgacgaggacuccgccgccgcccucggccuccucuacgacuacuacaaggucccccgcgacaagcgccuccucuccgucuccaaggccuccgacucccaggaggaccaggagaagcgcaacugccucggcaccuccgaggcccaguccaaccucuccggcggcgagaaccgcguccagguccucaagaccguccccgucaaccucucccucaaccaggaccaccucgagaacuccaagcgcgagcaguacuccaucuccuuccccgaguccuccgccaucauccccgucuccggcaucaccgucgucaaggccgaggacuucacccccgucuucauggccccccccguccacuacccccgcggcgacggcgaggagcagcgcgucgucaucuucgagcagacccaguacgacguccccucccucgccacccacuccgccuaccucaaggacgaccagcgcuccacccccgacuccaccuacuccgaguccuucaaggacgccgccaccgagaaguuccgcuccgccuccgucggcgccgaggaguacauguacgaccagaccuccuccggcaccuuccaguacacccucgaggccaccaagucccuccgccagaagcagggcgagggccccaugaccuaccucaacaagggccaguucuacgccaucacccucuccgagaccggcgacaacaagugcuuccgccaccccaucuccaagguccgcuccgucgucauggucgucuucuccgaggacaagaaccgcgacgagcagcucaaguacuggaaguacuggcacucccgccagcacaccgccaagcagcgcguccucgacaucgccgacuacaaggaguccuucaacaccaucggcaacaucgaggagaucgccuacaacgccgucuccuucaccugggacgucaacgaggaggccaagaucuucaucaccgucaacugccucuccaccgacuucuccucccagaagggcgucaagggccucccccucaugauccagaucgacaccuacuccuacaacaaccgcuccaacaagcccauccaccgcgccuacugccagaucaaggucuucugcgacaagggcgccgagcgcaagauccgcgacgaggagcgcaagcagaaccgcaagaagggcaagggccaggccucccagacccagugcaacuccuccuccgacggcaagcucgccgccaucccccuccagaagaaguccgacaucaccuacuucaagaccaugcccgaccuccacucccagcccguccucuucauccccgacguccacuucgccaaccuccagcgcaccggccaggucuacuacaacaccgacgacgagcgcgagggcggcuccguccucgucaagcgcauguuccgccccauggaggaggaguucggccccguccccuccaagcagaugaaggaggagggcaccaagcgcguccuccucuacguccgcaaggagaccgacgacgucuucgacgcccucaugcucaagucccccaccgucaagggccucauggaggccaucuccgagaaguacggccuccccgucgagaagaucgccaagcucuacaagaaguccaagaagggcauccucgucaacauggacgacaacaucaucgagcacuacuccaacgaggacaccuucauccucaacauggaguccauggucgagggcuucaaggucacccucauggagaucuga

SEQ ID NO: 43884 - RNA, 987 nt, Artificial Sequence
  derived and/or modified sequence opt2 from GRHPR__Homo_sapiens__NP_036335
augcgccccguccgccucaugaaggucuucgucacccgccgcauccccgccgagggccgcgucgcccucgcccgcgccgccgacugcgaggucgagcagugggacuccgacgagcccauccccgccaaggagcucgagcgcggcgucgccggcgcccacggccuccucugccuccucuccgaccacgucgacaagcgcauccucgacgccgccggcgccaaccucaaggucaucuccaccauguccgucggcaucgaccaccucgcccucgacgagaucaagaagcgcggcauccgcgucggcuacacccccgacguccucaccgacaccaccgccgagcucgccgucucccuccuccucaccaccugccgccgccuccccgaggccaucgaggaggucaagaacggcggcuggaccuccuggaagccccucuggcucugcggcuacggccucacccaguccaccgucggcaucaucggccucggccgcaucggccaggccaucgcccgccgccucaagcccuucggcguccagcgcuuccucuacaccggccgccagccccgccccgaggaggccgccgaguuccaggccgaguucgucuccacccccgagcucgccgcccaguccgacuucaucgucgucgccugcucccucacccccgccaccgagggccucugcaacaaggacuucuuccagaagaugaaggagaccgccgucuucaucaacaucucccgcggcgacgucgucaaccaggacgaccucuaccaggcccucgccuccggcaagaucgccgccgccggccucgacgucaccucccccgagccccuccccaccaaccacccccuccucacccucaagaacugcgucauccucccccacaucggcuccgccacccaccgcacccgcaacaccaugucccuccucgccgccaacaaccuccucgccggccuccgcggcgagcccaugcccuccgagcucaagcucuga

SEQ ID NO: 43885 - RNA, 2721 nt, Artificial Sequence
  derived and/or modified sequence opt2 from GRIA1__Homo_sapiens__NP_000818
augcagcacaucuucgccuucuucugcaccggcuuccucggcgccgucgucggcgccaacuuccccaacaacauccagaucggcggccucuuccccaaccagcagucccaggagcacgccgccuuccgcuucgcccucucccagcucaccgagccccccaagcuccucccccagaucgacaucgucaacaucuccgacuccuucgagaugaccuaccgcuucugcucccaguucuccaagggcgucuacgccaucuucggcuucuacgagcgccgcaccgucaacaugcucaccuccuucugcggcgcccuccacgucugcuucaucacccccuccuuccccgucgacaccuccaaccaguucguccuccagcuccgccccgagcuccaggacgcccucaucuccaucaucgaccacuacaaguggcagaaguucgucuacaucuacgacgccgaccgcggccucuccguccuccagaagguccucgacaccgccgccgagaagaacuggcaggucaccgccgucaacauccucaccaccaccgaggagggcuaccgcaugcucuuccaggaccucgagaagaagaaggagcgccucgucgucgucgacugcgaguccgagcgccucaacgccauccucggccagaucaucaagcucgagaagaacggcaucggcuaccacuacauccucgccaaccucggcuucauggacaucgaccucaacaaguucaaggaguccggcgccaacgucaccggcuuccagcucgucaacuacaccgacaccauccccgccaagaucaugcagcaguggaagaacuccgacgcccgcgaccacacccgcgucgacuggaagcgccccaaguacaccuccgcccucaccuacgacggcgucaaggucauggccgaggccuuccagucccuccgccgccagcgcaucgacaucucccgccgcggcaacgccggcgacugccucgccaaccccgccguccccuggggccagggcaucgacauccagcgcgcccuccagcagguccgcuucgagggccucaccggcaacguccaguucaacgagaagggccgccgcaccaacuacacccuccacgucaucgagaugaagcacgacggcauccgcaagaucggcuacuggaacgaggacgacaaguucguccccgccgccaccgacgcccaggccggcggcgacaacuccuccguccagaaccgcaccuacaucgucaccaccauccucgaggaccccuacgucaugcucaagaagaacgccaaccaguucgagggcaacgaccgcuacgagggcuacugcgucgagcucgccgccgagaucgccaagcacgucggcuacuccuaccgccucgagaucgucuccgacggcaaguacggcgcccgcgaccccgacaccaaggccuggaacggcauggucggcgagcucgucuacggccgcgccgacgucgccgucgccccccucaccaucacccucguccgcgaggaggucaucgacuucuccaagcccuucaugucccucggcaucuccaucaugaucaagaagccccagaaguccaagcccggcgucuucuccuuccucgacccccucgccuacgagaucuggaugugcaucgucuucgccuacaucggcgucuccgucguccucuuccucgucucccgcuucucccccuacgaguggcacuccgaggaguucgaggagggccgcgaccagaccaccuccgaccaguccaacgaguucggcaucuucaacucccucugguucucccucggcgccuucaugcagcagggcugcgacaucuccccccgcucccucuccggccgcaucgucggcggcgucuggugguucuucacccucaucaucaucuccuccuacaccgccaaccucgccgccuuccucaccgucgagcgcauggucucccccaucgaguccgccgaggaccucgccaagcagaccgagaucgccuacggcacccucgaggccggcuccaccaaggaguucuuccgccgcuccaagaucgccgucuucgagaagauguggaccuacaugaaguccgccgagcccuccgucuucguccgcaccaccgaggagggcaugauccgcguccgcaaguccaagggcaaguacgccuaccuccucgaguccaccaugaacgaguacaucgagcagcgcaagcccugcgacaccaugaaggucggcggcaaccucgacuccaagggcuacggcaucgccacccccaagggcuccgcccuccgcaaccccgucaaccucgccguccucaagcucaacgagcagggccuccucgacaagcucaagaacaaguggugguacgacaagggcgagugcggcuccggcggcggcgacuccaaggacaagaccuccgcccucucccucuccaacgucgccggcgucuucuacauccucaucggcggccucggccucgccaugcucgucgcccucaucgaguucugcuacaagucccgcuccgaguccaagcgcaugaagggcuucugccucaucccccagcaguccaucaacgaggccauccgcaccuccacccucccccgcaacuccggcgccggcgccuccuccggcggcuccggcgagaacggccgcgucgucucccacgacuuccccaaguccaugcaguccauccccugcaugucccacuccuccggcaugccccucggcgccaccggccucuga

SEQ ID NO: 43886 - RNA, 2652 nt, Artificial Sequence
  derived and/or modified sequence opt2 from GRIA2__Homo_sapiens__NP_000817
augcagaagaucaugcacaucuccguccuccucucccccguccucuggggccucaucuucggcgucuccuccaacuccauccagaucggcggccucuucccccgcggcgccgaccaggaguacuccgccuuccgcgucggcaugguccaguucuccaccuccgaguuccgccucaccccccacaucgacaaccucgaggucgccaacuccuucgccgucaccaacgccuucugcucccaguucucccgcggcgucuacgccaucuucggcuucuacgacaagaaguccgucaacaccaucaccuccuucugcggcacccuccacgucuccuucaucacccccuccuuccccaccgacggcacccaccccuucgucauccagaugcgccccgaccucaagggcgcccuccucucccucaucgaguacuaccagugggacaaguucgccuaccucuacgacuccgaccgcggccucuccacccuccaggccguccucgacuccgccgccgagaagaaguggcaggucaccgccaucaacgucggcaacaucaacaacgacaagaaggacgagauguaccgcucccucuuccaggaccucgagcucaagaaggagcgccgcgucauccucgacugcgagcgcgacaaggucaacgacaucgucgaccaggucaucaccaucggcaagcacgucaagggcuaccacuacaucaucgccaaccucggcuucaccgacggcgaccuccucaagauccaguucggcggcgccaacgucuccggcuuccagaucgucgacuacgacgacucccucgucuccaaguucaucgagcgcugguccacccucgaggagaaggaguaccccggcgcccacaccaccaccaucaaguacaccuccgcccucaccuacgacgccguccaggucaugaccgaggccuuccgcaaccuccgcaagcagcgcaucgagaucucccgccgcggcaacgccggcgacugccucgccaaccccgccguccccuggggccagggcgucgagaucgagcgcgcccucaagcagguccaggucgagggccucuccggcaacaucaaguucgaccagaacggcaagcgcaucaacuacaccaucaacaucauggagcucaagaccaacggcccccgcaagaucggcuacugguccgaggucgacaagauggucgucacccucaccgagcuccccuccggcaacgacaccuccggccucgagaacaagaccgucgucgucaccaccauccucgagucccccuacgucaugaugaagaagaaccacgagaugcucgagggcaacgagcgcuacgagggcuacugcgucgaccucgccgccgagaucgccaagcacugcggcuucaaguacaagcucaccaucgucggcgacggcaaguacggcgcccgcgacgccgacaccaagaucuggaacggcauggucggcgagcucgucuacggcaaggccgacaucgccaucgccccccucaccaucacccucguccgcgaggaggucaucgacuucuccaagcccuucaugucccucggcaucuccaucaugaucaagaagccccagaaguccaagcccggcgucuucuccuuccucgacccccucgccuacgagaucuggaugugcaucgucuucgccuacaucggcgucuccgucguccucuuccucgucucccgcuucucccccuacgaguggcacaccgaggaguucgaggacggccgcgagacccaguccuccgaguccaccaacgaguucggcaucuucaacucccucugguucucccucggcgccuucaugcgccagggcugcgacaucuccccccgcucccucuccggccgcaucgucggcggcgucuggugguucuucacccucaucaucaucuccuccuacaccgccaaccucgccgccuuccucaccgucgagcgcauggucucccccaucgaguccgccgaggaccucuccaagcagaccgagaucgccuacggcacccucgacuccggcuccaccaaggaguucuuccgccgcuccaagaucgccgucuucgacaagauguggaccuacaugcgcuccgccgagcccuccgucuucguccgcaccaccgccgagggcgucgcccgcguccgcaaguccaagggcaaguacgccuaccuccucgaguccaccaugaacgaguacaucgagcagcgcaagcccugcgacaccaugaaggucggcggcaaccucgacuccaagggcuacggcaucgccacccccaagggcuccucccuccgcacccccgucaaccucgccguccucaagcucuccgagcagggcguccucgacaagcucaagaacaaguggugguacgacaagggcgagugcggcgccaaggacuccggcuccaaggagaagaccuccgcccucucccucuccaacgucgccggcgucuucuacauccucgucggcggccucggccucgccaugcucgucgcccucaucgaguucugcuacaagucccgcgccgaggccaagcgcaugaaggucgccaagaacgcccagaacaucaaccccuccuccucccagaacucccagaacuucgccaccuacaaggagggcuacaacgucuacggcaucgaguccgucaagaucuga

SEQ ID NO: 43887 - RNA, 2685 nt, Artificial Sequence
  derived and/or modified sequence opt2 from GRIA3__Homo_sapiens__NP_000819
auggcccgccagaagaagaugggccaguccguccuccgcgccgucuucuuccucguccucggccuccucggccacucccacggcggcuuccccaacaccaucuccaucggcggccucuucaugcgcaacaccguccaggagcacuccgccuuccgcuucgccguccagcucuacaacaccaaccagaacaccaccgagaagcccuuccaccucaacuaccacgucgaccaccucgacuccuccaacuccuucuccgucaccaacgccuucugcucccaguucucccgcggcgucuacgccaucuucggcuucuacgaccagauguccaugaacacccucaccuccuucugcggcgcccuccacaccuccuucgucacccccuccuuccccaccgacgccgacguccaguucgucauccagaugcgccccgcccucaagggcgccauccucucccuccucggccacuacaagugggagaaguucgucuaccucuacgacaccgagcgcggcuucuccauccuccaggccaucauggaggccgccguccagaacaacuggcaggucaccgcccgcuccgucggcaacaucaaggacguccaggaguuccgccgcaucaucgaggagauggaccgccgccaggagaagcgcuaccucaucgacugcgaggucgagcgcaucaacaccauccucgagcaggucgucauccucggcaagcacucccgcggcuaccacuacaugcucgccaaccucggcuucaccgacauccuccucgagcgcgucaugcacggcggcgccaacaucaccggcuuccagaucgucaacaacgagaaccccaugguccagcaguucauccagcgcuggguccgccucgacgagcgcgaguuccccgaggccaagaacgccccccucaaguacaccuccgcccucacccacgacgccauccucgucaucgccgaggccuuccgcuaccuccgccgccagcgcgucgacgucucccgccgcggcuccgccggcgacugccucgccaaccccgccguccccuggucccagggcaucgacaucgagcgcgcccucaagaugguccagguccagggcaugaccggcaacauccaguucgacaccuacggccgccgcaccaacuacaccaucgacgucuacgagaugaaggucuccggcucccgcaaggccggcuacuggaacgaguacgagcgcuucguccccuucuccgaccagcagaucuccaacgacuccgccuccuccgagaaccgcaccaucgucgucaccaccauccucgagucccccuacgucauguacaagaagaaccacgagcagcucgagggcaacgagcgcuacgagggcuacugcgucgaccucgccuacgagaucgccaagcacguccgcaucaaguacaagcucuccaucgucggcgacggcaaguacggcgcccgcgaccccgagaccaagaucuggaacggcauggucggcgagcucgucuacggccgcgccgacaucgccgucgccccccucaccaucacccucguccgcgaggaggucaucgacuucuccaagcccuucaugucccucggcaucuccaucaugaucaagaagccccagaaguccaagcccggcgucuucuccuuccucgacccccucgccuacgagaucuggaugugcaucgucuucgccuacaucggcgucuccgucguccucuuccucgucucccgcuucucccccuacgaguggcaccucgaggacaacaacgaggagccccgcgacccccaguccccccccgacccccccaacgaguucggcaucuucaacucccucugguucucccucggcgccuucaugcagcagggcugcgacaucuccccccgcucccucuccggccgcaucgucggcggcgucuggugguucuucacccucaucaucaucuccuccuacaccgccaaccucgccgccuuccucaccgucgagcgcauggucucccccaucgaguccgccgaggaccucgccaagcagaccgagaucgccuacggcacccucgacuccggcuccaccaaggaguucuuccgccgcuccaagaucgccgucuacgagaagaugugguccuacaugaaguccgccgagcccuccgucuucaccaagaccaccgccgacggcgucgcccgcguccgcaaguccaagggcaaguucgccuuccuccucgaguccaccaugaacgaguacaucgagcagcgcaagcccugcgacaccaugaaggucggcggcaaccucgacuccaagggcuacggcgucgccacccccaagggcuccgcccucggcaacgccgucaaccucgccguccucaagcucaacgagcagggccuccucgacaagcucaagaacaaguggugguacgacaagggcgagugcggcuccggcggcggcgacuccaaggacaagaccuccgcccucucccucuccaacgucgccggcgucuucuacauccucgucggcggccucggccucgccaugauggucgcccucaucgaguucugcuacaagucccgcgccgaguccaagcgcaugaagcucaccaagaacacccagaacuucaagcccgcccccgccaccaacacccagaacuacgccaccuaccgcgagggcuacaacgucuacggcaccgaguccgucaagaucuga

SEQ ID NO: 43888 - RNA, 2655 nt, Artificial Sequence
  derived and/or modified sequence opt2 from GRIA4__Homo_sapiens__NP_001070711
augcgcaucaucucccgccagaucguccuccucuucuccggcuucuggggccucgccaugggcgccuuccccuccuccguccagaucggcggccucuucauccgcaacaccgaccaggaguacaccgccuuccgccucgccaucuuccuccacaacaccucccccaacgccuccgaggcccccuucaaccucgucccccacgucgacaacaucgagaccgccaacuccuucgccgucaccaacgccuucugcucccaguacucccgcggcgucuucgccaucuucggccucuacgacaagcgcuccguccacacccucaccuccuucugcuccgcccuccacaucucccucaucacccccuccuuccccaccgagggcgagucccaguucguccuccagcuccgccccucccuccgcggcgcccuccucucccuccucgaccacuacgaguggaacugcuucgucuuccucuacgacaccgaccgcggcuacuccauccuccaggccaucauggagaaggccggccagaacggcuggcacgucuccgccaucugcgucgagaacuucaacgacgucuccuaccgccagcuccucgaggagcucgaccgccgccaggagaagaaguucgucaucgacugcgagaucgagcgccuccagaacauccucgagcagaucgucuccgucggcaagcacgucaagggcuaccacuacaucaucgccaaccucggcuucaaggacaucucccucgagcgcuucauccacggcggcgccaacgucaccggcuuccagcucgucgacuucaacacccccauggucaucaagcucauggaccgcuggaagaagcucgaccagcgcgaguaccccggcuccgagaccccccccaaguacaccuccgcccucaccuacgacggcguccucgucauggccgagaccuuccgcucccuccgccgccagaagaucgacaucucccgccgcggcaacgccggcgacugccucgccaaccccgccgcccccuggggccagggcaucgacauggagcgcacccucaagcagguccgcauccagggccucaccggcaacguccaguucgaccacuacggccgccgcgucaacuacaccauggacgucuucgagcucaaguccaccggcccccgcaaggucggcuacuggaacgacauggacaagcucguccucauccaggacguccccacccucggcaacgacaccgccgccaucgagaaccgcaccgucgucgucaccaccaucauggagucccccuacgucauguacaagaagaaccacgagauguucgagggcaacgacaaguacgagggcuacugcgucgaccucgccuccgagaucgccaagcacaucggcaucaaguacaagaucgccaucguccccgacggcaaguacggcgcccgcgacgccgacaccaagaucuggaacggcauggucggcgagcucgucuacggcaaggccgagaucgccaucgccccccucaccaucacccucguccgcgaggaggucaucgacuucuccaagcccuucaugucccucggcaucuccaucaugaucaagaagccccagaaguccaagcccggcgucuucuccuuccucgacccccucgccuacgagaucuggaugugcaucgucuucgccuacaucggcgucuccgucguccucuuccucgucucccgcuucucccccuacgaguggcacaccgaggagcccgaggacggcaaggagggccccuccgaccagccccccaacgaguucggcaucuucaacucccucugguucucccucggcgccuucaugcagcagggcugcgacaucuccccccgcucccucuccggccgcaucgucggcggcgucuggugguucuucacccucaucaucaucuccuccuacaccgccaaccucgccgccuuccucaccgucgagcgcauggucucccccaucgaguccgccgaggaccucgccaagcagaccgagaucgccuacggcacccucgacuccggcuccaccaaggaguucuuccgccgcuccaagaucgccgucuacgagaagauguggaccuacaugcgcuccgccgagcccuccgucuucacccgcaccaccgccgagggcgucgcccgcguccgcaaguccaagggcaaguucgccuuccuccucgaguccaccaugaacgaguacaucgagcagcgcaagcccugcgacaccaugaaggucggcggcaaccucgacuccaagggcuacggcgucgccacccccaagggcuccucccucggcaacgccgucaaccucgccguccucaagcucaacgagcagggccuccucgacaagcucaagaacaaguggugguacgacaagggcgagugcggcuccggcggcggcgacuccaaggacaagaccuccgcccucucccucuccaacgucgccggcgucuucuacauccucgucggcggccucggccucgccaugcucgucgcccucaucgaguucugcuacaagucccgcgccgaggccaagcgcaugaaggucgccaaguccgcccagaccuucaaccccaccuccucccagaacacccagaaccucgccaccuaccgcgagggcuacaacgucuacggcaccgaguccaucaagaucuga

SEQ ID NO: 43889 - RNA, 3030 nt, Artificial Sequence
  derived and/or modified sequence opt2 from GRID1__Homo_sapiens__NP_060021
auggaggcccucacccucuggcuccuccccuggaucugccagugcgucuccguccgcgccgacuccaucauccacaucggcgccaucuucgaggagaacgccgccaaggacgaccgcgucuuccagcucgccgucuccgaccucucccucaacgacgacauccuccaguccgagaagaucaccuacuccaucaaggucaucgaggccaacaaccccuuccaggccguccaggaggccugcgaccucaugacccagggcauccucgcccucgucaccuccaccggcugcgccuccgccaacgcccuccagucccucaccgacgccaugcacaucccccaccucuucguccagcgcaaccccggcggcuccccccgcaccgccugccaccucaaccccucccccgacggcgaggccuacacccucgccucccgcccccccguccgccucaacgacgucaugcuccgccucgucaccgagcuccgcuggcagaaguucgucauguucuacgacuccgaguacgacauccgcggccuccaguccuuccucgaccaggccucccgccucggccucgacgucucccuccagaaggucgacaagaacaucucccacgucuucaccucccucuucaccaccaugaagaccgaggagcucaaccgcuaccgcgacacccuccgccgcgccauccuccuccucuccccccagggcgcccacuccuucaucaacgaggccgucgagaccaaccucgccuccaaggacucccacugggucuucgucaacgaggagaucuccgaccccgagauccucgaccucguccacuccgcccucggccgcaugaccgucguccgccagaucuuccccuccgccaaggacaaccagaagugcacccgcaacaaccaccgcaucuccucccuccucugcgacccccaggagggcuaccuccagaugcuccagaucuccaaccucuaccucuacgacuccguccucaugcucgccaacgccuuccaccgcaagcucgaggaccgcaaguggcacuccauggccucccucaacugcauccgcaaguccaccaagcccuggaacggcggccgcuccaugcucgacaccaucaagaagggccacaucaccggccucaccggcgucauggaguuccgcgaggacuccuccaaccccuacguccaguucgagauccucggcaccaccuacuccgagaccuucggcaaggacaugcgcaagcucgccaccugggacuccgagaagggccucaacggcucccuccaggagcgccccaugggcucccgccuccagggccucacccucaaggucgucaccguccucgaggagcccuucgucauggucgccgagaacauccucggccagcccaagcgcuacaagggcuucuccaucgacguccucgacgcccucgccaaggcccucggcuucaaguacgagaucuaccaggcccccgacggccgcuacggccaccagcuccacaacaccuccuggaacggcaugaucggcgagcucaucuccaagcgcgccgaccucgccaucuccgccaucaccaucacccccgagcgcgaguccgucgucgacuucuccaagcgcuacauggacuacuccgucggcauccucaucaagaagcccgaggagaagaucuccaucuucucccucuucgcccccuucgacuucgccgucugggccugcaucgccgccgccauccccgucgucggcguccucaucuucguccucaaccgcauccaggccguccgcgcccaguccgccgcccagccccgccccuccgccuccgccacccuccacuccgccaucuggaucgucuacggcgccuucguccagcagggcggcgaguccuccgucaacuccauggccaugcgcaucgucaugggcuccugguggcucuucacccucaucgucugcuccuccuacaccgccaaccucgccgccuuccucaccgucucccgcauggacaaccccauccgcaccuuccaggaccucuccaagcaggucgagauguccuacggcaccguccgcgacuccgccgucuacgaguacuuccgcgccaagggcaccaacccccucgagcaggacuccaccuucgccgagcucuggcgcaccaucuccaagaacggcggcgccgacaacugcgucuccucccccuccgagggcauccgcaaggccaagaagggcaacuacgccuuccucugggacgucgccgucgucgaguacgccgcccucaccgacgacgacugcuccgucaccgucaucggcaacuccaucuccuccaagggcuacggcaucgcccuccagcacggcucccccuaccgcgaccucuucucccagcgcauccucgagcuccaggacaccggcgaccucgacguccucaagcagaagugguggccccacaugggccgcugcgaccucaccucccacgccuccgcccaggccgacggcaagucccucaagcuccacuccuucgccggcgucuucugcauccucgccaucggccuccuccucgccugccucgucgccgcccucgagcucugguggaacuccaaccgcugccaccaggagacccccaaggaggacaaggaggucaaccucgagcagguccaccgccgcaugaacucccucauggacgaggacaucgcccacaagcagaucucccccgccuccaucgagcucuccgcccucgagaugggcggccucgcccccacccagacccucgagcccacccgcgaguaccagaacacccagcucuccgucuccaccuuccuccccgagcaguccucccacggcaccucccgcacccucuccuccggccccuccuccaaccucccccucccccucuccuccuccgccaccaugcccuccaugcagugcaagcaccgcucccccaacggcggccucuuccgccagucccccgucaagacccccauccccauguccuuccagcccguccccggcggcguccuccccgaggcccucgacaccucccacggcaccuccaucuga

SEQ ID NO: 43890 - RNA, 2739 nt, Artificial Sequence
  derived and/or modified sequence opt2 from GRID2__Homo_sapiens__NP_001273767
auggaggucuuccccuuccuccucguccucuccgucugguggucccgcaccugggacuccgccaacgccgacuccaucauccacaucggcgccaucuucgacgaguccgccaagaaggacgacgaggucuuccgcaccgccgucggcgaccucaaccagaacgaggagauccuccagaccgagaagaucaccuucuccgucaccuucgucgacggcaacaaccccuuccaggccguccaggaggacauccgcggcauccaggaguuccucgacaaggucucccagcagggcauggacgucgcccuccagaaggucgagaacaacaucaacaagaugaucaccacccucuucgacaccaugcgcaucgaggagcucaaccgcuaccgcgacacccuccgccgcgccauccucgucaugaaccccgccaccgccaaguccuucaucaccgaggucgucgagaccaaccucgucgccuucgacugccacuggaucaucaucaacgaggagaucaacgacgucgacguccaggagcucguccgccgcuccaucggccgccucaccaucauccgccagaccuuccccgucccccagaacaucucccagcgcugcuuccgcggcaaccaccgcaucuccuccacccucugcgaccccaaggaccccuucgcccagaacauggagaucuccaaccucuacaucuacgacaccguccuccuccucgccaacgccuuccacaagaagcucgaggaccgcaaguggcacuccauggccucccucuccugcauccgcaagaacuccaagcccuggcagggcggccgcuccaugcucgagaccaucaagaagggcggcgucuccggccucaccggcgagcucgaguucggcgagaacggcggcaaccccaacguccacuucgagauccucggcaccaacuacggcgaggagcucggccgcggcguccgcaagcucggcugcuggaaccccgucaccggccucaacggcucccucaccgacaagaagcucgagaacaacaugcgcggcgucguccuccgcgucgucaccguccucgaggagcccuucgucauggucuccgagaacguccucggcaagcccaagaaguaccagggcuucuccaucgacguccucgacgcccucuccaacuaccucggcuucaacuacgagaucuacgucgcccccgaccacaaguacggcuccccccaggaggacggcaccuggaacggccucgucggcgagcucgucuucaagcgcgccgacaucggcaucuccgcccucaccaucacccccgaccgcgagaacgucgucgacuucaccacccgcuacauggacuacuccgucggcguccuccuccgccgcgccgagaagaccgucgacauguucgccugccucgcccccuucgaccucucccucugggccugcaucgccggcaccguccuccucgucggccuccucgucuaccuccucaacuggcucaaccccccccgccuccagaugggcuccaugaccuccaccacccucuacaacuccaugugguucgucuacggcuccuucguccagcagggcggcgagguccccuacaccacccucgccacccgcaugaugaugggcgccugguggcucuucgcccucaucgucaucuccuccuacaccgccaaccucgccgccuuccucaccaucacccgcaucgaguccuccauccagucccuccaggaccucuccaagcagaccgagauccccuacggcaccguccucgacuccgccgucuacgagcacguccgcaugaagggccucaaccccuucgagcgcgacuccauguacucccagauguggcgcaugaucaaccgcuccaacggcuccgagaacaacguccucgagucccaggccggcauccagaaggucaaguacggcaacuacgccuucgucugggacgccgccguccucgaguacgucgccaucaacgaccccgacugcuccuucuacaccaucggcaacaccgucgccgaccgcggcuacggcaucgcccuccagcacggcucccccuaccgcgacgucuucucccagcgcauccucgagcuccagcagaacggcgacauggacauccucaagcacaagugguggcccaagaacggccagugcgaccucuacuccuccgucgacaccaagcagaagggcggcgcccucgacaucaaguccuucgccggcgucuucugcauccucgccgccggcaucguccucuccugcuucaucgccaugcucgagaccugguggaacaagcgcaagggcucccgcguccccuccaaggaggacgacaaggagaucgaccucgagcaccuccaccgccgcgucaacucccucugcaccgacgacgacuccccccacaagcaguucuccaccuccuccaucgaccucaccccccucgacaucgacacccuccccacccgccaggcccucgagcagaucuccgacuuccgcaacacccacaucaccaccaccaccuucauccccgagcagauccagacccucucccgcacccucuccgccaaggccgccuccggcuucaccuucggcaacguccccgagcaccgcaccggccccuuccgccaccgcgcccccaacggcggcuucuuccgcucccccaucaagaccauguccuccauccccuaccagcccacccccacccucggccucaaccucggcaacgaccccgaccgcggcaccuccaucuga

SEQ ID NO: 43891 - RNA, 2757 nt, Artificial Sequence
  derived and/or modified sequence opt2 from GRIK1__Homo_sapiens__NP_000821
auggagcacggcacccuccucgcccagcccggccucuggacccgcgacaccuccugggcccuccucuacuuccucugcuacauccucccccagaccgccccccagguccuccgcaucggcggcaucuucgagaccgucgagaacgagcccgucaacgucgaggagcucgccuucaaguucgccgucaccuccaucaaccgcaaccgcacccucaugcccaacaccacccucaccuacgacauccagcgcaucaaccucuucgacuccuucgaggccucccgccgcgccugcgaccagcucgcccucggcgucgccgcccucuucggccccucccacuccuccuccgucuccgccguccaguccaucugcaacgcccucgaggucccccacauccagacccgcuggaagcaccccuccgucgacaacaaggaccucuucuacaucaaccucuaccccgacuacgccgccaucucccgcgccauccucgaccucguccucuacuacaacuggaagaccgucaccgucgucuacgaggacuccaccggccucauccgccuccaggagcucaucaaggcccccucccgcuacaacaucaagaucaagauccgccagcuccccuccggcaacaaggacgccaagccccuccucaaggagaugaagaagggcaaggaguucuacgucaucuucgacugcucccacgagaccgccgccgagauccucaagcagauccucuucaugggcaugaugaccgaguacuaccacuacuucuucaccacccucgaccucuucgcccucgaccucgagcucuaccgcuacuccggcgucaacaugaccggcuuccgccuccucaacaucgacaacccccacgucuccuccaucaucgagaagugguccauggagcgccuccaggcccccccccgccccgagaccggccuccucgacggcaugaugaccaccgaggccgcccucauguacgacgccgucuacauggucgccaucgccucccaccgcgccucccagcucaccgucuccucccuccagugccaccgccacaagcccuggcgccucggcccccgcuucaugaaccucaucaaggaggcccgcugggacggccucaccggccacaucaccuucaacaagaccaacggccuccgcaaggacuucgaccucgacaucaucucccucaaggaggagggcaccgagaaggccgccggcgaggucuccaagcaccucuacaaggucuggaagaagaucggcaucuggaacuccaacuccggccucaacaugaccgacuccaacaaggacaaguccuccaacaucaccgacucccucgccaaccgcacccucaucgucaccaccauccucgaggagcccuacgucauguaccgcaaguccgacaagccccucuacggcaacgaccgcuucgagggcuacugccucgaccuccucaaggagcucuccaacauccucggcuucaucuacgacgucaagcucguccccgacggcaaguacggcgcccagaacgacaagggcgaguggaacggcauggucaaggagcucaucgaccaccgcgccgaccucgccgucgccccccucaccaucaccuacguccgcgagaaggucaucgacuucuccaagcccuucaugacccucggcaucuccauccucuaccgcaagcccaacggcaccaaccccggcgucuucuccuuccucaacccccucucccccgacaucuggauguacguccuccucgccugccucggcgucuccugcguccucuucgucaucgcccgcuucacccccuacgagugguacaacccccaccccugcaaccccgacuccgacgucgucgagaacaacuucacccuccucaacuccuucugguucggcgucggcgcccucaugcagcagggcuccgagcucaugcccaaggcccucuccacccgcaucgucggcggcaucuggugguucuucacccucaucaucaucuccuccuacaccgccaaccucgccgccuuccucaccgucgagcgcauggagucccccaucgacuccgccgacgaccucgccaagcagaccaagaucgaguacggcgccguccgcgacggcuccaccaugaccuucuucaagaaguccaagaucuccaccuacgagaagaugugggccuucauguccucccgccagcagaccgcccucguccgcaacuccgacgagggcauccagcgcguccucaccaccgacuacgcccuccucauggaguccaccuccaucgaguacgucacccagcgcaacugcaaccucacccagaucggcggccucaucgacuccaagggcuacggcgucggcacccccaucggcucccccuaccgcgacaagaucaccaucgccauccuccagcuccaggaggagggcaagcuccacaugaugaaggagaagugguggcgcggcaacggcugccccgaggaggacaacaaggaggccuccgcccucggcgucgagaacaucggcggcaucuucaucguccucgccgccggccucguccucuccgucuucgucgccaucggcgaguucaucuacaagucccgcaagaacaacgacaucgagcaggccuucugcuucuucuacggccuccagugcaagcagacccaccccaccaacuccaccuccggcaccacccucuccaccgaccucgagugcggcaagcucauccgcgaggagcgcggcauccgcaagcaguccuccguccacaccgucuga

SEQ ID NO: 43892 - RNA, 2727 nt, Artificial Sequence
  derived and/or modified sequence opt2 from GRIK2__Homo_sapiens__XP_005267002
augaagaucaucuuccccauccucuccaaccccgucuuccgccgcaccgucaagcuccuccucugccuccucuggaucggcuacucccagggcaccacccacguccuccgcuucggcggcaucuucgaguacgucgaguccggccccaugggcgccgaggagcucgccuuccgcuucgccgucaacaccaucaaccgcaaccgcacccuccuccccaacaccacccucaccuacgacacccagaagaucaaccucuacgacuccuucgaggccuccaagaaggccugcgaccagcucucccucggcgucgccgccaucuucggccccucccacuccuccuccgccaacgccguccaguccaucugcaacgcccucggcgucccccacauccagacccgcuggaagcaccaggucuccgacaacaaggacuccuucuacgucucccucuaccccgacuucuccucccucucccgcgccauccucgaccucguccaguucuucaaguggaagaccgucaccgucgucuacgacgacuccaccggccucauccgccuccaggagcucaucaaggcccccucccgcuacaaccuccgccucaagauccgccagcuccccgccgacaccaaggacgccaagccccuccucaaggagaugaagcgcggcaaggaguuccacgucaucuucgacugcucccacgagauggccgccggcauccucaagcaggcccucgccaugggcaugaugaccgaguacuaccacuacaucuucaccacccucgaccucuucgcccucgacgucgagcccuaccgcuacuccggcgucaacaugaccggcuuccgcauccucaacaccgagaacacccaggucuccuccaucaucgagaagugguccauggagcgccuccaggccccccccaagcccgacuccggccuccucgacggcuucaugaccaccgacgccgcccucauguacgacgccguccacgucgucuccgucgccguccagcaguucccccagaugaccgucuccucccuccagugcaaccgccacaagcccuggcgcuucggcacccgcuucaugucccucaucaaggaggcccacugggagggccucaccggccgcaucaccuucaacaagaccaacggccuccgcaccgacuucgaccucgacgucaucucccucaaggaggagggccucgagaagaucggcaccugggaccccgccuccggccucaacaugaccgagucccagaagggcaagcccgccaacaucaccgacucccucuccaaccgcucccucaucgucaccaccauccucgaggagcccuacguccucuucaagaaguccgacaagccccucuacggcaacgaccgcuucgagggcuacugcaucgaccuccuccgcgagcucuccaccauccucggcuucaccuacgagauccgccucgucgaggacggcaaguacggcgcccaggacgacgccaacggccaguggaacggcaugguccgcgagcucaucgaccacaaggccgaccucgccgucgccccccucgccaucaccuacguccgcgagaaggucaucgacuucuccaagcccuucaugacccucggcaucuccauccucuaccgcaagcccaacggcaccaaccccggcgucuucuccuuccucaacccccucucccccgacaucuggauguacauccuccucgccuaccucggcgucuccugcguccucuucgucaucgcccgcuucucccccuacgagugguacaacccccaccccugcaaccccgacuccgacgucgucgagaacaacuucacccuccucaacuccuucugguucggcgucggcgcccucaugcagcagggcuccgagcucaugcccaaggcccucuccacccgcaucgucggcggcaucuggugguucuucacccucaucaucaucuccuccuacaccgccaaccucgccgccuuccucaccgucgagcgcauggagucccccaucgacuccgccgacgaccucgccaagcagaccaagaucgaguacggcgccgucgaggacggcgccaccaugaccuucuucaagaaguccaagaucuccaccuacgacaagaugugggccuucauguccucccgccgccaguccguccucgucaaguccaacgaggagggcauccagcgcguccucaccuccgacuacgccuuccucauggaguccaccaccaucgaguucgucacccagcgcaacugcaaccucacccagaucggcggccucaucgacuccaagggcuacggcgucggcacccccaugggcucccccuaccgcgacaagaucaccaucgccauccuccagcuccaggaggagggcaagcuccacaugaugaaggagaagugguggcgcggcaacggcugccccgaggaggaguccaaggaggccuccgcccucggcguccagaacaucggcggcaucuucaucguccucgccgccggccucguccucuccgucuucgucgccgucggcgaguuccucuacaaguccaagaagaacgcccagcucgagaagcgcuccuucugcuccgccauggucgaggagcuccgcaugucccucaagugccagcgccgccucaagcacaagccccaggcccccgucaucgucaagaccgaggaggucaucaacaugcacaccuucaacgaccgccgccuccccggcaaggagaccauggccuga

SEQ ID NO: 43893 - RNA, 2871 nt, Artificial Sequence
  derived and/or modified sequence opt2 from GRIK4__Homo_sapiens__NP_001269399
augccccgcgucuccgccccccucguccuccuccccgccuggcucgucauggucgccugcuccccccacucccuccgcaucgccgccauccucgacgaccccauggagugcucccgcggcgagcgccucuccaucacccucgccaagaaccgcaucaaccgcgcccccgagcgccucggcaaggccaaggucgaggucgacaucuucgagcuccuccgcgacuccgaguacgagaccgccgagaccaugugccagauccuccccaagggcgucgucgccguccucggccccuccuccucccccgccuccuccuccaucaucuccaacaucugcggcgagaaggaggucccccacuucaaggucgcccccgaggaguucgucaaguuccaguuccagcgcuucaccacccucaaccuccaccccuccaacaccgacaucuccgucgccgucgccggcauccucaacuucuucaacugcaccaccgccugccucaucugcgccaaggccgagugccuccucaaccucgagaagcuccuccgccaguuccucaucuccaaggacacccucuccguccgcaugcucgacgacacccgcgaccccaccccccuccucaaggagauccgcgacgacaagaccgccaccaucaucauccacgccaacgccuccaugucccacaccauccuccucaaggccgccgagcucggcauggucuccgccuacuacaccuacaucuucaccaaccucgaguucucccuccagcgcauggacucccucgucgacgaccgcgucaacauccucggcuucuccaucuucaaccagucccacgccuucuuccaggaguucgcccagucccucaaccaguccuggcaggagaacugcgaccacguccccuucaccggccccgcccucuccuccgcccuccucuucgacgccgucuacgccgucgucaccgccguccaggagcucaaccgcucccaggagaucggcgucaagccccucuccugcggcuccgcccagaucuggcagcacggcaccucccucaugaacuaccuccgcauggucgagcucgagggccucaccggccacaucgaguucaacuccaagggccagcgcuccaacuacgcccucaagauccuccaguucacccgcaacggcuuccgccagaucggccaguggcacgucgccgagggccucuccauggacucccaccucuacgccuccaacaucuccgacacccucuucaacaccacccucgucgucaccaccauccucgagaaccccuaccucaugcucaagggcaaccaccaggagauggagggcaacgaccgcuacgagggcuucugcgucgacaugcucaaggagcucgccgagauccuccgcuucaacuacaagauccgccucgucggcgacggcgucuacggcguccccgaggccaacggcaccuggaccggcauggucggcgagcucaucgcccgcaaggccgaccucgccgucgccggccucaccaucaccgccgagcgcgagaaggucaucgacuucuccaagcccuucaugacccucggcaucuccauccucuaccgcguccacaugggccgcaagcccggcuacuucuccuuccucgaccccuucucccccggcgucuggcucuucaugcuccucgccuaccucgccgucuccugcguccucuuccucgucgcccgccucacccccuacgagugguacuccccccaccccugcgcccagggccgcugcaaccuccucgucaaccaguacucccucggcaacucccucugguuccccgucggcggcuucaugcagcagggcuccaccaucgccccccgcgcccucuccacccgcugcgucuccggcgucuggugggccuucacccucaucaucaucuccuccuacaccgccaaccucgccgccuuccucaccguccagcgcauggacguccccaucgaguccgucgacgaccucgccgaccagaccgccaucgaguacggcaccauccacggcggcuccuccaugaccuucuuccagaacucccgcuaccagaccuaccagcgcauguggaacuacauguacuccaagcagcccuccgucuucgucaaguccaccgaggagggcaucgcccgcguccucaacuccaacuacgccuuccuccucgaguccaccaugaacgaguacuaccgccagcgcaacugcaaccucacccagaucggcggccuccucgacaccaagggcuacggcaucggcaugcccgucggcuccgucuuccgcgacgaguucgaccucgccauccuccagcuccaggagaacaaccgccucgagauccucaagcgcaaguggugggagggcggcaagugccccaaggaggaggaccaccgcgccaagggccucggcauggagaacaucggcggcaucuucgucguccucaucugcggccucaucgucgccaucuucauggccaugcucgaguuccucuggacccuccgccacuccgaggccaccgaggucuccgucugccaggagauggucaccgagcuccgcuccaucauccucugccaggacuccauccacccccgccgccgccgcgccgccgucccccccccccgcccccccauccccgaggagcgccgcccccgcggcaccgccacccucuccaacggcaagcucugcggcgccggcgagcccgaccagcucgcccagcgccucgcccaggaggccgcccucgucgcccgcggcugcacccacauccgcgucugccccgagugccgccgcuuccagggccuccgcgcccgccccucccccgcccgcuccgaggagucccucgagugggagaagaccaccaacuccuccgagcccgaguga

SEQ ID NO: 43894 - RNA, 2946 nt, Artificial Sequence
  derived and/or modified sequence opt2 from GRIK5__Homo_sapiens__NP_001287959
augcccgccgagcuccuccuccuccucaucgucgccuucgccucccccuccugccagguccucuccucccuccgcauggccgccauccucgacgaccagaccgucugcggccgcggcgagcgccucgcccucgcccucgcccgcgagcagaucaacggcaucaucgagguccccgccaaggcccgcgucgaggucgacaucuucgagcuccagcgcgacucccaguacgagaccaccgacaccaugugccagauccuccccaagggcgucgucuccguccucggccccuccuccucccccgccuccgccuccaccgucucccacaucugcggcgagaaggagaucccccacaucaaggucggccccgaggagaccccccgccuccaguaccuccgcuucgccuccgucucccucuaccccuccaacgaggacgucucccucgccgucucccgcauccucaaguccuucaacuaccccuccgccucccucaucugcgccaaggccgagugccuccuccgccucgaggagcucguccgcggcuuccucaucuccaaggagacccucuccguccgcaugcucgacgacucccgcgaccccaccccccuccucaaggagauccgcgacgacaaggucuccaccaucaucaucgacgccaacgccuccaucucccaccucauccuccgcaaggccuccgagcucggcaugaccuccgccuucuacaaguacauccucaccaccauggacuuccccauccuccaccucgacggcaucgucgaggacuccuccaacauccucggcuucuccauguucaacaccucccaccccuucuaccccgaguucguccgcucccucaacauguccuggcgcgagaacugcgaggccuccaccuaccucggccccgcccucuccgccgcccucauguucgacgccguccacgucgucgucuccgccguccgcgagcucaaccgcucccaggagaucggcgucaagccccucgccugcaccuccgccaacaucuggccccacggcaccucccucaugaacuaccuccgcauggucgaguacgacggccucaccggccgcgucgaguucaacuccaagggccagcgcaccaacuacacccuccgcauccucgagaagucccgccagggccaccgcgagaucggcgucugguacuccaaccgcacccucgccaugaacgccaccacccucgacaucaaccucucccagacccucgccaacaagacccucgucgucaccaccauccucgagaaccccuacgucaugcgccgccccaacuuccaggcccucuccggcaacgagcgcuucgagggcuucugcgucgacaugcuccgcgagcucgccgagcuccuccgcuuccgcuaccgccuccgccucgucgaggacggccucuacggcgcccccgagcccaacggcuccuggaccggcauggucggcgagcucaucaaccgcaaggccgaccucgccgucgccgccuucaccaucaccgccgagcgcgagaaggucaucgacuucuccaagcccuucaugacccucggcaucuccauccucuaccgcguccacaugggccgcaagcccggcuacuucuccuuccucgaccccuucucccccgccgucuggcucuucaugcuccucgccuaccucgccgucuccugcguccucuuccucgccgcccgccucucccccuacgagugguacaacccccaccccugccuccgcgcccgcccccacauccucgagaaccaguacacccucggcaacucccucugguuccccgucggcggcuucaugcagcagggcuccgagaucaugccccgcgcccucuccacccgcugcgucuccggcgucuggugggccuucacccucaucaucaucuccuccuacaccgccaaccucgccgccuuccucaccguccagcgcauggagguccccgucgaguccgccgacgaccucgccgaccagaccaacaucgaguacggcaccauccacgccggcuccaccaugaccuucuuccagaacucccgcuaccagaccuaccagcgcauguggaacuacaugcaguccaagcagcccuccgucuucgucaaguccaccgaggagggcaucgcccgcguccucaacucccgcuacgccuuccuccucgaguccaccaugaacgaguaccaccgccgccucaacugcaaccucacccagaucggcggccuccucgacaccaagggcuacggcaucggcaugccccucggcucccccuuccgcgacgagaucacccucgccauccuccagcuccaggagaacaaccgccucgagauccucaagcgcaaguggugggagggcggccgcugccccaaggaggaggaccaccgcgccaagggccucggcauggagaacaucggcggcaucuucaucguccucaucugcggccucaucaucgccgucuucgucgccgucauggaguucaucugguccacccgccgcuccgccgaguccgaggagacccccgcccuccaccccgccgccugccagugcuccgcccucggcccccgcaccccccucaaggagcccuccaugcuccucgucaagguccccuccacccgcguccaggucgccuucucccgcaccucccuccgccaggucugccccuuccuccuccagcaccagcucuccucccucuacuggauccaggccaccaacguccagaucugcugccacuucuccucccucaagcccucccccgaccucaccuucccccccucccaccgcccccucuccucccuccucuucaccgcccucgccgccgucggcggccuccccgacgccuccuccuucuucuucccccccaucuccuccugccccccccuccaguccggcaucggccccugccacuccaccgaggccacccucgucaccuccaacuuccacgucuga

SEQ ID NO: 43895 - RNA, 2658 nt, Artificial Sequence
  derived and/or modified sequence opt2 from GRIN1__Homo_sapiens__NP_000823
auguccaccaugcgccuccucacccucgcccuccucuucuccugcuccgucgcccgcgccgccugcgaccccaagaucgucaacaucggcgccguccucuccacccgcaagcacgagcagauguuccgcgaggccgucaaccaggccaacaagcgccacggcuccuggaagauccagcucaacgccaccuccgucacccacaagcccaacgccauccagauggcccucuccgucugcgaggaccucaucuccucccaggucuacgccauccucgucucccacccccccacccccaacgaccacuucacccccacccccgucuccuacaccgccggcuucuaccgcauccccguccucggccucaccacccgcauguccaucuacuccgacaaguccauccaccucuccuuccuccgcaccgucccccccuacucccaccaguccuccgucugguucgagaugaugcgcgucuacuccuggaaccacaucauccuccucgucuccgacgaccacgagggccgcgccgcccagaagcgccucgagacccuccucgaggagcgcgaguccaaggccgagaagguccuccaguucgaccccggcaccaagaacgucaccgcccuccucauggaggccaaggagcucgaggcccgcgucaucauccucuccgccuccgaggacgacgccgccaccgucuaccgcgccgccgccaugcucaacaugaccggcuccggcuacgucuggcucgucggcgagcgcgagaucuccggcaacgcccuccgcuacgcccccgacggcauccucggccuccagcucaucaacggcaagaacgaguccgcccacaucuccgacgccgucggcgucgucgcccaggccguccacgagcuccucgagaaggagaacaucaccgaccccccccgcggcugcgucggcaacaccaacaucuggaagaccggcccccucuucaagcgcguccucauguccuccaaguacgccgacggcgucaccggccgcgucgaguucaacgaggacggcgaccgcaaguucgccaacuacuccaucaugaaccuccagaaccgcaagcucguccaggucggcaucuacaacggcacccacgucauccccaacgaccgcaagaucaucuggcccggcggcgagaccgagaagccccgcggcuaccagauguccacccgccucaagaucgucaccauccaccaggagcccuucgucuacgucaagcccacccucuccgacggcaccugcaaggaggaguucaccgucaacggcgaccccgucaagaaggucaucugcaccggccccaacgacaccucccccggcuccccccgccacaccgucccccagugcugcuacggcuucugcaucgaccuccucaucaagcucgcccgcaccaugaacuucaccuacgagguccaccucgucgccgacggcaaguucggcacccaggagcgcgucaacaacuccaacaagaaggaguggaacggcaugaugggcgagcuccucuccggccaggccgacaugaucgucgccccccucaccaucaacaacgagcgcgcccaguacaucgaguucuccaagcccuucaaguaccagggccucaccauccucgucaagaaggagaucccccgcuccacccucgacuccuucaugcagcccuuccaguccacccucuggcuccucgucggccucuccguccacgucgucgccgucaugcucuaccuccucgaccgcuucucccccuucggccgcuucaaggucaacuccgaggaggaggaggaggacgcccucacccucuccuccgccaugugguucuccuggggcguccuccucaacuccggcaucggcgagggcgccccccgcuccuucuccgcccgcauccucggcauggucugggccggcuucgccaugaucaucgucgccuccuacaccgccaaccucgccgccuuccucguccucgaccgccccgaggagcgcaucaccggcaucaacgacccccgccuccgcaaccccuccgacaaguucaucuacgccaccgucaagcaguccuccgucgacaucuacuuccgccgccaggucgagcucuccaccauguaccgccacauggagaagcacaacuacgaguccgccgccgaggccauccaggccguccgcgacaacaagcuccacgccuucaucugggacuccgccguccucgaguucgaggccucccagaagugcgaccucgucaccaccggcgagcucuucuuccgcuccggcuucggcaucggcaugcgcaaggacucccccuggaagcagaacgucucccucuccauccucaagucccacgagaacggcuucauggaggaccucgacaagaccuggguccgcuaccaggagugcgacucccgcuccaacgcccccgccacccucaccuucgagaacauggccggcgucuucaugcucgucgccggcggcaucgucgccggcaucuuccucaucuucaucgagaucgccuacaagcgccacaaggacgcccgccgcaagcagaugcagcucgccuucgccgccgucaacgucuggcgcaagaaccuccagcaguaccaccccaccgacaucaccggcccccucaaccucuccgaccccuccgucuccaccgucgucuga

SEQ ID NO: 43896 - RNA, 4395 nt, Artificial Sequence
  derived and/or modified sequence opt2 from GRIN2A__Homo_sapiens__NP_000824
augggccgcgucggcuacuggacccuccucguccuccccgcccuccucgucuggcgcggccccgcccccuccgccgccgccgagaagggcccccccgcccucaacaucgccgucaugcucggccacucccacgacgucaccgagcgcgagcuccgcacccucuggggccccgagcaggccgccggccucccccucgacgucaacgucgucgcccuccucaugaaccgcaccgaccccaagucccucaucacccacgucugcgaccucauguccggcgcccgcauccacggccucgucuucggcgacgacaccgaccaggaggccgucgcccagaugcucgacuucaucuccucccacaccuucguccccauccucggcauccacggcggcgccuccaugaucauggccgacaaggaccccaccuccaccuucuuccaguucggcgccuccauccagcagcaggccaccgucaugcucaagaucaugcaggacuacgacuggcacgucuucucccucgucaccaccaucuuccccggcuaccgcgaguucaucuccuucgucaagaccaccgucgacaacuccuucgucggcugggacaugcagaacgucaucacccucgacaccuccuucgaggacgccaagacccagguccagcucaagaagauccacuccuccgucauccuccucuacugcuccaaggacgaggccguccucauccucuccgaggcccgcucccucggccucaccggcuacgacuucuucuggaucguccccucccucgucuccggcaacaccgagcucauccccaaggaguuccccuccggccucaucuccgucuccuacgacgacugggacuacucccucgaggcccgcguccgcgacggcaucggcauccucaccaccgccgccuccuccaugcucgagaaguucuccuacauccccgaggccaaggccuccugcuacggccagauggagcgccccgagguccccaugcacacccuccaccccuucauggucaacgucaccugggacggcaaggaccucuccuucaccgaggagggcuaccagguccacccccgccucgucgucaucguccucaacaaggaccgcgagugggagaaggucggcaagugggagaaccacacccucucccuccgccacgccgucuggccccgcuacaaguccuucuccgacugcgagcccgacgacaaccaccucuccaucgucacccucgaggaggcccccuucgucaucgucgaggacaucgacccccucaccgagaccugcguccgcaacaccguccccugccgcaaguucgucaagaucaacaacuccaccaacgagggcaugaacgucaagaagugcugcaagggcuucugcaucgacauccucaagaagcucucccgcaccgucaaguucaccuacgaccucuaccucgucaccaacggcaagcacggcaagaaggucaacaacgucuggaacggcaugaucggcgaggucgucuaccagcgcgccgucauggccgucggcucccucaccaucaacgaggagcgcuccgaggucgucgacuucuccguccccuucgucgagaccggcaucuccgucauggucucccgcuccaacggcaccgucucccccuccgccuuccucgagcccuucuccgccuccgucugggucaugauguucgucaugcuccucaucgucuccgccaucgccgucuucgucuucgaguacuucucccccgucggcuacaaccgcaaccucgccaagggcaaggccccccacggccccuccuucaccaucggcaaggccaucuggcuccucuggggccucgucuucaacaacuccguccccguccagaaccccaagggcaccaccuccaagaucauggucuccgucugggccuucuucgccgucaucuuccucgccuccuacaccgccaaccucgccgccuucaugauccaggaggaguucgucgaccaggucaccggccucuccgacaagaaguuccagcgcccccacgacuacuccccccccuuccgcuucggcaccguccccaacggcuccaccgagcgcaacauccgcaacaacuaccccuacaugcaccaguacaugaccaaguucaaccagaagggcgucgaggacgcccucgucucccucaagaccggcaagcucgacgccuucaucuacgacgccgccguccucaacuacaaggccggccgcgacgagggcugcaagcucgucaccaucggcuccggcuacaucuucgccaccaccggcuacggcaucgcccuccagaagggcucccccuggaagcgccagaucgaccucgcccuccuccaguucgucggcgacggcgagauggaggagcucgagacccucuggcucaccggcaucugccacaacgagaagaacgaggucauguccucccagcucgacaucgacaacauggccggcgucuucuacaugcucgccgccgccauggcccucucccucaucaccuucaucugggagcaccucuucuacuggaagcuccgcuucugcuucaccggcgucugcuccgaccgccccggccuccucuucuccaucucccgcggcaucuacuccugcauccacggcguccacaucgaggagaagaagaagucccccgacuucaaccucaccggcucccaguccaacaugcucaagcuccuccgcuccgccaagaacaucuccuccauguccaacaugaacuccucccgcauggacucccccaagcgcgccgccgacuucauccagcgcggcucccucaucauggacauggucuccgacaagggcaaccucauguacuccgacaaccgcuccuuccagggcaaggaguccaucuucggcgacaacaugaacgagcuccagaccuucgucgccaaccgccagaaggacaaccucaacaacuacgucuuccagggccagcacccccucacccucaacgaguccaaccccaacaccgucgaggucgccgucuccaccgaguccaaggccaacucccgcccccgccagcucuggaagaaguccgucgacuccauccgccaggacucccucucccagaaccccgucucccagcgcgacgaggccaccgccgagaaccgcacccacucccucaaguccccccgcuaccuccccgaggagauggcccacuccgacaucuccgagaccuccaaccgcgccaccugccaccgcgagcccgacaacuccaagaaccacaagaccaaggacaacuucaagcgcuccgucgccuccaaguaccccaaggacugcuccgaggucgagcgcaccuaccucaagaccaaguccuccuccccccgcgacaagaucuacaccaucgacggcgagaaggagcccggcuuccaccucgaccccccccaguucgucgagaacgucacccuccccgagaacgucgacuuccccgaccccuaccaggaccccuccgagaacuuccgcaagggcgacuccacccuccccaugaaccgcaacccccuccacaacgaggagggccucuccaacaacgaccaguacaagcucuacuccaagcacuucacccucaaggacaagggcuccccccacuccgagaccuccgagcgcuaccgccagaacuccacccacugccgcuccugccucuccaacaugcccaccuacuccggccacuucaccaugcgcucccccuucaagugcgacgccugccuccgcaugggcaaccucuacgacaucgacgaggaccagaugcuccaggagaccggcaaccccgccaccggcgagcaggucuaccagcaggacugggcccagaacaacgcccuccagcuccagaagaacaagcuccgcaucucccgccagcacuccuacgacaacaucgucgacaagccccgcgagcucgaccucucccgccccucccgcuccaucucccucaaggaccgcgagcgccuccucgagggcaacuucuacggcucccucuucuccguccccuccuccaagcucuccggcaagaaguccucccucuucccccagggccucgaggacuccaagcgcuccaagucccuccuccccgaccacaccuccgacaaccccuuccuccacucccaccgcgacgaccagcgccucgucaucggccgcugccccuccgaccccuacaagcacucccuccccucccaggccgucaacgacuccuaccuccgcuccucccuccgcuccaccgccuccuacugcucccgcgacucccgcggccacaacgacgucuacaucuccgagcacgucaugcccuacgccgccaacaagaacaacauguacuccaccccccgcguccucaacuccugcuccaaccgccgcgucuacaagaagaugcccuccaucgaguccgacgucuga

SEQ ID NO: 43897 - RNA, 4455 nt, Artificial Sequence
  derived and/or modified sequence opt2 from GRIN2B__Homo_sapiens__XP_011518932
augaagccccgcgccgagugcugcucccccaaguucuggcucguccucgccguccucgccgucuccggcucccgcgcccgcucccagaaguccccccccuccaucggcaucgccgucauccucgucggcaccuccgacgaggucgccaucaaggacgcccacgagaaggacgacuuccaccaccucuccgucgucccccgcgucgagcucgucgccaugaacgagaccgaccccaaguccaucaucacccgcaucugcgaccucauguccgaccgcaagauccagggcgucgucuucgccgacgacaccgaccaggaggccaucgcccagauccucgacuucaucuccgcccagacccucacccccauccucggcauccacggcggcuccuccaugaucauggccgacaaggacgaguccuccauguucuuccaguucggccccuccaucgagcagcaggccuccgucaugcucaacaucauggaggaguacgacugguacaucuucuccaucgucaccaccuacuuccccggcuaccaggacuucgucaacaagauccgcuccaccaucgagaacuccuucgucggcugggagcucgaggagguccuccuccucgacaugucccucgacgacggcgacuccaagauccagaaccagcucaagaagcuccagucccccaucauccuccucuacugcaccaaggaggaggccaccuacaucuucgaggucgccaacuccgucggccucaccggcuacggcuacaccuggaucguccccucccucgucgccggcgacaccgacaccguccccgccgaguuccccaccggccucaucuccgucuccuacgacgagugggacuacggccuccccgcccgcguccgcgacggcaucgccaucaucaccaccgccgccuccgacaugcucuccgagcacuccuucauccccgagcccaaguccuccugcuacaacacccacgagaagcgcaucuaccaguccaacaugcucaaccgcuaccucaucaacgucaccuucgagggccgcaaccucuccuucuccgaggacggcuaccagaugcaccccaagcucgucaucauccuccucaacaaggagcgcaagugggagcgcgucggcaaguggaaggacaagucccuccagaugaaguacuacgucuggccccgcaugugccccgagaccgaggagcaggaggacgaccaccucuccaucgucacccucgaggaggcccccuucgucaucgucgaguccgucgacccccucuccggcaccugcaugcgcaacaccguccccugccagaagcgcaucgucaccgagaacaagaccgacgaggagcccggcuacaucaagaagugcugcaagggcuucugcaucgacauccucaagaagaucuccaaguccgucaaguucaccuacgaccucuaccucgucaccaacggcaagcacggcaagaagaucaacggcaccuggaacggcaugaucggcgaggucgucaugaagcgcgccuacauggccgucggcucccucaccaucaacgaggagcgcuccgaggucgucgacuucuccguccccuucaucgagaccggcaucuccgucauggucucccgcuccaacggcaccgucucccccuccgccuuccucgagcccuucuccgccgacgucugggucaugauguucgucaugcuccucaucgucuccgccgucgccgucuucgucuucgaguacuucucccccgucggcuacaaccgcugccucgccgacggccgcgagcccggcggccccuccuucaccaucggcaaggccaucuggcuccucuggggccucgucuucaacaacuccguccccguccagaaccccaagggcaccaccuccaagaucauggucuccgucugggccuucuucgccgucaucuuccucgccuccuacaccgccaaccucgccgccuucaugauccaggaggaguacgucgaccaggucuccggccucuccgacaagaaguuccagcgccccaacgacuucuccccccccuuccgcuucggcaccguccccaacggcuccaccgagcgcaacauccgcaacaacuacgccgagaugcacgccuacaugggcaaguucaaccagcgcggcgucgacgacgcccuccucucccucaagaccggcaagcucgacgccuucaucuacgacgccgccguccucaacuacauggccggccgcgacgagggcugcaagcucgucaccaucggcuccggcaaggucuucgccuccaccggcuacggcaucgccauccagaaggacuccggcuggaagcgccaggucgaccucgccauccuccagcucuucggcgacggcgagauggaggagcucgaggcccucuggcucaccggcaucugccacaacgagaagaacgaggucauguccucccagcucgacaucgacaacauggccggcgucuucuacaugcucggcgccgccauggcccucucccucaucaccuucaucugcgagcaccucuucuacuggcaguuccgccacugcuucaugggcgucugcuccggcaagcccggcauggucuucuccaucucccgcggcaucuacuccugcauccacggcgucgccaucgaggagcgccaguccgucaugaacucccccaccgccaccaugaacaacacccacuccaacauccuccgccuccuccgcaccgccaagaacauggccaaccucuccggcgucaacggcuccccccaguccgcccucgacuucauccgccgcgaguccuccgucuacgacaucuccgagcaccgccgcuccuucacccacuccgacugcaaguccuacaacaacccccccugcgaggagaaccucuucuccgacuacaucuccgaggucgagcgcaccuucggcaaccuccagcucaaggacuccaacgucuaccaggaccacuaccaccaccaccaccgcccccacuccaucggcuccgccuccuccaucgacggccucuacgacugcgacaacccccccuucaccacccagucccgcuccaucuccaagaagccccucgacaucggccuccccuccuccaagcacucccagcucuccgaccucuacggcaaguucuccuucaaguccgaccgcuacuccggccacgacgaccucauccgcuccgacgucuccgacaucuccacccacaccgucaccuacggcaacaucgagggcaacgccgccaagcgccgcaagcagcaguacaaggacucccucaagaagcgccccgccuccgccaagucccgccgcgaguucgacgagaucgagcucgccuaccgccgccgccccccccgcucccccgaccacaagcgcuacuuccgcgacaaggagggccuccgcgacuucuaccucgaccaguuccgcaccaaggagaacuccccccacugggagcacgucgaccucaccgacaucuacaaggagcgcuccgacgacuucaagcgcgacuccgucuccggcggcggccccugcaccaaccgcucccacaucaagcacggcaccggcgacaagcacggcgucgucuccggcguccccgcccccugggagaagaaccucaccaacgucgagugggaggaccgcuccggcggcaacuucugccgcuccugccccuccaagcuccacaacuacuccaccaccgucaccggccagaacuccggccgccaggccugcauccgcugcgaggccugcaagaaggccggcaaccucuacgacaucuccgaggacaacucccuccaggagcucgaccagcccgccgcccccgucgccgucaccuccaacgccuccaccaccaaguacccccagucccccaccaacuccaaggcccagaagaagaaccgcaacaagcuccgccgccagcacuccuacgacaccuucgucgaccuccagaaggaggaggccgcccucgccccccgcuccgucucccucaaggacaagggccgcuucauggacggcucccccuacgcccacauguucgagauguccgccggcgaguccaccuucgccaacaacaaguccuccguccccaccgccggccaccaccaccacaacaaccccggcggcggcuacaugcucuccaagucccucuaccccgaccgcgucacccagaaccccuucauccccaccuucggcgacgaccagugccuccuccacggcuccaaguccuacuucuuccgccagcccaccgucgccggcgccuccaaggcccgccccgacuuccgcgcccucgucaccaacaagcccgucgucuccgcccuccacggcgccguccccgcccgcuuccagaaggacaucugcaucggcaaccaguccaaccccugcguccccaacaacaagaacccccgcgccuucaacggcuccuccaacggccacgucuacgagaagcucuccuccaucgaguccgacgucuga

SEQ ID NO: 43898 - RNA, 3702 nt, Artificial Sequence
  derived and/or modified sequence opt2 from GRIN2C__Homo_sapiens__NP_000826
augggcggcgcccucggccccgcccuccuccucaccucccucuucggcgccugggccggccucggccccggccagggcgagcagggcaugaccgucgccgucgucuucuccuccuccggccccccccaggcccaguuccgcgcccgccucaccccccaguccuuccucgaccucccccucgagauccagccccucaccgucggcgucaacaccaccaaccccuccucccuccucacccagaucugcggccuccucggcgccgcccacguccacggcaucgucuucgaggacaacgucgacaccgaggccgucgcccagauccucgacuucaucuccucccagacccacguccccauccucuccaucuccggcggcuccgccgucguccucacccccaaggagcccggcuccgccuuccuccagcucggcgucucccucgagcagcagcuccagguccucuucaagguccucgaggaguacgacugguccgccuucgccgucaucaccucccuccaccccggccacgcccucuuccucgagggcguccgcgccgucgccgacgccucccacgucuccuggcgccuccucgacgucgucacccucgagcucggccccggcggcccccgcgcccgcacccagcgccuccuccgccagcucgacgcccccgucuucgucgccuacugcucccgcgaggaggccgagguccucuucgccgaggccgcccaggccggccucgucggccccggccacgucuggcucguccccaaccucgcccucggcuccaccgacgccccccccgccaccuuccccgucggccucaucuccgucgucaccgaguccuggcgccucucccuccgccagaagguccgcgacggcgucgccauccucgcccucggcgcccacuccuacuggcgccagcacggcacccuccccgcccccgccggcgacugccgcguccaccccggccccgucucccccgcccgcgaggccuucuaccgccaccuccucaacgucaccugggagggccgcgacuucuccuucucccccggcggcuaccucguccagcccaccauggucgucaucgcccucaaccgccaccgccucugggagauggucggccgcugggagcacggcguccucuacaugaaguaccccgucuggccccgcuacuccgccucccuccagcccgucgucgacucccgccaccucaccgucgccacccucgaggagcgccccuucgucaucgucgagucccccgaccccggcaccggcggcugcguccccaacaccguccccugccgccgccaguccaaccacaccuucuccuccggcgacgucgcccccuacaccaagcucugcugcaagggcuucugcaucgacauccucaagaagcucgcccgcgucgucaaguucuccuacgaccucuaccucgucaccaacggcaagcacggcaagcgcguccgcggcgucuggaacggcaugaucggcgaggucuacuacaagcgcgccgacauggccaucggcucccucaccaucaacgaggagcgcuccgagaucgucgacuucuccguccccuucgucgagaccggcaucuccgucauggucgcccgcuccaacggcaccgucucccccuccgccuuccucgagcccuacucccccgccgucugggucaugauguucgucaugugccucaccgucgucgccaucaccgucuucauguucgaguacuucucccccgucuccuacaaccagaaccucacccgcggcaagaaguccggcggccccgccuucaccaucggcaaguccgucuggcuccucugggcccucgucuucaacaacuccguccccaucgagaacccccgcggcaccaccuccaagaucaugguccucgucugggccuucuucgccgucaucuuccucgccuccuacaccgccaaccucgccgccuucaugauccaggagcaguacaucgacaccgucuccggccucuccgacaagaaguuccagcgcccccaggaccaguacccccccuuccgcuucggcaccguccccaacggcuccaccgagcgcaacauccgcuccaacuaccgcgacaugcacacccacauggucaaguucaaccagcgcuccgucgaggacgcccucaccucccucaagaugggcaagcucgacgccuucaucuacgacgccgccguccucaacuacauggccggcaaggacgagggcugcaagcucgucaccaucggcuccggcaaggucuucgccaccaccggcuacggcaucgccaugcagaaggacucccacuggaagcgcgccaucgaccucgcccuccuccaguuccucggcgacggcgagacccagaagcucgagaccgucuggcucuccggcaucugccagaacgagaagaacgaggucauguccuccaagcucgacaucgacaacauggccggcgucuucuacaugcuccucgucgccaugggccucgcccuccucgucuucgccugggagcaccucgucuacuggaagcuccgccacuccguccccaacuccucccagcucgacuuccuccucgccuucucccgcggcaucuacuccugcuucuccggcguccagucccucgccucccccccccgccaggccucccccgaccucaccgccuccuccgcccaggccuccguccucaagaugcuccaggccgcccgcgacauggucaccaccgccggcgucuccuccucccucgaccgcgccacccgcaccaucgagaacuggggcggcggccgccgcgcccccccccccucccccugccccaccccccgcuccggccccucccccugccuccccacccccgaccccccccccgagcccucccccaccggcuggggcccccccgacggcggccgcgccgcccucguccgccgcgccccccagccccccggccgcccccccacccccggccccccccucuccgacgucucccgcgucucccgccgccccgccugggaggcccgcuggcccguccgcaccggccacugcggccgccaccucuccgccuccgagcgcccccucucccccgcccgcugccacuacuccuccuucccccgcgccgaccgcuccggccgccccuuccucccccucuuccccgagcucgaggaccucccccuccucggccccgagcagcucgcccgccgcgaggcccuccuccacgccgccugggcccgcggcucccgcccccgccacgccucccuccccuccuccgucgccgaggccuucgcccgccccuccucccuccccgccggcugcaccggccccgccugcgcccgccccgacggccacuccgccugccgccgccucgcccaggcccaguccaugugccuccccaucuaccgcgaggccugccaggagggcgagcaggccggcgcccccgccuggcagcaccgccagcacgucugccuccacgcccacgcccaccuccccuucugcuggggcgccgucugcccccaccucccccccugcgccucccacggcuccuggcucuccggcgccuggggcccccucggccaccgcggccgcacccucggccucggcaccggcuaccgcgacuccggcggccucgacgagaucucccgcgucgcccgcggcacccagggcuuccccggccccugcaccuggcgccgcaucuccucccucgaguccgaggucuga

SEQ ID NO: 43899 - RNA, 4011 nt, Artificial Sequence
  derived and/or modified sequence opt2 from GRIN2D__Homo_sapiens__NP_000827
augcgcggcgccggcggcccccgcggcccccgcggccccgccaagaugcuccuccuccucgcccucgccugcgccucccccuuccccgaggaggcccccggccccggcggcgccggcggccccggcggcggccucggcggcgcccgcccccucaacgucgcccucgucuucuccggccccgccuacgccgccgaggccgcccgccucggccccgccgucgccgccgccguccgcucccccggccucgacguccgccccgucgcccucguccucaacggcuccgacccccgcucccucguccuccagcucugcgaccuccucuccggccuccgcguccacggcgucgucuucgaggacgacucccgcgcccccgccgucgcccccauccucgacuuccucuccgcccagaccucccuccccaucgucgccguccacggcggcgccgcccucguccucacccccaaggagaagggcuccaccuuccuccagcucggcuccuccaccgagcagcagcuccaggucaucuucgagguccucgaggaguacgacuggaccuccuucgucgccgucaccacccgcgcccccggccaccgcgccuuccucuccuacaucgagguccucaccgacggcucccucgucggcugggagcaccgcggcgcccucacccucgaccccggcgccggcgaggccguccucuccgcccagcuccgcuccgucuccgcccagauccgccuccucuucugcgcccgcgaggaggccgagcccgucuuccgcgccgccgaggaggccggccucaccggcuccggcuacgucugguucauggucggcccccagcucgccggcggcggcggcuccggcgcccccggcgagcccccccuccuccccggcggcgccccccuccccgccggccucuucgccguccgcuccgccggcuggcgcgacgaccucgcccgccgcgucgccgccggcgucgccgucgucgcccgcggcgcccaggcccuccuccgcgacuacggcuuccuccccgagcucggccacgacugccgcgcccagaaccgcacccaccgcggcgagucccuccaccgcuacuucaugaacaucaccugggacaaccgcgacuacuccuucaacgaggacggcuuccucgucaaccccucccucgucgucaucucccucacccgcgaccgcaccugggaggucgucggcuccugggagcagcagacccuccgccucaaguacccccucuggucccgcuacggccgcuuccuccagcccgucgacgacacccagcaccucaccgucgccacccucgaggagcgccccuucgucaucgucgagcccgccgaccccaucuccggcaccugcauccgcgacuccguccccugccgcucccagcucaaccgcacccacucccccccccccgacgccccccgccccgagaagcgcugcugcaagggcuucugcaucgacauccucaagcgccucgcccacaccaucggcuucuccuacgaccucuaccucgucaccaacggcaagcacggcaagaagaucgacggcgucuggaacggcaugaucggcgaggucuucuaccagcgcgccgacauggccaucggcucccucaccaucaacgaggagcgcuccgagaucgucgacuucuccguccccuucgucgagaccggcaucuccgucauggucgcccgcuccaacggcaccgucucccccuccgccuuccucgagcccuacucccccgccgucugggucaugauguucgucaugugccucaccgucgucgccgucaccgucuucaucuucgaguaccucucccccgucggcuacaaccgcucccucgccaccggcaagcgccccggcggcuccaccuucaccaucggcaaguccaucuggcuccucugggcccucgucuucaacaacuccguccccgucgagaacccccgcggcaccaccuccaagaucaugguccucgucugggccuucuucgccgucaucuuccucgccuccuacaccgccaaccucgccgccuucaugauccaggaggaguacgucgacaccgucuccggccucuccgaccgcaaguuccagcgcccccaggagcaguaccccccccucaaguucggcaccguccccaacggcuccaccgagaagaacauccgcuccaacuaccccgacaugcacuccuacaugguccgcuacaaccagccccgcgucgaggaggcccucacccagcucaaggccggcaagcucgacgccuucaucuacgacgccgccguccucaacuacauggcccgcaaggacgagggcugcaagcucgucaccaucggcuccggcaaggucuucgccaccaccggcuacggcaucgcccuccacaagggcucccgcuggaagcgccccaucgaccucgcccuccuccaguuccucggcgacgacgagaucgagaugcucgagcgccucuggcucuccggcaucugccacaacgacaagaucgaggucauguccuccaagcucgacaucgacaacauggccggcgucuucuacaugcuccucgucgccaugggccucucccuccucgucuucgccugggagcaccucgucuacuggcgccuccgccacugccucggccccacccaccgcauggacuuccuccucgccuucucccgcggcauguacuccugcugcuccgccgaggccgcccccccccccgccaagccccccccccccccccagccccuccccucccccgccuaccccgccccccgccccgcccccggccccgcccccuucgucccccgcgagcgcgccuccgucgaccgcuggcgccgcaccaagggcgccggcccccccggcggcgccggccucgccgacggcuuccaccgcuacuacggccccaucgagccccagggccucggccucggccucggcgaggcccgcgccgccccccgcggcgccgccggccgcccccucuccccccccgccgcccagcccccccagaagcccccccccuccuacuucgccaucguccgcgacaaggagcccgccgagccccccgccggcgccuuccccggcuuccccuccccccccgccccccccgccgccgccgccaccgccgucggccccccccucugccgccucgccuucgaggacgaguccccccccgcccccgcccgcuggccccgcuccgaccccgagucccagccccuccucggccccggcgccggcggcgccggcggcaccggcggcgccggcggcggcgcccccgccgcccccccccccugccgcgccgcccccccccccugccccuaccucgaccucgagcccucccccuccgacuccgaggacuccgagucccucggcggcgccucccucggcggccucgagcccuggugguucgccgacuuccccuaccccuacgccgagcgccucggccccccccccggccgcuacugguccgucgacaagcucggcggcuggcgcgccggcuccugggacuaccuccccccccgcuccggccccgccgccuggcacugccgccacugcgccucccucgagcuccucccccccccccgccaccucuccugcucccacgacggccucgacggcggcuggugggcccccccccccccccccugggccgccggcccccucccccgccgccgcgcccgcugcggcugcccccgcucccacccccaccgcccccgcgccucccaccgcacccccgccgccgccgccccccaccaccaccgccaccgccgcgccgccggcggcugggaccuccccccccccgcccccaccucccgcucccucgaggaccucuccuccugcccccgcgccgcccccgcccgccgccucaccggccccucccgccacgcccgccgcugcccccacgccgcccacuggggccccccccuccccaccgccucccaccgccgccaccgcggcggcgaccucggcacccgccgcggcuccgcccacuucuccucccucgaguccgaggucuga

SEQ ID NO: 43900 - RNA, 3348 nt, Artificial Sequence
  derived and/or modified sequence opt2 from GRIN3A__Homo_sapiens__NP_597702
augcgccgccucucccucugguggcuccucucccgcgucugccuccuccuccccccccccugcgcccucguccucgccggcguccccuccuccuccucccacccccagcccugccagauccucaagcgcaucggccacgccguccgcgucggcgccguccaccuccagcccuggaccaccgccccccgcgccgccucccgcgcccccgacgacucccgcgccggcgcccagcgcgacgagcccgagcccggcacccgccgcucccccgcccccucccccggcgcccgcuggcucggcuccacccuccacggccgcggcccccccggcucccgcaagcccggcgagggcgcccgcgccgaggcccucuggccccgcgacgcccuccucuucgccgucgacaaccucaaccgcgucgagggccuccuccccuacaaccucucccucgaggucgucauggccaucgaggccggccucggcgaccucccccuccuccccuucuccucccccuccucccccugguccuccgaccccuucuccuuccuccaguccgucugccacaccgucgucguccagggcgucuccgcccuccucgccuucccccagucccagggcgagaugauggagcucgaccucgucucccucguccuccacauccccgucaucuccaucguccgccacgaguucccccgcgagucccagaacccccuccaccuccagcucucccucgagaacucccucuccuccgacgccgacgucaccgucuccauccucaccaugaacaacugguacaacuucucccuccuccucugccaggaggacuggaacaucaccgacuuccuccuccucacccagaacaacuccaaguuccaccucggcuccaucaucaacaucaccgccaaccuccccuccacccaggaccuccucuccuuccuccagauccagcucgaguccaucaagaacuccacccccaccgucgucauguucggcugcgacauggaguccauccgccgcaucuucgagaucaccacccaguucggcgucaugccccccgagcuccgcuggguccucggcgacucccagaacgucgaggagcuccgcaccgagggccucccccucggccucaucgcccacggcaagaccacccaguccgucuucgagcacuacguccaggacgccauggagcucgucgcccgcgccgucgccaccgccaccaugauccagcccgagcucgcccucauccccuccaccaugaacugcauggaggucgagaccaccaaccucaccuccggccaguaccucucccgcuuccucgccaacaccaccuuccgcggccucuccggcuccauccgcgucaagggcuccaccaucgucuccuccgagaacaacuucuucaucuggaaccuccagcacgaccccaugggcaagcccauguggacccgccucggcuccuggcagggcggcaagaucgucauggacuacggcaucuggcccgagcaggcccagcgccacaagacccacuuccagcaccccuccaagcuccaccuccgcgucgucacccucaucgagcaccccuucgucuucacccgcgaggucgacgacgagggccucugccccgccggccagcucugccucgaccccaugaccaacgacuccuccacccucgacucccucuucuccucccuccacuccuccaacgacaccguccccaucaaguucaagaagugcugcuacggcuacugcaucgaccuccucgagaagaucgccgaggacaugaacuucgacuucgaccucuacaucgucggcgacggcaaguacggcgccuggaagaacggccacuggaccggccucgucggcgaccuccuccgcggcaccgcccacauggccgucaccuccuucuccaucaacaccgcccgcucccaggucaucgacuucaccucccccuucuucuccaccucccucggcauccucguccgcacccgcgacaccgccgcccccaucggcgccuucauguggccccuccacuggaccauguggcucggcaucuucgucgcccuccacaucaccgccgucuuccucacccucuacgaguggaagucccccuucggccucacccccaagggccgcaaccgcuccaaggucuucuccuucuccuccgcccucaacaucugcuacgcccuccucuucggccgcaccgucgccaucaagccccccaagugcuggaccggccgcuuccucaugaaccucugggccaucuucugcauguucugccucuccaccuacaccgccaaccucgccgccgucauggucggcgagaagaucuacgaggagcucuccggcauccacgaccccaagcuccaccaccccucccagggcuuccgcuucggcaccguccgcgaguccuccgccgaggacuacguccgccaguccuuccccgagaugcacgaguacaugcgccgcuacaacguccccgccacccccgacggcgucgaguaccucaagaacgaccccgagaagcucgacgccuucaucauggacaaggcccuccucgacuacgaggucuccaucgacgccgacugcaagcuccucaccgucggcaagcccuucgccaucgagggcuacggcaucggccucccccccaacuccccccucaccgccaacaucuccgagcucaucucccaguacaagucccacggcuucauggacaugcuccacgacaagugguaccgcgucguccccugcggcaagcgcuccuucgccgucaccgagacccuccagaugggcaucaagcacuucuccggccucuucguccuccucugcaucggcuucggccucuccauccucaccaccaucggcgagcacaucgucuaccgccuccuccucccccgcaucaagaacaaguccaagcuccaguacuggcuccacaccucccagcgccuccaccgcgccaucaacaccuccuucaucgaggagaagcagcagcacuucaagaccaagcgcgucgagaagcgcuccaacgucggcccccgccagcucaccgucuggaacaccuccaaccucucccacgacaaccgccgcaaguacaucuucuccgacgaggagggccagaaccagcucggcauccgcauccaccaggacaucccccuccccccccgccgccgcgagcuccccgcccuccgcaccaccaacggcaaggccgacucccucaacgucucccgcaacuccgucaugcaggagcucuccgagcucgagaagcagauccaggucauccgccaggagcuccagcucgccgucucccgcaagaccgagcucgaggaguaccagcgcaccucccgcaccugcgaguccuga

SEQ ID NO: 43901 - RNA, 3132 nt, Artificial Sequence
  derived and/or modified sequence opt2 from GRIN3B__Homo_sapiens__NP_619635
auggaguucguccgcgcccucuggcucggccucgcccucgcccucggccccggcuccgccggcggccacccccagcccugcggcguccucgcccgccucggcggcuccguccgccucggcgcccuccucccccgcgccccccucgcccgcgcccgcgcccgcgccgcccucgcccgcgccgcccucgccccccgccucccccacaaccucucccucgagcucgucgucgccgccccccccgcccgcgaccccgccucccucacccgcggccucugccaggcccucgucccccccggcgucgccgcccuccucgccuuccccgaggcccgccccgagcuccuccagcuccacuuccucgccgccgccaccgagacccccguccucucccuccuccgccgcgaggcccgcgccccccucggcgcccccaaccccuuccaccuccagcuccacugggccuccccccucgagacccuccucgacguccucgucgccguccuccaggcccacgccugggaggacgucggccucgcccucugccgcacccaggaccccggcggccucgucgcccucuggaccucccgcgccggccgccccccccagcucguccucgaccucucccgccgcgacaccggcgacgccggccuccgcgcccgccucgcccccauggccgcccccgucggcggcgaggcccccguccccgccgccguccuccucggcugcgacaucgcccgcgcccgccgcguccucgaggccgucccccccggcccccacuggcuccucggcaccccccucccccccaaggcccuccccaccgccggccucccccccggccuccucgcccucggcgaggucgcccgccccccccucgaggccgccauccacgacaucguccagcucgucgcccgcgcccucggcuccgccgcccagguccagcccaagcgcgcccuccuccccgcccccgucaacugcggcgaccuccagcccgccggccccgagucccccggccgcuuccucgcccgcuuccucgccaacaccuccuuccagggccgcaccggccccgucugggucaccggcuccucccagguccacaugucccgccacuucaaggucuggucccuccgccgcgacccccgcggcgcccccgccugggccaccgucggcuccuggcgcgacggccagcucgaccucgagcccggcggcgccuccgcccgccccccccccccccagggcgcccaggucuggcccaagcuccgcgucgucacccuccucgagcaccccuucgucuucgcccgcgaccccgacgaggacggccagugccccgccggccagcucugccucgaccccggcaccaacgacuccgccacccucgacgcccucuucgccgcccucgccaacggcuccgccccccgcgcccuccgcaagugcugcuacggcuacugcaucgaccuccucgagcgccucgccgaggacacccccuucgacuucgagcucuaccucgucggcgacggcaaguacggcgcccuccgcgacggccgcuggaccggccucgucggcgaccuccucgccggccgcgcccacauggccgucaccuccuucuccaucaacuccgcccgcucccaggucgucgacuucaccucccccuucuucuccaccucccucggcaucaugguccgcgcccgcgacaccgccucccccaucggcgccuucauguggccccuccacugguccaccuggcucggcgucuucgccgcccuccaccucaccgcccucuuccucaccgucuacgaguggcgcucccccuacggccucaccccccgcggccgcaaccgcuccaccgucuucuccuacuccuccgcccucaaccucugcuacgccauccucuuccgccgcaccgucuccuccaagacccccaagugccccaccggccgccuccucaugaaccucugggccaucuucugccuccucguccucuccuccuacaccgccaaccucgccgccgucauggucggcgacaagaccuucgaggagcucuccggcauccacgaccccaagcuccaccaccccgcccagggcuuccgcuucggcaccgucugggaguccuccgccgaggccuacaucaagaaguccuuccccgacaugcacgcccacaugcgccgccacuccgcccccaccaccccccgcggcgucgccaugcucaccuccgacccccccaagcucaacgccuucaucauggacaagucccuccucgacuacgaggucuccaucgacgccgacugcaagcuccucaccgucggcaagcccuucgccaucgagggcuacggcaucggccucccccagaacuccccccucaccuccaaccucuccgaguucaucucccgcuacaaguccuccggcuucaucgaccuccuccacgacaagugguacaagaugguccccugcggcaagcgcgucuucgccgucaccgagacccuccagauguccaucuaccacuucgccggccucuucguccuccucugccucggccucggcuccgcccuccucuccucccucggcgagcacgccuucuuccgccucgcccucccccgcauccgcaagggcucccgccuccaguacuggcuccacaccucccagaagauccaccgcgcccucaacaccgagccccccgagggcuccaaggaggagaccgccgaggccgagcccuccggccccgaggucgagcagcagcagcagcagcaggaccagcccaccgcccccgagggcuggaagcgcgcccgccgcgccgucgacaaggagcgccgcguccgcuuccuccucgagcccgccgucgucgucgcccccgaggccgacgccgaggccgaggccgccccccgcgagggccccgucuggcucugcuccuacggccgcccccccgccgcccgccccaccggcgccccccagcccggcgagcuccaggagcucgagcgccgcaucgaggucgcccgcgagcgccuccgccaggcccucguccgccgcggccagcuccucgcccagcucggcgacuccgcccgccaccgcccccgccgccuccuccaggcccgcgccgcccccgccgaggcccccccccacuccggccgccccggcucccaggaguga

SEQ ID NO: 43902 - RNA, 1116 nt, Artificial Sequence
  derived and/or modified sequence opt2 from GRINA__Homo_sapiens__NP_001009184
augucccacgagaaguccuuccucgucuccggcgacaacuaccccccccccaaccccggcuaccccggcggcccccagccccccaugccccccuacgcccagccccccuaccccggcgcccccuacccccagccccccuuccagcccucccccuacggccagcccggcuacccccacggccccucccccuacccccagggcggcuacccccagggccccuacccccagggcggcuacccccagggccccuacccccaggagggcuacccccagggccccuacccccagggcggcuacccccagggccccuacccccagucccccuucccccccaaccccuacggccagccccaggucuuccccggccaggaccccgacuccccccagcacggcaacuaccaggaggagggcccccccuccuacuacgacaaccaggacuuccccgccaccaacugggacgacaaguccauccgccaggccuucauccgcaaggucuuccucguccucacccuccagcucuccgucacccucuccaccgucuccgucuucaccuucgucgccgaggucaagggcuucguccgcgagaacgucuggaccuacuacgucuccuacgccgucuucuucaucucccucaucguccucuccugcugcggcgacuuccgccgcaagcaccccuggaaccucgucgcccucuccguccucaccgccucccucuccuacauggucggcaugaucgccuccuucuacaacaccgaggccgucaucauggccgucggcaucaccaccgccgucugcuucaccgucgucaucuucuccaugcagacccgcuacgacuucaccuccugcaugggcguccuccucgucuccauggucguccucuucaucuucgccauccucugcaucuucauccgcaaccgcauccucgagaucgucuacgccucccucggcgcccuccucuucaccugcuuccucgccgucgacacccagcuccuccucggcaacaagcagcucucccucucccccgaggaguacgucuucgccgcccucaaccucuacaccgacaucaucaacaucuuccucuacauccucaccaucaucggccgcgccaaggaguga

SEQ ID NO: 43903 - RNA, 3231 nt, Artificial Sequence
  derived and/or modified sequence opt2 from GRIP1__Homo_sapiens__NP_066973
augaucgccgucuccuucaagugccgcugccagauccuccgccgccucaccaaggacgagucccccuacaccaaguccgccucccagaccaagccccccgacggcgcccucgccguccgccgccaguccauccccgaggaguucaagggcuccaccgucgucgagcucaugaagaaggagggcaccacccucggccucaccgucuccggcggcaucgacaaggacggcaagccccgcgucuccaaccuccgccagggcggcaucgccgcccgcuccgaccagcucgacgucggcgacuacaucaaggccgucaacggcaucaaccucgccaaguuccgccacgacgagaucaucucccuccucaagaacgucggcgagcgcgucguccucgaggucgaguacgagcucccccccgucuccguccagggcuccuccgucaucuuccgcaccgucgaggucacccuccacaaggagggcaacaccuucggcuucgucauccgcggcggcgcccacgacgaccgcaacaagucccgccccgucgucaucaccugcguccgccccggcggccccgccgaccgcgagggcaccaucaagcccggcgaccgccuccucuccgucgacggcauccgccuccucggcaccacccacgccgaggccauguccauccucaagcagugcggccaggaggccgcccuccucaucgaguacgacgucuccgucauggacuccgucgccaccgccuccggcccccuccucgucgaggucgccaagacccccggcgccucccucggcgucgcccucaccaccuccaugugcugcaacaagcaggucaucgucaucgacaagaucaaguccgccuccaucgccgaccgcugcggcgcccuccacgucggcgaccacauccucuccaucgacggcaccuccauggaguacugcacccucgccgaggccacccaguuccucgccaacaccaccgaccaggucaagcucgagauccucccccaccaccagacccgccucgcccucaagggccccgaccacgccgcccucgucuccuccuccuucucccccaccuccauguccgccuacucccucuccucccucaacaugggcacccucccccgcucccucuacuccaccuccccccgcggcaccaugaugcgccgccgccucaagaagaaggacuucaaguccucccucucccucgccuccuccaccgucggccucgccggccaggucguccacaccgagaccaccgaggucguccucaccgccgaccccgucaccggcuucggcauccagcuccagggcuccgucuucgccaccgagacccucuccucccccccccucaucuccuacaucgaggccgacucccccgccgagcgcugcggcguccuccagaucggcgaccgcgucauggccaucaacggcauccccaccgaggacuccaccuucgaggaggccucccagcuccuccgcgacuccuccaucaccuccaaggucacccucgagaucgaguucgacgucgccgaguccgucauccccuccuccggcaccuuccacgucaagcuccccaagaagcacaacgucgagcucggcaucaccaucuccucccccuccucccgcaagcccggcgacccccucgucaucuccgacaucaagaagggcuccgucgcccaccgcaccggcacccucgagcucggcgacaagcuccucgccaucgacaacauccgccucgacaacugcuccauggaggacgccguccagauccuccagcagugcgaggaccucgucaagcucaagauccgcaaggacgaggacaacuccgacgagcaggaguccuccggcgccaucaucuacaccgucgagcucaagcgcuacggcggcccccucggcaucaccaucuccggcaccgaggagcccuucgaccccaucaucaucuccucccucaccaagggcggccucgccgagcgcaccggcgccauccacaucggcgaccgcauccucgccaucaacuccuccucccucaagggcaagccccucuccgaggccauccaccuccuccagauggccggcgagaccgucacccucaagaucaagaagcagaccgacgcccaguccgccuccucccccaagaaguuccccaucuccucccaccucuccgaccucggcgacgucgaggaggacuccucccccgcccagaagcccggcaagcucuccgacauguaccccuccaccguccccuccgucgacuccgccgucgacuccugggacggcuccgccaucgacaccuccuacggcacccagggcaccuccuuccaggccuccggcuacaacuucaacaccuacgacuggcgcucccccaagcagcgcggcucccucucccccgucaccaagccccgcucccagaccuaccccgacgucggccucuccuacgaggacugggaccgcuccaccgccuccggcuucgccggcgccgccgacuccgccgagaccgagcaggaggagaacuucuggucccaggcccucgaggaccucgagaccugcggccaguccggcauccuccgcgagcucgaggagaaggccgaccgccgcgucucccuccgcaacaugacccuccucgccaccaucauguccggcuccaccaugucccucaaccacgaggcccccaccccccgcucccagcucggccgccaggccuccuuccaggagcgcuccuccucccgcccccacuacucccagaccacccgcuccaacacccuccccuccgacgucggccgcaaguccgucacccuccgcaagaugaagcaggagaucaaggagaucaugucccccacccccgucgagcuccacaaggucacccucuacaaggacuccgacauggaggacuucggcuucuccgucgccgacggccuccucgagaagggcgucuacgucaagaacauccgccccgccggccccggcgaccucggcggccucaagcccuacgaccgccuccuccaggucaaccacguccgcacccgcgacuucgacugcugccucgucgucccccucaucgccgaguccggcaacaagcucgaccucgucaucucccgcaacccccucgccucccagaaguccaucgaccagcagucccuccccggcgacugguccgagcagaacuccgccuucuuccagcagcccucccacggcggcaaccucgagacccgcgagcccaccaacacccucuga

SEQ ID NO: 43904 - RNA, 1692 nt, Artificial Sequence
  derived and/or modified sequence opt2 from GRK1__Homo_sapiens__NP_002920
auggacuucggcucccucgagaccgucgucgccaacuccgccuucaucgccgcccgcggcuccuucgacggcuccuccucccagcccucccgcgacaagaaguaccucgccaagcucaagcuccccccccucuccaagugcgagucccuccgcgacucccucucccucgaguucgaguccgucugccucgagcagcccaucggcaagaagcucuuccagcaguuccuccaguccgccgagaagcaccuccccgcccucgagcucuggaaggacaucgaggacuacgacaccgccgacaacgaccuccagccccagaaggcccagaccauccucgcccaguaccucgacccccaggccaagcucuucugcuccuuccucgacgagggcaucgucgccaaguucaaggagggccccgucgagauccaggacggccucuuccagccccuccuccaggccacccucgcccaccucggccaggcccccuuccaggaguaccucggcucccucuacuuccuccgcuuccuccaguggaaguggcucgaggcccagcccaugggcgaggacugguuccucgacuuccgcguccucggcaagggcggcuucggcgaggucuccgccugccagaugaaggccaccggcaagcucuacgccugcaagaagcucaacaagaagcgccucaagaagcgcaagggcuaccagggcgccauggucgagaagaagauccucaugaagguccacucccgcuucaucgucucccucgccuacgccuucgagaccaaggccgaccucugccucgucaugaccaucaugaacggcggcgacauccgcuaccacaucuacaacgucaacgaggagaaccccggcuuccccgagccccgcgcccucuucuacaccgcccagaucaucugcggccucgagcaccuccaccagcgccgcaucgucuaccgcgaccucaagcccgagaacguccuccucgacaacgacggcaacguccgcaucuccgaccucggccucgccgucgagcuccucgacggccaguccaagaccaagggcuacgccggcacccccggcuucauggcccccgagcuccuccagggcgaggaguacgacuucuccgucgacuacuucgcccucggcgucacccucuacgagaugaucgccgcccgcggccccuuccgcgcccgcggcgagaaggucgagaacaaggagcucaagcaccgcaucaucuccgagcccgucaaguaccccgacaaguucucccaggccuccaaggacuucugcgaggcccuccucgagaaggaccccgagaagcgccucggcuuccgcgacgagaccugcgacaagcuccgcgcccacccccucuucaaggaccucaacuggcgccagcucgaggccggcaugcucaugccccccuucauccccgacuccaagaccgucuacgccaaggacauccaggacgucggcgccuucuccaccgucaagggcgucgccuucgacaagaccgacaccgaguucuuccaggaguucgccaccggcaacugccccauccccuggcaggaggagaugaucgagaccggcaucuucggcgagcucaacgucuggcgcuccgacggccagaugcccgacgacaugaagggcaucuccggcggcuccuccuccuccuccaaguccggcaugugccucgucuccuga

SEQ ID NO: 43905 - RNA, 1641 nt, Artificial Sequence
  derived and/or modified sequence opt2 from GRK4__Homo_sapiens__NP_001004056
auggagcucgagaacaucgucgccaacucccuccuccucaaggcccgccaggagaaggacuacuccucccucugcgacaagcagcccaucggccgccgccucuuccgccaguucugcgacaccaagcccacccucaagcgccacaucgaguuccucgacgccgucgccgaguacgaggucgccgacgacgaggaccgcuccgacugcggccucuccauccucgaccgcuucuucaacgacaagcucgccgccccccuccccgagaucccccccgacgucgucaccgagugccgccucggccucaaggaggagaaccccuccaagaaggccuucgaggagugcacccgcgucgcccacaacuaccuccgcggcgagcccuucgaggaguaccaggaguccuccuacuucucccaguuccuccaguggaaguggcucgagcgccagcccgucaccaagaacaccuuccgccacuaccgcguccucggcaagggcggcuucggcgaggucugcgccugccagguccgcgccaccggcaagauguacgccugcaagaagcuccagaagaagcgcaucaagaagcgcaagggcgaggccauggcccucaacgagaagcgcauccucgagaagguccagucccgcuucgucgucucccucgccuacgccuacgagaccaaggacgcccucugccucguccucaccaucaugaacggcggcgaccucaaguuccacaucuacaaccucggcaaccccggcuucgacgagcagcgcgccgucuucuacgccgccgagcucugcugcggccucgaggaccuccagcgcgagcgcaucgucuaccgcgaccucaagcccgagaacauccuccucgacgaccgcggccacauccgcaucuccgaccucggccucgccaccgagauccccgagggccagcgcguccgcggccgcgucggcaccgucggcuacauggcccccgaggucgucaacaacgagaaguacaccuucucccccgacugguggggccucggcugccucaucuacgagaugauccagggccacucccccuucaagaaguacaaggagaaggucaagugggaggaggucgaccagcgcaucaagaacgacaccgaggaguacuccgagaaguucuccgaggacgccaaguccaucugccgcaugcuccucaccaagaaccccuccaagcgccucggcugccgcggcgagggcgccgccggcgucaagcagcaccccgucuucaaggacaucaacuuccgccgccucgaggccaacaugcucgagccccccuucugccccgacccccacgccgucuacugcaaggacguccucgacaucgagcaguucuccgucgucaagggcaucuaccucgacaccgccgacgaggacuucuacgcccgcuucgccaccggcugcgucuccauccccuggcagaacgagaugaucgaguccggcugcuucaaggacaucaacaaguccgaguccgaggaggcccucccccucgaccucgacaagaacauccacacccccgucucccgccccaaccgcggcuucuucuaccgccucuuccgccgcggcggcugccucaccaugguccccuccgagaaggaggucgagcccaagcagugcuga

SEQ ID NO: 43906 - RNA, 1773 nt, Artificial Sequence
  derived and/or modified sequence opt2 from GRK5__Homo_sapiens__NP_005299
auggagcucgagaacaucgucgccaacaccguccuccucaaggcccgcgagggcggcggcggcaagcgcaagggcaaguccaagaaguggaaggagauccucaaguucccccacaucucccagugcgaggaccuccgccgcaccaucgaccgcgacuacugcucccucugcgacaagcagcccaucggccgccuccucuuccgccaguucugcgagacccgccccggccucgagugcuacauccaguuccucgacuccgucgccgaguacgaggucacccccgacgagaagcucggcgagaagggcaaggagaucaugaccaaguaccucacccccaagucccccgucuucaucgcccaggucggccaggaccucgucucccagaccgaggagaagcuccuccagaagcccugcaaggagcucuucuccgccugcgcccaguccguccacgaguaccuccgcggcgagcccuuccacgaguaccucgacuccauguucuucgaccgcuuccuccaguggaaguggcucgagcgccagcccgucaccaagaacaccuuccgccaguaccgcguccucggcaagggcggcuucggcgaggucugcgccugccagguccgcgccaccggcaagauguacgccugcaagcgccucgagaagaagcgcaucaagaagcgcaagggcgaguccauggcccucaacgagaagcagauccucgagaaggucaacucccaguucgucgucaaccucgccuacgccuacgagaccaaggacgcccucugccucguccucaccaucaugaacggcggcgaccucaaguuccacaucuacaacaugggcaaccccggcuucgaggaggagcgcgcccucuucuacgccgccgagauccucugcggccucgaggaccuccaccgcgagaacaccgucuaccgcgaccucaagcccgagaacauccuccucgacgacuacggccacauccgcaucuccgaccucggccucgccgucaagauccccgagggcgaccucauccgcggccgcgucggcaccgucggcuacauggcccccgagguccucaacaaccagcgcuacggccucucccccgacuacuggggccucggcugccucaucuacgagaugaucgagggccagucccccuuccgcggccgcaaggagaaggucaagcgcgaggaggucgaccgccgcguccucgagaccgaggaggucuacucccacaaguucuccgaggaggccaaguccaucugcaagaugcuccucaccaaggacgccaagcagcgccucggcugccaggaggagggcgccgccgaggucaagcgccaccccuucuuccgcaacaugaacuucaagcgccucgaggccggcaugcucgacccccccuucguccccgacccccgcgccgucuacugcaaggacguccucgacaucgagcaguucuccaccgucaagggcgucaaccucgaccacaccgacgacgacuucuacuccaaguucuccaccggcuccgucuccauccccuggcagaacgagaugaucgagaccgagugcuucaaggagcucaacgucuucggccccaacggcacccucccccccgaccucaaccgcaaccacccccccgagccccccaagaagggccuccuccagcgccucuucaagcgccagcaccagaacaacuccaaguccucccccuccuccaagaccuccuucaaccaccacaucaacuccaaccacgucuccuccaacuccaccggcuccuccuga

SEQ ID NO: 43907 - RNA, 1683 nt, Artificial Sequence
  derived and/or modified sequence opt2 from GRK6__Homo_sapiens__NP_001004105
auggagcucgagaacaucgucgccaacaccguccuccucaaggcccgcgagggcggcggcggcaaccgcaagggcaaguccaagaaguggcgccagaugcuccaguucccccacaucucccagugcgaggagcuccgccucucccucgagcgcgacuaccacucccucugcgagcgccagcccaucggccgccuccucuuccgcgaguucugcgccacccgccccgagcucucccgcugcgucgccuuccucgacggcgucgccgaguacgaggucacccccgacgacaagcgcaaggccugcggccgccagcucacccagaacuuccucucccacaccggccccgaccucauccccgaggucccccgccagcucgucaccaacugcacccagcgccucgagcagggccccugcaaggaccucuuccaggagcucacccgccucacccacgaguaccucuccgucgcccccuucgccgacuaccucgacuccaucuacuucaaccgcuuccuccaguggaaguggcucgagcgccagcccgucaccaagaacaccuuccgccaguaccgcguccucggcaagggcggcuucggcgaggucugcgccugccagguccgcgccaccggcaagauguacgccugcaagaagcucgagaagaagcgcaucaagaagcgcaagggcgaggccauggcccucaacgagaagcagauccucgagaaggucaacucccgcuucgucgucucccucgccuacgccuacgagaccaaggacgcccucugccucguccucacccucaugaacggcggcgaccucaaguuccacaucuaccacaugggccaggccggcuuccccgaggcccgcgccgucuucuacgccgccgagaucugcugcggccucgaggaccuccaccgcgagcgcaucgucuaccgcgaccucaagcccgagaacauccuccucgacgaccacggccacauccgcaucuccgaccucggccucgccguccacguccccgagggccagaccaucaagggccgcgucggcaccgucggcuacauggcccccgaggucgucaagaacgagcgcuacaccuucucccccgacuggugggcccucggcugccuccucuacgagaugaucgccggccagucccccuuccagcagcgcaagaagaagaucaagcgcgaggaggucgagcgccucgucaaggagguccccgaggaguacuccgagcgcuucuccccccaggcccgcucccucugcucccagcuccucugcaaggaccccgccgagcgccucggcugccgcggcggcuccgcccgcgaggucaaggagcacccccucuucaagaagcucaacuucaagcgccucggcgccggcaugcucgagccccccuucaagcccgacccccaggccaucuacugcaaggacguccucgacaucgagcaguucuccaccgucaagggcgucgagcucgagcccaccgaccaggacuucuaccagaaguucgccaccggcuccguccccauccccuggcagaacgagauggucgagaccgagugcuuccaggagcucaacgucuucggccucgacggcuccgucccccccgaccucgacuggaagggccagccccccgccccccccaagaagggccuccuccagcgccucuucucccgccagcgcuga

SEQ ID NO: 43908 - RNA, 1662 nt, Artificial Sequence
  derived and/or modified sequence opt2 from GRK7__Homo_sapiens__NP_631948
auggucgacaugggcgcccucgacaaccucaucgccaacaccgccuaccuccaggcccgcaagcccuccgacugcgacuccaaggagcuccagcgccgccgccgcucccucgcccuccccggccuccagggcugcgccgagcuccgccagaagcucucccucaacuuccacucccucugcgagcagcagcccaucggccgccgccucuuccgcgacuuccucgccaccguccccaccuuccgcaaggccgccaccuuccucgaggacguccagaacugggagcucgccgaggagggccccaccaaggacuccgcccuccagggccucgucgccaccugcgccuccgcccccgcccccggcaacccccagcccuuccucucccaggccgucgccaccaagugccaggccgccaccaccgaggaggagcgcgucgccgccgucacccucgccaaggccgaggccauggccuuccuccaggagcagcccuucaaggacuucgucaccuccgccuucuacgacaaguuccuccaguggaagcucuucgagaugcagcccgucuccgacaaguacuucaccgaguuccgcguccucggcaagggcggcuucggcgaggucugcgccguccaggucaagaacaccggcaagauguacgccugcaagaagcucgacaagaagcgccucaagaagaagggcggcgagaagauggcccuccucgagaaggagauccucgagaaggucuccucccccuucaucgucucccucgccuacgccuucgaguccaagacccaccucugccucgucaugucccucaugaacggcggcgaccucaaguuccacaucuacaacgucggcacccgcggccucgacaugucccgcgucaucuucuacuccgcccagaucgccugcggcaugcuccaccuccacgagcucggcaucgucuaccgcgacaugaagcccgagaacguccuccucgacgaccucggcaacugccgccucuccgaccucggccucgccgucgagaugaagggcggcaagcccaucacccagcgcgccggcaccaacggcuacauggcccccgagauccucauggagaaggucuccuacuccuaccccgucgacugguucgccaugggcugcuccaucuacgagauggucgccggccgcacccccuucaaggacuacaaggagaaggucuccaaggaggaccucaagcagcgcacccuccaggacgaggucaaguuccagcacgacaacuucaccgaggaggccaaggacaucugccgccucuuccucgccaagaagcccgagcagcgccucggcucccgcgagaaguccgacgacccccgcaagcaccacuucuucaagaccaucaacuucccccgccucgaggccggccucaucgagccccccuucguccccgaccccuccgucgucuacgccaaggacaucgccgagaucgacgacuucuccgagguccgcggcgucgaguucgacgacaaggacaagcaguucuucaagaacuucgccaccggcgccguccccaucgccuggcaggaggagaucaucgagaccggccucuucgaggagcucaacgaccccaaccgccccaccggcugcgaggagggcaacuccuccaaguccggcgucugccuccuccucuga

SEQ ID NO: 43909 - RNA, 2721 nt, Artificial Sequence
  derived and/or modified sequence opt2 from GRM1__Homo_sapiens__NP_001264995
auggucggccuccuccucuucuucuuccccgccaucuuccucgaggucucccuccucccccgcucccccggccgcaagguccuccucgccggcgccuccucccagcgcuccgucgcccgcauggacggcgacgucaucaucggcgcccucuucuccguccaccaccagccccccgccgagaagguccccgagcgcaagugcggcgagauccgcgagcaguacggcauccagcgcgucgaggccauguuccacacccucgacaagaucaacgccgaccccguccuccuccccaacaucacccucggcuccgagauccgcgacuccugcuggcacuccuccgucgcccucgagcaguccaucgaguucauccgcgacucccucaucuccauccgcgacgagaaggacggcaucaaccgcugccuccccgacggccagucccucccccccggccgcaccaagaagcccaucgccggcgucaucggccccggcuccuccuccgucgccauccagguccagaaccuccuccagcucuucgacaucccccagaucgccuacuccgccaccuccaucgaccucuccgacaagacccucuacaaguacuuccuccgcgucguccccuccgacacccuccaggcccgcgccaugcucgacaucgucaagcgcuacaacuggaccuacgucuccgccguccacaccgagggcaacuacggcgaguccggcauggacgccuucaaggagcucgccgcccaggagggccucugcaucgcccacuccgacaagaucuacuccaacgccggcgagaaguccuucgaccgccuccuccgcaagcuccgcgagcgccuccccaaggcccgcgucgucgucugcuucugcgagggcaugaccguccgcggccuccucuccgccaugcgccgccucggcgucgucggcgaguucucccucaucggcuccgacggcugggccgaccgcgacgaggucaucgagggcuacgaggucgaggccaacggcggcaucaccaucaagcuccagucccccgagguccgcuccuucgacgacuacuuccucaagcuccgccucgacaccaacacccgcaaccccugguuccccgaguucuggcagcaccgcuuccagugccgccuccccggccaccuccucgagaaccccaacuucaagcgcaucugcaccggcaacgagucccucgaggagaacuacguccaggacuccaagaugggcuucgucaucaacgccaucuacgccauggcccacggccuccagaacaugcaccacgcccucugccccggccacgucggccucugcgacgccaugaagcccaucgacggcuccaagcuccucgacuuccucaucaaguccuccuucaucggcgucuccggcgaggaggucugguucgacgagaagggcgacgcccccggccgcuacgacaucaugaaccuccaguacaccgaggccaaccgcuacgacuacguccacgucggcaccuggcacgagggcguccucaacaucgacgacuacaagauccagaugaacaaguccggcgucguccgcuccgucugcuccgagcccugccucaagggccagaucaaggucauccgcaagggcgaggucuccugcugcuggaucugcaccgccugcaaggagaacgaguacguccaggacgaguucaccugcaaggccugcgaccucggcugguggcccaacgccgaccucaccggcugcgagcccauccccguccgcuaccucgagugguccaacaucgaguccaucaucgccaucgccuucuccugccucggcauccucgucacccucuucgucacccucaucuucguccucuaccgcgacacccccgucgucaaguccuccucccgcgagcucugcuacaucauccucgccggcaucuuccucggcuacgucugccccuucacccucaucgccaagcccaccaccaccuccugcuaccuccagcgccuccucgucggccucuccuccgccaugugcuacuccgcccucgucaccaagaccaaccgcaucgcccgcauccucgccggcuccaagaagaagaucugcacccgcaagccccgcuucauguccgccugggcccaggucaucaucgccuccauccucaucuccguccagcucacccucgucgucacccucaucaucauggagccccccaugcccauccucuccuaccccuccaucaaggaggucuaccucaucugcaacaccuccaaccucggcgucgucgccccccucggcuacaacggccuccucaucauguccugcaccuacuacgccuucaagacccgcaacguccccgccaacuucaacgaggccaaguacaucgccuucaccauguacaccaccugcaucaucuggcucgccuucguccccaucuacuucggcuccaacuacaagaucaucaccaccugcuucgccgucucccucuccgucaccgucgcccucggcugcauguucacccccaagauguacaucaucaucgccaagcccgagcgcaacguccgcuccgccuucaccaccuccgacgucguccgcaugcacgucggcgacggcaagcuccccugccgcuccaacaccuuccucaacaucuuccgccgcaagaaggccggcgccggcaacgccaagaagcgccagcccgaguucucccccaccucccagugccccuccgcccacguccagcucuga

SEQ ID NO: 43910 - RNA, 2619 nt, Artificial Sequence
  derived and/or modified sequence opt2 from GRM2__Homo_sapiens__NP_000830
augggcucccuccucgcccuccucgcccuccuccuccucuggggcgccgucgccgagggccccgccaagaagguccucacccucgagggcgaccucguccucggcggccucuuccccguccaccagaagggcggccccgccgaggacugcggccccgucaacgagcaccgcggcauccagcgccucgaggccaugcucuucgcccucgaccgcaucaaccgcgacccccaccuccuccccggcguccgccucggcgcccacauccucgacuccugcuccaaggacacccacgcccucgagcaggcccucgacuucguccgcgccucccucucccgcggcgccgacggcucccgccacaucugccccgacggcuccuacgccacccacggcgacgcccccaccgccaucaccggcgucaucggcggcuccuacuccgacgucuccauccaggucgccaaccuccuccgccucuuccagaucccccagaucuccuacgccuccaccuccgccaagcucuccgacaagucccgcuacgacuacuucgcccgcaccgucccccccgacuucuuccaggccaaggccauggccgagauccuccgcuucuucaacuggaccuacgucuccaccgucgccuccgagggcgacuacggcgagaccggcaucgaggccuucgagcucgaggcccgcgcccgcaacaucugcgucgccaccuccgagaaggucggccgcgccaugucccgcgccgccuucgagggcgucguccgcgcccuccuccagaagcccuccgcccgcgucgccguccucuucacccgcuccgaggacgcccgcgagcuccucgccgccucccagcgccucaacgccuccuucaccugggucgccuccgacggcuggggcgcccucgaguccgucgucgccggcuccgagggcgccgccgagggcgccaucaccaucgagcucgccuccuaccccaucuccgacuucgccuccuacuuccagucccucgaccccuggaacaacucccgcaaccccugguuccgcgaguucugggagcagcgcuuccgcugcuccuuccgccagcgcgacugcgccgcccacucccuccgcgccguccccuucgagcaggaguccaagaucauguucgucgucaacgccgucuacgccauggcccacgcccuccacaacaugcaccgcgcccucugccccaacaccacccgccucugcgacgccaugcgccccgucaacggccgccgccucuacaaggacuucguccucaacgucaaguucgacgcccccuuccgccccgccgacacccacaacgagguccgcuucgaccgcuucggcgacggcaucggccgcuacaacaucuucaccuaccuccgcgccggcuccggccgcuaccgcuaccagaaggucggcuacugggccgagggccucacccucgacaccucccucauccccugggccucccccuccgccggcccccuccccgccucccgcugcuccgagcccugccuccagaacgaggucaaguccguccagcccggcgaggucugcugcuggcucugcauccccugccagcccuacgaguaccgccucgacgaguucaccugcgccgacugcggccucggcuacuggcccaacgccucccucaccggcugcuucgagcucccccaggaguacauccgcuggggcgacgccugggccgucggccccgucaccaucgccugccucggcgcccucgccacccucuucguccucggcgucuucguccgccacaacgccacccccgucgucaaggccuccggccgcgagcucugcuacauccuccucggcggcgucuuccucugcuacugcaugaccuucaucuucaucgccaagcccuccaccgccgucugcacccuccgccgccucggccucggcaccgccuucuccgucugcuacuccgcccuccucaccaagaccaaccgcaucgcccgcaucuucggcggcgcccgcgagggcgcccagcgcccccgcuucaucucccccgccucccaggucgccaucugccucgcccucaucuccggccagcuccucaucgucgucgccuggcucgucgucgaggcccccggcaccggcaaggagaccgcccccgagcgccgcgaggucgucacccuccgcugcaaccaccgcgacgccuccaugcucggcucccucgccuacaacguccuccucaucgcccucugcacccucuacgccuucaagacccgcaagugccccgagaacuucaacgaggccaaguucaucggcuucaccauguacaccaccugcaucaucuggcucgccuuccuccccaucuucuacgucaccuccuccgacuaccgcguccagaccaccaccaugugcgucuccgucucccucuccggcuccgucguccucggcugccucuucgcccccaagcuccacaucauccucuuccagccccagaagaacgucgucucccaccgcgcccccaccucccgcuucggcuccgccgccgcccgcgccuccuccucccucggccagggcuccggcucccaguucguccccaccgucugcaacggccgcgaggucgucgacuccaccaccuccucccucuga

SEQ ID NO: 43911 - RNA, 2640 nt, Artificial Sequence
  derived and/or modified sequence opt2 from GRM3__Homo_sapiens__NP_000831
augaagaugcucacccgccuccagguccucacccucgcccucuucuccaagggcuuccuccucucccucggcgaccacaacuuccuccgccgcgagaucaagaucgagggcgaccucguccucggcggccucuuccccaucaacgagaagggcaccggcaccgaggagugcggccgcaucaacgaggaccgcggcauccagcgccucgaggccaugcucuucgccaucgacgagaucaacaaggacgacuaccuccuccccggcgucaagcucggcguccacauccucgacaccugcucccgcgacaccuacgcccucgagcagucccucgaguucguccgcgccucccucaccaaggucgacgaggccgaguacaugugccccgacggcuccuacgccauccaggagaacaucccccuccucaucgccggcgucaucggcggcuccuacuccuccgucuccauccaggucgccaaccuccuccgccucuuccagaucccccagaucuccuacgccuccaccuccgccaagcucuccgacaagucccgcuacgacuacuucgcccgcaccgucccccccgacuucuaccaggccaaggccauggccgagauccuccgcuucuucaacuggaccuacgucuccaccgucgccuccgagggcgacuacggcgagaccggcaucgaggccuucgagcaggaggcccgccuccgcaacaucugcaucgccaccgccgagaaggucggccgcuccaacauccgcaaguccuacgacuccgucauccgcgagcuccuccagaagcccaacgcccgcgucgucguccucuucaugcgcuccgacgacucccgcgagcucaucgccgccgccucccgcgccaacgccuccuucaccugggucgccuccgacggcuggggcgcccaggaguccaucaucaagggcuccgagcacgucgccuacggcgccaucacccucgagcucgccucccagcccguccgccaguucgaccgcuacuuccagucccucaaccccuacaacaaccaccgcaaccccugguuccgcgacuucugggagcagaaguuccagugcucccuccagaacaagcgcaaccaccgccgcgucugcgacaagcaccucgccaucgacuccuccaacuacgagcaggaguccaagaucauguucgucgucaacgccgucuacgccauggcccacgcccuccacaagaugcagcgcacccucugccccaacaccaccaagcucugcgacgccaugaagauccucgacggcaagaagcucuacaaggacuaccuccucaagaucaacuucaccgcccccuucaaccccaacaaggacgccgacuccaucgucaaguucgacaccuucggcgacggcaugggccgcuacaacgucuucaacuuccagaacgucggcggcaaguacuccuaccucaaggucggccacugggccgagacccucucccucgacgucaacuccauccacuggucccgcaacuccguccccaccucccagugcuccgaccccugcgcccccaacgagaugaagaacaugcagcccggcgacgucugcugcuggaucugcauccccugcgagcccuacgaguaccucgccgacgaguucaccugcauggacugcggcuccggccaguggcccaccgccgaccucaccggcugcuacgaccuccccgaggacuacauccgcugggaggacgccugggccaucggccccgucaccaucgccugccucggcuucaugugcaccugcauggucgucaccgucuucaucaagcacaacaacaccccccucgucaaggccuccggccgcgagcucugcuacauccuccucuucggcgucggccucuccuacugcaugaccuucuucuucaucgccaagcccucccccgucaucugcgcccuccgccgccucggccucggcuccuccuucgccaucugcuacuccgcccuccucaccaagaccaacugcaucgcccgcaucuucgacggcgucaagaacggcgcccagcgccccaaguucaucucccccuccucccaggucuucaucugccucggccucauccucguccagaucgucauggucuccgucuggcucauccucgaggcccccggcacccgccgcuacacccucgccgagaagcgcgagaccgucauccucaagugcaacgucaaggacuccuccaugcucaucucccucaccuacgacgucauccucgucauccucugcaccgucuacgccuucaagacccgcaagugccccgagaacuucaacgaggccaaguucaucggcuucaccauguacaccaccugcaucaucuggcucgccuuccuccccaucuucuacgucaccuccuccgacuaccgcguccagaccaccaccaugugcaucuccgucucccucuccggcuucgucguccucggcugccucuucgcccccaagguccacaucauccucuuccagccccagaagaacgucgucacccaccgccuccaccucaaccgcuucuccgucuccggcaccggcaccaccuacucccaguccuccgccuccaccuacguccccaccgucugcaacggccgcgagguccucgacuccaccaccuccucccucuga

SEQ ID NO: 43912 - RNA, 2739 nt, Artificial Sequence
  derived and/or modified sequence opt2 from GRM4__Homo_sapiens__NP_000832
augcccggcaagcgcggccucggcugguggugggcccgccucccccucugccuccuccucucccucuacggccccuggaugcccuccucccucggcaagcccaagggccacccccacaugaacuccauccgcaucgacggcgacaucacccucggcggccucuuccccguccacggccgcggcuccgagggcaagcccugcggcgagcucaagaaggagaagggcauccaccgccucgaggccaugcucuucgcccucgaccgcaucaacaacgaccccgaccuccuccccaacaucacccucggcgcccgcauccucgacaccugcucccgcgacacccacgcccucgagcagucccucaccuucguccaggcccucaucgagaaggacggcaccgagguccgcugcggcuccggcggcccccccaucaucaccaagcccgagcgcgucgucggcgucaucggcgccuccggcuccuccgucuccaucauggucgccaacauccuccgccucuucaagaucccccagaucuccuacgccuccaccgcccccgaccucuccgacaacucccgcuacgacuucuucucccgcgucguccccuccgacaccuaccaggcccaggccauggucgacaucguccgcgcccucaaguggaacuacgucuccaccgucgccuccgagggcuccuacggcgaguccggcgucgaggccuucauccagaagucccgcgaggacggcggcgucugcaucgcccaguccgucaagaucccccgcgagcccaaggccggcgaguucgacaagaucauccgccgccuccucgagaccuccaacgcccgcgccgucaucaucuucgccaacgaggacgacauccgccgcguccucgaggccgcccgccgcgccaaccagaccggccacuucuucuggaugggcuccgacuccuggggcuccaagaucgcccccguccuccaccucgaggaggucgccgagggcgccgucaccauccuccccaagcgcauguccguccgcggcuucgaccgcuacuucuccucccgcacccucgacaacaaccgccgcaacaucugguucgccgaguucugggaggacaacuuccacugcaagcucucccgccacgcccucaagaagggcucccacgucaagaagugcaccaaccgcgagcgcaucggccaggacuccgccuacgagcaggagggcaagguccaguucgucaucgacgccgucuacgccaugggccacgcccuccacgccaugcaccgcgaccucugccccggccgcgucggccucugcccccgcauggaccccgucgacggcacccagcuccucaaguacauccgcaacgucaacuucuccggcaucgccggcaaccccgucaccuucaacgagaacggcgacgcccccggccgcuacgacaucuaccaguaccagcuccgcaacgacuccgccgaguacaaggucaucggcuccuggaccgaccaccuccaccuccgcaucgagcgcaugcacuggcccggcuccggccagcagcucccccgcuccaucugcucccuccccugccagcccggcgagcgcaagaagaccgucaagggcaugcccugcugcuggcacugcgagcccugcaccggcuaccaguaccaggucgaccgcuacaccugcaagaccugccccuacgacaugcgccccaccgagaaccgcaccggcugccgccccauccccaucaucaagcucgaguggggcucccccugggccguccucccccucuuccucgccgucgucggcaucgccgccacccucuucgucgucaucaccuucguccgcuacaacgacacccccaucgucaaggccuccggccgcgagcucuccuacguccuccucgccggcaucuuccucugcuacgccaccaccuuccucaugaucgccgagcccgaccucggcaccugcucccuccgccgcaucuuccucggccucggcauguccaucuccuacgccgcccuccucaccaagaccaaccgcaucuaccgcaucuucgagcagggcaagcgcuccgucuccgccccccgcuucaucucccccgccucccagcucgccaucaccuucucccucaucucccuccagcuccucggcaucugcgucugguucgucgucgaccccucccacuccgucgucgacuuccaggaccagcgcacccucgacccccgcuucgcccgcggcguccucaagugcgacaucuccgaccucucccucaucugccuccucggcuacuccaugcuccucauggucaccugcaccgucuacgccaucaagacccgcggcguccccgagaccuucaacgaggccaagcccaucggcuucaccauguacaccaccugcaucgucuggcucgccuucauccccaucuucuucggcaccucccaguccgccgacaagcucuacauccagaccaccacccucaccgucuccgucucccucuccgccuccgucucccucggcaugcucuacaugcccaaggucuacaucauccucuuccaccccgagcagaacguccccaagcgcaagcgcucccucaaggccgucgucaccgccgccaccauguccaacaaguucacccagaagggcaacuuccgccccaacggcgaggccaaguccgagcucugcgagaaccucgaggcccccgcccucgccaccaagcagaccuacgucaccuacaccaaccacgccaucuga

SEQ ID NO: 43913 - RNA, 3543 nt, Artificial Sequence
  derived and/or modified sequence opt2 from GRM5__Homo_sapiens__NP_000833
augguccuccuccucauccucuccguccuccuccucaaggaggacguccgcggcuccgcccaguccuccgagcgccgcgucgucgcccacaugcccggcgacaucaucaucggcgcccucuucuccguccaccaccagcccaccgucgacaagguccacgagcgcaagugcggcgccguccgcgagcaguacggcauccagcgcgucgaggccaugcuccacacccucgagcgcaucaacuccgaccccacccuccuccccaacaucacccucggcugcgagauccgcgacuccugcuggcacuccgccgucgcccucgagcaguccaucgaguucauccgcgacucccucaucuccuccgaggaggaggagggccucguccgcugcgucgacggcuccuccuccuccuuccgcuccaagaagcccaucgucggcgucaucggccccggcuccuccuccgucgccauccagguccagaaccuccuccagcucuucaacaucccccagaucgccuacuccgccaccuccauggaccucuccgacaagacccucuucaaguacuucaugcgcgucguccccuccgacgcccagcaggcccgcgccauggucgacaucgucaagcgcuacaacuggaccuacgucuccgccguccacaccgagggcaacuacggcgaguccggcauggaggccuucaaggacauguccgccaaggagggcaucugcaucgcccacuccuacaagaucuacuccaacgccggcgagcaguccuucgacaagcuccucaagaagcucaccucccaccuccccaaggcccgcgucgucgccugcuucugcgagggcaugaccguccgcggccuccucauggccaugcgccgccucggccucgccggcgaguuccuccuccucggcuccgacggcugggccgaccgcuacgacgucaccgacggcuaccagcgcgaggccgucggcggcaucaccaucaagcuccagucccccgacgucaagugguucgacgacuacuaccucaagcuccgccccgagaccaaccaccgcaaccccugguuccaggaguucuggcagcaccgcuuccagugccgccucgagggcuucccccaggagaacuccaaguacaacaagaccugcaacuccucccucacccucaagacccaccacguccaggacuccaagaugggcuucgucaucaacgccaucuacuccauggccuacggccuccacaacaugcagaugucccucugccccggcuacgccggccucugcgacgccaugaagcccaucgacggccgcaagcuccucgagucccucaugaagaccaacuucaccggcgucuccggcgacaccauccucuucgacgagaacggcgacucccccggccgcuacgagaucaugaacuucaaggagaugggcaaggacuacuucgacuacaucaacgucggcuccugggacaacggcgagcucaagauggacgacgacgaggucugguccaagaaguccaacaucauccgcuccgucugcuccgagcccugcgagaagggccagaucaaggucauccgcaagggcgaggucuccugcugcuggaccugcacccccugcaaggagaacgaguacgucuucgacgaguacaccugcaaggccugccagcucggcuccuggcccaccgacgaccucaccggcugcgaccucauccccguccaguaccuccgcuggggcgaccccgagcccaucgccgccgucgucuucgccugccucggccuccucgccacccucuucgucaccgucgucuucaucaucuaccgcgacacccccgucgucaaguccuccucccgcgagcucugcuacaucauccucgccggcaucugccucggcuaccucugcaccuucugccucaucgccaagcccaagcagaucuacugcuaccuccagcgcaucggcaucggccucucccccgccauguccuacuccgcccucgucaccaagaccaaccgcaucgcccgcauccucgccggcuccaagaagaagaucugcaccaagaagccccgcuucauguccgccugcgcccagcucgucaucgccuucauccucaucugcauccagcucggcaucaucgucgcccucuucaucauggagccccccgacaucaugcacgacuaccccuccauccgcgaggucuaccucaucugcaacaccaccaaccucggcgucgucaccccccucggcuacaacggccuccucauccucuccugcaccuucuacgccuucaagacccgcaacguccccgccaacuucaacgaggccaaguacaucgccuucaccauguacaccaccugcaucaucuggcucgccuucguccccaucuacuucggcuccaacuacaagaucaucaccaugugcuucuccgucucccucuccgccaccgucgcccucggcugcauguucguccccaaggucuacaucauccucgccaagcccgagcgcaacguccgcuccgccuucaccaccuccaccgucguccgcaugcacgucggcgacggcaaguccuccuccgccgccucccgcuccuccucccucgucaaccucuggaagcgccgcggcuccuccggcgagacccucuccuccaacggcaaguccgucaccugggcccagaacgagaaguccucccgcggccagcaccucuggcagcgccucuccauccacaucaacaagaaggagaaccccaaccagaccgccgucaucaagcccuuccccaaguccaccgagucccgcggccucggcgccggcgccggcgccggcggcuccgccggcggcgucggcgccaccggcggcgccggcugcgccggcgccggccccggcggccccgagucccccgacgccggccccaaggcccucuacgacgucgccgaggccgaggagcacuuccccgcccccgcccgcccccgcucccccucccccaucuccacccucucccaccgcgccggcuccgccucccgcaccgacgacgacguccccucccuccacuccgagcccgucgcccgcuccuccuccucccagggcucccucauggagcagaucuccuccgucgucacccgcuucaccgccaacaucuccgagcucaacuccaugaugcucuccaccgccgcccccucccccggcgucggcgccccccucugcuccuccuaccucauccccaaggagauccagcuccccaccaccaugaccaccuucgccgagauccagccccuccccgccaucgaggucaccggcggcgcccagcccgccgccggcgcccaggccgccggcgacgccgcccgcgagucccccgccgccggccccgaggccgccgccgccaagcccgaccucgaggagcucgucgcccucaccccccccucccccuuccgcgacuccgucgacuccggcuccaccacccccaacucccccgucuccgaguccgcccucugcauccccuccucccccaaguacgacacccucaucauccgcgacuacacccaguccuccuccucccucuga

SEQ ID NO: 43914 - RNA, 2634 nt, Artificial Sequence
  derived and/or modified sequence opt2 from GRM6__Homo_sapiens__NP_000834
auggcccgcccccgccgcgcccgcgagccccuccucgucgcccuccucccccucgccuggcucgcccaggccggccucgcccgcgccgccggcuccguccgccucgccggcggccucacccucggcggccucuuccccguccacgcccgcggcgccgccggccgcgccugcggccagcucaagaaggagcagggcguccaccgccucgaggccaugcucuacgcccucgaccgcgucaacgccgaccccgagcuccuccccggcguccgccucggcgcccgccuccucgacaccugcucccgcgacaccuacgcccucgagcaggcccucuccuucguccaggcccucauccgcggccgcggcgacggcgacgaggucggcguccgcugccccggcggcguccccccccuccgccccgccccccccgagcgcgucgucgccgucgucggcgccuccgccuccuccgucuccaucauggucgccaacguccuccgccucuucgccaucccccagaucuccuacgccuccaccgcccccgagcucuccgacuccacccgcuacgacuucuucucccgcgucgucccccccgacuccuaccaggcccaggccauggucgacaucguccgcgcccucggcuggaacuacgucuccacccucgccuccgagggcaacuacggcgaguccggcgucgaggccuucguccagaucucccgcgaggccggcggcgucugcaucgcccaguccaucaagaucccccgcgagcccaagcccggcgaguucuccaaggucauccgccgccucauggagacccccaacgcccgcggcaucaucaucuucgccaacgaggacgacauccgccgcguccucgaggccgcccgccaggccaaccucaccggccacuuccucugggucggcuccgacuccuggggcgccaagaccucccccauccucucccucgaggacgucgccgucggcgccaucaccauccuccccaagcgcgccuccaucgacggcuucgaccaguacuucaugacccgcucccucgagaacaaccgccgcaacaucugguucgccgaguucugggaggagaacuucaacugcaagcucaccuccuccggcacccaguccgacgacuccacccgcaagugcaccggcgaggagcgcaucggccgcgacuccaccuacgagcaggagggcaagguccaguucgucaucgacgccgucuacgccaucgcccacgcccuccacuccaugcaccaggcccucugccccggccacaccggccucugccccgccauggagcccaccgacggccgcaugcuccuccaguacauccgcgccguccgcuucaacggcuccgccggcacccccgucauguucaacgagaacggcgacgcccccggccgcuacgacaucuuccaguaccaggccaccaacggcuccgccuccuccggcggcuaccaggccgucggccagugggccgagacccuccgccucgacgucgaggcccuccagugguccggcgacccccacgagguccccuccucccucugcucccuccccugcggccccggcgagcgcaagaagauggucaagggcguccccugcugcuggcacugcgaggccugcgacggcuaccgcuuccaggucgacgaguucaccugcgaggccugccccggcgacaugcgccccacccccaaccacaccggcugccgccccacccccgucguccgccucuccugguccucccccugggccgcccccccccuccuccucgccguccucggcaucgucgccaccaccaccgucgucgccaccuucguccgcuacaacaacacccccaucguccgcgccuccggccgcgagcucuccuacguccuccucaccggcaucuuccucaucuacgccaucaccuuccucauggucgccgagcccggcgccgccgucugcgccgcccgccgccucuuccucggccucggcaccacccucuccuacuccgcccuccucaccaagaccaaccgcaucuaccgcaucuucgagcagggcaagcgcuccgucacccccccccccuucaucucccccaccucccagcucgucaucaccuucucccucaccucccuccaggucgucggcaugaucgccuggcucggcgcccgccccccccacuccgucaucgacuacgaggagcagcgcaccgucgaccccgagcaggcccgcggcguccucaagugcgacauguccgaccucucccucaucggcugccucggcuacucccuccuccucauggucaccugcaccgucuacgccaucaaggcccgcggcguccccgagaccuucaacgaggccaagcccaucggcuucaccauguacaccaccugcaucaucuggcucgccuucguccccaucuucuucggcaccgcccaguccgccgagaagaucuacauccagaccaccacccucaccgucucccucucccucuccgccuccgucucccucggcaugcucuacguccccaagaccuacgucauccucuuccaccccgagcagaacguccagaagcgcaagcgcucccucaaggccaccuccaccgucgccgccccccccaagggcgaggacgccgaggcccacaaguga

SEQ ID NO: 43915 - RNA, 2748 nt, Artificial Sequence
  derived and/or modified sequence opt2 from GRM7__Homo_sapiens__NP_000835
augguccagcuccgcaagcuccuccgcguccucacccucaugaaguuccccugcugcguccucgagguccuccucugcgcccucgccgccgccgcccgcggccaggagauguacgccccccacuccauccgcaucgagggcgacgucacccucggcggccucuuccccguccacgccaagggccccuccggcguccccugcggcgacaucaagcgcgagaacggcauccaccgccucgaggccaugcucuacgcccucgaccagaucaacuccgaccccaaccuccuccccaacgucacccucggcgcccgcauccucgacaccugcucccgcgacaccuacgcccucgagcagucccucaccuucguccaggcccucauccagaaggacaccuccgacguccgcugcaccaacggcgagccccccgucuucgucaagcccgagaaggucgucggcgucaucggcgccuccggcuccuccgucuccaucauggucgccaacauccuccgccucuuccagaucccccagaucuccuacgccuccaccgcccccgagcucuccgacgaccgccgcuacgacuucuucucccgcgucgucccccccgacuccuuccaggcccaggccauggucgacaucgucaaggcccucggcuggaacuacgucuccacccucgccuccgagggcuccuacggcgagaagggcgucgaguccuucacccagaucuccaaggaggccggcggccucugcaucgcccaguccguccgcaucccccaggagcgcaaggaccgcaccaucgacuucgaccgcaucaucaagcagcuccucgacacccccaacucccgcgccgucgucaucuucgccaacgacgaggacaucaagcagauccucgccgccgccaagcgcgccgaccaggucggccacuuccucugggucggcuccgacuccuggggcuccaagaucaacccccuccaccagcacgaggacaucgccgagggcgccaucaccauccagcccaagcgcgccaccgucgagggcuucgacgccuacuucaccucccgcacccucgagaacaaccgccgcaacgucugguucgccgaguacugggaggagaacuucaacugcaagcucaccaucuccggcuccaagaaggaggacaccgaccgcaagugcaccggccaggagcgcaucggcaaggacuccaacuacgagcaggagggcaagguccaguucgucaucgacgccgucuacgccauggcccacgcccuccaccacaugaacaaggaccucugcgccgacuaccgcggcgucugccccgagauggagcaggccggcggcaagaagcuccucaaguacauccgcaacgucaacuucaacggcuccgccggcacccccgucauguucaacaagaacggcgacgcccccggccgcuacgacaucuuccaguaccagaccaccaacaccuccaaccccggcuaccgccucaucggccaguggaccgacgagcuccagcucaacaucgaggacaugcaguggggcaagggcguccgcgagauccccgccuccgucugcacccuccccugcaagcccggccagcgcaagaagacccagaagggcacccccugcugcuggaccugcgagcccugcgacggcuaccaguaccaguucgacgagaugaccugccagcacugccccuacgaccagcgccccaacgagaaccgcaccggcugccaggacauccccaucaucaagcucgaguggcacucccccugggccgucauccccgucuuccucgccaugcucggcaucaucgccaccaucuucgucauggccaccuucauccgcuacaacgacacccccaucguccgcgccuccggccgcgagcucuccuacguccuccucaccggcaucuuccucugcuacaucaucaccuuccucaugaucgccaagcccgacgucgccgucugcuccuuccgccgcgucuuccucggccucggcaugugcaucuccuacgccgcccuccucaccaagaccaaccgcaucuaccgcaucuucgagcagggcaagaaguccgucaccgccccccgccucaucucccccaccucccagcucgccaucaccuccucccucaucuccguccagcuccucggcgucuucaucugguucggcgucgacccccccaacaucaucaucgacuacgacgagcacaagaccaugaaccccgagcaggcccgcggcguccucaagugcgacaucaccgaccuccagaucaucugcucccucggcuacuccauccuccucauggucaccugcaccgucuacgccaucaagacccgcggcguccccgagaacuucaacgaggccaagcccaucggcuucaccauguacaccaccugcaucgucuggcucgccuucauccccaucuucuucggcaccgcccaguccgccgagaagcucuacauccagaccaccacccucaccaucuccaugaaccucuccgccuccgucgcccucggcaugcucuacaugcccaaggucuacaucaucaucuuccaccccgagcucaacguccagaagcgcaagcgcuccuucaaggccgucgucaccgccgccaccauguccucccgccucucccacaagcccuccgaccgccccaacggcgaggccaagaccgagcucugcgagaacgucgaccccaacucccccgccgccaagaagaaguacgucuccuacaacaaccucgucaucuga

SEQ ID NO: 43916 - RNA, 2727 nt, Artificial Sequence
  derived and/or modified sequence opt2 from GRM8__Homo_sapiens__XP_006716001
auggucugcgagggcaagcgcuccgccuccugccccugcuucuuccuccucaccgccaaguucuacuggauccucaccaugaugcagcgcacccacucccaggaguacgcccacuccauccgcgucgacggcgacaucauccucggcggccucuuccccguccacgccaagggcgagcgcggcguccccugcggcgagcucaagaaggagaagggcauccaccgccucgaggccaugcucuacgccaucgaccagaucaacaaggaccccgaccuccucuccaacaucacccucggcguccgcauccucgacaccugcucccgcgacaccuacgcccucgagcagucccucaccuucguccaggcccucaucgagaaggacgccuccgacgucaagugcgccaacggcgacccccccaucuucaccaagcccgacaagaucuccggcgucaucggcgccgccgccuccuccgucuccaucauggucgccaacauccuccgccucuucaagaucccccagaucuccuacgccuccaccgcccccgagcucuccgacaacacccgcuacgacuucuucucccgcgucgucccccccgacuccuaccaggcccaggccauggucgacaucgucaccgcccucggcuggaacuacgucuccacccucgccuccgagggcaacuacggcgaguccggcgucgaggccuucacccagaucucccgcgagaucggcggcgucugcaucgcccagucccagaagaucccccgcgagccccgccccggcgaguucgagaagaucaucaagcgccuccucgagacccccaacgcccgcgccgucaucauguucgccaacgaggacgacauccgccgcauccucgaggccgccaagaagcucaaccaguccggccacuuccucuggaucggcuccgacuccuggggcuccaagaucgcccccgucuaccagcaggaggagaucgccgagggcgccgucaccauccuccccaagcgcgccuccaucgacggcuucgaccgcuacuuccgcucccgcacccucgccaacaaccgccgcaacgucugguucgccgaguucugggaggagaacuucggcugcaagcucggcucccacggcaagcgcaacucccacaucaagaagugcaccggccucgagcgcaucgcccgcgacuccuccuacgagcaggagggcaagguccaguucgucaucgacgccgucuacuccauggccuacgcccuccacaacaugcacaaggaccucugccccggcuacaucggccucugcccccgcauguccaccaucgacggcaaggagcuccucggcuacauccgcgccgucaacuucaacggcuccgccggcacccccgucaccuucaacgagaacggcgacgcccccggccgcuacgacaucuuccaguaccagaucaccaacaaguccaccgaguacaaggucaucggccacuggaccaaccagcuccaccucaaggucgaggacaugcagugggcccaccgcgagcacacccaccccgccuccgucugcucccuccccugcaagcccggcgagcgcaagaagaccgucaagggcguccccugcugcuggcacugcgagcgcugcgagggcuacaacuaccaggucgacgagcucuccugcgagcucugcccccucgaccagcgccccaacaugaaccgcaccggcugccagcucauccccaucaucaagcucgaguggcacucccccugggccgucguccccgucuucgucgccauccucggcaucaucgccaccaccuucgucaucgucaccuucguccgcuacaacgacacccccaucguccgcgccuccggccgcgagcucuccuacguccuccucaccggcaucuuccucugcuacuccaucaccuuccucaugaucgccgcccccgacaccaucaucugcuccuuccgccgcgucuuccucggccucggcaugugcuucuccuacgccgcccuccucaccaagaccaaccgcauccaccgcaucuucgagcagggcaagaaguccgucaccgcccccaaguucaucucccccgccucccagcucgucaucaccuucucccucaucuccguccagcuccucggcgucuucgucugguucgucgucgaccccccccacaucaucaucgacuacggcgagcagcgcacccucgaccccgagaaggcccgcggcguccucaagugcgacaucuccgaccucucccucaucugcucccucggcuacuccauccuccucauggucaccugcaccgucuacgccaucaagacccgcggcguccccgagaccuucaacgaggccaagcccaucggcuucaccauguacaccaccugcaucaucuggcucgccuucauccccaucuucuucggcaccgcccaguccgccgagaagauguacauccagaccaccacccucaccgucuccaugucccucuccgccuccgucucccucggcaugcucuacaugcccaaggucuacaucaucaucuuccaccccgagcagaacguccagaagcgcaagcgcuccuucaaggccgucgucaccgccgccaccaugcaguccaagcucauccagaagggcaacgaccgccccaacggcgaggucaaguccgagcucugcgagucccucgagaccaacaccuccuccaccaagaccaccuacaucuccuacuccaaccacuccaucuga

SEQ ID NO: 43917 - RNA, 1782 nt, Artificial Sequence
  derived and/or modified sequence opt2 from GRN__Homo_sapiens__XP_005257310
auguggacccucgucuccugggucgcccucaccgccggccucgucgccggcacccgcugccccgacggccaguucugccccgucgccugcugccucgaccccggcggcgccuccuacuccugcugccgcccccuccucgacaaguggcccaccacccucucccgccaccucggcggccccugccaggucgacgcccacugcuccgccggccacuccugcaucuucaccgucuccggcaccuccuccugcugccccuuccccgaggccgucgccugcggcgacggccaccacugcugcccccgcggcuuccacugcuccgccgacggccgcuccugcuuccagcgcuccggcaacaacuccgucggcgccauccagugccccgacucccaguucgagugccccgacuucuccaccugcugcgucauggucgacggcuccuggggcugcugccccaugccccaggccuccugcugcgaggaccgcguccacugcugcccccacggcgccuucugcgaccucguccacacccgcugcaucacccccaccggcacccacccccucgccaagaagcuccccgcccagcgcaccaaccgcgccgucgcccucuccuccuccgucaugugccccgacgcccgcucccgcugccccgacggcuccaccugcugcgagcuccccuccggcaaguacggcugcugccccaugcccaacgccaccugcugcuccgaccaccuccacugcugcccccaggacaccgucugcgaccucauccaguccaagugccucuccaaggagaacgccaccaccgaccuccucaccaagcuccccgcccacaccgucggcgacgucaagugcgacauggaggucuccugccccgacggcuacaccugcugccgccuccaguccggcgccuggggcugcugccccuucacccaggccgucugcugcgaggaccacauccacugcugccccgccggcuucaccugcgacacccagaagggcaccugcgagcagggcccccaccagguccccuggauggagaaggcccccgcccaccucucccuccccgacccccaggcccucaagcgcgacguccccugcgacaacgucuccuccugccccuccuccgacaccugcugccagcucaccuccggcgaguggggcugcugccccauccccgaggccgucugcugcuccgaccaccagcacugcugcccccagggcuacaccugcgucgccgagggccagugccagcgcggcuccgagaucgucgccggccucgagaagaugcccgcccgccgcgccucccucucccacccccgcgacaucggcugcgaccagcacaccuccugccccgucggccagaccugcugccccucccucggcggcuccugggccugcugccagcucccccacgccgucugcugcgaggaccgccagcacugcugccccgccggcuacaccugcaacgucaaggcccgcuccugcgagaaggaggucgucuccgcccagcccgccaccuuccucgcccgcuccccccacgucggcgucaaggacgucgagugcggcgagggccacuucugccacgacaaccagaccugcugccgcgacaaccgccagggcugggccugcugccccuaccgccagggcgucugcugcgccgaccgccgccacugcugccccgccggcuuccgcugcgccgcccgcggcaccaagugccuccgccgcgaggccccccgcugggacgccccccuccgcgaccccgcccuccgccagcuccucuga

SEQ ID NO: 43918 - RNA, 654 nt, Artificial Sequence
  derived and/or modified sequence opt2 from GRPEL1__Homo_sapiens__NP_079472
auggccgcccagugcguccgccucgcccgccgcucccuccccgcccucgcccucucccuccgccccuccccccgccuccucugcaccgccaccaagcagaagaacuccggccagaaccucgaggaggacaugggccaguccgagcagaaggccgacccccccgccaccgagaagacccuccucgaggagaaggucaagcucgaggagcagcucaaggagaccgucgagaaguacaagcgcgcccucgccgacaccgagaaccuccgccagcgcucccagaagcucgucgaggaggccaagcucuacggcauccaggccuucugcaaggaccuccucgaggucgccgacguccucgagaaggccacccagugcguccccaaggaggagaucaaggacgacaacccccaccucaagaaccucuacgagggccucgucaugaccgagguccagauccagaaggucuucaccaagcacggccuccucaagcucaaccccgucggcgccaaguucgaccccuacgagcacgaggcccucuuccacacccccgucgagggcaaggagcccggcaccgucgcccucgucuccaaggucggcuacaagcuccacggccgcacccuccgccccgcccucgucggcgucgucaaggaggccuga

SEQ ID NO: 43919 - RNA, 426 nt, Artificial Sequence
  derived and/or modified sequence opt2 from GRP__Homo_sapiens__NP_001012530
augcgcggccgcgagcucccccucguccuccucgcccucguccucugccucgccccccgcggccgcgccgucccccuccccgccggcggcggcaccguccucaccaagauguacccccgcggcaaccacugggccgucggccaccucaugggcaagaaguccaccggcgaguccuccuccgucuccgagcgcggcucccucaagcagcagcuccgcgaguacauccgcugggaggaggccgcccgcaaccuccucggccucaucgaggccaaggagaaccgcaaccaccagcccccccagcccaaggcccucggcaaccagcagcccuccugggacuccgaggacuccuccaacuucaaggacgucggcuccaagggcaagggcucccagcgcgagggccgcaacccccagcucaaccagcaguga

SEQ ID NO: 43920 - RNA, 1155 nt, Artificial Sequence
  derived and/or modified sequence opt2 from GRPR__Homo_sapiens__NP_005305
auggcccucaacgacugcuuccuccucaaccucgaggucgaccacuucaugcacugcaacaucuccucccacuccgccgaccuccccgucaacgacgacuggucccaccccggcauccucuacgucauccccgccgucuacggcgucaucauccucaucggccucaucggcaacaucacccucaucaagaucuucugcaccgucaaguccaugcgcaacguccccaaccucuucaucuccucccucgcccucggcgaccuccuccuccucaucaccugcgcccccgucgacgccucccgcuaccucgccgaccgcuggcucuucggccgcaucggcugcaagcucauccccuucauccagcucaccuccgucggcgucuccgucuucacccucaccgcccucuccgccgaccgcuacaaggccaucguccgccccauggacauccaggccucccacgcccucaugaagaucugccucaaggccgccuucaucuggaucaucuccaugcuccucgccauccccgaggccgucuucuccgaccuccaccccuuccacgaggaguccaccaaccagaccuucaucuccugcgcccccuacccccacuccaacgagcuccaccccaagauccacuccauggccuccuuccucgucuucuacgucaucccccucuccaucaucuccgucuacuacuacuucaucgccaagaaccucauccaguccgccuacaaccuccccgucgagggcaacauccacgucaagaagcagaucgagucccgcaagcgccucgccaagaccguccucgucuucgucggccucuucgccuucugcuggcuccccaaccacgucaucuaccucuaccgcuccuaccacuacuccgaggucgacaccuccaugcuccacuucgucaccuccaucugcgcccgccuccucgccuucaccaacuccugcgucaaccccuucgcccucuaccuccucuccaaguccuuccgcaagcaguucaacacccagcuccucugcugccagcccggccucaucauccgcucccacuccaccggccgcuccaccaccugcaugaccucccucaaguccaccaaccccuccgucgccaccuucucccucaucaacggcaacaucugccacgagcgcuacgucuga

SEQ ID NO: 43921 - RNA, 957 nt, Artificial Sequence
  derived and/or modified sequence opt2 from GRSF1__Homo_sapiens__NP_001091947
auggaggacguccucaacuucuucuccgacugccgcauccgcaacggcgagaacggcauccacuuccuccucaaccgcgacggcaagcgccgcggcgacgcccucaucgagauggaguccgagcaggacguccagaaggcccucgagaagcaccgcauguacaugggccagcgcuacgucgaggucuacgagaucaacaacgaggacgucgacgcccucaugaagucccuccaggucaaguccucccccgucgucaacgacggcgucguccgccuccgcggccuccccuacuccugcaacgagaaggacaucgucgacuucuucgccggccucaacaucgucgacaucaccuucgucauggacuaccgcggccgccgcaagaccggcgaggccuacguccaguucgaggagcccgagauggccaaccaggcccuccucaagcaccgcgaggagaucggcaaccgcuacaucgagaucuuccccucccgccgcaacgagguccgcacccacgucggcuccuacaagggcaagaagaucgccuccuuccccaccgccaaguacaucaccgagcccgagauggucuucgaggagcacgaggucaacgaggacauccagcccaugaccgccuucgaguccgagaaggagaucgagcuccccaaggagguccccgagaagcuccccgaggccgccgacuucggcaccaccuccucccuccacuucguccacaugcgcggccuccccuuccaggccaacgcccaggacaucaucaacuucuucgccccccucaagcccguccgcaucaccauggaguacuccuccuccggcaaggccaccggcgaggccgacguccacuucgagacccacgaggacgccgucgccgccaugcucaaggaccgcucccacguccaccaccgcuacaucgagcucuuccucaacuccugccccaagggcaaguga

SEQ ID NO: 43922 - RNA, 873 nt, Artificial Sequence
  derived and/or modified sequence opt2 from GRXCR1__Homo_sapiens__NP_001073945
augcucaagcgcgagaugaagcccgaguccgaccgcccccgcaagguccgcuuccgcaucgccuccucccacuccggccgcguccucaaggaggucuacgaggacggccagcccuccggcucccucgacuccgagugcgccuccaucugcggcaucgacggccucggcgacuccgacggccagcagaacggccacaucgaguccgagggcgacgagaacgagaacgaccaggacucccuccucguccucgcccgcgccgccuccgagaagggcuucggcacccgccgcgucaacauccucuccaagaacggcaccguccgcggcgucaaguacaaggucuccgccggccaggcccucuucaacaaccucaccaagguccuccagcagcccuccaccgaccucgaguucgaccgcgucgucaucuacaccaccugccuccgcgucguccgcaccaccuucgagcgcugcgagcucguccgcaagaucuuccagaaccaccgcgucaaguucgaggagaagaacaucgcccucaacggcgaguacggcaaggagcucgacgagcgcugccgccgcgucuccgaggcccccucccuccccgucgucuucaucgacggccacuaccucggcggcgccgagaagauccucuccaugaacgaguccggcgagcuccaggacauccucaccaagaucgagcgcguccagcacccccacgagugccccuccugcggcggcuucggcuuccuccccugcuccgucugccacggcuccaagauguccauguuccgcaacugcuucaccgacuccuucaaggcccucaagugcaccgccugcaacgagaacggccuccagcgcugcaagaacugcgccggcuga

SEQ ID NO: 43923 - RNA, 747 nt, Artificial Sequence
  derived and/or modified sequence opt2 from GRXCR2__Homo_sapiens__XP_011535976
auggaggaccccgagaagaagcucaaccagaaguccgacggcaagccccgcaagguccgcuucaagaucuccuccuccuacuccggccgcguccucaagcaggucuucgaggacggccaggagcucgagucccccaaggaggaguacccccacuccuuccuccaggagucccucgagaccauggacggcgucuacggcuccggcgaggucccccgcccccagaugugcucccccaagcucaccgcccagcgcaucuccgucuuccgcgagggcaacgccuacacccucgccggcggccagccccgcuucaacgacuacaaggccaacgaccacaagccccuccccaucaucgacuucggcaagaucaucaucuacaccaacaaccucaagaucauccgcacccccauggacaagcgcgacuucguccgcaagauccuccagaaggaggaggaggccgaggaggagucccucaugaacaaggaggaguccuacggcggccgcgaccagcacgaccgcccccucgucgaggccgaguccacccucccccagaaccgcuacacccaggagggcgacauccccgaggacuccugcuuccacugccgcggcuccggcuccgccaccugcucccucugccacggcuccaaguucuccaugcucgccaaccgcuucaaggaguccuaccgcgcccuccgcugccccgccugcaacgagaacggccuccagcccugccagaucugcaaccaguga

SEQ ID NO: 43924 - RNA, 618 nt, Artificial Sequence
  derived and/or modified sequence opt2 from GSC2__Homo_sapiens__NP_005306
auggccgccgccgccggcggcgccgccucccgccgcggcgccggccgccccugccccuucuccaucgagcacauccucuccucccuccccgagcgcucccuccccgcccgcgccgccugccccccccagcccgccggccgccagucccccgccaagcccgaggagcccggcgcccccgaggccgcccccugcgccugcugcugcugcugcggcccccgcgccgcccccugcggcccccccgaggccgccgccggccucggcgcccgccucgccuggccccuccgccucggccccgccgucccccucucccucggcgcccccgccggcggcuccggcgcccuccccggcgccgucggccccggcucccagcgccgcacccgccgccaccgcaccaucuucuccgaggagcagcuccaggcccucgaggcccucuucguccagaaccaguaccccgacgucuccacccgcgagcgccucgccggccgcauccgccuccgcgaggagcgcgucgaggucugguucaagaaccgccgcgccaaguggcgccaccagaagcgcgccuccgccuccgcccgccuccuccccggcgucaagaagucccccaagggcuccugcuga

SEQ ID NO: 43925 - RNA, 774 nt, Artificial Sequence
  derived and/or modified sequence opt2 from GSC__Homo_sapiens__NP_776248
augcccgccuccauguucuccaucgacaacauccucgccgcccgcccccgcugcaaggacuccguccuccccgucgcccacuccgccgccgcccccgucgucuuccccgcccuccacggcgacucccucuacggcgccuccggcggcgccuccuccgacuacggcgccuucuacccccgccccgucgcccccggcggcgccggccuccccgccgccgucuccggcucccgccucggcuacaacaacuacuucuacggccagcuccacguccaggccgcccccgucggccccgccugcugcggcgccguccccccccucggcgcccagcagugcuccugcguccccaccccccccggcuacgagggccccggcuccguccucgucucccccgucccccaccagaugcuccccuacaugaacgucggcacccucucccgcaccgagcuccagcuccucaaccagcuccacugccgccgcaagcgccgccaccgcaccaucuucaccgacgagcagcucgaggcccucgagaaccucuuccaggagaccaaguaccccgacgucggcacccgcgagcagcucgcccgcaagguccaccuccgcgaggagaaggucgaggucugguucaagaaccgccgcgccaaguggcgccgccagaagcgcuccuccuccgaggaguccgagaacgccgagaaguggaacaagaccuccuccuccaaggccucccccgagaagcgcgaggaggagggcaaguccgaccucgacuccgacuccuga

SEQ ID NO: 43926 - RNA, 1338 nt, Artificial Sequence
  derived and/or modified sequence opt2 from GSDMA__Homo_sapiens__XP_006721895
augaccauguucgagaacgucacccgcgcccucgcccgccagcucaacccccgcggcgaccucaccccccucgacucccucaucgacuucaagcgcuuccaccccuucugccucguccuccgcaagcgcaaguccacccucuucuggggcgcccgcuacguccgcaccgacuacacccuccucgacguccucgagcccggcuccucccccuccgaccccaccgacaccggcaacuucggcuucaagaacaugcucgacacccgcgucgagggcgacgucgacguccccaagaccgucaaggucaagggcaccgccggccucucccagaacuccacccucgagguccagacccucuccgucgcccccaaggcccucgagaccguccaggagcgcaagcucgccgccgaccaccccuuccucaaggagaugcaggaccagggcgagaaccucuacgucgucauggaggucgucgagaccguccaggaggucacccucgagcgcgccggcaaggccgaggccugcuucucccuccccuucuucgccccccucggccuccagggcuccaucaaccacaaggaggccgucaccauccccaagggcugcguccucgccuuccgcguccgccagcucauggucaagggcaaggacgagugggacaucccccacaucugcaacgacaacaugcagaccuucccccccggcgagaaguccggcgaggagaaggucauccucauccaggccuccgacgucggcgacguccacgagggcuuccgcacccucaaggaggagguccagcgcgagacccagcaggucgagaagcucucccgcgucggccaguccucccuccucuccucccucuccaagcuccucggcaagaagaaggagcuccaggaccucgagcucgcccucgagggcgcccucgacaagggccacgaggucacccucgaggcccuccccaaggacguccuccucuccaaggaggccgucggcgccauccucuacuucgucggcgcccucaccgagcucuccgaggcccagcagaagcuccucgucaaguccauggagaagaagauccuccccguccagcucaagcucgucgaguccaccauggagcagaacuuccuccucgacaaggagggcgucuucccccuccagcccgagcuccucuccucccucggcgacgaggagcucacccucaccgaggcccucgucggccucuccggccucgagguccagcgcuccggcccccaguacaugugggaccccgacacccucccccgccucugcgcccucuacgccggccucucccuccuccagcagcucaccaaggccuccuga

SEQ ID NO: 43927 - RNA, 1251 nt, Artificial Sequence
  derived and/or modified sequence opt2 from GSDMB__Homo_sapiens__XP_011523318
auguucuccgucuucgaggagaucacccgcaucgucgucaaggagauggacgccggcggcgacaugaucgccguccgcucccucgucgacgccgaccgcuuccgcugcuuccaccucgucggcgagaagcgcaccuucuucggcugccgccacuacaccaccggccucacccucauggacauccucgacaccgacggcgacaaguggcucgacgagcucgacuccggccuccagggccagaaggccgaguuccagauccucgacaacgucgacuccaccggcgagcucaucguccgccuccccaaggagaucaccaucuccggcuccuuccagggcuuccaccaccagaagaucaagaucuccgagaaccgcaucucccagcaguaccucgccacccucgagaaccgcaagcucaagcgcgagcuccccuucuccuuccgcuccaucaacacccgcgagaaccucuaccucgucaccgagacccucgagaccgucaaggaggagacccucaaguccgaccgccaguacaaguucuggucccagaucucccagggccaccucuccuacaagcacaagggccagcgcgaggucaccaucccccccaaccgcguccucuccuaccgcgucaagcagcucgucuuccccaacaaggagaccaugaacauccacuuccgcggcaagaccaaguccuuccccgaggagaaggacggcgccuccuccugccucggcaagucccucggcuccgaggacucccgcaacaugaaggagaagcucgaggacauggaguccguccucaaggaccucaccgaggagaagcgcaaggacguccucaacucccucgccaagugccucggcaaggaggacauccgccaggaccucgagcagcgcgucuccgagguccucaucuccggcgagcuccacauggaggaccccgacaagccccuccucuccucccucuucaacgccgccggcguccucgucgaggcccgcgccaaggccauccucgacuuccucgacgcccuccucgagcucuccgaggagcagcaguucgucgccgaggcccucgagaagggcacccucccccuccucaaggaccaggucaaguccgucauggagcagaacugggacgagcucgccuccuccccccccgacauggacuacgaccccgaggcccgcauccucugcgcccucuacgucgucgucuccauccuccucgagcucgccgagggccccaccuccgucuccuccuga

SEQ ID NO: 43928 - RNA, 1527 nt, Artificial Sequence
  derived and/or modified sequence opt2 from GSDMC__Homo_sapiens__NP_113603
augcccuccaugcucgagcgcaucuccaagaaccucgucaaggagaucggcuccaaggaccucacccccgucaaguaccuccucuccgccaccaagcuccgccaguucgucauccuccgcaagaagaaggacucccgcuccuccuucugggagcaguccgacuacguccccgucgaguucucccucaacgacauccucgagcccuccuccuccguccucgagaccgucgucaccggccccuuccacuucuccgacaucaugauccagaagcacaaggccgacaugggcgucaacgucggcaucgaggucuccgucuccggcgaggccuccgucgaccacggcugcucccucgaguuccagaucgucaccauccccucccccaaccucgaggacuuccagaagcgcaagcuccucgaccccgagcccuccuuccucaaggagugccgccgccgcggcgacaaccucuacgucgucaccgaggccgucgagcucaucaacaacaccguccucuacgacuccuccuccgucaacauccucggcaagaucgcccucuggaucaccuacggcaagggccagggccagggcgagucccuccgcgucaagaagaaggcccucacccuccagaagggcauggucauggccuacaagcgcaagcagcucgucaucaaggagaaggccauccucaucuccgacgacgacgagcagcgcaccuuccaggacgaguacgagaucuccgagauggucggcuacugcgccgcccgcuccgagggccuccuccccuccuuccacaccaucucccccacccucuucaacgccuccuccaacgacaugaagcucaagcccgagcucuuccucacccagcaguuccucuccggccaccuccccaaguacgagcagguccacauccuccccgucggccgcaucgaggagcccuucuggcagaacuucaagcaccuccaggaggaggucuuccagaagaucaagacccucgcccagcucuccaaggacguccaggacgucauguucuacuccauccucgccaugcuccgcgaccgcggcgcccuccaggaccucaugaacaugcucgagcucgacuccuccggccaccucgacggccccggcggcgccauccucaagaagcuccagcaggacuccaaccacgccugguucaaccccaaggaccccauccucuaccuccucgaggccaucaugguccucuccgacuuccagcacgaccuccucgccugcuccauggagaagcgcauccuccuccagcagcaggagcucguccgcuccauccucgagcccaacuuccgcuaccccugguccauccccuucacccucaagcccgagcuccucgccccccuccaguccgagggccucgccaucaccuacggccuccucgaggagugcggccuccgcauggagcucgacaacccccgcuccaccugggacgucgaggccaagaugccccucuccgcccucuacggcacccucucccuccuccagcagcucgccgaggccuga

SEQ ID NO: 43929 - RNA, 1455 nt, Artificial Sequence
  derived and/or modified sequence opt2 from GSDMD__Homo_sapiens__NP_079012
augggcuccgccuucgagcgcgucguccgccgcgucguccaggagcucgaccacggcggcgaguucauccccgucaccucccuccaguccuccaccggcuuccagcccuacugccucgucguccgcaagcccuccuccuccugguucuggaagccccgcuacaagugcgucaaccucuccaucaaggacauccucgagcccgacgccgccgagcccgacguccagcgcggccgcuccuuccacuucuacgacgccauggacggccagauccagggcuccgucgagcucgccgcccccggccaggccaagaucgccggcggcgccgccgucuccgacuccuccuccaccuccaugaacgucuacucccucuccgucgaccccaacaccuggcagacccuccuccacgagcgccaccuccgccagcccgagcacaagguccuccagcagcuccgcucccgcggcgacaacgucuacgucgucaccgagguccuccagacccagaaggaggucgaggucacccgcacccacaagcgcgagggcuccggccgcuucucccuccccggcgccaccugccuccagggcgagggccagggccaccucucccagaagaagaccgucaccauccccuccggcuccacccucgccuuccgcgucgcccagcucgucaucgacuccgaccucgacguccuccucuuccccgacaagaagcagcgcaccuuccagccccccgccaccggccacaagcgcuccaccuccgagggcgccuggccccagcuccccuccggccucuccaugaugcgcugccuccacaacuuccucaccgacggcguccccgccgagggcgccuucaccgaggacuuccagggccuccgcgccgaggucgagaccaucuccaaggagcucgagcuccucgaccgcgagcucugccagcuccuccucgagggccucgagggcguccuccgcgaccagcucgcccuccgcgcccucgaggaggcccucgagcagggccagucccucggccccgucgagccccucgacggccccgccggcgccguccucgagugccucguccucuccuccggcaugcucguccccgagcucgccauccccgucgucuaccuccucggcgcccucaccaugcucuccgagacccagcacaagcuccucgccgaggcccucgagucccagacccuccucggcccccucgagcucgucggcucccuccucgagcaguccgcccccuggcaggagcgcuccaccaugucccucccccccggccuccucggcaacuccuggggcgagggcgcccccgccuggguccuccucgacgagugcggccucgagcucggcgaggacaccccccacgucugcugggagccccaggcccagggccgcaugugcgcccucuacgccucccucgcccuccucuccggccucucccaggagccccacuga

SEQ ID NO: 43930 - RNA, 3342 nt, Artificial Sequence
  derived and/or modified sequence opt2 from GSE1__Homo_sapiens__NP_001127945
augggccccaucaucgucccccccggcggccacuccguccccuccaccccccccgucgucaccaucgcccccaccaagaccgucaacggcgucuggcgcuccgagucccgccaggacgccggcucccgcuccuccuccggcggccgcgagcgccucaucgucgagcccccccucccccaggagaaggccggcggccccgccauccccucccaccuccucuccacccccuaccccuucggccucucccccuccuccgucguccaggacucccgcuuccccccccucaaccuccagcgccccguccaccacgucgucccccccuccaccgucaccgaggacuaccuccgcuccuuccgccccuaccacaccaccgacgaccuccgcauguccucccuccccccccucggccucgaccccgccaccgccgccgccuacuaccaccccuccuaccucgccccccaccccuucccccaccccgccuuccgcauggacgacuccuacugccucuccgcccuccgcucccccuucuaccccauccccacccccggcucccuccccccccuccaccccuccgccaugcaccuccaccucuccggcguccgcuacccccccgagcucucccacuccucccucgccgcccuccacuccgagcgcauguccggccucuccgccgagcgccuccagauggacgaggagcuccgccgcgagcgcgagcgcgagcgcgagcgcgagcgcgagcgcgaggccgaccgcgagcgcgagaaggagcgcgagcgcgagcgcgagaaggagcgcgagcaggagaaggagcgcgagcgcgagaaggagcgcgagcgcgagcucgagcgccagcgcgagcagcgcgcccgcgagaaggagcuccucgccgccaaggcccucgagcccuccuuccuccccgucgccgagcuccacggccuccgcggccacgccaccgaggagcgcggcaagcccuccgagcagcucacccccacccgcgccgagaagcucaaggacgccggccuccaggcccccaagcccguccagcacccccuccaccccguccccaccccccaccacaccguccccucccucaucuccaaccacggcaucuucucccuccccuccuccuccgccgccaccgcccuccucauccagcgcaccaacgaggaggagaaguggcucgcccgccagcgccgccuccgccaggagaaggaggaccgccagucccaggucuccgaguuccgccagcagguccucgagcagcaccucgacaugggccgcccccccguccccgccgaggccgagcaccgccccgaguccaccacccgccccggccccaaccgccacgagcccggcggccgcgaccccccccagcacuucggcggcccccccccccucaucucccccaagccccagcuccacgccgcccccaccgcccucuggaaccccgucucccucauggacaacacccucgagacccgccgcgccgagucccacucccuccacucccaccccgccgccuucgagcccucccgccaggccgccgucccccucgucaaggucgagcgcgucuucugccccgagaaggccgaggagggcccccgcaagcgcgagcccgccccccucgacaaguaccagcccccccccccccccccccgcgagggcggcucccucgagcaccagcccuuccuccccggccccggccccuuccucgccgagcucgagaaguccacccagaccauccucggccagcagcgcgccucccucccccaggccgccaccuucggcgagcucuccggcccccucaagcccggcucccccuaccgcccccccgucccccgcgcccccgaccccgccuacaucuacgacgaguuccuccagcagcgccgccgccucgucuccaagcucgaccucgaggagcgccgccgccgcgaggcccaggagaagggcuacuacuacgaccucgacgacuccuacgacgaguccgacgaggaggagguccgcgcccaccuccgcugcgucgccgagcagcccccccucaagcucgacaccuccuccgagaagcucgaguuccuccagcucuucggccucaccacccagcagcagaaggaggagcucgucgcccagaagcgccgcaagcgccgccgcaugcuccgcgagcgcucccccuccccccccaccauccaguccaagcgccagacccccuccccccgccucgcccucuccacccgcuacucccccgacgagaugaacaacucccccaacuucgaggagaagaagaaguuccucaccaucuucaaccucacccacaucuccgccgagaagcgcaaggacaaggagcgccucgucgagaugcuccgcgccaugaagcagaaggcccucuccgccgccgucgccgacucccucaccaacuccccccgcgacucccccgccgucucccucuccgagcccgccacccagcaggccucccucgacgucgagaagcccgucggcgucgccgccucccucuccgacauccccaaggccgccgagcccggcaagcucgagcagguccgcccccaggagcucucccgcguccaggagcucgcccccgccuccggcgagaaggcccgccucuccgaggcccccggcggcaagaagucccucuccaugcuccacuacauccgcggcgccgcccccaaggacauccccgucccccucucccacuccaccaacggcaaguccaagcccugggagcccuucgucgccgaggaguucgcccaccaguuccacgaguccguccuccaguccacccagaaggcccuccagaagcacaagggcuccgucgccguccucuccgccgagcagaaccacaaggucgacaccuccguccacuacaacauccccgagcuccaguccuccucccgcgccccccccccccagcacaacggccagcaggagccccccaccgcccgcaagggcccccccacccaggagcucgaccgcgacuccgaggaggaggaggaggaggacgacgaggacggcgaggacgaggaggagguccccaagcgcaaguggcagggcaucgaggccgucuucgaggccuaccaggagcacaucgaggagcagaaccucgagcgccagguccuccagacccagugccgccgccucgaggcccgccacuacucccucucccucaccgccgagcagcucucccacuccgucgccgagcuccgcucccagaagcagaagauggucuccgagcgcgagcgccuccaggccgagcucgaccaccuccgcaagugccucgcccuccccgccaugcacuggccccgcggcuaccucaagggcuacccccgcuga

SEQ ID NO: 43931 - RNA, 996 nt, Artificial Sequence
  derived and/or modified sequence opt2 from GSG1L__Homo_sapiens__NP_001103233
augaagaccucccgccgcggccgcgcccuccucgccgucgcccucaaccuccucgcccuccucuucgccaccaccgccuuccucaccacccacuggugccagggcacccagcgcguccccaagcccggcugcggccagggcggccgcgccaacugccccaacuccggcgccaacgccaccgccaacggcaccgccgcccccgccgccgccgccgccgccgccaccgccuccggcaacggcccccccggcggcgcccucuacuccugggagaccggcgacgaccgcuuccucuuccgcaacuuccacaccggcaucugguacuccugcgaggaggagcucuccggccucggcgagaagugccgcuccuucaucgaccucgcccccgccuccgagaagggcguccucuggcucuccgucgucuccgagguccucuacauccuccuccucgucgucggcuucucccucaugugccucgagcucuuccacuccuccaacgucaucgacggccucaagcucaacgccuucgccgccgucuucaccguccucuccggccuccucggcauggucgcccacaugauguacacccaggucuuccaggucaccgucucccucggccccgaggacuggcgcccccacuccugggacuacggcugguccuucugccucgccuggggcuccuucaccugcugcauggccgccuccgucaccacccucaacuccuacaccaagaccgucaucgaguuccgccacaagcgcaaggucuucgagcagggcuaccgcgaggagcccaccuucaucgaccccgaggccaucaaguacuuccgcgagcgcauggagaagcgcgacggcuccgaggaggacuuccaccucgacugccgccacgagcgcuaccccgcccgccaccagccccacauggccgacuccuggccccgcuccuccgcccaggaggcccccgagcucaaccgccagugcuggguccucggccacugggucuga

SEQ ID NO: 43932 - RNA, 1452 nt, Artificial Sequence
  derived and/or modified sequence opt2 from GSK3A__Homo_sapiens__NP_063937
auguccggcggcggccccuccggcggcggccccggcggcuccggccgcgcccgcaccuccuccuucgccgagcccggcggcggcggcggcggcggcggcggcggccccggcggcuccgccuccggccccggcggcaccggcggcggcaaggccuccgucggcgccaugggcggcggcgucggcgccuccuccuccggcggcggccccggcggcuccggcggcggcggcuccggcggccccggcgccggcaccuccuuccccccccccggcgucaagcucggccgcgacuccggcaaggucaccaccgucgucgccacccucggccagggccccgagcgcucccaggaggucgccuacaccgacaucaaggucaucggcaacggcuccuucggcgucgucuaccaggcccgccucgccgagacccgcgagcucgucgccaucaagaagguccuccaggacaagcgcuucaagaaccgcgagcuccagaucaugcgcaagcucgaccacugcaacaucguccgccuccgcuacuucuucuacuccuccggcgagaagaaggacgagcucuaccucaaccucguccucgaguacguccccgagaccgucuaccgcgucgcccgccacuucaccaaggccaagcucaccauccccauccucuacgucaaggucuacauguaccagcucuuccgcucccucgccuacauccacucccagggcgucugccaccgcgacaucaagccccagaaccuccucgucgaccccgacaccgccguccucaagcucugcgacuucggcuccgccaagcagcucguccgcggcgagcccaacgucuccuacaucugcucccgcuacuaccgcgcccccgagcucaucuucggcgccaccgacuacaccuccuccaucgacgucugguccgccggcugcguccucgccgagcuccuccucggccagcccaucuuccccggcgacuccggcgucgaccagcucgucgagaucaucaagguccucggcacccccacccgcgagcagauccgcgagaugaaccccaacuacaccgaguucaaguucccccagaucaaggcccaccccuggaccaaggucuucaagucccgcaccccccccgaggccaucgcccucugcuccucccuccucgaguacacccccuccucccgccucuccccccucgaggccugcgcccacuccuucuucgacgagcuccgcugccucggcacccagcuccccaacaaccgcccccuccccccccucuucaacuucuccgccggcgagcucuccauccagcccucccucaacgccauccucauccccccccaccuccgcucccccgccggcaccaccacccucacccccuccucccaggcccucaccgagacccccaccuccuccgacuggcaguccaccgacgccacccccacccucaccaacuccuccuga

SEQ ID NO: 43933 - RNA, 1263 nt, Artificial Sequence
  derived and/or modified sequence opt2 from GSK3B__Homo_sapiens__NP_001139628
auguccggccgcccccgcaccaccuccuucgccgaguccugcaagcccguccagcagcccuccgccuucggcuccaugaaggucucccgcgacaaggacggcuccaaggucaccaccgucgucgccacccccggccagggccccgaccgcccccaggaggucuccuacaccgacaccaaggucaucggcaacggcuccuucggcgucgucuaccaggccaagcucugcgacuccggcgagcucgucgccaucaagaagguccuccaggacaagcgcuucaagaaccgcgagcuccagaucaugcgcaagcucgaccacugcaacaucguccgccuccgcuacuucuucuacuccuccggcgagaagaaggacgaggucuaccucaaccucguccucgacuacguccccgagaccgucuaccgcgucgcccgccacuacucccgcgccaagcagacccuccccgucaucuacgucaagcucuacauguaccagcucuuccgcucccucgccuacauccacuccuucggcaucugccaccgcgacaucaagccccagaaccuccuccucgaccccgacaccgccguccucaagcucugcgacuucggcuccgccaagcagcucguccgcggcgagcccaacgucuccuacaucugcucccgcuacuaccgcgcccccgagcucaucuucggcgccaccgacuacaccuccuccaucgacgucugguccgccggcugcguccucgccgagcuccuccucggccagcccaucuuccccggcgacuccggcgucgaccagcucgucgagaucaucaagguccucggcacccccacccgcgagcagauccgcgagaugaaccccaacuacaccgaguucaaguucccccagaucaaggcccaccccuggaccaaggucuuccgcccccgcaccccccccgaggccaucgcccucugcucccgccuccucgaguacacccccaccgcccgccucaccccccucgaggccugcgcccacuccuucuucgacgagcuccgcgaccccaacgucaagcuccccaacggccgcgacacccccgcccucuucaacuucaccacccaggagcucuccuccaaccccccccucgccaccauccucauccccccccacgcccgcauccaggccgccgccuccacccccaccaacgccaccgccgccuccgacgccaacaccggcgaccgcggccagaccaacaacgccgccuccgccuccgccuccaacuccaccuga

SEQ ID NO: 43934 - RNA, 2349 nt, Artificial Sequence
  derived and/or modified sequence opt2 from GSN__Homo_sapiens__NP_000168
auggccccccaccgccccgcccccgcccuccucugcgcccucucccucgcccucugcgcccucucccuccccguccgcgccgccaccgccucccgcggcgccucccaggccggcgccccccagggccgcguccccgaggcccgccccaacuccauggucgucgagcaccccgaguuccucaaggccggcaaggagcccggccuccagaucuggcgcgucgagaaguucgaccucguccccguccccaccaaccucuacggcgacuucuucaccggcgacgccuacgucauccucaagaccguccagcuccgcaacggcaaccuccaguacgaccuccacuacuggcucggcaacgagugcucccaggacgaguccggcgccgccgccaucuucaccguccagcucgacgacuaccucaacggccgcgccguccagcaccgcgagguccagggcuucgaguccgccaccuuccucggcuacuucaaguccggccucaaguacaagaagggcggcgucgccuccggcuucaagcacgucguccccaacgaggucgucguccagcgccucuuccaggucaagggccgccgcgucguccgcgccaccgagguccccgucuccugggaguccuucaacaacggcgacugcuucauccucgaccucggcaacaacauccaccaguggugcggcuccaacuccaaccgcuacgagcgccucaaggccacccaggucuccaagggcauccgcgacaacgagcgcuccggccgcgcccgcguccacgucuccgaggagggcaccgagcccgaggccaugcuccagguccucggccccaagcccgcccuccccgccggcaccgaggacaccgccaaggaggacgccgccaaccgcaagcucgccaagcucuacaaggucuccaacggcgccggcaccauguccgucucccucgucgccgacgagaaccccuucgcccagggcgcccucaaguccgaggacugcuucauccucgaccacggcaaggacggcaagaucuucgucuggaagggcaagcaggccaacaccgaggagcgcaaggccgcccucaagaccgccuccgacuucaucaccaagauggacuaccccaagcagacccaggucuccguccuccccgagggcggcgagaccccccucuucaagcaguucuucaagaacuggcgcgaccccgaccagaccgacggccucggccucuccuaccucuccucccacaucgccaacgucgagcgcguccccuucgacgccgccacccuccacaccuccaccgccauggccgcccagcacggcauggacgacgacggcaccggccagaagcagaucuggcgcaucgagggcuccaacaagguccccgucgaccccgccaccuacggccaguucuacggcggcgacuccuacaucauccucuacaacuaccgccacggcggccgccagggccagaucaucuacaacuggcagggcgcccaguccacccaggacgaggucgccgccuccgccauccucaccgcccagcucgacgaggagcucggcggcacccccguccagucccgcgucguccagggcaaggagcccgcccaccucaugucccucuucggcggcaagcccaugaucaucuacaagggcggcaccucccgcgagggcggccagaccgcccccgccuccacccgccucuuccagguccgcgccaacuccgccggcgccacccgcgccgucgagguccuccccaaggccggcgcccucaacuccaacgacgccuucguccucaagacccccuccgccgccuaccucugggucggcaccggcgccuccgaggccgagaagaccggcgcccaggagcuccuccgcguccuccgcgcccagcccguccaggucgccgagggcuccgagcccgacggcuucugggaggcccucggcggcaaggccgccuaccgcaccuccccccgccucaaggacaagaagauggacgcccaccccccccgccucuucgccugcuccaacaagaucggccgcuucgucaucgaggagguccccggcgagcucaugcaggaggaccucgccaccgacgacgucaugcuccucgacaccugggaccaggucuucgucugggucggcaaggacucccaggaggaggagaagaccgaggcccucaccuccgccaagcgcuacaucgagaccgaccccgccaaccgcgaccgccgcacccccaucaccgucgucaagcagggcuucgagccccccuccuucgucggcugguuccucggcugggacgacgacuacugguccgucgacccccucgaccgcgccauggccgagcucgccgccuga

SEQ ID NO: 43935 - RNA, 1911 nt, Artificial Sequence
  derived and/or modified sequence opt2 from GSPT1__Homo_sapiens__NP_001123478
auggaccccggcuccggcggcggcggcggcggcggcggcggcggcggcuccuccuccggcuccuccuccuccgacuccgcccccgacugcugggaccaggccgacauggaggcccccggccccggccccugcggcggcggcggcucccucgccgccgccgccgaggcccagcgcgagaaccucuccgccgccuucucccgccagcucaacgucaacgccaagcccuucguccccaacguccacgccgccgaguucguccccuccuuccuccgcggccccgccgccccccccccccccgccggcggcgccgccaacaaccacggcgccggcuccggcgccggcggccgcgccgcccccgucgaguccucccaggaggagcagucccucugcgagggcuccaacuccgccgucuccauggagcucuccgagcccaucgagaacggcgagaccgagaugucccccgaggaguccugggagcacaaggaggagaucuccgaggccgagcccggcggcggcucccucggcgacggccgcccccccgaggaguccgcccacgagaugauggaggaggaggaggagauccccaagcccaaguccgucgucgccccccccggcgcccccaagaaggagcacgucaacgucgucuucaucggccacgucgacgccggcaaguccaccaucggcggccagaucauguaccucaccggcauggucgacaagcgcacccucgagaaguacgagcgcgaggccaaggagaagaaccgcgagaccugguaccucuccugggcccucgacaccaaccaggaggagcgcgacaagggcaagaccgucgaggucggccgcgccuacuucgagaccgagaagaagcacuucaccauccucgacgcccccggccacaaguccuucguccccaacaugaucggcggcgccucccaggccgaccucgccguccucgucaucuccgcccgcaagggcgaguucgagaccggcuucgagaagggcggccagacccgcgagcacgccaugcucgccaagaccgccggcgucaagcaccucaucguccucaucaacaagauggacgaccccaccgucaacugguccaacgagcgcuacgaggagugcaaggagaagcucguccccuuccucaagaaggucggcuucaaccccaagaaggacauccacuucaugcccugcuccggccucaccggcgccaaccucaaggagcaguccgacuucugccccugguacaucggccuccccuucauccccuaccucgacaaccuccccaacuucaaccgcuccgucgacggccccauccgccuccccaucgucgacaaguacaaggacaugggcaccgucguccucggcaagcucgaguccggcuccaucugcaagggccagcagcucgucaugaugcccaacaagcacaacgucgagguccucggcauccucuccgacgacgucgagaccgacaccgucgcccccggcgagaaccucaagauccgccucaagggcaucgaggaggaggagauccuccccggcuucauccucugcgaccccaacaaccucugccacuccggccgcaccuucgacgcccagaucgucaucaucgagcacaaguccaucaucugccccggcuacaacgccguccuccacauccacaccugcaucgaggaggucgagaucaccgcccucaucugccucgucgacaagaaguccggcgagaaguccaagacccgcccccgcuucgucaagcaggaccaggucugcaucgcccgccuccgcaccgccggcaccaucugccucgagaccuucaaggacuucccccagaugggccgcuucacccuccgcgacgagggcaagaccaucgccaucggcaagguccucaagcucguccccgagaaggacuga

SEQ ID NO: 43936 - RNA, 1887 nt, Artificial Sequence
  derived and/or modified sequence opt2 from GSPT2__Homo_sapiens__NP_060564
auggacuccggcuccuccuccuccgacuccgcccccgacugcugggaccaggucgacauggagucccccggcuccgcccccuccggcgacggcgucuccuccgccgucgccgaggcccagcgcgagccccucuccuccgccuucucccgcaagcucaacgucaacgccaagcccuucguccccaacguccacgccgccgaguucguccccuccuuccuccgcggccccacccagccccccacccuccccgccggcuccggcuccaacgacgagaccugcaccggcgccggcuacccccagggcaagcgcaugggccgcggcgcccccgucgagcccucccgcgaggagccccucgucucccucgagggcuccaacuccgccgucaccauggagcucuccgagcccgucgucgagaacggcgaggucgagauggcccucgaggaguccugggagcacuccaaggaggucuccgaggccgagcccggcggcggcuccuccggcgacuccggcccccccgaggaguccggccaggagaugauggaggagaaggaggagauccgcaaguccaaguccgucaucguccccuccggcgcccccaagaaggagcacgucaacgucgucuucaucggccacgucgacgccggcaaguccaccaucggcggccagaucauguuccucaccggcauggucgacaagcgcacccucgagaaguacgagcgcgaggccaaggagaagaaccgcgagaccugguaccucuccugggcccucgacaccaaccaggaggagcgcgacaagggcaagaccgucgaggucggccgcgccuacuucgagaccgagcgcaagcacuucaccauccucgacgcccccggccacaaguccuucguccccaacaugaucggcggcgccucccaggccgaccucgccguccucgucaucuccgcccgcaagggcgaguucgagaccggcuucgagaagggcggccagacccgcgagcacgccaugcucgccaagaccgccggcgucaagcaccucaucguccucaucaacaagauggacgaccccaccgucaacugguccaucgagcgcuacgaggagugcaaggagaagcucguccccuuccucaagaaggucggcuucucccccaagaaggacauccacuucaugcccugcuccggccucaccggcgccaacaucaaggagcaguccgacuucugccccugguacaccggccuccccuucauccccuaccucgacaaccuccccaacuucaaccgcuccaucgacggccccauccgccuccccaucgucgacaaguacaaggacaugggcaccgucguccucggcaagcucgaguccggcuccaucuucaagggccagcagcucgucaugaugcccaacaagcacaacgucgagguccucggcauccucuccgacgacaccgagaccgacuucgucgcccccggcgagaaccucaagauccgccucaagggcaucgaggaggaggagauccuccccggcuucauccucugcgaccccuccaaccucugccacuccggccgcaccuucgacguccagaucgucaucaucgagcacaaguccaucaucugccccggcuacaacgccguccuccacauccacaccugcaucgaggaggucgagaucaccgcccucaucucccucgucgacaagaaguccggcgagaaguccaagacccgcccccgcuucgucaagcaggaccaggucugcaucgcccgccuccgcaccgccggcaccaucugccucgagaccuucaaggacuucccccagaugggccgcuucacccuccgcgacgagggcaagaccaucgccaucggcaagguccucaagcucguccccgagaaggacuga

SEQ ID NO: 43937 - RNA, 1569 nt, Artificial Sequence
  derived and/or modified sequence opt2 from GSR__Homo_sapiens__NP_000628
auggcccuccucccccgcgcccucuccgccggcgccggccccuccuggcgccgcgccgcccgcgccuuccgcggcuuccuccuccuccuccccgagcccgccgcccucacccgcgcccucucccgcgccauggccugccgccaggagccccagccccagggccccccccccgccgccggcgccgucgccuccuacgacuaccucgucaucggcggcggcuccggcggccucgccuccgcccgccgcgccgccgagcucggcgcccgcgccgccgucgucgagucccacaagcucggcggcaccugcgucaacgucggcugcguccccaagaaggucauguggaacaccgccguccacuccgaguucaugcacgaccacgccgacuacggcuuccccuccugcgagggcaaguucaacuggcgcgucaucaaggagaagcgcgacgccuacgucucccgccucaacgccaucuaccagaacaaccucaccaagucccacaucgagaucauccgcggccacgccgccuucaccuccgaccccaagcccaccaucgaggucuccggcaagaaguacaccgccccccacauccucaucgccaccggcggcaugcccuccaccccccacgagucccagauccccggcgccucccucggcaucaccuccgacggcuucuuccagcucgaggagcuccccggccgcuccgucaucgucggcgccggcuacaucgccgucgagauggccggcauccucuccgcccucggcuccaagaccucccucaugauccgccacgacaagguccuccgcuccuucgacuccaugaucuccaccaacugcaccgaggagcucgagaacgccggcgucgagguccucaaguucucccaggucaaggaggucaagaagacccucuccggccucgaggucuccauggucaccgccguccccggccgccuccccgucaugaccaugauccccgacgucgacugccuccucugggccaucggccgcguccccaacaccaaggaccucucccucaacaagcucggcauccagaccgacgacaagggccacaucaucgucgacgaguuccagaacaccaacgucaagggcaucuacgccgucggcgacgucugcggcaaggcccuccucacccccgucgccaucgccgccggccgcaagcucgcccaccgccucuucgaguacaaggaggacuccaagcucgacuacaacaacauccccaccgucgucuucucccacccccccaucggcaccgucggccucaccgaggacgaggccauccacaaguacggcaucgagaacgucaagaccuacuccaccuccuucacccccauguaccacgccgucaccaagcgcaagaccaagugcgucaugaagauggucugcgccaacaaggaggagaaggucgucggcauccacaugcagggccucggcugcgacgagaugcuccagggcuucgccgucgccgucaagaugggcgccaccaaggccgacuucgacaacaccgucgccauccaccccaccuccuccgaggagcucgucacccuccgcuga

SEQ ID NO: 43938 - RNA, 1425 nt, Artificial Sequence
  derived and/or modified sequence opt2 from GSS__Homo_sapiens__XP_011527098
auggccaccaacuggggcucccuccuccaggacaagcagcagcucgaggagcucgcccgccaggccgucgaccgcgcccucgccgagggcguccuccuccgcaccucccaggagcccaccuccuccgaggucgucuccuacgcccccuucacccucuuccccucccucguccccuccgcccuccucgagcaggccuacgccguccagauggacuucaaccuccucgucgacgccgucucccagaacgccgccuuccucgagcagacccucuccuccaccaucaagcaggacgacuucaccgcccgccucuucgacauccacaagcagguccucaaggagggcaucgcccagaccgucuuccucggccucaaccgcuccgacuacauguuccagcgcuccgccgacggcucccccgcccucaagcagaucgagaucaacaccaucuccgccuccuucggcggccucgccucccgcacccccgccguccaccgccacguccucuccguccucuccaagaccaaggaggccggcaagauccucuccaacaaccccuccaagggccucgcccucggcaucgccaaggccugggagcucuacggcucccccaacgcccucguccuccucaucgcccaggagaaggagcgcaacaucuucgaccagcgcgccaucgagaacgagcuccucgcccgcaacauccacgucauccgccgcaccuucgaggacaucuccgagaagggcucccucgaccaggaccgccgccucuucgucgacggccaggagaucgccgucgucuacuuccgcgacggcuacaugccccgccaguacucccuccagaacugggaggcccgccuccuccucgagcgcucccacgccgccaagugccccgacaucgccacccagcucgccggcaccaagaagguccagcaggagcucucccgccccggcaugcucgagaugcuccuccccggccagcccgaggccgucgcccgccuccgcgccaccuucgccggccucuacucccucgacgucggcgaggagggcgaccaggccaucgccgaggcccucgccgcccccucccgcuucguccucaagccccagcgcgagggcggcggcaacaaccucuacggcgaggagaugguccaggcccucaagcagcucaaggacuccgaggagcgcgccuccuacauccucauggagaagaucgagcccgagcccuucgagaacugccuccuccgccccggcucccccgcccgcgucguccagugcaucuccgagcucggcaucuucggcgucuacguccgccaggagaagacccucgucaugaacaagcacgucggccaccuccuccgcaccaaggccaucgagcacgccgacggcggcgucgccgccggcgucgccguccucgacaaccccuaccccgucuga

SEQ ID NO: 43939 - RNA, 669 nt, Artificial Sequence
  derived and/or modified sequence opt2 from GSTA1__Homo_sapiens__NP_665683
auggccgagaagcccaagcuccacuacuucaacgcccgcggccgcauggaguccacccgcuggcuccucgccgccgccggcgucgaguucgaggagaaguucaucaaguccgccgaggaccucgacaagcuccgcaacgacggcuaccucauguuccagcagguccccauggucgagaucgacggcaugaagcucguccagacccgcgccauccucaacuacaucgccuccaaguacaaccucuacggcaaggacaucaaggagcgcgcccucaucgacauguacaucgagggcaucgccgaccucggcgagaugauccuccuccuccccgucugcccccccgaggagaaggacgccaagcucgcccucaucaaggagaagaucaagaaccgcuacuuccccgccuucgagaagguccucaagucccacggccaggacuaccucgucggcaacaagcucucccgcgccgacauccaccucgucgagcuccucuacuacgucgaggagcucgacuccucccucaucuccuccuucccccuccucaaggcccucaagacccgcaucuccaaccuccccaccgucaagaaguuccuccagcccggcuccccccgcaagccccccauggacgagaagucccucgaggaggcccgcaagaucuuccgcuucuga

SEQ ID NO: 43940 - RNA, 669 nt, Artificial Sequence
  derived and/or modified sequence opt2 from GSTA2__Homo_sapiens__XP_011512834
auggccgagaagcccaagcuccacuacuccaacauccgcggccgcauggaguccauccgcuggcuccucgccgccgccggcgucgaguucgaggagaaguucaucaaguccgccgaggaccucgacaagcuccgcaacgacggcuaccucauguuccagcagguccccauggucgagaucgacggcaugaagcucguccagacccgcgccauccucaacuacaucgccuccaaguacaaccucuacggcaaggacaucaaggagaaggcccucaucgacauguacaucgagggcaucgccgaccucggcgagaugauccuccuccuccccuucucccagcccgaggagcaggacgccaagcucgcccucauccaggagaagaccaagaaccgcuacuuccccgccuucgagaagguccucaagucccacggccaggacuaccucgucggcaacaagcucucccgcgccgacauccaccucgucgagcuccucuacuacgucgaggagcucgacuccucccucaucuccuccuucccccuccucaaggcccucaagacccgcaucuccaaccuccccaccgucaagaaguuccuccagcccggcuccccccgcaagccccccauggacgagaagucccucgaggagucccgcaagaucuuccgcuucuga

SEQ ID NO: 43941 - RNA, 669 nt, Artificial Sequence
  derived and/or modified sequence opt2 from GSTA4__Homo_sapiens__XP_005249092
auggccgcccgccccaagcuccacuaccccaacggccgcggccgcauggaguccguccgcuggguccucgccgccgccggcgucgaguucgacgaggaguuccucgagaccaaggagcagcucuacaagcuccaggacggcaaccaccuccucuuccagcagguccccauggucgagaucgacggcaugaagcucguccagacccgcuccauccuccacuacaucgccgacaagcacaaccucuucggcaagaaccucaaggagcgcacccucaucgacauguacgucgagggcacccucgaccuccucgagcuccucaucaugcaccccuuccucaagcccgacgaccagcagaaggaggucgucaacauggcccagaaggccaucauccgcuacuuccccgucuucgagaagauccuccgcggccacggccaguccuuccucgucggcaaccagcucucccucgccgacgucauccuccuccagaccauccucgcccucgaggagaagauccccaacauccucuccgccuuccccuuccuccaggaguacaccgucaagcucuccaacauccccaccaucaagcgcuuccucgagcccggcuccaagaagaagcccccccccgacgagaucuacguccgcaccgucuacaacaucuuccgccccuga

SEQ ID NO: 43942 - RNA, 669 nt, Artificial Sequence
  derived and/or modified sequence opt2 from GSTA5__Homo_sapiens__NP_714543
auggccgagaagcccaagcuccacuacuccaacgcccgcggcuccauggaguccauccgcuggcuccucgccgccgccggcgucgagcucgaggagaaguuccucgaguccgccgaggaccucgacaagcuccgcaacgacggcucccuccucuuccagcagguccccauggucgagaucgacggcaugaagcucguccagacccgcgccauccucaacuacaucgccuccaaguacaaccucuacggcaaggacaugaaggagcgcgcccucaucgacauguacaccgagggcaucgucgaccucaccgagaugauccuccuccuccucaucugccagcccgaggagcgcgacgccaagaccgcccucgucaaggagaagaucaagaaccgcuacuuccccgccuucgagaagguccucaagucccaccgccaggacuaccucgucggcaacaagcucuccugggccgacauccaccucgucgagcucuucuacuacgucgaggagcucgacuccucccucaucuccuccuucccccuccucaaggcccucaagacccgcaucuccaaccuccccaccgucaagaaguuccuccagcccggcucccagcgcaagccccccauggacgagaagucccucgaggaggcccgcaagaucuuccgcuucuga

SEQ ID NO: 43943 - RNA, 1902 nt, Artificial Sequence
  derived and/or modified sequence opt2 from GSTCD__Homo_sapiens__NP_001026890
augaaggccaucaagaagucccucaccgaggaggaguaccucuaccucgacuucucccaccagaccgagggcugcaucuucccccuccacaccuccgucacccucuuccuccucuccuacugcgacugcaagaucuucaagaucugccucgucgucaccaaggaggucucccgcgacuccucccuccuccgcgacgaccucauccaggacgucgagauccagaucaucucccgccaggagcucccccccaucguccagaacugcugccuccccgccgucgucgagcgcuccgacaacuucugccgcgccggccucgccgucguccuccgccacaucauccagaaguccuacgaggccgacccccucaagaaggagcuccucgagcuccucggcuucaagaagaccugccucaaggccugcgccgaggucucccaguggacccgccucugcgagcucaccaucccccucgccaucgagaacuuccuccgcgaguccuccgaccagccccccaccauccccgucgagauccuccagcucgagaagaagcucuccgagcccguccgcguccacaacgacgacaagcuccgccgccagaagcucaagcagcagaaggccgacggcgucggccccccccucaccaagggcaaggccaaguccaagguccacacccaggagaccuccgagggccucgacuccuccuccaagucccucgagcucaaggucgccuucuccaagcucaccguccaggaggagcccgccaccaccaaccgcgagcccucccacauccgcaaggccaaggccuccgaccuccccccccucgagcacgucuucgccgagggccucuacuucacccucgccgacaucguccuccuccccugcauccaccacuuccucgucaucaucucccgcaaguucuccgagaagcucgucgaguucccccuccucgccuccugguaccagcgcauccaggagguccccggcgucaagaccgccgccuccaagugcggcauccaguuccuccaccuccccaagcuccucaccaccuccaccgagcagcaccccaaccucugcgagguccccggcgucgaggagcaguccgacccccucuucaucggcggcccccgccccaccauggccaagcucauggagaagggcaucgaggucauguucuccccccaccccugccccaccuggacccucgacuggaacguccuccccgccgccgucucccccaaggagggcaagauguccuccgaccgcgcccuccgcaagcagcagcagcucaacaaccucgucuacgucgucaccaaccaggccaagcccggcgaccgcaucgucgacuucugcuccggcggcggccacgucggcaucguccucgcccacaugcuccccuccugccaggucacccucaucgagaacaaggagcucucccucauccgcgccaagaagcgcuccgacgagcucggccucuccaacaucugguucauccaggccaacauggaguacuucaccggcauguucaacaucggcgucgcccuccacgccugcggcgucgccaccgacauggucaucgagcacugcaucaagacccgcgccuccuucgucaccugccccugcugcuacggcuucauccagaacaccuccaaguucaacuuccccaaguccgagcaguucaagaagacccucuccuacaaggagcacaugauccucugccgcuucgccgaccagaccgccguccagcuccccccccagcgccgccucaucggcaagcagugcaugugccucgucgaccucgaccgcgcccgcgccgccgaggagugcggcuacuccguccaggucaucuccauggagcccgaguccugcucccccaagaacaacaugaucgucggcguccccaucuga

SEQ ID NO: 43944 - RNA, 849 nt, Artificial Sequence
  derived and/or modified sequence opt2 from GSTK1__Homo_sapiens__NP_001137151
augggcccccucccccgcaccgucgagcucuucuacgacguccucucccccuacuccuggcucggcuucgagauccucugccgcuaccagaacaucuggaacaucaaccuccagcuccgccccucccucaucaccggcaucaugaaggacuccggcaacaagccccccggccuccucccccgcaagggccucuacauggccaacgaccucaagcuccuccgccaccaccuccagauccccauccacuuccccaaggacuuccucuccgucaugcucgagaagggcucccucuccgccaugcgcuuccucaccgccgucaaccucgagcaccccgagaugcucgagaaggccucccgcgagcucuggaugcgcgucuggucccgcgucuccgucggccucugggaguccuccggccgcacccucgacgacuuccucaccuucccccgccacgucuuccgcgucaugauccuccccccccccggcggcuccaccguccuccccgucaccccccucuccccccaccgccuccccgccgucuucuccuccucccagaacgaggacaucaccgagccccaguccauccucgccgccgccgagaaggccggcauguccgccgagcaggcccagggccuccucgagaagaucgccacccccaaggucaagaaccagcucaaggagaccaccgaggccgccugccgcuacggcgccuucggccuccccaucaccgucgcccacgucgacggccagacccacaugcucuucggcuccgaccgcauggagcuccucgcccaccuccucggcgagaaguggaugggccccaucccccccgccgucaacgcccgccucuga

SEQ ID NO: 43945 - RNA, 897 nt, Artificial Sequence
  derived and/or modified sequence opt2 from GSTM3__Homo_sapiens__XP_011539598
augaacgaggucuggcucccccccgccggcaagggcggcgccuccaccuccggcccccuccucuccugcuccacccccgcccgcguccccccccgcggccgccaggcccucaaccccaacgccggcaucucccgcgccugcgcccgccccugcggcgccgccgaggcccgcgacggcgagcgcggcggcggcggcguccgcgcccccgcccgcggcccccgcccccucauguccggcaucaagccccucccccucaccgucucccucguccucgagggcuccgaggcccgccaccacgucguccgcgucgucuacggcucccgcguccucggcuacuccugggcccccgacuacgaccgcucccaguggcucgacgucaaguucaagcucgaccucgacuuccccaaccuccccuaccuccucgacggcaagaacaagaucacccaguccaacgccauccuccgcuacaucgcccgcaagcacaacaugugcggcgagaccgaggaggagaagauccgcgucgacaucaucgagaaccaggucauggacuuccgcacccagcucauccgccucugcuacuccuccgaccacgagaagcucaagccccaguaccucgaggagcuccccggccagcucaagcaguucuccauguuccucggcaaguucuccugguucgccggcgagaagcucaccuucgucgacuuccucaccuacgacauccucgaccagaaccgcaucuucgaccccaagugccucgacgaguuccccaaccucaaggccuucaugugccgcuucgaggcccucgagaagaucgccgccuaccuccaguccgaccaguucugcaagaugcccaucaacaacaagauggcccaguggggcaacaagcccgucugcuga

SEQ ID NO: 43946 - RNA, 627 nt, Artificial Sequence
  derived and/or modified sequence opt2 from GSTO1__Homo_sapiens__NP_001177931
auguccggcgaguccgcccgcucccucggcaagggcuccgccccccccggccccguccccgagggcuccauccgcaucuacuccaugcgcuucugccccuucgccgagcgcacccgccucguccucaaggccaagggcauccgccacgaggucaucaacaucaaccucaagaacaagcccgagugguucuucaagaagaaccccuucggccucguccccguccucgagaacucccagggccagcucaucuacgaguccgccaucaccugcgaguaccucgacgaggccuaccccggcaagaagcuccuccccgacgaccccuacgagaaggccugccagaagaugauccucgagcucuucuccaagguccucaccaacaagaagaccaccuucuucggcggcaacuccaucuccaugaucgacuaccucaucuggcccugguucgagcgccucgaggccaugaagcucaacgagugcgucgaccacacccccaagcucaagcucuggauggccgccaugaaggaggaccccaccgucuccgcccuccucaccuccgagaaggacuggcagggcuuccucgagcucuaccuccagaacucccccgaggccugcgacuacggccucuga

SEQ ID NO: 43947 - RNA, 630 nt, Artificial Sequence
  derived and/or modified sequence opt2 from GSTO2__Homo_sapiens__NP_001177942
auguccggcgacgccacccgcacccucggcaagggcucccagccccccggccccguccccgagggccucauccgcaucuacuccaugcgcuucugccccuacucccaccgcacccgccucguccucaaggccaaggacauccgccacgaggucgucaacaucaaccuccgcaacaagcccgagugguacuacaccaagcaccccuucggccacauccccguccucgagaccucccagugccagcucaucuacgaguccgucaucgccugcgaguaccucgacgacgccuaccccggccgcaagcucuuccccuacgaccccuacgagcgcgcccgccagaagaugcuccucgagcucuucugcaagauccucgaguaccagaacaccaccuucuucggcggcaccugcaucuccaugaucgacuaccuccucuggcccugguucgagcgccucgacgucuacggcauccucgacugcgucucccacacccccgcccuccgccucuggaucuccgccaugaagugggaccccaccgucugcgcccuccucauggacaaguccaucuuccagggcuuccucaaccucuacuuccagaacaaccccaacgccuucgacuucggccucugcuga

SEQ ID NO: 43948 - RNA, 633 nt, Artificial Sequence
  derived and/or modified sequence opt2 from GSTP1__Homo_sapiens__NP_000843
augccccccuacaccgucgucuacuuccccguccgcggccgcugcgccgcccuccgcaugcuccucgccgaccagggccaguccuggaaggaggaggucgucaccgucgagaccuggcaggagggcucccucaaggccuccugccucuacggccagcuccccaaguuccaggacggcgaccucacccucuaccaguccaacaccauccuccgccaccucggccgcacccucggccucuacggcaaggaccagcaggaggccgcccucgucgacauggucaacgacggcgucgaggaccuccgcugcaaguacaucucccucaucuacaccaacuacgaggccggcaaggacgacuacgucaaggcccuccccggccagcucaagcccuucgagacccuccucucccagaaccagggcggcaagaccuucaucgucggcgaccagaucuccuucgccgacuacaaccuccucgaccuccuccucauccacgagguccucgcccccggcugccucgacgccuucccccuccucuccgccuacgucggccgccucuccgcccgccccaagcucaaggccuuccucgccucccccgaguacgucaaccuccccaucaacggcaacggcaagcaguga

SEQ ID NO: 43949 - RNA, 723 nt, Artificial Sequence
  derived and/or modified sequence opt2 from GSTT1__Homo_sapiens__NP_000844
augggccucgagcucuaccucgaccuccucucccagcccugccgcgccgucuacaucuucgccaagaagaacgacauccccuucgagcuccgcaucgucgaccucaucaagggccagcaccucuccgacgccuucgcccaggucaacccccucaagaagguccccgcccucaaggacggcgacuucacccucaccgaguccgucgccauccuccucuaccucacccgcaaguacaagguccccgacuacugguacccccaggaccuccaggcccgcgcccgcgucgacgaguaccucgccuggcagcacaccacccuccgccgcuccugccuccgcgcccucuggcacaaggucauguuccccgucuuccucggcgagcccgucuccccccagacccucgccgccacccucgccgagcucgacgucacccuccagcuccucgaggacaaguuccuccagaacaaggccuuccucaccggcccccacaucucccucgccgaccucgucgccaucaccgagcucaugcaccccgucggcgccggcugccaggucuucgagggccgccccaagcucgccaccuggcgccagcgcgucgaggccgccgucggcgaggaccucuuccaggaggcccacgaggucauccucaaggccaaggacuucccccccgccgaccccaccaucaagcagaagcucaugcccuggguccucgccaugauccgcuga

SEQ ID NO: 43950 - RNA, 735 nt, Artificial Sequence
  derived and/or modified sequence opt2 from GSTT2B__Homo_sapiens__NP_001074312
augggccucgagcucuuccucgaccucgucucccagcccucccgcgccgucuacaucuucgccaagaagaacggcaucccccucgagcuccgcaccgucgaccucgucaagggccagcacaaguccaaggaguuccuccagaucaacucccucggcaagcuccccacccucaaggacggcgacuucauccucaccgaguccuccgccauccucaucuaccucuccugcaaguaccagacccccgaccacugguaccccuccgaccuccaggcccgcgcccgcguccacgaguaccucggcuggcacgccgacugcauccgcggcaccuucggcaucccccucuggguccagguccucggcccccucaucggcguccagguccccgaggagaaggucgagcgcaaccgcaccgccauggaccaggcccuccaguggcucgaggacaaguuccucggcgaccgccccuuccucgccggccagcaggucacccucgccgaccucauggcccucgaggagcucaugcagcccgucgcccucggcuacgagcucuucgagggccgcccccgccucgccgccuggcgcggccgcgucgaggccuuccucggcgccgagcucugccaggaggcccacuccaucauccucuccauccucgagcaggccgccaagaagacccuccccacccccucccccgaggccuaccaggccaugcuccuccgcaucgcccgcauccccuga

SEQ ID NO: 43951 - RNA, 735 nt, Artificial Sequence
  derived and/or modified sequence opt2 from GSTT2__Homo_sapiens__NP_000845
augggccucgagcucuuccucgaccucgucucccagcccucccgcgccgucuacaucuucgccaagaagaacggcaucccccucgagcuccgcaccgucgaccucgucaagggccagcacaaguccaaggaguuccuccagaucaacucccucggcaagcuccccacccucaaggacggcgacuucauccucaccgaguccuccgccauccucaucuaccucuccugcaaguaccagacccccgaccacugguaccccuccgaccuccaggcccgcgcccgcguccacgaguaccucggcuggcacgccgacugcauccgcggcaccuucggcaucccccucuggguccagguccucggcccccucaucggcguccagguccccaaggagaaggucgagcgcaaccgcaccgccauggaccaggcccuccaguggcucgaggacaaguuccucggcgaccgccccuuccucgccggccagcaggucacccucgccgaccucauggcccucgaggagcucaugcagcccgucgcccucggcuacgagcucuucgagggccgcccccgccucgccgccuggcgcggccgcgucgaggccuuccucggcgccgagcucugccaggaggcccacuccaucauccucuccauccucgagcaggccgccaagaagacccuccccacccccucccccgaggccuaccaggccaugcuccuccgcaucgcccgcauccccuga

SEQ ID NO: 43952 - RNA, 651 nt, Artificial Sequence
  derived and/or modified sequence opt2 from GSTZ1__Homo_sapiens__NP_665877
augcaggccggcaagcccauccucuacuccuacuuccgcuccuccugcuccuggcgcguccgcaucgcccucgcccucaagggcaucgacuacgagaccguccccaucaaccucaucaaggacggcggccagcaguucuccaaggacuuccaggcccucaaccccaugaagcagguccccacccucaagaucgacggcaucaccauccaccagucccucgccaucaucgaguaccucgaggagaugcgccccaccccccgccuccucccccaggaccccaagaagcgcgccuccguccgcaugaucuccgaccucaucgccggcggcauccagccccuccagaaccucuccguccucaagcaggucggcgaggagaugcagcucaccugggcccagaacgccaucaccugcggcuucaacgcccucgagcagauccuccaguccaccgccggcaucuacugcgucggcgacgaggucaccauggccgaccucugccucgucccccaggucgccaacgccgagcgcuucaaggucgaccucacccccuaccccaccaucuccuccaucaacaagcgccuccucguccucgaggccuuccaggucucccaccccugccgccagcccgacacccccaccgagcuccgcgccuga

SEQ ID NO: 43953 - RNA, 795 nt, Artificial Sequence
  derived and/or modified sequence opt2 from GSX1__Homo_sapiens__NP_663632
augccccgcuccuuccucgucgacucccucguccuccgcgaggccggcgagaagaaggcccccgagggcuccccccccccccucuuccccuacgccgucccccccccccacgcccuccacggccucucccccggcgccugccacgcccgcaaggccggccuccucugcgucugcccccucugcgucaccgccucccagcuccacggcccccccggcccccccgcccucccccuccucaaggccuccuucccccccuucggcucccaguacugccacgccccccucggccgccagcacuccgccgucucccccggcgucgcccacggccccgccgccgccgccgccgccgccgcccucuaccagaccuccuacccccuccccgacccccgccaguuccacugcaucuccgucgacuccuccuccaaccagcuccccuccuccaagcgcaugcgcaccgccuucaccuccacccagcuccucgagcucgagcgcgaguucgccuccaacauguaccucucccgccuccgccgcaucgagaucgccaccuaccucaaccucuccgagaagcaggucaagaucugguuccagaaccgccgcgucaagcacaagaaggagggcaagggcuccaaccaccgcggcggcggcggcggcggcgccggcggcggcggcuccgccccccagggcugcaagugcgccucccucuccuccgccaagugcuccgaggacgacgacgagcuccccaugucccccuccuccuccggcaaggacgaccgcgaccucaccgucacccccuga

SEQ ID NO: 43954 - RNA, 915 nt, Artificial Sequence
  derived and/or modified sequence opt2 from GSX2__Homo_sapiens__NP_573574
augucccgcuccuucuacgucgacucccucaucaucaaggacaccucccgccccgcccccucccuccccgagccccaccccggccccgacuucuucaucccccucggcaugccccccccccucgucauguccgucuccggccccggcugccccucccgcaaguccggcgccuucugcgucugcccccucugcgucaccucccaccuccacuccucccgcggcuccgucggcgccggcuccggcggcgccggcgccggcgucaccggcgccggcggcuccggcgucgccggcgccgccggcgcccucccccuccucaagucccaguucuccuccgcccccggcgacgcccaguucugcccccgcgucaaccacgcccaccaccaccaccaccccccccagcaccaccaccaccaccaccagccccagcagcccggcuccgccgccgccgccgccgccgccgccgccgccgccgccgccgccgccgcccucggccacccccagcaccacgcccccgucugcaccgccaccaccuacaacgucgccgacccccgccgcuuccacugccucaccaugggcggcuccgacgccucccagguccccaacggcaagcgcaugcgcaccgccuucaccuccacccagcuccucgagcucgagcgcgaguucuccuccaacauguaccucucccgccuccgccgcaucgagaucgccaccuaccucaaccucuccgagaagcaggucaagaucugguuccagaaccgccgcgucaagcacaagaaggagggcaagggcacccagcgcaacucccacgccggcugcaagugcgucggcucccagguccacuacgcccgcuccgaggacgaggacucccucucccccgccuccgccaacgacgacaaggagaucuccccccucuga

SEQ ID NO: 43955 - RNA, 1377 nt, Artificial Sequence
  derived and/or modified sequence opt2 from GTDC1__Homo_sapiens__NP_001006637
auguccauccucaucaucgaggccuucuacggcggcucccacaagcagcucgucgaccuccuccaggaggagcucggcgacugcgucgucuacacccuccccgccaagaaguggcacuggcgcgcccgcaccuccgcccucuacuucucccagaccauccccaucuccgagcacuaccgcacccucuucgccuccuccguccucaaccucaccgagcucgccgcccuccgccccgaccucggcaagcucaagaagauccucuacuuccacgagaaccagcucaucuaccccgucaagaagugccaggagcgcgacuuccaguacggcuacaaccagauccucuccugccucgucgccgacgucgucgucuucaacuccgucuucaacauggaguccuuccucaccuccaugggcaaguucaugaagcucauccccgaccaccgccccaaggaccucgaguccaucauccgccccaagugccaggucaucuacuuccccauccgcuuccccgacgucucccgcuucaugcccaagcacaagaccacccaccucaagaagaugcucggccucaagggcaacggcggcgccguccucuccauggcccuccccuuccagcccgagcagcgcgacuccgaggaccuccucaagaacuucaacuccgagugcgacacccacugcggccucgacaccgcccgccaggaguaccucggcaacucccuccgccaggaguccgaccucaagaaguccaccuccuccgacaacuccuccucccaccacggcgagaacaagcagaaccucaccgucgaccccugcgacauccucggcggcgucgacaaccagcagcgccuccuccacaucgucuggccccaccgcugggagcacgacaaggaccccgaguccuucuucaagguccucaugcaccucaaggaccucggccucaacuuccacgucuccguccucggcgagaccuucaccgacguccccgacaucuucuccgaggccaagaaggcccucggcuccuccguccuccacuggggcuaccuccccuccaaggacgacuacuuccagguccucugcauggccgacgucgucaucuccaccgccaagcacgaguucuucggcgucgccaugcucgaggccgucuacugcggcugcuacccccucugccccaaggaccucgucuaccccgagaucuuccccgccgaguaccucuacuccacccccgagcagcucuccaagcgccuccagaacuucugcaagcgccccgacaucauccgcaagcaccucuacaagggcgagaucgcccccuucuccugggccgcccuccacggcaaguuccgcucccuccucaccaccgagccccgcgaggaccucuga

SEQ ID NO: 43956 - RNA, 1131 nt, Artificial Sequence
  derived and/or modified sequence opt2 from GTF2A1__Homo_sapiens__NP_056943
auggccaacuccgccaacaccaacaccguccccaagcucuaccgcuccgucaucgaggacgucaucaacgacguccgcgacaucuuccucgacgacggcgucgacgagcagguccucauggagcucaagacccucugggagaacaagcucaugcagucccgcgccgucgacggcuuccacuccgaggagcagcagcuccuccuccagguccagcagcagcaccagccccagcagcagcagcaccaccaccaccaccaccaccagcaggcccagccccagcagaccgucccccagcaggcccagacccagcagguccucauccccgccucccagcaggccaccgccccccaggucaucguccccgacuccaagcucauccagcacaugaacgccuccaacauguccgccgccgccaccgccgccacccucgcccuccccgccggcgucacccccguccagcagauccucaccaacuccggccagcuccuccaggucguccgcgccgccaacggcgcccaguacaucuuccagccccagcaguccgucguccuccagcagcaggucaucccccagaugcagcccggcggcguccaggcccccgucauccagcagguccucgccccccuccccggcggcaucuccccccagaccggcgucaucauccagccccagcagauccucuucaccggcaacaagacccaggucauccccaccaccgucgccgcccccacccccgcccaggcccagaucaccgccaccggccagcagcagccccaggcccagcccgcccagacccaggccccccucguccuccaggucgacggcaccggcgacaccuccuccgaggaggacgaggacgaggaggaggacuacgacgacgacgaggaggaggacaaggagaaggacggcgccgaggacggccaggucgaggaggagccccucaacuccgaggacgacgucuccgacgaggagggccaggagcucuucgacaccgagaacgucgucgucugccaguacgacaagauccaccgcuccaagaacaaguggaaguuccaccucaaggacggcaucaugaaccucaacggccgcgacuacaucuucuccaaggccaucggcgacgccgagugguga

SEQ ID NO: 43957 - RNA, 1335 nt, Artificial Sequence
  derived and/or modified sequence opt2 from GTF2A1L__Homo_sapiens__NP_001180416
auggccugccucaaccccguccucugggagaccaagguccuccaguccaaggccaccgaggacuucuuccgcaacuccauccaguccccccucuucacccuccagcucccccacucccuccaccagacccuccaguccuccaccgccucccucgucauccccgccggccgcacccuccccuccuucaccaccgccgagcucggcaccuccaacuccuccgccaacuucaccuuccccggcuaccccauccacguccccgccggcgucacccuccagaccgucuccggccaccucuacaaggucaacguccccaucauggucaccgagaccuccggccgcgccggcauccuccagcaccccauccagcaggucuuccagcagcucggccagcccuccgucauccagaccuccgucccccagcucaaccccuggucccuccaggccaccaccgagaagucccagcgcaucgagaccguccuccagcagcccgccauccuccccuccggccccgucgaccgcaagcaccucgagaacgccaccuccgacauccucgucucccccggcaacgagcacaagaucguccccgaggcccuccucugccaccaggaguccucccacuacaucucccuccccggcgucgucuucuccccccaggucucccagaccaacuccaacgucgaguccguccucuccggcuccgccuccauggcccagaaccuccacgacgagucccucuccaccuccccccacggcgcccuccaccagcacgucaccgacauccagcuccacauccucaagaaccgcauguacggcugcgacuccgucaagcagccccgcaacaucgaggagcccuccaacauccccgucuccgagaaggacuccaacucccaggucgaccucuccauccgcgucaccgacgacgacaucggcgagaucauccaggucgacggcuccggcgacaccuccuccaacgaggagaucggcuccacccgcgacgccgacgagaacgaguuccucggcaacaucgacggcggcgaccucaagguccccgaggaggaggccgacuccaucuccaacgaggacuccgccaccaacuccuccgacaacgaggacccccaggucaacaucgucgaggaggacccccucaacuccggcgacgacgucuccgagcaggacguccccgaccucuucgacaccgacaacgucaucgucugccaguacgacaagauccaccgcuccaagaacaaguggaaguucuaccucaaggacggcgucaugugcuucggcggccgcgacuacgucuucgccaaggccaucggcgacgccgagugguga

SEQ ID NO: 43958 - RNA, 330 nt, Artificial Sequence
  derived and/or modified sequence opt2 from GTF2A2__Homo_sapiens__NP_004483
auggccuaccagcucuaccgcaacaccacccucggcaacucccuccaggagucccucgacgagcucauccagucccagcagaucaccccccagcucgcccuccagguccuccuccaguucgacaaggccaucaacgccgcccucgcccagcgcguccgcaaccgcgucaacuuccgcggcucccucaacaccuaccgcuucugcgacaacgucuggaccuucguccucaacgacgucgaguuccgcgaggucaccgagcucaucaaggucgacaaggucaagaucgucgccugcgacggcaagaacaccggcuccaacaccaccgaguga

SEQ ID NO: 43959 - RNA, 1320 nt, Artificial Sequence
  derived and/or modified sequence opt2 from GTF2E1__Homo_sapiens__NP_005504
auggccgaccccgacguccucaccgagguccccgccgcccucaagcgccucgccaaguacgucauccgcggcuucuacggcaucgagcacgcccucgcccucgacauccucauccgcaacuccugcgucaaggaggaggacaugcucgagcuccucaaguucgaccgcaagcagcuccgcuccguccucaacaaccucaagggcgacaaguucaucaagugccgcaugcgcgucgagaccgccgccgacggcaagaccacccgccacaacuacuacuucaucaacuaccgcacccucgucaacgucgucaaguacaagcucgaccacaugcgccgccgcaucgagaccgacgagcgcgacuccaccaaccgcgccuccuucaagugccccgucugcuccuccaccuucaccgaccucgaggccaaccagcucuucgaccccaugaccggcaccuuccgcugcaccuucugccacaccgaggucgaggaggacgaguccgccaugcccaagaaggacgcccgcacccuccucgcccgcuucaacgagcagaucgagcccaucuacgcccuccuccgcgagaccgaggacgucaaccucgccuacgagauccucgagcccgagcccaccgagauccccgcccucaagcaguccaaggaccacgccgccaccaccgccggcgccgccucccucgccggcggccaccaccgcgaggccugggccaccaagggccccuccuacgaggaccucuacacccagaacgucgucaucaacauggacgaccaggaggaccuccaccgcgccucccucgagggcaaguccgccaaggagcgccccaucuggcuccgcgaguccaccguccagggcgccuacggcuccgaggacaugaaggagggcggcaucgacauggacgccuuccaggagcgcgaggagggccacgccggccccgacgacaacgaggaggucaugcgcgcccuccucauccacgagaagaagaccuccuccgccauggccggcuccgucggcgccgccgcccccgucaccgccgccaacggcuccgacuccgaguccgagaccuccgaguccgacgacgacucccccccccgccccgccgccgucgccguccacaagcgcgaggaggacgaggaggaggacgacgaguucgaggaggucgccgacgaccccaucgucauggucgccggccgccccuucuccuacuccgaggucucccagcgccccgagcucgucgcccagaugacccccgaggagaaggaggccuacaucgccaugggccagcgcauguucgaggaccucuucgaguga

SEQ ID NO: 43960 - RNA, 876 nt, Artificial Sequence
  derived and/or modified sequence opt2 from GTF2E2__Homo_sapiens__NP_002086
auggaccccucccuccuccgcgagcgcgagcucuucaagaagcgcgcccucuccacccccgucgucgagaagcgcuccgccuccuccgaguccuccuccuccuccuccaagaagaagaagaccaaggucgagcacggcggcuccuccggcuccaagcagaacuccgaccacuccaacggcuccuucaaccucaaggcccucuccggcuccuccggcuacaaguucggcguccucgccaagaucgucaacuacaugaagacccgccaccagcgcggcgacacccacccccucacccucgacgagauccucgacgagacccagcaccucgacaucggccucaagcagaagcaguggcucaugaccgaggcccucgucaacaaccccaagaucgaggucaucgacggcaaguacgccuucaagcccaaguacaacguccgcgacaagaaggcccuccuccgccuccucgaccagcacgaccagcgcggccucggcggcauccuccucgaggacaucgaggaggcccuccccaacucccagaaggccgucaaggcccucggcgaccagauccucuucgucaaccgccccgacaagaagaagauccucuucuucaacgacaaguccugccaguucuccgucgacgaggaguuccagaagcucuggcgcuccgucaccgucgacuccauggacgaggagaagaucgaggaguaccucaagcgccagggcaucuccuccaugcaggaguccggccccaagaaggucgcccccauccagcgccgcaagaagcccgccucccagaagaagcgccgcuucaagacccacaacgagcaccucgccggcguccucaaggacuacuccgacaucaccuccuccaaguga

SEQ ID NO: 43961 - RNA, 1554 nt, Artificial Sequence
  derived and/or modified sequence opt2 from GTF2F1__Homo_sapiens__NP_002087
auggccgcccucggccccuccucccagaacgucaccgaguacgucguccgcguccccaagaacaccaccaagaaguacaacaucauggccuucaacgccgccgacaaggucaacuucgccaccuggaaccaggcccgccucgagcgcgaccucuccaacaagaagaucuaccaggaggaggagaugcccgaguccggcgccggcuccgaguucaaccgcaagcuccgcgaggaggcccgccgcaagaaguacggcaucguccucaaggaguuccgccccgaggaccagcccuggcuccuccgcgucaacggcaaguccggccgcaaguucaagggcaucaagaagggcggcgucaccgagaacaccuccuacuacaucuucacccagugccccgacggcgccuucgaggccuuccccguccacaacugguacaacuucaccccccucgcccgccaccgcacccucaccgccgaggaggccgaggaggagugggagcgccgcaacaagguccucaaccacuucuccaucaugcagcagcgccgccucaaggaccaggaccaggacgaggacgaggaggagaaggagaagcgcggccgccgcaaggccuccgagcuccgcauccacgaccucgaggacgaccucgagauguccuccgacgccuccgacgccuccggcgaggagggcggccgcguccccaaggccaagaagaaggccccccucgccaagggcggccgcaagaagaagaagaagaagggcuccgacgacgaggccuucgaggacuccgacgacggcgacuucgagggccaggaggucgacuacauguccgacggcuccuccuccucccaggaggagcccgaguccaaggccaaggccccccagcaggaggagggccccaagggcgucgacgagcaguccgacuccuccgaggaguccgaggaggagaagccccccgaggaggacaaggaggaggaggaggagaagaaggcccccaccccccaggagaagaagcgccgcaaggacuccuccgaggaguccgacuccuccgaggaguccgacaucgacuccgaggccuccuccgcccucuucauggccaagaagaagaccccccccaagcgcgagcgcaagcccuccggcggcuccucccgcggcaacucccgccccggcacccccuccgccgagggcggcuccaccuccuccacccuccgcgccgccgccuccaagcucgagcagggcaagcgcgucuccgagaugcccgccgccaagcgccuccgccucgacaccggcccccagucccucuccggcaaguccaccccccagccccccuccggcaagaccacccccaacuccggcgacguccaggucaccgaggacgccguccgccgcuaccucacccgcaagcccaugaccaccaaggaccuccucaagaaguuccagaccaagaagaccggccucuccuccgagcagaccgucaacguccucgcccagauccucaagcgccucaaccccgagcgcaagaugaucaacgacaagaugcacuucucccucaaggaguga

SEQ ID NO: 43962 - RNA, 750 nt, Artificial Sequence
  derived and/or modified sequence opt2 from GTF2F2__Homo_sapiens__NP_004119
auggccgagcgcggcgagcucgaccucaccggcgccaagcagaacaccggcgucuggcucgucaagguccccaaguaccucucccagcagugggccaaggccuccggccgcggcgaggucggcaagcuccgcaucgccaagacccagggccgcaccgaggucuccuucacccucaacgaggaccucgccaacauccacgacaucggcggcaagcccgccuccgucuccgccccccgcgagcaccccuucguccuccaguccgucggcggccagacccucaccgucuucaccgaguccuccuccgacaagcucucccucgagggcaucgucguccagcgcgccgagugccgccccgccgccuccgagaacuacaugcgccucaagcgccuccagaucgaggaguccuccaagcccguccgccucucccagcagcucgacaaggucgucaccaccaacuacaagcccgucgccaaccaccaguacaacaucgaguacgagcgcaagaagaaggaggacggcaagcgcgcccgcgccgacaagcagcacguccucgacaugcucuucuccgccuucgagaagcaccaguacuacaaccucaaggaccucgucgacaucaccaagcagcccgucgucuaccucaaggagauccucaaggagaucggcguccagaacgucaagggcauccacaagaacaccugggagcucaagcccgaguaccgccacuaccagggcgaggagaaguccgacuga

SEQ ID NO: 43963 - RNA, 1647 nt, Artificial Sequence
  derived and/or modified sequence opt2 from GTF2H1__Homo_sapiens__NP_001135779
auggccaccuccuccgaggagguccuccucaucgucaagaagguccgccagaagaagcaggacggcgcccucuaccucauggccgagcgcaucgccugggcccccgagggcaaggaccgcuucaccaucucccacauguacgccgacaucaagugccagaagaucucccccgagggcaaggccaagauccagcuccagcucguccuccacgccggcgacaccaccaacuuccacuucuccaacgaguccaccgccgucaaggagcgcgacgccgucaaggaccuccuccagcagcuccuccccaaguucaagcgcaaggccaacaaggagcucgaggagaagaaccgcaugcuccaggaggaccccguccucuuccagcucuacaaggaccucgucgucucccaggucaucuccgccgaggaguucugggccaaccgccucaacgucaacgccaccgacuccuccuccaccuccaaccacaagcaggacgucggcaucuccgccgccuuccucgccgacguccgcccccagaccgacggcugcaacggccuccgcuacaaccucaccuccgacaucaucgaguccaucuuccgcaccuaccccgccgucaagaugaaguacgccgagaacgucccccacaacaugaccgagaaggaguucuggacccgcuucuuccagucccacuacuuccaccgcgaccgccucaacaccggcuccaaggaccucuucgccgagugcgccaagaucgacgagaagggccucaagaccauggucucccucggcgucaagaacccccuccucgaccucaccgcccucgaggacaagccccucgacgagggcuacggcaucuccuccguccccuccgccuccaacuccaaguccaucaaggagaacuccaacgccgccaucaucaagcgcuucaaccaccacuccgccaugguccucgccgccggccuccgcaagcaggaggcccagaacgagcagaccuccgagcccuccaacauggacggcaacuccggcgacgccgacugcuuccagcccgccgucaagcgcgccaagcuccaggaguccaucgaguacgaggaccucggcaagaacaacuccgucaagaccaucgcccucaaccucaagaaguccgaccgcuacuaccacggccccacccccauccagucccuccaguacgccaccucccaggacaucaucaacuccuuccaguccauccgccaggagauggaggccuacacccccaagcucacccagguccucuccuccuccgccgccuccuccaccaucaccgcccucucccccggcggcgcccucaugcagggcggcacccagcaggccaucaaccagaugguccccaacgacauccaguccgagcucaagcaccucuacgucgccgucggcgagcuccuccgccacuucugguccugcuuccccgucaacacccccuuccucgaggagaaggucgucaagaugaaguccaaccucgagcgcuuccaggucaccaagcucugccccuuccaggagaagauccgccgccaguaccucuccaccaaccucgucucccacaucgaggagaugcuccagaccgccuacaacaagcuccacaccuggcagucccgccgccucaugaagaagaccuga

SEQ ID NO: 43964 - RNA, 1188 nt, Artificial Sequence
  derived and/or modified sequence opt2 from GTF2H2C_2__Homo_sapiens__NP_001035955
auggacgaggagcccgagcgcaccaagcgcugggagggcggcuacgagcgcaccugggagauccucaaggaggacgaguccggcucccucaaggccaccaucgaggacauccucuucaaggccaagcgcaagcgcgucuucgagcaccacggccagguccgccucggcaugaugcgccaccucuacgucgucgucgacggcucccgcaccauggaggaccaggaccucaagcccaaccgccucaccugcacccucaagcuccucgaguacuucgucgaggaguacuucgaccagaaccccaucucccagaucggcaucaucgucaccaaguccaagcgcgccgagaagcucaccgagcucuccggcaacccccgcaagcacaucaccucccucaaggaggccgucgacaugaccugccacggcgagcccucccucuacaacucccucuccauggccaugcagacccucaagcacaugcccggccacaccucccgcgagguccucaucaucuucuccucccucaccaccugcgaccccuccaacaucuacgaccucaucaagacccucaaggccgccaagauccgcgucuccgucaucggccucuccgccgagguccgcgucugcaccguccucgcccgcgagaccggcggcaccuaccacgucauccucgacgagucccacuacaaggagcuccucacccaccaccucucccccccccccgccuccuccuccuccgagugcucccucauccgcaugggcuucccccagcacaccaucgccucccucuccgaccaggacgccaagcccuccuucuccauggcccaccucgacggcaacaccgagcccggccucacccucggcggcuacuucugcccccagugccgcgccaaguacugcgagcuccccgucgagugcaagaucugcggccucacccucgucuccgccccccaccucgcccgcuccuaccaccaccucuucccccucgacgccuuccaggagaucccccucgaggaguacaacggcgagcgcuucugcuacggcugccagggcgagcucaaggaccagcacgucuacgucugcgccgucugccagaacgucuucugcgucgacugcgacgucuucguccacgacucccuccacugcugccccggcugcauccacaagauccccgcccccuccggcgucuga

SEQ ID NO: 43965 - RNA, 1017 nt, Artificial Sequence
  derived and/or modified sequence opt2 from GTF2H2C__Homo_sapiens__XP_005248650
augcgccaccucuacgucgucgucgacggcucccgcaccauggaggaccaggaccucaagcccaaccgccucaccugcacccucaagcuccucgaguacuucgucgaggaguacuucgaccagaaccccaucucccagaucggcaucaucgucaccaaguccaagcgcgccgagaagcucaccgagcucuccggcaacccccgcaagcacaucaccucccucaaggaggccgucgacaugaccugccacggcgagcccucccucuacaacucccucuccauggccaugcagacccucaagcacaugcccggccacaccucccgcgagguccucaucaucuucuccucccucaccaccugcgaccccuccaacaucuacgaccucaucaagacccucaaggccgccaagauccgcgucuccgucaucggccucuccgccgagguccgcgucugcaccguccucgcccgcgagaccggcggcaccuaccacgucauccucgacgagucccacuacaaggagcuccucacccaccaccucucccccccccccgccuccuccuccuccgagugcucccucauccgcaugggcuucccccagcacaccaucgccucccucuccgaccaggacgccaagcccuccuucuccauggcccaccucgacggcaacaccgagcccggccucacccucggcggcuacuucugcccccagugccgcgccaaguacugcgagcuccccgucgagugcaagaucugcggccucacccucgucuccgccccccaccucgcccgcuccuaccaccaccucuucccccucgacgccuuccaggagaucccccucgaggaguacaacggcgagcgcuucugcuacggcugccagggcgagcucaaggaccagcacgucuacgucugcgccgucugccagaacgucuucugcgucgacugcgacgucuucguccacgacucccuccacugcugccccggcugcauccacaagauccccgcccccuccggcgucuga

SEQ ID NO: 43966 - RNA, 1188 nt, Artificial Sequence
  derived and/or modified sequence opt2 from GTF2H2__Homo_sapiens__NP_001506
auggacgaggagcccgagcgcaccaagcgcugggagggcggcuacgagcgcaccugggagauccucaaggaggacgaguccggcucccucaaggccaccaucgaggacauccucuucaaggccaagcgcaagcgcgucuucgagcaccacggccagguccgccucggcaugaugcgccaccucuacgucgucgucgacggcucccgcaccauggaggaccaggaccucaagcccaaccgccucaccugcacccucaagcuccucgaguacuucgucgaggaguacuucgaccagaaccccaucucccagaucggcaucaucgucaccaaguccaagcgcgccgagaagcucaccgagcucuccggcaacccccgcaagcacaucaccucccucaagaaggccgucgacaugaccugccacggcgagcccucccucuacaacucccucuccaucgccaugcagacccucaagcacaugcccggccacaccucccgcgagguccucaucaucuucuccucccucaccaccugcgaccccuccaacaucuacgaccucaucaagacccucaaggccgccaagauccgcgucuccgucaucggccucuccgccgagguccgcgucugcaccguccucgcccgcgagaccggcggcaccuaccacgucauccucgacgagucccacuacaaggagcuccucacccaccacgucucccccccccccgccuccuccuccuccgagugcucccucauccgcaugggcuucccccagcacaccaucgccucccucuccgaccaggacgccaagcccuccuucuccauggcccaccucgacggcaacaccgagcccggccucacccucggcggcuacuucugcccccagugccgcgccaaguacugcgagcuccccgucgagugcaagaucugcggccucacccucgucuccgccccccaccucgcccgcuccuaccaccaccucuucccccucgacgccuuccaggagaucccccucgaggaguacaacggcgagcgcuucugcuacggcugccagggcgagcucaaggaccagcacgucuacgucugcgccgucugccagaacgucuucugcgucgacugcgacgucuucguccacgacucccuccacugcugccccggcugcauccacaagauccccgcccccuccggcgucuga

SEQ ID NO: 43967 - RNA, 804 nt, Artificial Sequence
  derived and/or modified sequence opt2 from GTF2H3__Homo_sapiens__NP_001258796
augguccucggcaacucccaccucuucaugaaccgcuccaacaagcucgccgucaucgccucccacauccaggagucccgcuuccucuaccccggcaagaacggccgccucggcgacuucuucggcgaccccggcaacccccccgaguucaaccccuccggcuccaaggacggcaaguacgagcuccucaccuccgccaacgaggucaucgucgaggagaucaaggaccucaugaccaaguccgacaucaagggccagcacaccgagacccuccucgccggcucccucgccaaggcccucugcuacauccaccgcaugaacaaggaggucaaggacaaccaggagaugaagucccgcauccucgucaucaaggccgccgaggacuccgcccuccaguacaugaacuucaugaacgucaucuucgccgcccagaagcagaacauccucaucgacgccugcguccucgacuccgacuccggccuccuccagcaggccugcgacaucaccggcggccucuaccucaaggucccccagaugcccucccuccuccaguaccuccucugggucuuccuccccgaccaggaccagcgcucccagcucauccuccccccccccguccacgucgacuaccgcgccgccugcuucugccaccgcaaccucaucgagaucggcuacgucugcuccgucugccucuccaucuucugcaacuucucccccaucugcaccaccugcgagaccgccuucaagaucucccucccccccguccucaaggccaagaagaagaagcucaaggucuccgccuga

SEQ ID NO: 43968 - RNA, 1389 nt, Artificial Sequence
  derived and/or modified sequence opt2 from GTF2H4__Homo_sapiens__NP_001508
auggaguccacccccucccgcggccucaaccgcguccaccuccagugccgcaaccuccaggaguuccucggcggccucucccccggcguccucgaccgccucuacggccaccccgccaccugccucgccgucuuccgcgagcuccccucccucgccaagaacugggucaugcgcaugcucuuccucgagcagccccucccccaggccgccgucgcccucugggucaagaaggaguucuccaaggcccaggaggaguccaccggccuccucuccggccuccgcaucuggcacacccagcuccuccccggcggccuccagggccucauccucaaccccaucuuccgccagaaccuccgcaucgcccuccucggcggcggcaaggccugguccgacgacaccucccagcucggccccgacaagcacgcccgcgacguccccucccucgacaaguacgccgaggagcgcugggaggucguccuccacuucauggucggcucccccuccgccgccgucucccaggaccucgcccagcuccucucccaggccggccucaugaaguccaccgagcccggcgagccccccugcaucaccuccgccggcuuccaguuccuccuccucgacacccccgcccagcucugguacuucaugcuccaguaccuccagaccgcccagucccgcggcauggaccucgucgagauccucuccuuccucuuccagcucuccuucuccacccucggcaaggacuacuccgucgagggcauguccgacucccuccucaacuuccuccagcaccuccgcgaguucggccucgucuuccagcgcaagcgcaagucccgccgcuacuaccccacccgccucgccaucaaccucuccuccggcgucuccggcgccggcggcaccguccaccagcccggcuucaucgucgucgagaccaacuaccgccucuacgccuacaccgaguccgagcuccagaucgcccucaucgcccucuucuccgagaugcucuaccgcuuccccaacauggucgucgcccaggucacccgcgaguccguccagcaggccaucgccuccggcaucaccgcccagcagaucauccacuuccuccgcacccgcgcccaccccgucaugcucaagcagacccccguccucccccccaccaucaccgaccagauccgccucugggagcucgagcgcgaccgccuccgcuucaccgagggcguccucuacaaccaguuccucucccaggucgacuucgagcuccuccucgcccacgcccgcgagcucggcguccucgucuucgagaacuccgccaagcgccucauggucgucacccccgccggccacuccgacgucaagcgcuucuggaagcgccagaagcacuccuccuga

SEQ ID NO: 43969 - RNA, 216 nt, Artificial Sequence
  derived and/or modified sequence opt2 from GTF2H5__Homo_sapiens__NP_997001
auggucaacguccucaagggcguccucaucgagugcgaccccgccaugaagcaguuccuccucuaccucgacgaguccaacgcccucggcaagaaguucaucauccaggacaucgacgacacccacgucuucgucaucgccgagcucgucaacguccuccaggagcgcgucggcgagcucauggaccagaacgccuucucccucacccagaaguga

SEQ ID NO: 43970 - RNA, 825 nt, Artificial Sequence
  derived and/or modified sequence opt2 from GTF2I__Homo_sapiens__NP_001267729
auggcccaggucgccauguccacccuccccgucgaggacgaggaguccuccgagucccgcauggucgucaccuuccucauguccgcccucgaguccaugugcaaggagcucgccaaguccaaggccgaggucgccugcaucgccgucuacgagaccgacgucuucgucgucggcaccgagcgcggccgcgccuucgucaacacccgcaaggacuuccagaaggacuucgucaaguacugcgucgaggaggaggagaaggccgccgagaugcacaagaugaaguccaccacccaggccaaccgcauguccgucgacgccgucgagaucgagacccuccgcaagaccgucgaggacuacuucugcuucugcuacggcaaggcccucggcaaguccaccgucguccccguccccuacgagaagaugcuccgcgaccaguccgccgucgucguccagggccuccccgagggcgucgccuucaagcaccccgagaacuacgaccucgccacccucaaguggauccucgagaacaaggccggcaucuccuucaucaucaagcgccccuuccucgagcccaagaagcacgucggcggccgcgucauggucaccgacgccgaccgcuccauccucucccccggcggcuccugcggccccaucaaggucaagaccgagcccaccgaggacuccggcaucucccucgagauggccgccgucaccgucaaggaggaguccgaggaccccgacuacuaccaguacaacauccagggcucccaccacuccuccgagggcaacgagggcaccgagauggagguccccgccgagggcuga

SEQ ID NO: 43971 - RNA, 2931 nt, Artificial Sequence
  derived and/or modified sequence opt2 from GTF2IRD1__Homo_sapiens__NP_001186136
auggcccuccucggcaagcgcugcgacguccccaccaacggcugcggccccgaccgcuggaacuccgccuucacccgcaaggacgagaucaucaccucccucgucuccgcccucgacuccaugugcuccgcccucuccaagcucaacgccgaggucgccugcgucgccguccacgacgaguccgccuucgucgucggcaccgagaagggccgcauguuccucaacgcccgcaaggagcuccaguccgacuuccuccgcuucugccucuccgccgcccagcaccgcgccgccaccucccagcucgagggccgcgucguccgccgcguccucaccgucgccucccgcgcccucugccccaccggcggcccccccuggaaggaccccgaggccgagcaccccaagaagguccagcgcggcgagggcggcggccgcucccucccccgcuccucccucgagcacggcuccgacgucuaccuccuccgcaagauggucgaggaggucuucgacguccucuacuccgaggcccucggccgcgccuccgucgucccccuccccuacgagcgccuccuccgcgagcccggccuccucgccguccagggccuccccgagggccucgccuuccgccgccccgccgaguacgaccccaaggcccucauggccauccucgagcacucccaccgcauccgcuucaagcucaagcgcccccucgaggacggcggccgcgacuccaaggcccucgucgagcucaacggcgucucccucauccccaagggcucccgcgacugcggccuccacggccaggcccccaagguccccccccaggaccucccccccaccgccaccuccuccuccauggccuccuuccucuacuccaccgcccuccccaaccacgccauccgcgagcucaagcaggaggcccccuccugcccccucgcccccuccgaccucggccucucccgccccaugcccgagcccaaggccaccggcgcccaggacuucuccgacugcugcggccagaagcccaccggccccggcggcccccucauccagaacguccacgccuccaagcgcauccucuucuccaucguccacgacaaguccgagaagugggacgccuucaucaaggagaccgaggacaucaacacccuccgcgagugcguccagauccucuucaacucccgcuacgccgaggcccucggccucgaccacaugguccccguccccuaccgcaagaucgccugcgaccccgaggccgucgagaucgucggcauccccgacaagauccccuucaagcgccccugcaccuacggcguccccaagcucaagcgcauccucgaggagcgccacuccauccacuucaucaucaagcgcauguucgacgagcgcaucuucaccggcaacaaguucaccaaggacaccaccaagcucgagcccgccuccccccccgaggacaccuccgccgaggucucccgcgccaccguccucgaccucgccggcaacgcccgcuccgacaagggcuccauguccgaggacugcggccccggcaccuccggcgagcucggcggccuccgccccaucaagaucgagcccgaggaccucgacaucauccaggucaccguccccgaccccucccccaccuccgaggagaugaccgacuccaugcccggccaccuccccuccgaggacuccggcuacggcauggagaugcucaccgacaagggccucuccgaggacgcccgccccgaggagcgccccgucgaggacucccacggcgacgucauccgcccccuccgcaagcaggucgagcuccucuucaacacccgcuacgccaaggccaucggcaucuccgagcccgucaagguccccuacuccaaguuccucaugcaccccgaggagcucuucgucgucggccuccccgagggcaucucccuccgccgccccaacugcuucggcaucgccaagcuccgcaagauccucgaggccuccaacuccauccaguucgucaucaagcgccccgagcuccucaccgagggcgucaaggagcccaucauggacucccaggagcgcgacuccggcgacccccucgucgacgagucccucaagcgccagggcuuccaggagaacuacgacgcccgccucucccgcaucgacaucgccaacacccuccgcgagcagguccaggaccucuucaacaagaaguacggcgaggcccucggcaucaaguaccccguccagguccccuacaagcgcaucaaguccaaccccggcuccgucaucaucgagggccucccccccggcauccccuuccgcaagcccugcaccuucggcucccagaaccucgagcgcauccucgccgucgccgacaagaucaaguucaccgucacccgccccuuccagggccucauccccaagcccgacgaggacgacgccaaccgccucggcgagaaggucauccuccgcgagcaggucaaggagcucuucaacgagaaguacggcgaggcccucggccucaaccgccccguccucguccccuacaagcucauccgcgacucccccgacgccgucgaggucaccggccuccccgacgacauccccuuccgcaaccccaacaccuacgacauccaccgccucgagaagauccucaaggcccgcgagcacguccgcauggucaucaucaaccagcuccagcccuucgccgagaucugcaacgacgccaagguccccgccaaggacuccuccauccccaagcgcaagcgcaagcgcgucuccgagggcaacuccgucuccuccuccuccuccuccuccuccuccuccuccuccaaccccgacuccgucgccuccgccaaccagaucucccucguccaguggcccauguacauggucgacuacgccggccucaacguccagcuccccggcccccucaacuacuga

SEQ ID NO: 43972 - RNA, 2850 nt, Artificial Sequence
  derived and/or modified sequence opt2 from GTF2IRD2__Homo_sapiens__NP_775808
auggcccaggucgccgucuccacccuccccgucgaggaggaguccuccuccgagacccgcauggucgucaccuuccucgucuccgcccucgaguccaugugcaaggagcucgccaaguccaaggccgaggucgccugcaucgccgucuacgagaccgacgucuucgucgucggcaccgagcgcggcugcgccuucgucaacgcccgcaccgacuuccagaaggacuucgccaaguacugcgucgccgagggccucugcgaggucaagccccccugccccgucaacggcaugcagguccacuccggcgagaccgagauccuccgcaaggccgucgaggacuacuucugcuucugcuacggcaaggcccucggcaccaccgucaugguccccguccccuacgagaagaugcuccgcgaccaguccgccgucgucguccagggccuccccgagggcgucgccuuccagcaccccgagaacuacgaccucgccacccucaaguggauccucgagaacaaggccggcaucuccuucaucaucaaccgccccuuccucggccccgagucccagcucggcggccccggcauggucaccgacgccgagcgcuccaucgucucccccuccgaguccugcggccccaucaacgucaagaccgagcccauggaggacuccggcaucucccucaaggccgaggccgucuccgucaagaaggaguccgaggaccccaacuacuaccaguacaacaugcagggcucccaccccuccuccaccuccaacgaggucaucgagauggagcuccccauggaggacuccaccccccucguccccuccgaggagcccaacgaggaccccgaggccgaggucaagaucgagggcaacaccaacuccuccuccgucaccaacuccgccgccggcgucgaggaccucaacaucguccaggucaccguccccgacaacgagaaggagcgccucuccuccaucgagaagaucaagcagcuccgcgagcaggucaacgaccucuucucccgcaaguucggcgaggccaucggcgucgacuuccccgucaagguccccuaccgcaagaucaccuucaaccccggcugcgucgucaucgacggcaugccccccggcgucgucuucaaggcccccggcuaccucgagaucuccuccaugcgccgcauccucgaggccgccgaguucaucaaguucaccgucauccgcccccuccccggccucgagcucuccaacgucggcaagcgcaagaucgaccaggagggccgcgucuuccaggagaagugggagcgcgccuacuucuucgucgagguccagaacauccccaccugccucaucugcaagcaguccauguccgucuccaaggaguacaaccuccgccgccacuaccagaccaaccacuccaagcacuacgaccaguacauggagcgcaugcgcgacgagaagcuccacgagcucaagaagggccuccgcaaguaccuccucggcuccuccgacaccgagugccccgagcagaagcaggucuucgccaaccccucccccacccagaagucccccguccagcccgucgaggaccucgccggcaaccucugggagaagcuccgcgagaagauccgcuccuucgucgccuacuccaucgccaucgacgagaucaccgacaucaacaacaccacccagcucgccaucuucauccgcggcgucgacgagaacuucgacgucuccgaggagcuccucgacaccguccccaugaccggcaccaaguccggcaacgagaucuucucccgcgucgagaagucccucaagaaguucugcaucgacugguccaagcucgucuccgucgccuccaccggcacccccgccauggucgacgccaacaacggccucgucaccaagcucaagucccgcgucgccaccuucugcaagggcgccgagcucaaguccaucugcugcaucauccaccccgagucccucugcgcccagaagcucaagauggaccacgucauggacgucgucgucaaguccgucaacuggaucugcucccgcggccucaaccacuccgaguucaccacccuccucuacgagcucgacucccaguacggcucccuccucuacuacaccgagaucaaguggcucucccgcggccucguccucaagcgcuucuucgagucccucgaggagaucgacuccuucauguccucccgcggcaagccccucccccagcucuccuccaucgacuggauccgcgaccucgccuuccucgucgacaugaccaugcaccucaacgcccucaacaucucccuccagggccacucccagaucgucacccagauguacgaccucauccgcgccuuccucgccaagcucugccucugggagacccaccucacccgcaacaaccucgcccacuuccccacccucaagcucgccucccgcaacgaguccgacggccucaacuacauccccaagaucgccgagcucaagaccgaguuccagaagcgccucuccgacuucaagcucuacgaguccgagcucacccucuucuccucccccuucuccaccaagaucgacuccguccacgaggagcuccagauggaggucaucgaccuccagugcaacaccguccucaagaccaaguacgacaaggucggcauccccgaguucuacaaguaccucuggggcuccuaccccaaguacaagcaccacugcgccaagauccucuccauguucggcuccaccuacaucugcgagcagcucuucuccaucaugaagcucuccaagaccaaguacugcucccagcucaaggacucccagugggacuccguccuccacaucgccaccuga

SEQ ID NO: 43973 - RNA, 1098 nt, Artificial Sequence
  derived and/or modified sequence opt2 from GTF3A__Homo_sapiens__NP_002088
auggacccccccgccgucgucgccgaguccgucuccucccucaccaucgccgacgccuucaucgccgccggcgaguccuccgcccccacccccccccgccccgcccucccccgccgcuucaucugcuccuuccccgacugcuccgccaacuacuccaaggccuggaagcucgacgcccaccucugcaagcacaccggcgagcgccccuucgucugcgacuacgagggcugcggcaaggccuucauccgcgacuaccaccucucccgccacauccucacccacaccggcgagaagcccuucgucugcgccgccaacggcugcgaccagaaguucaacaccaaguccaaccucaagaagcacuucgagcgcaagcacgagaaccagcagaagcaguacaucugcuccuucgaggacugcaagaagaccuucaagaagcaccagcagcucaagauccaccagugccagcacaccaacgagccccucuucaagugcacccaggagggcugcggcaagcacuucgccucccccuccaagcucaagcgccacgccaaggcccacgagggcuacgucugccagaagggcugcuccuucgucgccaagaccuggaccgagcuccucaagcacguccgcgagacccacaaggaggagauccucugcgaggucugccgcaagaccuucaagcgcaaggacuaccucaagcagcacaugaagacccacgcccccgagcgcgacgucugccgcugcccccgcgagggcugcggccgcaccuacaccaccgucuucaaccuccagucccacauccucuccuuccacgaggagucccgccccuucgucugcgagcacgccggcugcggcaagaccuucgccaugaagcagucccucacccgccacgccgucguccacgaccccgacaagaagaagaugaagcucaaggucaagaagucccgcgagaagcgcucccucgccucccaccucuccggcuacaucccccccaagcgcaagcagggccagggccucucccucugccagaacggcgagucccccaacugcgucgaggacaagaugcucuccaccgucgccguccucacccucggcuga

SEQ ID NO: 43974 - RNA, 6330 nt, Artificial Sequence
  derived and/or modified sequence opt2 from GTF3C1__Homo_sapiens__NP_001511
auggacgcccucgagucccuccucgacgaggucgcccucgagggccucgacggccucugccuccccgcccucuggucccgccucgagacccgcgucccccccuucccccucccccucgagcccugcacccaggaguuccucuggcgcgcccucgccacccaccccggcaucuccuucuacgaggagccccgcgagcgccccgaccuccagcuccaggaccgcuacgaggagaucgaccucgagaccggcauccucgagucccgccgcgaccccgucgcccucgaggacgucuaccccauccacaugauccucgagaacaaggacggcauccagggcuccugccgcuacuucaaggagcgcaagaacaucaccaacgacauccgcaccaagucccuccagccccgcugcaccauggucgaggccuucgaccgcuggggcaagaagcucaucaucgucgccucccaggccaugcgcuaccgcgcccucaucggccaggagggcgaccccgaccucaagcuccccgacuucuccuacugcauccucgagcgccucggccgcucccgcuggcagggcgagcuccagcgcgaccuccacaccaccgccuucaaggucgacgccggcaagcuccacuaccaccgcaagauccucaacaagaacggccucaucaccaugcagucccacgucauccgccuccccaccggcgcccagcagcacuccauccuccuccuccucaaccgcuuccacgucgaccgccgcuccaaguacgacauccucauggagaagcucuccgucaugcucuccacccgcaccaaccacaucgagacccucggcaagcuccgcgaggagcucggccucugcgagcgcaccuucaagcgccucuaccaguacaugcucaacgccggccucgccaaggucgucucccuccgccuccaggagauccaccccgagugcggccccugcaagaccaagaagggcaccgacgucaugguccgcugccucaagcuccucaaggaguucaagcgcaacgaccacgacgacgacgaggacgaggaggucaucuccaagaccgucccccccgucgacaucgucuucgagcgcgacaugcucacccagaccuacgaccucaucgagcgccgcggcaccaagggcaucucccaggccgagauccgcgucgccaugaacgucggcaagcucgaggcccgcaugcucugccgccuccuccagcgcuucaaggucgucaagggcuucauggaggacgagggccgccagcgcaccaccaaguacaucuccugcgucuucgccgaggaguccgaccucucccgccaguaccagcgcgagaaggcccgcuccgagcuccucaccaccgucucccucgccuccaugcaggaggagucccuccuccccgagggcgaggacaccuuccucuccgaguccgacuccgaggaggagcgcuccuccuccaagcgccgcggccgcggcucccagaaggacacccgcgccuccgccaaccuccgccccaagacccagccccaccacuccacccccaccaagggcggcuggaaggucgucaaccuccacccccucaagaagcagccccccuccuuccccggcgccgccgaggagcgcgccugccagucccucgccucccgcgacucccuccucgacaccuccuccgucuccgagcccaacgucuccuucgucucccacugcgccgacuccaacuccggcgacaucgccgucaucgaggagguccgcauggagaaccccaaggaguccuccuccucccucaagaccggccgccacuccuccggccaggacaagccccacgagaccuaccgccuccucaagcgccgcaaccucaucaucgaggccgucaccaaccuccgccucaucgagucccucuucaccauccagaagaugaucauggaccaggagaagcaggagggcgucuccaccaagugcugcaagaaguccaucguccgccucguccgcaaccucuccgaggagggccuccuccgccucuaccgcaccaccgucauccaggacggcaucaagaagaaggucgaccucgucguccaccccuccauggaccagaacgacccccucguccgcuccgccaucgagcagguccgcuuccgcaucuccaacuccuccaccgccaaccgcgucaagaccucccagccccccgucccccagggcgaggccgaggaggacucccagggcaaggagggccccuccggcuccggcgacucccagcucuccgccuccucccgcuccgaguccggccgcaugaagaaguccgacaacaagaugggcaucaccccccuccgcaacuaccaccccaucgucguccccggccucggccgcucccucggcuuccuccccaagaugccccgccuccgcgucguccacauguuccucugguaccucaucuacggccaccccgccuccaacaccgucgagaagcccuccuucaucuccgagcgccgcaccaucaagcaggaguccggccgcgccggcguccgccccuccuccuccggcuccgccugggaggccugcuccgaggcccccuccaagggcucccaggacggcgucaccugggaggccgaggucgagcucgccaccgagaccgucuacgucgacgacgccuccuggaugcgcuacaucccccccauccccguccaccgcgacuucggcuucggcugggcccucgucuccgacauccuccucugccucccccucuccaucuucauccagaucguccaggucuccuacaaggucgacaaccucgaggaguuccucaacgacccccucaagaagcacacccucauccgcuuccucccccgccccauccgccagcagcuccucuacaagcgccgcuacaucuucuccgucgucgagaaccuccagcgccucugcuacaugggccuccuccaguucggccccaccgagaaguuccaggacaaggaccaggucuucaucuuccucaagaagaacgccgucaucgucgacaccaccaucugcgacccccacuacaaccucgcccgcuccucccgccccuucgagcgccgccucuacguccucaacuccaugcaggacgucgagaacuacugguucgaccuccagugcgucugccucaacaccccccucggcgucguccgcugcccccgcguccgcaagaacuccuccaccgaccagggcuccgacgaggagggcucccuccagaaggagcaggaguccgccauggacaagcacaaccucgagcgcaagugcgccaugcucgaguacaccaccggcucccgcgaggucgucgacgagggccucauccccggcgacggccucggcgccgccggccucgacuccuccuucuacggccaccucaagcgcaacuggaucuggaccuccuacaucaucaaccaggccaagaaggagaacaccgccgccgagaacggccucaccguccgccuccagaccuuccucuccaagcgccccaugccccucuccgcccgcggcaacucccgccucaacaucuggggcgaggcccgcgucggcuccgagcucugcgccggcugggaggagcaguucgaggucgaccgcgagcccucccucgaccgcaaccgccgcguccgcggcggcaagucccagaagcgcaagcgccucaagaaggaccccggcaagaagaucaagcgcaagaagaagggcgaguuccccggcgagaaguccaagcgccuccgcuaccacgacgaggccgaccaguccgcccuccagcgcaugacccgccuccgcgucaccugguccaugcaggaggacggccuccucguccucugccgcaucgccuccaacguccucaacaccaaggucaagggccccuucgucaccuggcaggucguccgcgacauccuccacgccaccuucgaggagucccucgacaagaccucccacuccgucggccgccgcgcccgcuacaucgucaagaacccccaggccuaccucaacuacaaggucugccucgccgaggucuaccaggacaaggcccucgucggcgacuucaugaaccgccgcggcgacuacgacgaccccaaggucugcgccaacgaguucaaggaguucgucgagaagcucaaggagaaguucuccuccgcccuccgcaacuccaaccucgagauccccgacacccuccaggagcucuucgcccgcuaccgcguccucgccaucggcgacgagaaggaccagacccgcaaggaggacgagcucaacuccgucgacgacauccacuuccucguccuccagaaccucauccaguccacccucgcccucuccgacucccagaugaaguccuaccaguccuuccagaccuuccgccucuaccgcgaguacaaggaccacguccucgucaaggccuucauggagugccagaagcgcucccucgucaaccgccgccgcgucaaccacacccucggccccaagaagaaccgcgcccuccccuucguccccauguccuaccagcucucccagaccuacuaccgcaucuucaccuggcgcuuccccuccaccaucugcaccgaguccuuccaguuccucgaccgcaugcgcgccgccggcaagcucgaccagcccgaccgcuucuccuucaaggaccaggacaacaacgagcccaccaacgacauggucgccuucucccucgacggccccggcggcaacugcgucgccguccucacccucuucucccucggccucaucuccgucgacguccgcauccccgagcagaucaucgucgucgacuccuccauggucgagaacgaggucaucaagucccucggcaaggacggcucccucgaggacgacgaggacgaggaggacgaccucgacgagggcgucggcggcaagcgccgcuccauggaggucaagcccgcccaggccucccacaccaacuaccuccucaugcgcggcuacuacucccccggcaucgucuccacccgcaaccucaaccccaacgacuccaucgucgucaacuccugccagaugaaguuccagcuccgcugcacccccguccccgcccgccuccgccccgccgccgccccccucgaggagcucaccaugggcaccuccugccuccccgacaccuucaccaagcucaucaacccccaggagaacaccugcucccucgaggaguucguccuccagcucgagcucuccggcuacucccccgaggaccucaccgccgcccucgagauccucgaggccaucaucgccaccggcugcuucggcaucgacaaggaggagcuccgccgccgcuucuccgcccucgagaaggccggcggcggccgcacccgcaccuucgccgacugcauccaggcccuccucgagcagcaccagguccucgaggucggcggcaacaccgcccgccucgucgccaugggcuccgccuggcccuggcuccuccacuccguccgccucaaggaccgcgaggacgccgacauccagcgcgaggacccccaggcccgcccccucgagggcuccuccuccgaggacuccccccccgagggccaggccccccccucccacuccccccgcggcaccaagcgccgcgccuccugggccuccgagaacggcgagaccgacgccgagggcacccagaugacccccgccaagcgccccgcccuccaggacuccaaccucgcccccucccucggccccggcgccgaggacggcgccgaggcccaggcccccucccccccccccgcccucgaggacaccgccgccgccggcgccgcccaggaggaccaggagggcgucggcgaguucuccucccccggccaggagcagcucuccggccaggcccagccccccgagggcuccgaggacccccgcggcuucaccgaguccuucggcgccgccaacaucucccaggccgcccgcgagcgcgacugcgaguccgucugcuucaucggccgccccuggcgcgucgucgacggccaccucaaccuccccgucugcaagggcaugauggaggccaugcucuaccacaucaugacccgccccggcauccccgaguccucccuccuccgccacuaccagggcguccuccagcccgucgccguccucgagcuccuccagggccucgagucccucggcugcauccgcaagcgcuggcuccgcaagccccgccccgucucccucuucuccacccccgucgucgaggaggucgagguccccuccucccucgacgagucccccauggccuucuacgagcccacccucgacugcacccuccgccucggccgcgucuucccccacgaggucaacuggaacaaguggauccaccucuga

SEQ ID NO: 43975 - RNA, 2010 nt, Artificial Sequence
  derived and/or modified sequence opt2 from GTPBP1__Homo_sapiens__NP_004277
auggccaccgagcgcucccgcuccgccauggacucccccguccccgccuccauguucgcccccgagcccuccucccccggcgccgcccgcgccgccgccgccgccgcccgccuccacggcggcuucgacuccgacugcuccgaggacggcgaggcccucaacggcgagcccgagcucgaccucaccuccaagcucguccucgucucccccaccuccgagcaguacgacucccuccuccgccagaugugggagcgcauggacgagggcugcggcgagaccaucuacgucaucggccagggcuccgacggcaccgaguacggccucuccgaggccgacauggaggccuccuacgccaccgucaaguccauggccgagcagaucgaggccgacgucauccuccuccgcgagcgccaggaggccggcggccgcguccgcgacuaccucguccgcaagcgcgucggcgacaacgacuuccucgagguccgcgucgccgucgucggcaacgucgacgccggcaaguccacccuccucggcguccucacccacggcgagcucgacaacggccgcggcuucgcccgccagaagcucuuccgccacaagcacgagaucgaguccggccgcaccuccuccgucggcaacgacauccucggcuucgacuccgagggcaacgucgucaacaagcccgacucccacggcggcucccucgaguggaccaagaucugcgagaaguccaccaaggucaucaccuucaucgaccucgccggccacgagaaguaccucaagaccaccgucuucggcaugaccggccaccuccccgacuucugcaugcucauggucggcuccaacgccggcaucgucggcaugaccaaggagcaccucggccucgcccucgcccucaacguccccgucuucgucgucgucaccaagaucgacaugugccccgccaacauccuccaggagacccucaagcuccuccagcgccuccucaagucccccggcugccgcaagauccccguccucguccaguccaaggacgacgucaucgucaccgccuccaacuucuccuccgagcgcaugugccccaucuuccagaucuccaacgucaccggcgagaaccucgaccuccucaagauguuccucaaccuccucuccccccgcaccuccuaccgcgaggaggagcccgccgaguuccagaucgacgacaccuacuccguccccggcgucggcaccgucgucuccggcaccacccuccgcggccucaucaagcucaacgacacccuccuccucggccccgacccccucggcaacuuccucuccaucgccgucaaguccauccaccgcaagcgcaugcccgucaaggagguccgcggcggccagaccgccuccuucgcccucaagaagaucaagcgcuccuccauccgcaagggcauggucauggucuccccccgccucaacccccaggccuccugggaguucgaggccgagauccucguccuccaccaccccaccaccaucuccccccgcuaccaggccaugguccacugcggcuccauccgccagaccgccaccauccucuccauggacaaggacugccuccgcaccggcgacaaggccaccguccacuuccgcuucaucaagacccccgaguaccuccacaucgaccagcgccucgucuuccgcgagggccgcaccaaggccgucggcaccaucaccaagcuccuccagaccaccaacaacucccccaugaacuccaagccccagcagaucaagaugcaguccaccaagaagggcccccucaccaagcgcgacgagggcggccccuccggcggccccgccgucggcgcccccccccccggcgacgaggccuccuccgucggcgccggccagcccgccgccuccuccaaccuccagccccagcccaagcccuccuccggcggccgccgccgcggcggccagcgccacaaggucaagucccagggcgccugcgucacccccgccuccggcugcuga

SEQ ID NO: 43976 - RNA, 1416 nt, Artificial Sequence
  derived and/or modified sequence opt2 from GTPBP3__Homo_sapiens__NP_001122327
auguggcgcggccucuggacccucgccgcccaggccgcccgcggcccccgccgccucugcacccgccgcuccuccggcgcccccgcccccggcuccggcgccaccaucuucgcccucuccuccggccagggccgcugcggcaucgccgucauccgcaccuccggccccgccuccggccacgcccuccgcauccucaccgccccccgcgaccucccccucgcccgccacgccucccuccgccuccucuccgacccccgcuccggcgagccccucgaccgcgcccucguccucugguuccccggcccccaguccuucaccggcgaggacugcgucgaguuccacguccacggcggccccgccgucgucuccggcguccuccaggcccucggcuccguccccggccuccgccccgccgaggccggcgaguucacccgccgcgccuucgccaacggcaagcucaaccucaccgaggucgagggccucgccgaccucauccacgccgagaccgaggcccagcgccgccaggcccuccgccagcucgacggcgagcucggccaccucugccgcggcugggccgagacccucaccaaggcccucgcccacgucgaggccuacaucgacuucggcgaggacgacaaccucgaggagggcguccucgagcaggccgacaucgagguccgcgcccuccaggucgcccucggcgcccaccuccgcgacgcccgccgcggccagcgccuccgcuccggcguccacgucgucgucaccggcccccccaacgccggcaaguccucccucgucaaccuccucucccgcaagcccgucuccaucgucucccccgagcccggcaccacccgcgacguccucgagacccccgucgaccucgccggcuuccccguccuccucuccgacaccgccggccuccgcgagggcgucggccccgucgagcaggagggcguccgccgcgcccgcgaguccugcaacuuccucgccaccgucgucgccuccgucggcgcccagucccccuccgacuccucccagcgccuccuccucguccucaacaaguccgaccuccucucccccgagggccccggccccggccccgaccuccccccccaccuccuccucuccugccucaccggcgagggccucgacggccuccucgaggcccuccgcaaggagcucgccgccgucugcggcgaccccuccaccgaccccccccuccucacccgcgcccgccaccagcaccaccuccagggcugccucgacgcccucggccacuacaagcaguccaaggaccucgcccucgccgccgaggcccuccgcgucgcccgcggccaccucacccgccucaccggcggcggcggcaccgaggagauccucgacaucaucuuccaggacuucugcgucggcaaguga

SEQ ID NO: 43977 - RNA, 1905 nt, Artificial Sequence
  derived and/or modified sequence opt2 from GTPBP4__Homo_sapiens__NP_036473
auggcccacuacaacuucaagaagaucaccgucguccccuccgccaaggacuucaucgaccucacccucuccaagacccagcgcaagacccccaccgucauccacaagcacuaccagauccaccgcauccgccacuucuacaugcgcaaggucaaguucacccagcagaacuaccacgaccgccucucccagauccucaccgacuuccccaagcucgacgacauccaccccuucuacgccgaccucaugaacauccucuacgacaaggaccacuacaagcucgcccucggccagaucaacaucgccaagaaccucgucgacaacgucgccaaggacuacguccgccucaugaaguacggcgacucccucuaccgcugcaagcagcucaagcgcgccgcccucggccgcaugugcaccgucaucaagcgccagaagcagucccucgaguaccucgagcagguccgccagcaccucucccgccuccccaccaucgaccccaacacccgcacccuccuccucugcggcuaccccaacgucggcaaguccuccuucaucaacaaggucacccgcgccgacgucgacguccagcccuacgccuucaccaccaagucccucuucgucggccacauggacuacaaguaccuccgcuggcaggucgucgacacccccggcauccucgaccacccccucgaggaccgcaacaccaucgagaugcaggccaucaccgcccucgcccaccuccgcgccgccguccucuacgucauggaccucuccgagcagugcggccacggccuccgcgagcagcucgagcucuuccagaacauccgcccccucuucaucaacaagccccucaucgucgucgccaacaagugcgacgucaagcgcaucgccgagcucuccgaggacgaccagaagaucuucaccgaccuccaguccgagggcuuccccgucaucgagaccuccacccucaccgaggagggcgucaucaaggucaagaccgaggccugcgaccgccuccucgcccaccgcgucgagaccaagaugaagggcaacaaggucaacgagguccucaaccgccuccaccucgccauccccacccgccgcgacgacaaggagcgcccccccuucauccccgagggcgucgucgcccgccgcaagcgcauggagaccgaggagucccgcaagaagcgcgagcgcgaccucgagcucgagaugggcgacgacuacauccucgaccuccagaaguacugggaccucaugaaccucuccgagaagcacgacaagauccccgagaucugggagggccacaacaucgccgacuacaucgaccccgccaucaugaagaagcucgaggagcucgagaaggaggaggagcuccgcaccgccgccggcgaguacgacuccgucuccgaguccgaggacgaggagaugcucgagauccgccagcucgccaagcagauccgcgagaagaagaagcucaagauccucgaguccaaggagaagaacacccagggcccccgcaugccccgcaccgccaagaagguccagcgcaccguccucgagaaggagaugcgcucccucggcgucgacauggacgacaaggacgacgcccacuacgccguccaggcccgccgcucccgcuccaucacccgcaagcgcaagcgcgaggacuccgccccccccuccuccgucgcccgcuccggcuccugcucccgcaccccccgcgacgucuccggccuccgcgacgucaagauggucaagaaggccaagaccaugaugaagaacgcccagaagaagaugaaccgccucggcaagaagggcgaggccgaccgccacgucuucgacaugaagcccaagcaccuccucuccggcaagcgcaaggccggcaagaaggaccgccgcuga

SEQ ID NO: 43978 - RNA, 504 nt, Artificial Sequence
  derived and/or modified sequence opt2 from GTSF1__Homo_sapiens__NP_653195
auggaggagaccuacaccgacucccucgaccccgagaagcuccuccagugccccuacgacaagaaccaccagauccgcgccugccgcuuccccuaccaccucaucaagugccgcaagaaccaccccgacgucgccuccaagcucgccaccugccccuucaacgcccgccaccaggucccccgcgccgagaucucccaccacaucuccuccugcgacgaccgcuccugcaucgagcaggacgucgucaaccagacccgcucccuccgccaggagacccucgccgaguccaccuggcagugcccccccugcgacgaggacugggacaaggaccucugggagcagaccuccacccccuucgucuggggcaccacccacuacuccgacaacaacucccccgccuccaacaucgucaccgagcacaagaacaaccucgccuccggcaugcgcguccccaagucccuccccuacguccuccccuggaagaacaacggcaacgcccaguga

SEQ ID NO: 43979 - RNA, 606 nt, Artificial Sequence
  derived and/or modified sequence opt2 from GUCA1A__Homo_sapiens__NP_000400
augggcaacgucauggagggcaaguccgucgaggagcucuccuccaccgagugccaccagugguacaagaaguucaugaccgagugccccuccggccagcucacccucuacgaguuccgccaguucuucggccucaagaaccucucccccuccgccucccaguacgucgagcagauguucgagaccuucgacuucaacaaggacggcuacaucgacuucauggaguacgucgccgcccucucccucguccucaagggcaaggucgagcagaagcuccgcugguacuucaagcucuacgacgucgacggcaacggcugcaucgaccgcgacgagcuccucaccaucauccaggccauccgcgccaucaaccccugcuccgacaccaccaugaccgccgaggaguucaccgacaccgucuucuccaagaucgacgucaacggcgacggcgagcucucccucgaggaguucaucgagggcguccagaaggaccagaugcuccucgacacccucacccgcucccucgaccucacccgcaucguccgccgccuccagaacggcgagcaggacgaggagggcgccgacgaggccgccgaggccgccggcuga

SEQ ID NO: 43980 - RNA, 603 nt, Artificial Sequence
  derived and/or modified sequence opt2 from GUCA1B__Homo_sapiens__NP_002089
augggccaggaguucuccugggaggaggccgaggccgccggcgagaucgacgucgccgagcuccaggagugguacaagaaguucgucauggagugccccuccggcacccucuucaugcacgaguucaagcgcuucuucaaggucaccgacgacgaggaggccucccaguacgucgagggcauguuccgcgccuucgacaagaacggcgacaacaccaucgacuuccucgaguacgucgccgcccucaaccucguccuccgcggcacccucgagcacaagcucaaguggaccuucaagaucuacgacaaggacggcaacggcugcaucgaccgccucgagcuccucaacaucgucgagggcaucuaccagcucaagaaggccugccgccgcgagcuccagaccgagcagggccagcuccucacccccgaggaggucgucgaccgcaucuuccuccucgucgacgagaacggcgacggccagcucucccucaacgaguucgucgagggcgcccgccgcgacaagugggucaugaagaugcuccagauggacaugaaccccuccuccuggcucgcccagcagcgccgcaaguccgccauguucuga

SEQ ID NO: 43981 - RNA, 720 nt, Artificial Sequence
  derived and/or modified sequence opt2 from GUCD1__Homo_sapiens__NP_001271183
augcgcaccgaggccgaggccgccggccccccccucgagcccggcgacuucguccagcuccccguccccgucauccagcagcucuaccacugggacugcggccucgccugcucccgcaugguccuccgcuaccucggccagcucgacgacuccgaguucgagcgcgcccuccagaagcuccagcucacccgcuccaucuggaccaucgaccucgccuaccucaugcaccacuucggcguccgccaccgcuucugcacccagacccucggcgucgacaagggcuacaagaaccaguccuucuaccgcaagcacuucgacaccgaggagacccgcgucaaccagcucuucgcccaggccaaggccugcaagguccucgucgagaagugcaccgucuccgucaaggacauccaggcccaccucgcccagggccacgucgccaucguccucgucaacuccggcguccuccacugcgaccucugcuccucccccgucaaguacugcugcuucacccccuccggccaccacugcuucugccgcacccccgacuaccagggccacuucaucguccuccgcggcuacaaccgcgccaccggcugcaucuucuacaacaaccccgccuacgccgaccgcaugugcuccaccuccaucuccaacuucgaggaggcccgcaccuccuacggcaccgacgaggacauccucuucgucuaccucgacuccuga

SEQ ID NO: 43982 - RNA, 2199 nt, Artificial Sequence
  derived and/or modified sequence opt2 from GUCY1A2__Homo_sapiens__NP_000846
augucccgccgcaagaucuccuccgaguccuucuccucccucggcuccgacuaccucgagaccucccccgaggaggagggcgagugcccccucucccgccucugcuggaacggcucccgcuccccccccggcccccucgagcccucccccgccgccgccgccgccgccgccgcccccgcccccacccccgccgccuccgccgccgccgccgccgccaccgccggcgcccgccgcguccagcgccgccgccgcgucaaccucgacucccucggcgaguccaucucccgccucaccgcccccuccccccagaccauccagcagacccucaagcgcacccuccaguacuacgagcaccaggucaucggcuaccgcgacgccgagaagaacuuccacaacaucuccaaccgcugcuccuacgccgaccacuccaacaaggaggagaucgaggacgucuccggcauccuccagugcaccgccaacauccucggccucaaguucgaggagauccagaagcgcuucggcgaggaguucuucaacaucugcuuccacgagaacgagcgcguccuccgcgccgucggcggcacccuccaggacuucuucaacggcuucgacgcccuccucgagcacauccgcaccuccuucggcaagcaggccacccucgagucccccuccuuccucugcaaggagcuccccgagggcacccucaugcuccacuacuuccacccccaccacaucgucggcuucgccaugcucggcaugaucaaggccgccggcaagaagaucuaccgccucgacgucgaggucgagcaggucgccaacgagaagcucugcuccgacgucuccaaccccggcaacugcuccugccucaccuuccucaucaaggagugcgagaacaccaacaucaugaagaaccucccccagggcaccucccagguccccgccgaccuccgcaucuccaucaacaccuucugccgcgccuuccccuuccaccucauguucgaccccuccauguccguccuccagcucggcgagggccuccgcaagcagcuccgcugcgacacccacaagguccucaaguucgaggacugcuucgagaucgucucccccaaggucaacgccaccuucgagcgcguccuccuccgccucuccacccccuucgucauccgcaccaagcccgaggccuccggcuccgagaacaaggacaaggucauggaggucaagggccagaugauccacguccccgaguccaacuccauccucuuccucggcucccccugcgucgacaagcucgacgagcucaugggccgcggccuccaccucuccgacauccccauccacgacgccacccgcgacgucauccucgucggcgagcaggccaaggcccaggacggccucaagaagcgcauggacaagcucaaggccacccucgagcgcacccaccaggcccucgaggaggagaagaagaagaccgucgaccuccucuacuccaucuuccccggcgacgucgcccagcagcucuggcagggccagcagguccaggcccgcaaguucgacgacgucaccaugcucuucuccgacaucgucggcuucaccgccaucugcgcccagugcacccccaugcaggucaucuccaugcucaacgagcucuacacccgcuucgaccaccagugcggcuuccucgacaucuacaaggucgagaccaucggcgacgccuacugcgucgccgccggccuccaccgcaagucccucugccacgccaagcccaucgcccucauggcccucaagaugauggagcucuccgaggagguccucacccccgacggccgccccauccagaugcgcaucggcauccacuccggcuccguccucgccggcgucgucggcguccgcaugccccgcuacugccucuucggcaacaacgucacccucgccuccaaguucgaguccggcucccacccccgccgcaucaacgucucccccaccaccuaccagcuccucaagcgcgaggaguccuucaccuucaucccccgcucccgcgaggagcuccccgacaacuuccccaaggagauccccggcaucugcuacuuccucgagguccgcaccggccccaagccccccaagcccucccucuccuccucccgcaucaagaaggucuccuacaacaucggcaccauguuccuccgcgagaccucccucuga

SEQ ID NO: 43983 - RNA, 1368 nt, Artificial Sequence
  derived and/or modified sequence opt2 from GUCY1A3__Homo_sapiens__NP_001124157
augccccccugcuuccacaacgacugcuccgaguucgucaaccagcccuaccuccucuacuccguccacaugaaguccaccaagcccucccucucccccuccaagccccaguccucccucgucauccccaccucccucuucugcaagaccuuccccuuccacuucauguucgacaaggacaugaccauccuccaguucggcaacggcauccgccgccucaugaaccgccgcgacuuccagggcaagcccaacuucgaggaguacuucgagauccucacccccaagaucaaccagaccuucuccggcaucaugaccaugcucaacaugcaguucgucguccgcguccgccgcugggacaacuccgucaagaaguccucccgcgucauggaccucaagggccagaugaucuacaucgucgaguccuccgccauccucuuccucggcucccccugcgucgaccgccucgaggacuucaccggccgcggccucuaccucuccgacauccccauccacaacgcccuccgcgacgucguccucaucggcgagcaggcccgcgcccaggacggccucaagaagcgccucggcaagcucaaggccacccucgagcaggcccaccaggcccucgaggaggagaagaagaagaccgucgaccuccucugcuccaucuuccccugcgaggucgcccagcagcucuggcagggccaggucguccaggccaagaaguucuccaacgucaccaugcucuucuccgacaucgucggcuucaccgccaucugcucccagugcuccccccuccaggucaucaccaugcucaacgcccucuacacccgcuucgaccagcagugcggcgagcucgacgucuacaaggucgagaccaucggcgacgccuacugcgucgccggcggccuccacaaggaguccgacacccacgccguccagaucgcccucauggcccucaagaugauggagcucuccgacgaggucauguccccccacggcgagcccaucaagaugcgcaucggccuccacuccggcuccgucuucgccggcgucgucggcgucaagaugccccgcuacugccucuucggcaacaacgucacccucgccaacaaguucgaguccugcuccgucccccgcaagaucaacgucucccccaccaccuaccgccuccucaaggacugccccggcuucgucuucaccccccgcucccgcgaggagcucccccccaacuuccccuccgagauccccggcaucugccacuuccucgacgccuaccagcagggcaccaacuccaagcccugcuuccagaagaaggacgucgaggacggcaacgccaacuuccucggcaaggccuccggcaucgacuga

SEQ ID NO: 43984 - RNA, 1860 nt, Artificial Sequence
  derived and/or modified sequence opt2 from GUCY1B3__Homo_sapiens__NP_000848
auguacggcuucgucaaccacgcccucgagcuccucgucauccgcaacuacggccccgaggucugggaggacaucaagaaggaggcccagcucgacgaggagggccaguuccucguccgcaucaucuacgacgacuccaagaccuacgaccucgucgccgccgccuccaagguccucaaccucaacgccggcgagauccuccagauguucggcaagauguucuucgucuucugccaggaguccggcuacgacaccauccuccgcguccucggcuccaacguccgcgaguuccuccagaaccucgacgcccuccacgaccaccucgccaccaucuaccccggcaugcgcgcccccuccuuccgcugcaccgacgccgagaagggcaagggccucauccuccacuacuacuccgagcgcgagggccuccaggacaucgucaucggcaucaucaagaccgucgcccagcagauccacggcaccgagaucgacaugaaggucauccagcagcgcaacgaggagugcgaccacacccaguuccucaucgaggagaaggaguccaaggaggaggacuucuacgaggaccucgaccgcuucgaggagaacggcacccaggagucccgcaucucccccuacaccuucugcaaggccuuccccuuccacaucaucuucgaccgcgaccucgucgucacccagugcggcaacgccaucuaccgcguccucccccagcuccagcccggcaacugcucccuccucuccgucuucucccucguccgcccccacaucgacaucuccuuccacggcauccucucccacaucaacaccgucuucguccuccgcuccaaggagggccuccucgacgucgagaagcucgagugcgaggacgagcucaccggcaccgagaucuccugccuccgccucaagggccagaugaucuaccuccccgaggccgacuccauccucuuccucugcucccccuccgucaugaaccucgacgaccucacccgccgcggccucuaccucuccgacaucccccuccacgacgccacccgcgaccucguccuccucggcgagcaguuccgcgaggaguacaagcucacccaggagcucgagauccucaccgaccgccuccagcucacccuccgcgcccucgaggacgagaagaagaagaccgacacccuccucuacuccguccucccccccuccgucgccaacgagcuccgccacaagcgccccguccccgccaagcgcuacgacaacgucaccauccucuucuccggcaucgucggcuucaacgccuucugcuccaagcacgccuccggcgagggcgccaugaagaucgucaaccuccucaacgaccucuacacccgcuucgacacccucaccgacucccgcaagaaccccuucgucuacaaggucgagaccgucggcgacaaguacaugaccgucuccggccuccccgagcccugcauccaccacgcccgcuccaucugccaccucgcccucgacaugauggagaucgccggccagguccaggucgacggcgaguccguccagaucaccaucggcauccacaccggcgaggucgucaccggcgucaucggccagcgcaugccccgcuacugccucuucggcaacaccgucaaccucaccucccgcaccgagaccaccggcgagaagggcaagaucaacgucuccgaguacaccuaccgcugccucaugucccccgagaacuccgacccccaguuccaccucgagcaccgcggccccgucuccaugaagggcaagaaggagcccaugcaggucugguuccucucccgcaagaacaccggcaccgaggagaccaagcaggacgacgacuga

SEQ ID NO: 43985 - RNA, 3222 nt, Artificial Sequence
  derived and/or modified sequence opt2 from GUCY2C__Homo_sapiens__NP_004954
augaagacccuccuccucgaccucgcccucuggucccuccucuuccagcccggcuggcucuccuucuccucccaggucucccagaacugccacaacggcuccuacgagaucuccguccucaugaugggcaacuccgccuucgccgagccccucaagaaccucgaggacgccgucaacgagggccucgagaucguccgcggccgccuccagaacgccggccucaacgucaccgucaacgccaccuucauguacuccgacggccucauccacaacuccggcgacugccgcuccuccaccugcgagggccucgaccuccuccgcaagaucuccaacgcccagcgcaugggcugcguccucaucggccccuccugcaccuacuccaccuuccagauguaccucgacaccgagcucuccuaccccaugaucuccgccggcuccuucggccucuccugcgacuacaaggagacccucacccgccucaugucccccgcccgcaagcucauguacuuccucgucaacuucuggaagaccaacgaccuccccuucaagaccuacuccugguccaccuccuacgucuacaagaacggcaccgagaccgaggacugcuucugguaccucaacgcccucgaggccuccgucuccuacuucucccacgagcucggcuucaaggucguccuccgccaggacaaggaguuccaggacauccucauggaccacaaccgcaaguccaacgucaucaucaugugcggcggccccgaguuccucuacaagcucaagggcgaccgcgccgucgccgaggacaucgucaucauccucgucgaccucuucaacgaccaguacuucgaggacaacgucaccgcccccgacuacaugaagaacguccucguccucacccucucccccggcaacucccuccucaacuccuccuucucccgcaaccucucccccaccaagcgcgacuucgcccucgccuaccucaacggcauccuccucuucggccacaugcucaagaucuuccucgagaacggcgagaacaucaccacccccaaguucgcccacgccuuccgcaaccucaccuucgagggcuacgacggccccgucacccucgacgacuggggcgacgucgacuccaccaugguccuccucuacaccuccgucgacaccaagaaguacaagguccuccucaccuacgacacccacgucaacaagaccuaccccgucgacaugucccccaccuucaccuggaagaacuccaagcuccccaacgacaucaccggccgcggcccccagauccucaugaucgccgucuucacccucaccggcgccgucguccuccuccuccucgucgcccuccucaugcuccgcaaguaccgcaaggacuacgagcuccgccagaagaaguggucccacaucccccccgagaacaucuucccccucgagaccaacgagaccaaccacgucucccucaagaucgacgacgacaagcgccgcgacaccauccagcgccuccgccagugcaaguacgacaagaagcgcgucauccucaaggaccucaagcacaacgacggcaacuucaccgagaagcagaagaucgagcucaacaagcuccuccagaucgacuacuacaaccucaccaaguucuacggcaccgucaagcucgacaccaugaucuucggcgucaucgaguacugcgagcgcggcucccuccgcgagguccucaacgacaccaucuccuaccccgacggcaccuucauggacugggaguucaagaucuccguccucuacgacaucgccaagggcauguccuaccuccacuccuccaagaccgagguccacggccgccucaaguccaccaacugcgucgucgacucccgcauggucgucaagaucaccgacuucggcugcaacuccauccucccccccaagaaggaccucuggaccgcccccgagcaccuccgccaggccaacaucucccagaagggcgacgucuacuccuacggcaucaucgcccaggagaucauccuccgcaaggagaccuucuacacccucuccugccgcgaccgcaacgagaagaucuuccgcgucgagaacuccaacggcaugaagcccuuccgccccgaccucuuccucgagaccgccgaggagaaggagcucgaggucuaccuccucgucaagaacugcugggaggaggaccccgagaagcgccccgacuucaagaagaucgagaccacccucgccaagaucuucggccucuuccacgaccagaagaacgaguccuacauggacacccucauccgccgccuccagcucuacucccgcaaccucgagcaccucgucgaggagcgcacccagcucuacaaggccgagcgcgaccgcgccgaccgccucaacuucaugcuccucccccgccucgucgucaagucccucaaggagaagggcuucgucgagcccgagcucuacgaggaggucaccaucuacuucuccgacaucgucggcuucaccaccaucugcaaguacuccacccccauggaggucgucgacaugcucaacgacaucuacaaguccuucgaccacaucgucgaccaccacgacgucuacaaggucgagaccaucggcgacgccuacauggucgccuccggccuccccaagcgcaacggcaaccgccacgccaucgacaucgccaagauggcccucgagauccucuccuucaugggcaccuucgagcucgagcaccuccccggccuccccaucuggauccgcaucggcguccacuccggccccugcgccgccggcgucgucggcaucaagaugccccgcuacugccucuucggcgacaccgucaacaccgccucccgcauggaguccaccggccucccccuccgcauccacgucuccggcuccaccaucgccauccucaagcgcaccgagugccaguuccucuacgagguccgcggcgagaccuaccucaagggccgcggcaacgagaccaccuacuggcucaccggcaugaaggaccagaaguucaaccuccccaccccccccaccgucgagaaccagcagcgccuccaggccgaguucuccgacaugaucgccaacucccuccagaagcgccaggccgccggcauccgcucccagaagccccgccgcgucgccuccuacaagaagggcacccucgaguaccuccagcucaacaccaccgacaaggaguccaccuacuucuga

SEQ ID NO: 43986 - RNA, 3312 nt, Artificial Sequence
  derived and/or modified sequence opt2 from GUCY2D__Homo_sapiens__NP_000171
augaccgccugcgcccgccgcgccggcggccuccccgaccccggccucugcggccccgccuggugggcccccucccucccccgccucccccgcgcccucccccgccucccccuccuccuccuccuccuccuccuccagccccccgcccucuccgccgucuucaccgucggcguccucggccccugggccugcgaccccaucuucucccgcgcccgccccgaccucgccgcccgccucgccgccgcccgccucaaccgcgaccccggccucgccggcggcccccgcuucgaggucgcccuccuccccgagcccugccgcacccccggcucccucggcgccgucuccuccgcccucgcccgcgucuccggccucgucggccccgucaaccccgccgccugccgccccgccgagcuccucgccgaggaggccggcaucgcccucguccccuggggcugccccuggacccaggccgagggcaccaccgcccccgccgucacccccgccgccgacgcccucuacgcccuccuccgcgccuucggcugggcccgcgucgcccucgucaccgccccccaggaccucugggucgaggccggccgcucccucuccaccgcccuccgcgcccgcggccuccccgucgccuccgucaccuccauggagccccucgaccucuccggcgcccgcgaggcccuccgcaagguccgcgacggcccccgcgucaccgccgucaucauggucaugcacuccguccuccucggcggcgaggagcagcgcuaccuccucgaggccgccgaggagcucggccucaccgacggcucccucgucuuccuccccuucgacaccauccacuacgcccucucccccggccccgaggcccucgccgcccucgccaacuccucccagcuccgccgcgcccacgacgccguccucacccucacccgccacugccccuccgagggcuccguccucgacucccuccgccgcgcccaggagcgccgcgagcuccccuccgaccucaaccuccagcaggucuccccccucuucggcaccaucuacgacgccgucuuccuccucgcccgcggcgucgccgaggcccgcgccgccgccggcggccgcugggucuccggcgccgccgucgcccgccacauccgcgacgcccagguccccggcuucugcggcgaccucggcggcgacgaggagccccccuucguccuccucgacaccgacgccgccggcgaccgccucuucgccaccuacaugcucgaccccgcccgcggcuccuuccucuccgccggcacccgcaugcacuucccccgcggcggcuccgcccccggccccgaccccuccugcugguucgaccccaacaacaucugcggcggcggccucgagcccggccucgucuuccucggcuuccuccucgucgucggcaugggccucgccggcgccuuccucgcccacuacguccgccaccgccuccuccacaugcagauggucuccggccccaacaagaucauccucaccgucgacgacaucaccuuccuccacccccacggcggcaccucccgcaaggucgcccagggcucccgcuccucccucggcgcccgcuccauguccgacauccgcuccggccccucccagcaccucgacucccccaacaucggcgucuacgagggcgaccgcgucuggcucaagaaguuccccggcgaccagcacaucgccauccgccccgccaccaagaccgccuucuccaagcuccaggagcuccgccacgagaacgucgcccucuaccucggccucuuccucgcccgcggcgccgagggccccgccgcccucugggagggcaaccucgccgucgucuccgagcacugcacccgcggcucccuccaggaccuccucgcccagcgcgagaucaagcucgacuggauguucaaguccucccuccuccucgaccucaucaagggcauccgcuaccuccaccaccgcggcgucgcccacggccgccucaagucccgcaacugcaucgucgacggccgcuucguccucaagaucaccgaccacggccacggccgccuccucgaggcccagaagguccuccccgagcccccccgcgccgaggaccagcucuggaccgcccccgagcuccuccgcgaccccgcccucgagcgccgcggcacccucgccggcgacgucuucucccucgccaucaucaugcaggaggucgucugccgcuccgcccccuacgccaugcucgagcucacccccgaggaggucguccagcgcguccgcuccccccccccccucugccgcccccucgucuccauggaccaggcccccgucgagugcauccuccucaugaagcagugcugggccgagcagcccgagcuccgccccuccauggaccacaccuucgaccucuucaagaacaucaacaagggccgcaagaccaacaucaucgacuccaugcuccgcaugcucgagcaguacuccuccaaccucgaggaccucauccgcgagcgcaccgaggagcucgagcucgagaagcagaagaccgaccgccuccucacccagaugcucccccccuccgucgccgaggcccucaagaccggcacccccgucgagcccgaguacuucgagcaggucacccucuacuucuccgacaucgucggcuucaccaccaucuccgccauguccgagcccaucgaggucgucgaccuccucaacgaccucuacacccucuucgacgccaucaucggcucccacgacgucuacaaggucgagaccaucggcgacgccuacauggucgccuccggccucccccagcgcaacggccagcgccacgccgccgagaucgccaacaugucccucgacauccucuccgccgucggcaccuuccgcaugcgccacaugcccgagguccccguccgcauccgcaucggccuccacuccggccccugcgucgccggcgucgucggccucaccaugccccgcuacugccucuucggcgacaccgucaacaccgccucccgcauggaguccaccggccuccccuaccgcauccacgucaaccucuccaccgucggcauccuccgcgcccucgacuccggcuaccaggucgagcuccgcggccgcaccgagcucaagggcaagggcgccgaggacaccuucuggcucgucggccgccgcggcuucaacaagcccauccccaagccccccgaccuccagcccggcuccuccaaccacggcaucucccuccaggagaucccccccgagcgccgccgcaagcucgagaaggcccgccccggccaguucuccuga

SEQ ID NO: 43987 - RNA, 3327 nt, Artificial Sequence
  derived and/or modified sequence opt2 from GUCY2F__Homo_sapiens__NP_001513
auguuccucggccucggccgcuucucccgccucguccucugguucgccgccuuccgcaagcuccucggccaccacggccucgccuccgccaaguuccucuggugccucugccuccucuccgucaugucccucccccagcaggucuggacccuccccuacaagaucggcgucgucggccccugggccugcgacucccucuucuccaaggcccuccccgaggucgccgcccgccucgccaucgagcgcaucaaccgcgaccccuccuucgaccucuccuacuccuucgaguacgucauccucaacgaggacugccagaccucccgcgcccucuccuccuucaucucccaccaccagauggccuccggcuucaucggccccaccaaccccggcuacugcgaggccgccucccuccucggcaacuccugggacaagggcaucuucuccugggccugcgucaacuacgagcucgacaacaagaucuccuaccccaccuucucccgcacccuccccucccccauccgcguccucgucaccgucaugaaguacuuccagugggcccacgccggcgucaucuccuccgacgaggacaucuggguccacaccgccaaccgcgucgccuccgcccuccgcucccacggccuccccgucggcgucguccucaccaccggccaggacucccaguccaugcgcaaggcccuccagcgcauccaccaggccgaccgcauccgcaucaucaucaugugcaugcacuccgcccucaucggcggcgagacccagaugcaccuccucgagugcgcccacgaccucaagaugaccgacggcaccuacgucuucguccccuacgacgcccuccucuacucccuccccuacaagcacacccccuaccgcguccuccgcaacaaccccaagcuccgcgaggccuacgacgccguccucaccaucaccgucgagucccaggagaagaccuucuaccaggccuucaccgaggccgccgcccgcggcgagauccccgagaagcucgaguucgaccaggucuccccccucuucggcaccaucuacaacuccaucuacuucaucgcccaggccaugaacaacgccaugaaggagaacggccaggccggcgccgccucccucguccagcacucccgcaacaugcaguuccacggcuucaaccagcucaugcgcaccgacuccaacggcaacggcaucuccgaguacgucauccucgacaccaaccucaaggagugggagcuccacuccaccuacaccgucgacauggagauggagcuccuccgcuucggcggcacccccauccacuuccccggcggccgccccccccgcgccgacgccaagugcugguucgccgagggcaagaucugccacggcggcaucgaccccgccuucgccaugauggucugccucacccuccucaucgcccuccucuccaucaacggcuucgccuacuucauccgccgccgcaucaacaagauccagcucaucaagggccccaaccgcauccuccucacccucgaggacgucaccuucaucaacccccacuucggcuccaagcgcggcucccgcgccuccgucuccuuccagaucaccuccgagguccaguccggccgcuccccccgccucuccuucuccuccggcucccucacccccgccaccuacgagaacuccaacaucgccaucuacgagggcgacugggucuggcucaagaaguucucccucggcgacuucggcgaccucaaguccaucaagucccgcgccuccgacgucuucgagaugaugaaggaccuccgccacgagaacaucaacccccuccucggcuucuucuacgacuccggcauguucgccaucgucaccgaguucugcucccgcggcucccucgaggacauccucaccaaccaggacgucaagcucgacuggauguucaaguccucccuccuccucgaccucaucaagggcaugaaguaccuccaccaccgcgaguucguccacggccgccucaagucccgcaacugcgucgucgacggccgcuucguccucaaggucaccgacuacggcuucaacgacauccucgagaugcuccgccucuccgaggaggaguccuccauggaggagcuccucuggaccgcccccgagcuccuccgcgccccccgcggcucccgccucggcuccuucgccggcgacgucuacuccuucgccaucaucaugcaggaggucaugguccgcggcacccccuucugcaugauggaccuccccgcccaggagaucaucaaccgccucaagaagcccccccccgucuaccgccccgucgucccccccgagcacgccccccccgagugccuccagcucaugaagcagugcugggccgaggccgccgagcagcgccccaccuucgacgagaucuucaaccaguucaagaccuucaacaagggcaagaagaccaacaucaucgacuccaugcuccgcaugcucgagcaguacuccuccaaccucgaggaccucauccgcgagcgcaccgaggagcucgagaucgagaagcagaagaccgagaagcuccucacccagaugcucccccccuccgucgccgagucccucaagaagggcugcaccgucgagcccgagggcuucgaccucgucacccucuacuucuccgacaucgucggcuucaccaccaucuccgccauguccgagcccaucgaggucgucgaccuccucaacgaccucuacacccucuucgacgccaucaucggcucccacgacgucuacaaggucgagaccaucggcgacgccuacauggucgccuccggccuccccaagcgcaacggcucccgccacgccgccgagaucgccaacaugucccucgacauccucuccuccgucggcaccuucaagaugcgccacaugcccgagguccccguccgcauccgcaucggccuccacuccggccccgucgucgccggcgucgucggccucaccaugccccgcuacugccucuucggcgacaccgucaacaccgccucccgcauggaguccaccggccuccccuaccgcauccacgucucccucuccaccgucaccauccuccagaaccucuccgagggcuacgaggucgagcuccgcggccgcaccgagcucaagggcaagggcaccgaggagaccuucuggcucaucggcaagaagggcuucaugaagccccuccccguccccccccccgucgacaaggacggccaggucggccacggccuccagcccgucgagaucgccgccuuccagcgccgcaaggccgagcgccagcucguccgcaacaagcccuga

SEQ ID NO: 43988 - RNA, 657 nt, Artificial Sequence
  derived and/or modified sequence opt2 from GUK1__Homo_sapiens__NP_001152862
augcuccgccgcccccucgccggccucgccgccgccgcccucggccgcgccccccccgacggcauguccggcccccgccccgucguccucuccggccccuccggcgccggcaaguccacccuccucaagcgccuccuccaggagcacuccggcaucuucggcuucuccgucucccacaccacccgcaacccccgccccggcgaggagaacggcaaggacuacuacuucgucacccgcgaggucaugcagcgcgacaucgccgccggcgacuucaucgagcacgccgaguucuccggcaaccucuacggcaccuccaaggucgccguccaggccguccaggccaugaaccgcaucugcguccucgacgucgaccuccagggcguccgcaacaucaaggccaccgaccuccgccccaucuacaucuccguccagccccccucccuccacguccucgagcagcgccuccgccagcgcaacaccgagaccgaggagucccucgucaagcgccucgccgccgcccaggccgacauggaguccuccaaggagcccggccucuucgacgucgucaucaucaacgacucccucgaccaggccuacgccgagcucaaggaggcccucuccgaggagaucaagaaggcccagcgcaccggcgccuga

SEQ ID NO: 43989 - RNA, 876 nt, Artificial Sequence
  derived and/or modified sequence opt2 from GULP1__Homo_sapiens__NP_001239597
augaaccgcgccuucucccgcaagaaggacaagaccuggaugcacacccccgaggcccucuccaagcacuucauccccuacaacgccaaguuccucggcuccaccgaggucgagcagcccaagggcaccgaggucguccgcgacgccguccgcaagcucaaguucgcccgccacaucaagaaguccgagggccagaagauccccaaggucgagcuccagaucuccaucuacggcgucaagauccucgagcccaagaccaaggagguccagcacaacugccagcuccaccgcaucuccuucugcgccgacgacaagaccgacaagcgcaucuucaccuucaucugcaaggacuccgaguccaacaagcaccucugcuacgucuucgacuccgagaagugcgccgaggagaucacccucaccaucggccaggccuucgaccucgccuaccgcaaguuccucgaguccggcggcaaggacgucgagacccgcaagcagaucgccggccuccagaagcgcauccaggaccucgagaccgagaacauggagcucaagaacaagguccaggaccucgagaaccagcuccgcaucacccaggucuccgccccccccgccggcuccaugacccccaagucccccuccaccgacaucuucgacaugauccccuucucccccaucucccaccaguccuccaugcccacccgcaacggcacccagcccccccccguccccucccgcuccaccgagaucaagcgcgaccucuucggcgccgagcccuucgaccccuucaacugcggcgccgccgacuucccccccgacauccaguccaagcucgacgagaugcagcgccagcgcuggcgcggcuccaagugggacuga

SEQ ID NO: 43990 - RNA, 1956 nt, Artificial Sequence
  derived and/or modified sequence opt2 from GUSB__Homo_sapiens__NP_000172
auggcccgcggcuccgccgucgccugggccgcccucggcccccuccucuggggcugcgcccucggccuccagggcggcaugcucuacccccaggagucccccucccgcgagugcaaggagcucgacggccucugguccuuccgcgccgacuucuccgacaaccgccgccgcggcuucgaggagcagugguaccgccgcccccucugggaguccggccccaccgucgacaugcccguccccuccuccuucaacgacaucucccaggacuggcgccuccgccacuucgucggcugggucugguacgagcgcgaggucauccuccccgagcgcuggacccaggaccuccgcacccgcgucguccuccgcaucggcuccgcccacuccuacgccaucgucugggucaacggcgucgacacccucgagcacgagggcggcuaccuccccuucgaggccgacaucuccaaccucguccaggucggcccccuccccucccgccuccgcaucaccaucgccaucaacaacacccucacccccaccacccucccccccggcaccauccaguaccucaccgacaccuccaaguaccccaagggcuacuucguccagaacaccuacuucgacuucuucaacuacgccggccuccagcgcuccguccuccucuacaccacccccaccaccuacaucgacgacaucaccgucaccaccuccgucgagcaggacuccggccucgucaacuaccagaucuccgucaagggcuccaaccucuucaagcucgagguccgccuccucgacgccgagaacaaggucgucgccaacggcaccggcacccagggccagcucaagguccccggcgucucccucugguggcccuaccucaugcacgagcgccccgccuaccucuacucccucgagguccagcucaccgcccagaccucccucggccccgucuccgacuucuacacccuccccgucggcauccgcaccgucgccgucaccaagucccaguuccucaucaacggcaagcccuucuacuuccacggcgucaacaagcacgaggacgccgacauccgcggcaagggcuucgacuggccccuccucgucaaggacuucaaccuccuccgcuggcucggcgccaacgccuuccgcaccucccacuaccccuacgccgaggaggucaugcagaugugcgaccgcuacggcaucgucgucaucgacgagugccccggcgucggccucgcccucccccaguucuucaacaacgucucccuccaccaccacaugcaggucauggaggaggucguccgccgcgacaagaaccaccccgccgucgucaugugguccgucgccaacgagcccgccucccaccucgaguccgccggcuacuaccucaagauggucaucgcccacaccaagucccucgaccccucccgccccgucaccuucgucuccaacuccaacuacgccgccgacaagggcgcccccuacgucgacgucaucugccucaacuccuacuacuccugguaccacgacuacggccaccucgagcucauccagcuccagcucgccacccaguucgagaacugguacaagaaguaccagaagcccaucauccaguccgaguacggcgccgagaccaucgccggcuuccaccaggaccccccccucauguucaccgaggaguaccagaagucccuccucgagcaguaccaccucggccucgaccagaagcgccgcaaguacgucgucggcgagcucaucuggaacuucgccgacuucaugaccgagcagucccccacccgcguccucggcaacaagaagggcaucuucacccgccagcgccagcccaaguccgccgccuuccuccuccgcgagcgcuacuggaagaucgccaacgagacccgcuacccccacuccgucgccaagucccagugccucgagaacucccucuucaccuga

SEQ ID NO: 43991 - RNA, 1002 nt, Artificial Sequence
  derived and/or modified sequence opt2 from GYG1__Homo_sapiens__NP_001171649
augaccgaccaggccuucgucacccucaccaccaacgacgccuacgccaagggcgcccucguccucggcuccucccucaagcagcaccgcaccacccgccgccucgucguccucgccaccccccaggucuccgacuccaugcgcaagguccucgagaccgucuucgacgaggucaucauggucgacguccucgacuccggcgacuccgcccaccucacccucaugaagcgccccgagcucggcgucacccucaccaagcuccacugcuggucccucacccaguacuccaagugcgucuucauggacgccgacacccucguccucgccaacaucgacgaccucuucgaccgcgaggagcucuccgccgcccccgaccccggcuggcccgacugcuucaacuccggcgucuucgucuaccagcccuccgucgagaccuacaaccagcuccuccaccucgccuccgagcagggcuccuucgacggcggcgaccagggcauccucaacaccuucuucuccuccugggccaccaccgacauccgcaagcaccuccccuucaucuacaaccucuccuccaucuccaucuacuccuaccuccccgccuucaaggucuucggcgccuccgccaaggucguccacuuccucggccgcgucaagcccuggaacuacaccuacgaccccaagaccaaguccgucaaguccgaggcccacgaccccaacaugacccaccccgaguuccucauccucugguggaacaucuucaccaccaacguccucccccuccuccagcaguucggccucgucaaggacaccugcuccuacgucaacgucgaggacgucuccggcgccaucucccaccucucccucggcgagauccccgccauggcccagcccuucgucuccuccgaggagcgcaaggagcgcugggagcagggccaggccgacuacaugggcgccgacuccuucgacaacaucaagcgcaagcucgacaccuaccuccaguga

SEQ ID NO: 43992 - RNA, 1413 nt, Artificial Sequence
  derived and/or modified sequence opt2 from GYG2__Homo_sapiens__NP_001073324
auguccgucaccgaccaggccuucgucacccucgccaccaacgacaucuacugccagggcgcccucguccucggccagucccuccgccgccaccgccucacccgcaagcucgucguccucaucaccccccaggucuccucccuccuccgcgucauccucuccaaggucuucgacgaggucaucgaggucaaccucaucgacuccgccgacuacauccaccucgccuuccucaagcgccccgagcucggccucacccucaccaagcuccacugcuggacccucacccacuacuccaagugcgucuuccucgacgccgacacccucguccucuccaacgucgacgagcucuucgaccgcggcgaguucuccgccgcccccgaccccggcuggcccgacugcuucaacuccggcgucuucgucuuccagcccucccuccacacccacaagcuccuccuccagcacgccauggagcacggcuccuucgacggcgccgaccagggccuccucaacuccuucuuccgcaacugguccaccaccgacauccacaagcaccuccccuucaucuacaaccucuccuccaacaccauguacaccuacucccccgccuucaagcaguucggcuccuccgccaaggucguccacuuccucggcuccaugaagcccuggaacuacaaguacaacccccaguccggcuccguccucgagcagggcuccgccuccuccucccagcaccaggccgccuuccuccaccucugguggaccgucuaccagaacaacguccucccccucuacaaguccguccaggccggcgaggcccgcgccucccccggccacacccucugccacuccgacgucggcggccccugcgccgacuccgccuccggcgucggcgagcccugcgagaacuccacccccuccgccggcguccccugcgccaacuccccccucggcuccaaccagcccgcccagggccuccccgagcccacccagaucgucgacgagacccucucccuccccgagggccgccgcuccgaggacaugaucgccugccccgagaccgagacccccgccgucaucaccugcgacccccucucccagcccuccccccagcccgccgacuucaccgagaccgagaccauccuccagcccgccaacaaggucgaguccgucuccuccgaggagaccuucgagcccucccaggagcuccccgccgaggcccuccgcgaccccucccuccaggacgcccucgaggucgaccucgccgucuccgucucccagaucuccaucgaggagaaggucaaggagcucucccccgaggaggagcgccgcaagugggaggagggccgcaucgacuacaugggcaaggacgccuucgcccgcauccaggagaagcucgaccgcuuccuccaguga

SEQ ID NO: 43993 - RNA, 2166 nt, Artificial Sequence
  derived and/or modified sequence opt2 from GYLTL1B__Homo_sapiens__NP_001287650
augcucccccgcggccgcccccgcgcccucggcgccgccgcccuccuccuccuccuccuccuccucggcuuccuccucuucggcggcgaccucggcugcgagcgccgcgagcccggcggccgcgccggcgcccccggcugcuuccccggcccccucaugccccgcgucccccccgacggccgccuccgccgcgccgccgcccucgacggcgaccccggcgccggccccggcgaccacaaccgcuccgacugcggcccccagcccccccccccccccaagugcgagcuccuccacgucgccaucgucugcgccggccacaacuccucccgcgacgucaucacccucgucaaguccaugcucuucuaccgcaagaacccccuccaccuccaccucgucaccgacgccgucgcccgcaacauccucgagacccucuuccacaccuggaugguccccgccguccgcgucuccuucuaccacgccgaccagcucaagccccaggucuccuggauccccaacaagcacuacuccggccucuacggccucaugaagcucguccuccccuccgcccuccccgccgagcucgcccgcgucaucguccucgacaccgacgucaccuucgccuccgacaucuccgagcucugggcccucuucgcccacuucuccgacacccaggccaucggccucgucgagaaccaguccgacugguaccucggcaaccucuggaagaaccaccgccccuggcccgcccucggccgcggcuucaacaccggcgucauccuccuccgccucgaccgccuccgccaggccggcugggagcagauguggcgccucaccgcccgccgcgagcuccucucccuccccgccaccucccucgccgaccaggacaucuucaacgccgucaucaaggagcaccccggccucguccagcgccuccccugcgucuggaacguccagcucuccgaccacacccucgccgagcgcugcuacuccgaggccuccgaccucaaggucauccacuggaacucccccaagaagcuccgcgucaagaacaagcacgucgaguucuuccgcaacuucuaccucaccuuccucgaguacgacggcaaccuccuccgccgcgagcucuucgucugccccucccagcccccccccggcgccgagcagcuccagcaggcccucgcccagcucgacgaggaggaccccugcuucgaguuccgccagcagcagcucaccguccaccgcguccacgucaccuuccucccccacgagcccccccccccccgcccccacgacgucacccucgucgcccagcucuccauggaccgccuccagaugcucgaggcccucugccgccacuggcccggccccaugucccucgcccucuaccucaccgacgccgaggcccagcaguuccuccacuucgucgaggccucccccguccucgccgcccgccaggacgucgccuaccacgucgucuaccgcgagggcccccucuaccccgucaaccagcuccgcaacgucgcccucgcccaggcccucacccccuacgucuuccucuccgacaucgacuuccuccccgccuacucccucuacgacuaccuccgcgccuccaucgagcagcucggccucggcucccgccgcaaggccgcccucgucguccccgccuucgagacccuccgcuaccgcuucuccuucccccacuccaaggucgagcuccucgcccuccucgacgccggcacccucuacaccuuccgcuaccacgaguggccccgcggccacgcccccaccgacuacgcccgcuggcgcgaggcccaggcccccuaccgcguccagugggccgccaacuacgagcccuacgucgucgucccccgcgacugcccccgcuacgacccccgcuucgucggcuucggcuggaacaaggucgcccacaucgucgagcucgacgcccaggaguacgagcuccucguccuccccgaggccuucaccauccaccucccccacgcccccucccucgacaucucccgcuuccgcuccucccccaccuaccgcgacugccuccaggcccucaaggacgaguuccaccaggaccucucccgccaccacggcgccgccgcccucaaguaccuccccgcccuccagcagccccagucccccgcccgcggcuga

SEQ ID NO: 43994 - RNA, 453 nt, Artificial Sequence
  derived and/or modified sequence opt2 from GYPA__Homo_sapiens__NP_002090
auguacggcaagaucaucuucguccuccuccucuccgagaucgucuccaucuccgcccucuccaccaccgaggucgccaugcacaccuccaccuccuccuccgucaccaaguccuacaucuccucccagaccaacgacacccacaagcgcgacaccuacgccgccaccccccgcgcccacgaggucuccgagaucuccguccgcaccgucuacccccccgaggaggagaccggcgagcgcguccagcucgcccaccacuucuccgagcccgagaucacccucaucaucuucggcgucauggccggcgucaucggcaccauccuccucaucuccuacggcauccgccgccucaucaagaagucccccuccgacgucaagccccuccccucccccgacaccgacgucccccucuccuccgucgagaucgagaaccccgagaccuccgaccaguga

SEQ ID NO: 43995 - RNA, 276 nt, Artificial Sequence
  derived and/or modified sequence opt2 from GYPB__Homo_sapiens__NP_002091
auguacggcaagaucaucuucguccuccuccucuccgagaucgucuccaucuccgcccucuccaccaccgaggucgccaugcacaccuccaccuccuccuccgucaccaaguccuacaucuccucccagaccaacggcgagaccggccagcucguccaccgcuucaccguccccgcccccgucgucaucauccucaucauccucugcgucauggccggcaucaucggcaccauccuccucaucuccuacaccauccgccgccucaucaaggccuga

SEQ ID NO: 43996 - RNA, 324 nt, Artificial Sequence
  derived and/or modified sequence opt2 from GYPC__Homo_sapiens__NP_001243513
auggccuccgccuccaccaccaugcacaccaccaccaucgccgagcccgaccccggcauguccggcuggcccgacggccgcauggagaccuccacccccaccaucauggacaucgucgucaucgccggcgucaucgccgccgucgccaucguccucgucucccuccucuucgucaugcuccgcuacauguaccgccacaagggcaccuaccacaccaacgaggccaagggcaccgaguucgccgaguccgccgacgccgcccuccagggcgaccccgcccuccaggacgccggcgacuccucccgcaaggaguacuucaucuga

SEQ ID NO: 43997 - RNA, 237 nt, Artificial Sequence
  derived and/or modified sequence opt2 from GYPE__Homo_sapiens__NP_002093
auguacggcaagaucaucuucguccuccuccucuccggcaucgucuccaucuccgccuccuccaccaccggcgucgccaugcacaccuccaccuccuccuccgucaccaaguccuacaucuccucccagaccaacggcaucacccucaucaacuggugggccauggcccgcgucaucuucgaggucaugcucgucgucgucggcaugaucauccucaucuccuacugcauccgcuga

SEQ ID NO: 43998 - RNA, 2022 nt, Artificial Sequence
  derived and/or modified sequence opt2 from GYS1__Homo_sapiens__NP_001155059
augccccucaaccgcacccucuccauguccucccuccccggccucgaggacugggaggacgaguucgaccucgagaacgccguccucuucgaggucgccugggaggucgccaacaaggucggcggcaucuacaccguccuccagaccaaggccaaggucaccggcgacgaguggggcgacaacuacuuccucgucggccccuacaccgagcagggcguccgcacccaggucgagcuccucgaggcccccacccccgcccucaagcgcacccucgacuccaugaacuccaagggcugcaaguuccucgcccaguccgaggagaagccccacgucgucgcccacuuccacgaguggcucgccggcgucggccucugccucugccgcgcccgccgccuccccgucgccaccaucuucaccacccacgccacccuccucggccgcuaccucugcgccggcgccgucgacuucuacaacaaccucgagaacuucaacgucgacaaggaggccggcgagcgccagaucuaccaccgcuacugcauggagcgcgccgccgcccacugcgcccacgucuucaccaccgucucccagaucaccgccaucgaggcccagcaccuccucaagcgcaagcccgacaucgucacccccaacggccucaacgucaagaaguucuccgccaugcacgaguuccagaaccuccacgcccaguccaaggcccgcauccaggaguucguccgcggccacuucuacggccaccucgacuucaaccucgacaagacccucuacuucuucaucgccggccgcuacgaguucuccaacaagggcgccgacgucuuccucgaggcccucgcccgccucaacuaccuccuccgcgucaacggcuccgagcagaccgucgucgccuucuucaucaugcccgcccgcaccaacaacuucaacgucgagacccucaagggccaggccguccgcaagcagcucugggacaccgccaacaccgucaaggagaaguucggccgcaagcucuacgagucccuccucgucggcucccuccccgacaugaacaagaugcucgacaaggaggacuucaccaugaugaagcgcgccaucuucgccacccagcgccaguccuucccccccgucugcacccacaacaugcucgacgacuccuccgaccccauccucaccaccauccgccgcaucggccucuucaacuccuccgccgaccgcgucaaggucaucuuccaccccgaguuccucuccuccaccuccccccuccuccccgucgacuacgaggaguucguccgcggcugccaccucggcgucuuccccuccuacuacgagcccuggggcuacacccccgccgagugcaccgucaugggcauccccuccaucuccaccaaccucuccggcuucggcugcuucauggaggagcacaucgccgaccccuccgccuacggcaucuacauccucgaccgccgcuuccgcucccucgacgacuccugcucccagcucaccuccuuccucuacuccuucugccagcagucccgccgccagcgcaucauccagcgcaaccgcaccgagcgccucuccgaccuccucgacuggaaguaccucggccgcuacuacauguccgcccgccacauggcccucuccaaggccuuccccgagcacuucaccuacgagcccaacgaggccgacgccgcccagggcuaccgcuacccccgccccgccuccgucccccccucccccucccucucccgccacuccuccccccaccaguccgaggacgaggaggacccccgcaacggcccccucgaggaggacggcgagcgcuacgacgaggacgaggaggccgccaaggaccgccgcaacauccgcgcccccgaguggccccgccgcgccuccugcaccuccuccaccuccggcuccaagcgcaacuccgucgacaccgccaccuccuccucccucuccacccccuccgagccccucucccccaccuccucccucggcgaggagcgcaacuga

SEQ ID NO: 43999 - RNA, 2112 nt, Artificial Sequence
  derived and/or modified sequence opt2 from GYS2__Homo_sapiens__NP_068776
augcuccgcggccgcucccucuccgucaccucccucggcggccucccccagugggaggucgaggagcuccccgucgaggagcuccuccucuucgaggucgccugggaggucaccaacaaggucggcggcaucuacaccgucauccagaccaaggccaagaccaccgccgacgaguggggcgagaacuacuuccucaucggccccuacuucgagcacaacaugaagacccaggucgagcagugcgagcccgucaacgacgccguccgccgcgccgucgacgccaugaacaagcacggcugccagguccacuucggccgcuggcucaucgagggcucccccuacgucguccucuucgacaucggcuacuccgccuggaaccucgaccgcuggaagggcgaccucugggaggccugcuccgucggcauccccuaccacgaccgcgaggccaacgacaugcucaucuucggcucccucaccgccugguuccucaaggaggucaccgaccacgccgacggcaaguacgucgucgcccaguuccacgaguggcaggccggcaucggccucauccucucccgcgcccgcaagcuccccaucgccaccaucuucaccacccacgccacccuccucggccgcuaccucugcgccgccaacaucgacuucuacaaccaccucgacaaguucaacaucgacaaggaggccggcgagcgccagaucuaccaccgcuacugcauggagcgcgccuccguccacugcgcccacgucuucaccaccgucuccgagaucaccgccaucgaggccgagcacaugcucaagcgcaagcccgacgucgucacccccaacggccucaacgucaagaaguucuccgccguccacgaguuccagaaccuccacgccauguacaaggcccgcauccaggacuucguccgcggccacuucuacggccaccucgacuucgaccucgagaagacccucuuccucuucaucgccggccgcuacgaguucuccaacaagggcgccgacaucuuccucgagucccucucccgccucaacuuccuccuccgcaugcacaaguccgacaucaccgucauggucuucuucaucaugcccgccaagaccaacaacuucaacgucgagacccucaagggccaggccguccgcaagcagcucugggacgucgcccacuccgucaaggagaaguucggcaagaagcucuacgacgcccuccuccgcggcgagauccccgaccucaacgacauccucgaccgcgacgaccucaccaucaugaagcgcgccaucuucuccacccagcgccagucccucccccccgucaccacccacaacaugaucgacgacuccaccgaccccauccucuccaccauccgccgcaucggccucuucaacaaccgcaccgaccgcgucaaggucauccuccaccccgaguuccucuccuccaccuccccccuccuccccauggacuacgaggaguucguccgcggcugccaccucggcgucuuccccuccuacuacgagcccuggggcuacacccccgccgagugcaccgucaugggcauccccuccgucaccaccaaccucuccggcuucggcugcuucaugcaggagcacgucgccgaccccaccgccuacggcaucuacaucgucgaccgccgcuuccgcucccccgacgacuccugcaaccagcucaccaaguuccucuacggcuucugcaagcagucccgccgccagcgcaucauccagcgcaaccgcaccgagcgccucuccgaccuccucgacuggcgcuaccucggccgcuacuaccagcacgcccgccaccucacccucucccgcgccuuccccgacaaguuccacgucgagcucaccuccccccccaccaccgagggcuucaaguacccccgccccuccuccgucccccccucccccuccggcucccaggccuccuccccccaguccuccgacgucgaggacgaggucgaggacgagcgcuacgacgaggaggaggaggccgagcgcgaccgccucaacaucaagucccccuucucccucucccacgucccccacggcaagaagaagcuccacggcgaguacaagaacuga

SEQ ID NO: 44000 - RNA, 1368 nt, Artificial Sequence
  derived and/or modified sequence opt2 from GZF1__Homo_sapiens__XP_005260860
auggaguccggcgccguccuccucgaguccaaguccucccccuucaaccuccuccacgagaugcacgagcuccgccuccucggccaccucugcgacgucaccgucuccgucgaguaccagggcguccgcaaggacuucauggcccacaaggccguccucgccgccaccuccaaguucuucaaggaggucuuccucaacgagaaguccgucgacggcacccgcaccaacgucuaccucaacgagguccaggucgccgacuucgccuccuuccucgaguucgucuacaccgccaagguccaggucgaggaggaccgcguccagcgcaugcucgaggucgccgagaagcucaagugccucgaccucuccgagaccugcuuccagcucaagaagcagaugcucgaguccguccuccucgagcuccagaacuucuccgagucccaggaggucgaggucuccuccggcucccaggucuccgccgcccccgccccccgcgccuccgucgccaccgacggcccccaccccuccggccucaccgacucccucgacuaccccggcgagcgcgccuccaacggcauguccuccgaccucccccccaagaaguccaaggacaagcucgacaagaagaaggaggucgucaagccccccuaccccaagauccgccgcgccuccggccgccucgccggccgcaaggucuucgucgagauccccaagaagaaguacacccgccgccuccgcgagcagcagaagaccgccgagggcgacgucggcgacuaccgcugcccccaggaccagucccccgaccgcgucggcaccgagauggagcaggucuccaagaacgagggcugccaggccggcgccgagcucgaggagcucuccaagaaggccggccccgaggaggaggaggaggaggaggaggaggacgaggagggcgagaagaagaaguccaacuucaagugcuccaucugcgagaaggccuuccucuacgagaaguccuuccucaagcacuccaagcaccgccacggcgucgccaccgaggucgucuaccgcugcgacaccugcggccagaccuucgccaaccgcugcaaccucaagucccaccagcgccacguccacuccuccgagcgccacuuccccugcgagcucugcggcaagaaguucaagcgcaagaaggacgucaagcgccacguccuccagguccacgagggcggcggcgagcgccaccgcugcggccagugcggcaagggccucuccuccaagaccgcccuccgccuccacgagcgcacccacaccggcgaccgccccuacggcugcaccgagugcggcgcccgcuucucccagcccuccgcccucaagacccacaugcgcuga

SEQ ID NO: 44001 - RNA, 789 nt, Artificial Sequence
  derived and/or modified sequence opt2 from GZMA__Homo_sapiens__NP_006135
augcgcaacuccuaccgcuuccucgccuccucccucuccgucgucgucucccuccuccucauccccgaggacgucugcgagaagaucaucggcggcaacgaggucaccccccacucccgccccuacaugguccuccucucccucgaccgcaagaccaucugcgccggcgcccucaucgccaaggacuggguccucaccgccgcccacugcaaccucaacaagcgcucccaggucauccucggcgcccacuccaucacccgcgaggagcccaccaagcagaucaugcucgucaagaaggaguuccccuaccccugcuacgaccccgccacccgcgagggcgaccucaagcuccuccagcucaccgagaaggccaagaucaacaaguacgucaccauccuccaccuccccaagaagggcgacgacgucaagcccggcaccaugugccaggucgccggcuggggccgcacccacaacuccgccuccugguccgacacccuccgcgaggucaacaucaccaucaucgaccgcaaggucugcaacgaccgcaaccacuacaacuucaaccccgucaucggcaugaacauggucugcgccggcucccuccgcggcggccgcgacuccugcaacggcgacuccggcuccccccuccucugcgagggcgucuuccgcggcgucaccuccuucggccucgagaacaagugcggcgacccccgcggccccggcgucuacauccuccucuccaagaagcaccucaacuggaucaucaugaccaucaagggcgccgucuga

SEQ ID NO: 44002 - RNA, 744 nt, Artificial Sequence
  derived and/or modified sequence opt2 from GZMB__Homo_sapiens__NP_004122
augcagcccauccuccuccuccucgccuuccuccuccucccccgcgccgacgccggcgagaucaucggcggccacgaggccaagccccacucccgccccuacauggccuaccucaugaucugggaccagaagucccucaagcgcugcggcggcuuccucauccgcgacgacuucguccucaccgccgcccacugcuggggcuccuccaucaacgucacccucggcgcccacaacaucaaggagcaggagcccacccagcaguucauccccgucaagcgccccaucccccaccccgccuacaaccccaagaacuucuccaacgacaucaugcuccuccagcucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 44003 - RNA, 483 nt, Artificial Sequence
  derived and/or modified sequence opt2 from GZMH__Homo_sapiens__NP_001257710
augcagcccuuccuccuccuccucgccuuccuccucacccccggcgccggcaccgaggagaucaucggcggccacgaggccaagccccacucccgccccuacauggccuucguccaguuccuccaggagaagucccgcaagcgcugcggcggcauccucguccgcaaggacuucguccucaccgccgcccacugccagggcuccuccaucaacgucacccucggcgcccacaacaucaaggagcaggagcgcacccagcaguucauccccgucaagcgccccaucccccaccccgccuacaaccccaagaacuucuccaacgacaucaugcuccuccagggcgacuccggcggcccccucgucugcaaggacgucgcccagggcauccucuccuacggcaacaagaagggcaccccccccggcgucuacaucaaggucucccacuuccuccccuggaucaagcgcaccaugaagcgccucuga

SEQ ID NO: 44004 - RNA, 795 nt, Artificial Sequence
  derived and/or modified sequence opt2 from GZMK__Homo_sapiens__NP_002095
augaccaaguucuccuccuucucccucuucuuccucaucgucggcgccuacaugacccacgucugcuucaacauggagaucaucggcggcaaggaggucuccccccacucccgccccuucauggccuccauccaguacggcggccaccacgucugcggcggcguccucaucgacccccaguggguccucaccgccgcccacugccaguaccgcuucaccaagggccagucccccaccgucguccucggcgcccacucccucuccaagaacgaggccuccaagcagacccucgagaucaagaaguucauccccuucucccgcgucaccuccgacccccaguccaacgacaucaugcucgucaagcuccagaccgccgccaagcucaacaagcacgucaagaugcuccacauccgcuccaagaccucccuccgcuccggcaccaagugcaaggucaccggcuggggcgccaccgaccccgacucccuccgccccuccgacacccuccgcgaggucaccgucaccguccucucccgcaagcucugcaacucccaguccuacuacaacggcgaccccuucaucaccaaggacauggucugcgccggcgacgccaagggccagaaggacuccugcaagggcgacuccggcggcccccucaucugcaagggcgucuuccacgccaucgucuccggcggccacgagugcggcgucgccaccaagcccggcaucuacacccuccucaccaagaaguaccagaccuggaucaaguccaaccucguccccccccacaccaacuga

SEQ ID NO: 44005 - RNA, 774 nt, Artificial Sequence
  derived and/or modified sequence opt2 from GZMM__Homo_sapiens__NP_005308
auggaggccugcgucuccucccuccucguccucgcccucggcgcccucuccgucggcuccuccuucggcacccagaucaucggcggccgcgaggucaucccccacucccgccccuacauggccucccuccagcgcaacggcucccaccucugcggcggcguccucguccaccccaaguggguccucaccgccgcccacugccucgcccagcgcauggcccagcuccgccucguccucggccuccacacccucgacucccccggccucaccuuccacaucaaggccgccauccagcacccccgcuacaagcccguccccgcccucgagaacgaccucgcccuccuccagcucgacggcaaggucaagcccucccgcaccauccgcccccucgcccuccccuccaagcgccaggucgucgccgccggcacccgcugcuccauggccggcuggggccucacccaccagggcggccgccucucccgcguccuccgcgagcucgaccuccagguccucgacacccgcaugugcaacaacucccgcuucuggaacggcucccucucccccuccauggucugccucgccgccgacuccaaggaccaggcccccugcaagggcgacuccggcggcccccucgucugcggcaagggccgcguccucgccggcguccucuccuucuccucccgcgucugcaccgacaucuucaagccccccgucgccaccgccgucgcccccuacgucuccuggauccgcaaggucaccggccgcuccgccuga

SEQ ID NO: 44006 - RNA, 585 nt, Artificial Sequence
  derived and/or modified sequence opt2 from H1F0__Homo_sapiens__NP_005309
augaccgagaacuccaccuccgcccccgccgccaagcccaagcgcgccaaggccuccaagaaguccaccgaccaccccaaguacuccgacaugaucgucgccgccauccaggccgagaagaaccgcgccggcuccucccgccaguccauccagaaguacaucaagucccacuacaaggucggcgagaacgccgacucccagaucaagcucuccaucaagcgccucgucaccaccggcguccucaagcagaccaagggcgucggcgccuccggcuccuuccgccucgccaaguccgacgagcccaagaaguccgucgccuucaagaagaccaagaaggagaucaagaaggucgccacccccaagaaggccuccaagcccaagaaggccgccuccaaggcccccaccaagaagcccaaggccacccccgucaagaaggccaagaagaagcucgccgccacccccaagaaggccaagaagcccaagaccgucaaggccaagcccgucaaggccuccaagcccaagaaggccaagcccgucaagcccaaggccaaguccuccgccaagcgcgccggcaagaagaaguga

SEQ ID NO: 44007 - RNA, 642 nt, Artificial Sequence
  derived and/or modified sequence opt2 from H1FX__Homo_sapiens__NP_006017
auguccgucgagcucgaggaggcccuccccgucaccaccgccgagggcauggccaagaaggucaccaaggccggcggcuccgccgcccucucccccuccaagaagcgcaagaacuccaagaagaagaaccagcccggcaaguacucccagcucgucgucgagaccauccgccgccucggcgagcgcaacggcuccucccucgccaagaucuacaccgaggccaagaagguccccugguucgaccagcagaacggccgcaccuaccucaaguacuccaucaaggcccucguccagaacgacacccuccuccaggucaagggcaccggcgccaacggcuccuucaagcucaaccgcaagaagcucgagggcggcggcgagcgccgcggcgcccccgccgccgccaccgcccccgcccccaccgcccacaaggccaagaaggccgcccccggcgccgccggcucccgccgcgccgacaagaagcccgcccgcggccagaagcccgagcagcgcucccacaagaagggcgccggcgccaagaaggacaagggcggcaaggccaagaagaccgccgccgccggcggcaagaaggucaagaaggccgccaagcccuccguccccaagguccccaagggccgcaaguga

SEQ ID NO: 44008 - RNA, 390 nt, Artificial Sequence
  derived and/or modified sequence opt2 from H2AFJ__Homo_sapiens__NP_808760
auguccggccgcggcaagcagggcggcaagguccgcgccaaggccaagucccgcuccucccgcgccggccuccaguuccccgucggccgcguccaccgccuccuccgcaagggcaacuacgccgagcgcgucggcgccggcgcccccgucuaccucgccgccguccucgaguaccucaccgccgagauccucgagcucgccggcaacgccgcccgcgacaacaagaagacccgcaucaucccccgccaccuccagcucgccauccgcaacgacgaggagcucaacaagcuccucggcaaggucaccaucgcccagggcggcguccuccccaacauccaggccguccuccuccccaagaagaccgagucccagaagaccaaguccaaguga

SEQ ID NO: 44009 - RNA, 432 nt, Artificial Sequence
  derived and/or modified sequence opt2 from H2AFX__Homo_sapiens__NP_002096
auguccggccgcggcaagaccggcggcaaggcccgcgccaaggccaagucccgcuccucccgcgccggccuccaguuccccgucggccgcguccaccgccuccuccgcaagggccacuacgccgagcgcgucggcgccggcgcccccgucuaccucgccgccguccucgaguaccucaccgccgagauccucgagcucgccggcaacgccgcccgcgacaacaagaagacccgcaucaucccccgccaccuccagcucgccauccgcaacgacgaggagcucaacaagcuccucggcggcgucaccaucgcccagggcggcguccuccccaacauccaggccguccuccuccccaagaagaccuccgccaccgucggccccaaggcccccuccggcggcaagaaggccacccaggccucccaggaguacuga

SEQ ID NO: 44010 - RNA, 1119 nt, Artificial Sequence
  derived and/or modified sequence opt2 from H2AFY2__Homo_sapiens__NP_061119
auguccggccgcuccggcaagaagaagauguccaagcucucccgcuccgcccgcgccggcgucaucuuccccgucggccgccucaugcgcuaccucaagaagggcaccuucaaguaccgcaucuccgucggcgcccccgucuacauggccgccgucaucgaguaccucgccgccgagauccucgagcucgccggcaacgccgcccgcgacaacaagaaggcccgcaucgccccccgccacauccuccucgccgucgccaacgacgaggagcucaaccagcuccucaagggcgucaccaucgccuccggcggcguccucccccgcauccaccccgagcuccucgccaagaagcgcggcaccaagggcaaguccgagaccauccucucccccccccccgagaagcgcggccgcaaggccaccuccggcaagaagggcggcaagaaguccaaggccgccaagccccgcaccuccaagaaguccaagcccaaggacuccgacaaggagggcaccuccaacuccaccuccgaggacggccccggcgacggcuucaccauccucuccuccaagucccucguccucggccagaagcucucccucacccaguccgacaucucccacaucggcuccaugcgcgucgagggcaucguccaccccaccaccgccgagaucgaccucaaggaggacaucggcaaggcccucgagaaggccggcggcaaggaguuccucgagaccgucaaggagcuccgcaagucccagggcccccucgaggucgccgaggccgccgucucccaguccuccggccucgccgccaaguucgucauccacugccacaucccccaguggggcuccgacaagugcgaggagcagcucgaggagaccaucaagaacugccucuccgccgccgaggacaagaagcucaaguccgucgccuucccccccuuccccuccggccgcaacugcuuccccaagcagaccgccgcccaggucacccucaaggccaucuccgcccacuucgacgacuccuccgccuccucccucaagaacgucuacuuccuccucuucgacuccgaguccaucggcaucuacguccaggagauggccaagcucgacgccaaguga

SEQ ID NO: 44011 - RNA, 1116 nt, Artificial Sequence
  derived and/or modified sequence opt2 from H2AFY__Homo_sapiens__NP_004884
auguccucccgcggcggcaagaagaaguccaccaagaccucccgcuccgccaaggccggcgucaucuuccccgucggccgcaugcuccgcuacaucaagaagggccaccccaaguaccgcaucggcgucggcgcccccgucuacauggccgccguccucgaguaccucaccgccgagauccucgagcucgccggcaacgccgcccgcgacaacaagaagggccgcgucaccccccgccacauccuccucgccgucgccaacgacgaggagcucaaccagcuccucaagggcgucaccaucgccuccggcggcguccuccccaacauccaccccgagcuccucgccaagaagcgcggcuccaagggcaagcucgaggccaucaucacccccccccccgccaagaaggccaagucccccucccagaagaagcccgucuccaagaaggccggcggcaagaagggcgcccgcaaguccaagaagcagggcgaggucuccaaggccgccuccgccgacuccaccaccgagggcacccccgccgacggcuucaccguccucuccaccaagucccucuuccucggccagaagcucaaccucauccacuccgagaucuccaaccucgccggcuucgaggucgaggccaucaucaaccccaccaacgccgacaucgaccucaaggacgaccucggcaacacccucgagaagaagggcggcaaggaguucgucgaggccguccucgagcuccgcaagaagaacggcccccucgaggucgccggcgccgccgucuccgccggccacggccuccccgccaaguucgucauccacugcaacucccccgucuggggcgccgacaagugcgaggagcuccucgagaagaccgucaagaacugccucgcccucgccgacgacaagaagcucaaguccaucgccuuccccuccaucggcuccggccgcaacggcuuccccaagcagaccgccgcccagcucauccucaaggccaucuccuccuacuucgucuccaccauguccuccuccaucaagaccgucuacuucguccucuucgacuccgaguccaucggcaucuacguccaggagauggccaagcucgacgccaacuga

SEQ ID NO: 44012 - RNA, 387 nt, Artificial Sequence
  derived and/or modified sequence opt2 from H2AFZ__Homo_sapiens__NP_002097
auggccggcggcaaggccggcaaggacuccggcaaggccaagaccaaggccgucucccgcucccagcgcgccggccuccaguuccccgucggccgcauccaccgccaccucaagucccgcaccaccucccacggccgcgucggcgccaccgccgccgucuacuccgccgccauccucgaguaccucaccgccgagguccucgagcucgccggcaacgccuccaaggaccucaaggucaagcgcaucaccccccgccaccuccagcucgccauccgcggcgacgaggagcucgacucccucaucaaggccaccaucgccggcggcggcgucaucccccacauccacaagucccucaucggcaagaagggccagcagaagaccgucuga

SEQ ID NO: 44013 - RNA, 528 nt, Artificial Sequence
  derived and/or modified sequence opt2 from H2BFWT__Homo_sapiens__NP_001002916
augcuccgcaccgaggucccccgccucccccgcuccaccaccgccaucgucugguccugccaccucauggccaccgccuccgccauggccggccccuccuccgagaccaccuccgaggagcagcucaucacccaggagcccaaggaggccaacuccaccaccucccagaagcaguccaagcagcgcaagcgcggccgccacggcccccgccgcugccacuccaacugccgcggcgacuccuucgccaccuacuuccgccgcguccucaagcagguccaccagggccucucccucucccgcgaggccgucuccgucauggacucccucguccacgacauccucgaccgcaucgccaccgaggccggccaccucgcccgcuccaccaagcgccagaccaucaccgccugggagacccgcauggccguccgccuccuccuccccggccagaugggcaagcucgccgaguccgagggcaccaaggccguccuccgcaccucccucuacgccauccagcagcagcgcaaguga

SEQ ID NO: 44014 - RNA, 411 nt, Artificial Sequence
  derived and/or modified sequence opt2 from H3F3B__Homo_sapiens__NP_005315
auggcccgcaccaagcagaccgcccgcaaguccaccggcggcaaggccccccgcaagcagcucgccaccaaggccgcccgcaaguccgcccccuccaccggcggcgucaagaagccccaccgcuaccgccccggcaccgucgcccuccgcgagauccgccgcuaccagaaguccaccgagcuccucauccgcaagcuccccuuccagcgccucguccgcgagaucgcccaggacuucaagaccgaccuccgcuuccaguccgccgccaucggcgcccuccaggaggccuccgaggccuaccucgucggccucuucgaggacaccaaccucugcgccauccacgccaagcgcgucaccaucaugcccaaggacauccagcucgcccgccgcauccgcggcgagcgcgccuga

SEQ ID NO: 44015 - RNA, 861 nt, Artificial Sequence
  derived and/or modified sequence opt2 from HAAO__Homo_sapiens__NP_036337
auggagcgccgccucggcguccgcgccugggucaaggagaaccgcggcuccuuccagccccccgucugcaacaagcucaugcaccaggagcagcucaaggucauguucaucggcggccccaacacccgcaaggacuaccacaucgaggagggcgaggaggucuucuaccagcucgagggcgacaugguccuccgcguccucgagcagggcaagcaccgcgacgucgucauccgccagggcgagaucuuccuccuccccgcccgcgucccccacuccccccagcgcuucgccaacaccgucggccucgucgucgagcgccgccgccucgagaccgagcucgacggccuccgcuacuacgucggcgacaccauggacguccucuucgagaagugguucuacugcaaggaccucggcacccagcucgcccccaucauccaggaguucuucuccuccgagcaguaccgcaccggcaagcccauccccgaccagcuccucaaggagccccccuucccccucuccacccgcuccaucauggagcccaugucccucgacgccuggcucgacucccaccaccgcgagcuccaggccggcaccccccucucccucuucggcgacaccuacgagacccaggucaucgccuacggccagggcuccuccgagggccuccgccagaacgucgacgucuggcucuggcagcucgagggcuccuccgucgucaccaugggcggccgccgccucucccucgcccccgacgacucccuccucguccucgccggcaccuccuacgccugggagcgcacccagggcuccgucgcccucuccgucacccaggaccccgccugcaagaagccccucggcuga

SEQ ID NO: 44016 - RNA, 1605 nt, Artificial Sequence
  derived and/or modified sequence opt2 from HABP2__Homo_sapiens__NP_001171131
augucccuccucgagucccucgaccccgacuggacccccgaccaguacgacuacuccuacgaggacuacaaccaggaggagaacaccuccuccacccucacccacgccgagaaccccgacugguacuacaccgaggaccaggccgaccccugccagcccaaccccugcgagcacggcggcgacugccucguccacggcuccaccuucaccugcuccugccucgcccccuucuccggcaacaagugccagaagguccagaacaccugcaaggacaaccccugcggccgcggccagugccucaucacccaguccccccccuacuaccgcugcgucugcaagcaccccuacaccggccccuccugcucccaggucguccccgucugccgccccaaccccugccagaacggcgccaccugcucccgccacaagcgccgcuccaaguucaccugcgccugccccgaccaguucaagggcaaguucugcgagaucggcuccgacgacugcuacgucggcgacggcuacuccuaccgcggcaagaugaaccgcaccgucaaccagcacgccugccucuacuggaacucccaccuccuccuccaggagaacuacaacauguucauggaggacgccgagacccacggcaucggcgagcacaacuucugccgcaaccccgacgccgacgagaagcccuggugcuucaucaaggucaccaacgacaaggucaagugggaguacugcgacgucuccgccugcuccgcccaggacgucgccuaccccgaggagucccccaccgagcccuccaccaagcuccccggcuucgacuccugcggcaagaccgagaucgccgagcgcaagaucaagcgcaucuacggcggcuucaaguccaccgccggcaagcaccccuggcaggccucccuccaguccucccucccccucaccaucuccaugccccagggccacuucugcggcggcgcccucauccaccccugcuggguccucaccgccgcccacugcaccgacaucaagacccgccaccucaaggucguccucggcgaccaggaccucaagaaggaggaguuccacgagcaguccuuccgcgucgagaagaucuucaaguacucccacuacaacgagcgcgacgagaucccccacaacgacaucgcccuccucaagcucaagcccgucgacggccacugcgcccucgaguccaaguacgucaagaccgucugccuccccgacggcuccuuccccuccggcuccgagugccacaucuccggcuggggcgucaccgagaccggcaagggcucccgccagcuccucgacgccaaggucaagcucaucgccaacacccucugcaacucccgccagcucuacgaccacaugaucgacgacuccaugaucugcgccggcaaccuccagaagcccggccaggacaccugccagggcgacuccggcggcccccucaccugcgagaaggacggcaccuacuacgucuacggcaucgucuccuggggccucgagugcggcaagcgccccggcgucuacacccaggucaccaaguuccucaacuggaucaaggccaccaucaaguccgaguccggcuucuga

SEQ ID NO: 44017 - RNA, 1242 nt, Artificial Sequence
  derived and/or modified sequence opt2 from HABP4__Homo_sapiens__NP_055097
augaagggcgcccucggcucccccgucgccgccgccggcgccgccaugcaggaguccuucggcugcgucgucgccaaccgcuuccaccagcuccucgacgacgaguccgaccccuucgacauccuccgcgaggccgagcgccgccgccagcagcagcuccagcgcaagcgccgcgacgaggccgccgccgccgccggcgccggcccccgcggcggccgcucccccgccggcgccuccggccaccgcgccggcgccggcggccgccgcgagucccagaaggagcgcaagucccuccccgcccccgucgcccagcgccccgacucccccggcggcggccuccaggcccccggccagaagcgcaccccccgccgcggcgagcagcagggcuggaacgacucccgcggccccgagggcaugcucgagcgcgccgagcgccgcuccuaccgcgaguaccgccccuacgagaccgagcgccaggccgacuucaccgccgagaaguuccccgacgagaagcccggcgaccgcuucgaccgcgaccgcccccuccgcggccgcggcggcccccgcggcggcaugcgcggccgcggccgcggcggccccggcaaccgcgucuucgacgccuucgaccagcgcggcaagcgcgaguucgagcgcuacggcggcaacgacaagaucgccguccgcaccgaggacaacaugggcggcugcggcguccgcaccuggggcuccggcaaggacaccuccgacgucgagcccaccgcccccauggaggagcccaccgucgucgaggagucccagggcacccccgaggaggagucccccgccaagguccccgagcucgaggucgaggaggagacccagguccaggagaugacccucgacgaguggaagaaccuccaggagcagacccgccccaagcccgaguucaacauccgcaagcccgaguccaccguccccuccaaggccgucgucauccacaaguccaaguaccgcgacgacauggucaaggacgacuacgaggacgacucccacgucuuccgcaagcccgccaacgacaucaccucccagcucgagaucaacuucggcaaccucccccgccccggccgcggcgcccgcggcggcacccgcggcggccgcggccgcauccgccgcgccgagaacuacggcccccgcgccgaggucgucaugcaggacgucgcccccaaccccgacgaccccgaggacuuccccgcccucuccuga

SEQ ID NO: 44018 - RNA, 867 nt, Artificial Sequence
  derived and/or modified sequence opt2 from HACD1__Homo_sapiens__NP_055056
augggccgccucaccgaggccgccgccgccggcuccggcucccgcgccgccggcugggccggcuccccccccacccuccucccccucucccccaccuccccccgcugcgccgccaccauggccuccuccgacgaggacggcaccaacggcggcgccuccgaggccggcgaggaccgcgaggcccccggcgagcgccgccgccucggcguccucgccaccgccuggcucaccuucuacgacaucgccaugaccgccggcuggcucguccucgccaucgccaugguccgcuucuacauggagaagggcacccaccgcggccucuacaaguccauccagaagacccucaaguucuuccagaccuucgcccuccucgagaucguccacugccucaucggcaucguccccaccuccgucaucgucaccggcguccaggucuccucccgcaucuucauggucuggcucaucacccacuccaucaagcccauccagaacgaggaguccgucguccucuuccucgucgccuggaccgucaccgagaucacccgcuacuccuucuacaccuucucccuccucgaccaccuccccuacuucaucaagugggcccgcuacaacuucuucaucauccucuaccccgucggcgucgccggcgagcuccucaccaucuacgccgcccucccccacgucaagaagaccggcauguucuccauccgccuccccaacaaguacaacgucuccuucgacuacuacuacuuccuccucaucaccauggccuccuacaucccccucuucccccagcucuacuuccacaugcuccgccagcgccgcaagguccuccacggcgaggucaucgucgagaaggacgacuga

SEQ ID NO: 44019 - RNA, 765 nt, Artificial Sequence
  derived and/or modified sequence opt2 from HACD2__Homo_sapiens__NP_940684
auggccgccgucgccgccaccgccgccgccaagggcaacggcggcggcggcggccgcgccggcgccggcgacgccuccggcacccgcaagaagaagggccccggcccccucgccaccgccuaccucgucaucuacaacgucgucaugaccgccggcuggcucgucaucgccgucggccucguccgcgccuaccucgccaagggcuccuaccacucccucuacuacuccaucgagaagccccucaaguucuuccagaccggcgcccuccucgagauccuccacugcgccaucggcaucguccccuccuccgucguccucaccuccuuccaggucaugucccgcgucuuccucaucugggccgucacccacuccgucaaggagguccaguccgaggacuccguccuccucuucgucaucgccuggaccaucaccgagaucauccgcuacuccuucuacaccuucucccuccucaaccaccuccccuaccucaucaagugggcccgcuacacccucuucaucguccucuaccccaugggcgucuccggcgagcuccucaccaucuacgccgcccuccccuucguccgccaggccggccucuacuccaucucccuccccaacaaguacaacuucuccuucgacuacuacgccuuccucauccucaucaugaucuccuacauccccaucuucccccagcucuacuuccacaugauccaccagcgccgcaagauccucucccacaccgaggagcacaagaaguucgaguga

SEQ ID NO: 44020 - RNA, 699 nt, Artificial Sequence
  derived and/or modified sequence opt2 from HACD4__Homo_sapiens__NP_001010915
augggcccccucgcccuccccgccuggcuccagccccgcuaccgcaagaacgccuaccucuucaucuacuaccucauccaguucugcggccacuccuggaucuucaccaacaugaccguccgcuucuucuccuucggcaaggacuccauggucgacaccuucuacgccaucggccucgucaugcgccucugccaguccgucucccuccucgagcuccuccacaucuacgucggcaucgaguccaaccaccuccucccccgcuuccuccagcucaccgagcgcaucaucauccucuucgucgucaucaccucccaggaggagguccaggagaaguacgucgucugcguccucuucgucuucuggaaccuccucgacaugguccgcuacaccuacuccaugcucuccgucaucggcaucuccuacgccguccucaccuggcucucccagacccucuggaugcccaucuacccccucugcguccucgccgaggccuucgccaucuaccagucccuccccuacuucgaguccuucggcaccuacuccaccaagcuccccuucgaccucuccaucuacuuccccuacguccucaagaucuaccucaugaugcucuucaucggcauguacuucaccuacucccaccucuacuccgagcgccgcgacauccucggcaucuuccccaucaagaagaagaagauguga

SEQ ID NO: 44021 - RNA, 2730 nt, Artificial Sequence
  derived and/or modified sequence opt2 from HACE1__Homo_sapiens__NP_065822
auggagcgcgccauggagcagcucaaccgccucacccgcucccuccgccgcgcccgcaccgucgagcuccccgaggacaacgagaccgccgucuacacccucaugcccauggucauggccgaccagcaccgcuccgucuccgagcuccucuccaacuccaaguucgacgucaacuacgccuucggccgcgucaagcgcucccuccuccacaucgccgccaacugcggcuccgucgagugccucguccuccuccucaagaagggcgccaaccccaacuaccaggacaucuccggcugcaccccccuccaccucgccgcccgcaacggccagaagaagugcauguccaagcuccucgaguacuccgccgacgucaacaucugcaacaacgagggccucaccgccauccacuggcucgccgucaacggccgcaccgagcuccuccacgaccucguccagcacgucuccgacgucgacgucgaggacgccaugggccagaccgcccuccacgucgccugccagaacggccacaagaccaccguccagugccuccucgacuccggcgccgacaucaaccgccccaacgucuccggcgccaccccccucuacuucgccugcucccacggccagcgcgacaccgcccagauccuccuccuccgcggcgccaaguaccuccccgacaagaacggcgucaccccccucgaccucugcguccagggcggcuacggcgagaccugcgagguccucauccaguaccacccccgccucuuccagaccaucauccagaugacccagaacgaggaccuccgcgagaacaugcuccgccagguccucgagcaccucucccagcaguccgagucccaguaccucaagauccucaccucccucgccgaggucgccaccaccaacggccacaagcuccucucccucuccuccaacuacgacgcccagaugaagucccuccuccgcaucguccgcauguucugccacgucuuccgcaucggccccuccucccccuccaacggcaucgacaugggcuacaacggcaacaagaccccccgcucccaggucuucaagccccucgagcuccucuggcacucccucgacgaguggcucguccucaucgccaccgagcucaugaagaacaagcgcgacuccaccgagaucaccuccauccuccucaagcagaagggccaggaccaggacgccgccuccaucccccccuucgagccccccggccccggcuccuacgagaaccucuccaccggcacccgcgaguccaagcccgacgcccucgccggccgccaggaggccuccgccgacugccaggacgucaucuccaugaccgccaaccgccucuccgccgucauccaggccuucuacaugugcugcuccugccagaugccccccggcaugaccuccccccgcuucaucgaguucgucugcaagcacgacgagguccucaagugcuucgucaaccgcaaccccaagaucaucuucgaccacuuccacuuccuccucgagugccccgagcucaugucccgcuucaugcacaucaucaaggcccagcccuucaaggaccgcugcgagugguucuacgagcaccuccacuccggccagcccgacuccgacaugguccaccgccccgucaacgagaacgacauccuccucguccaccgcgacuccaucuuccgcuccuccugcgaggucgucuccaaggccaacugcgccaagcucaagcagggcaucgccguccgcuuccacggcgaggagggcaugggccagggcgucguccgcgagugguucgacauccucuccaacgagaucgucaaccccgacuacgcccucuucacccaguccgccgacggcaccaccuuccagcccaacuccaacuccuacgucaaccccgaccaccucaacuacuuccgcuucgccggccagauccucggccucgcccucaaccaccgccagcucgucaacaucuacuucacccgcuccuucuacaagcacauccucggcauccccgucaacuaccaggacgucgccuccaucgaccccgaguacgccaagaaccuccaguggauccucgacaacgacaucuccgaccucggccucgagcucaccuucuccgucgagaccgacgucuucggcgccauggaggaggucccccucaagcccggcggcggcuccauccucgucacccagaacaacaaggccgaguacguccagcucgucaccgagcuccgcaugacccgcgccauccagccccagaucaacgccuuccuccagggcuuccacauguucaucccccccucccucauccagcucuucgacgaguacgagcucgagcuccuccucuccggcaugcccgagaucgacgucuccgacuggaucaagaacaccgaguacaccuccggcuacgagcgcgaggaccccgucauccagugguucugggaggucgucgaggacaucacccaggaggagcgcguccuccuccuccaguucgucaccggcuccucccgcgucccccacggcggcuucgccaacaucaugggcggcuccggccuccagaacuucaccaucgccgccguccccuacacccccaaccuccuccccaccuccuccaccugcaucaacaugcucaagcuccccgaguaccccuccaaggagauccucaaggaccgccuccucgucgcccuccacugcggcuccuacggcuacaccauggccuga

SEQ ID NO: 44022 - RNA, 1737 nt, Artificial Sequence
  derived and/or modified sequence opt2 from HACL1__Homo_sapiens__NP_036392
augcccgacuccaacuucgccgagcgcuccgaggagcaggucuccggcgccaaggucaucgcccaggcccucaagacccaggacgucgaguacaucuucggcaucgucggcauccccgucaccgagaucgccaucgccgcccagcagcucggcaucaaguacaucggcaugcgcaacgagcaggccgccugcuacgccgccuccgccaucggcuaccucaccucccgccccggcgucugccucgucgucuccggccccggccucauccacgcccucggcggcauggccaacgccaacaugaacugcuggccccuccucgucaucggcggcuccuccgagcgcaaccaggagaccaugggcgccuuccaggaguucccccaggucgaggccugccgccucuacaccaaguucuccgcccgccccuccuccaucgaggccauccccuucgucaucgagaaggccguccgcuccuccaucuacggccgccccggcgccugcuacgucgacauccccgccgacuucgucaaccuccaggucaacgucaacuccaucaaguacauggagcgcugcauguccccccccaucuccauggccgagaccuccgccgucugcaccgccgccuccgucauccgcaacgccaagcagccccuccucaucaucggcaagggcgccgccuacgcccacgccgaggaguccaucaagaagcucgucgagcaguacaagcuccccuuccuccccacccccaugggcaagggcgucguccccgacaaccaccccuacugcgucggcgccgcccgcucccgcgcccuccaguucgccgacgucaucguccucuucggcgcccgccucaacuggauccuccacuucggccuccccccccgcuaccagcccgacgucaaguucauccaggucgacaucugcgccgaggagcucggcaacaacgucaagcccgccgucacccuccucggcaacauccacgccgucaccaagcagcuccucgaggagcucgacaagacccccuggcaguacccccccgaguccaagugguggaagacccuccgcgagaagaugaaguccaacgaggccgccuccaaggagcucgccuccaagaagucccuccccaugaacuacuacaccgucuucuaccacguccaggagcagcucccccgcgacugcuucgucgucuccgagggcgccaacaccauggacaucggccgcaccguccuccagaacuaccucccccgccaccgccucgacgccggcaccuucggcaccaugggcgucggccucggcuucgccaucgccgccgccgucgucgccaaggaccgcucccccggccaguggaucaucugcgucgagggcgacuccgccuucggcuucuccggcauggaggucgagaccaucugccgcuacaaccuccccaucauccuccucgucgucaacaacaacggcaucuaccagggcuucgacaccgacaccuggaaggagaugcucaaguuccaggacgccaccgccgucgucccccccaugugccuccuccccaacucccacuacgagcaggucaugaccgccuucggcggcaagggcuacuucguccagacccccgaggagcuccagaagucccuccgccagucccucgccgacaccaccaagcccucccucaucaacaucaugaucgagccccaggccacccgcaaggcccaggacuuccacuggcucacccgcuccaacauguga

SEQ ID NO: 44023 - RNA, 2292 nt, Artificial Sequence
  derived and/or modified sequence opt2 from HADHA__Homo_sapiens__NP_000173
auggucgccugccgcgccaucggcauccucucccgcuucuccgccuuccgcauccuccgcucccgcggcuacaucugccgcaacuucaccggcuccuccgcccuccucacccgcacccacaucaacuacggcgucaagggcgacgucgccgucguccgcaucaacucccccaacuccaaggucaacacccucuccaaggagcuccacuccgaguucuccgaggucaugaacgagaucugggccuccgaccagauccgcuccgccguccucaucuccuccaagcccggcugcuucaucgccggcgccgacaucaacaugcucgccgccugcaagacccuccaggaggucacccagcucucccaggaggcccagcgcaucgucgagaagcucgagaaguccaccaagcccaucgucgccgccaucaacggcuccugccucggcggcggccucgaggucgccaucuccugccaguaccgcaucgccaccaaggaccgcaagaccguccucggcacccccgagguccuccucggcgcccuccccggcgccggcggcacccagcgccuccccaagauggucggcguccccgccgcccucgacaugaugcucaccggccgcuccauccgcgccgaccgcgccaagaagaugggccucgucgaccagcucgucgagccccucggccccggccucaagccccccgaggagcgcaccaucgaguaccucgaggaggucgccaucaccuucgccaagggccucgccgacaagaagaucucccccaagcgcgacaagggccucgucgagaagcucaccgccuacgccaugaccauccccuucguccgccagcaggucuacaagaaggucgaggagaagguccgcaagcagaccaagggccucuaccccgccccccucaagaucaucgacgucgucaagaccggcaucgagcagggcuccgacgccggcuaccucugcgagucccagaaguucggcgagcucgucaugaccaaggaguccaaggcccucaugggccucuaccacggccagguccucugcaagaagaacaaguucggcgccccccagaaggacgucaagcaccucgccauccucggcgccggccucaugggcgccggcaucgcccaggucuccgucgacaagggccucaagaccauccucaaggacgccacccucaccgcccucgaccgcggccagcagcaggucuucaagggccucaacgacaaggucaagaagaaggcccucaccuccuucgagcgcgacuccaucuucuccaaccucaccggccagcucgacuaccagggcuucgagaaggccgacauggucaucgaggccgucuucgaggaccucucccucaagcaccgcguccucaaggaggucgaggccgucauccccgaccacugcaucuucgccuccaacaccuccgcccuccccaucuccgagaucgccgccgucuccaagcgccccgagaaggucaucggcaugcacuacuucucccccgucgacaagaugcagcuccucgagaucaucaccaccgagaagaccuccaaggacaccuccgccuccgccgucgccgucggccucaagcagggcaaggucaucaucgucgucaaggacggccccggcuucuacaccacccgcugccucgcccccaugauguccgaggucauccgcauccuccaggagggcgucgaccccaagaagcucgacucccucaccaccuccuucggcuuccccgucggcgccgccacccucgucgacgaggucggcgucgacgucgccaagcacgucgccgaggaccucggcaaggucuucggcgagcgcuucggcggcggcaaccccgagcuccucacccagauggucuccaagggcuuccucggccgcaaguccggcaagggcuucuacaucuaccaggagggcgucaagcgcaaggaccucaacuccgacauggacuccauccucgccucccucaagcucccccccaaguccgaggucuccuccgacgaggacauccaguuccgccucgucacccgcuucgucaacgaggccgucaugugccuccaggagggcauccucgccacccccgccgagggcgacaucggcgccgucuucggccucggcuucccccccugccucggcggccccuuccgcuucgucgaccucuacggcgcccagaagaucgucgaccgccucaagaaguacgaggccgccuacggcaagcaguucacccccugccagcuccucgccgaccacgccaacucccccaacaagaaguucuaccaguga

SEQ ID NO: 44024 - RNA, 1380 nt, Artificial Sequence
  derived and/or modified sequence opt2 from HADHB__Homo_sapiens__NP_001268441
augaccauccucaccuaccccuucaagaaccuccccaccgccuccaagugggcccuccgcuucuccauccgcccccucuccugcuccucccagcuccgcgccgcccccgccguccagaccaagaccaagaagacccucgccaagcccaacauccgcaacgucgucgucgucgacggcguccgcacccccuuccuccucuccggcaccuccggccuccuccaccgcaccuccguccccaaggaggucgucgacuacaucaucuucggcaccgucauccaggaggucaagaccuccaacgucgcccgcgaggccgcccucggcgccggcuucuccgacaagacccccgcccacaccgucaccauggccugcaucuccgccaaccaggccaugaccaccggcgucggccucaucgccuccggccagugcgacgucaucgucgccggcggcgucgagcucauguccgacguccccauccgccacucccgcaagaugcgcaagcucaugcucgaccucaacaaggccaaguccaugggccagcgccucucccucaucuccaaguuccgcuucaacuuccucgcccccgagcuccccgccgucuccgaguucuccaccuccgagaccaugggccacuccgccgaccgccucgccgccgccuucgccgucucccgccucgagcaggacgaguacgcccuccgcucccacucccucgccaagaaggcccaggacgagggccuccucuccgacgucguccccuucaagguccccggcaaggacaccgucaccaaggacaacggcauccgccccuccucccucgagcagauggccaagcucaagcccgccuucaucaagcccuacggcaccgucaccgccgccaacuccuccuuccucaccgacggcgccuccgccaugcucaucauggccgaggagaaggcccucgccaugggcuacaagcccaaggccuaccuccgcgacuucauguacgucucccaggaccccaaggaccagcuccuccucggccccaccuacgccacccccaagguccucgagaaggccggccucaccaugaacgacaucgacgccuucgaguuccacgaggccuucuccggccagauccucgccaacuucaaggccauggacuccgacugguucgccgagaacuacaugggccgcaagaccaaggucggccuccccccccucgagaaguucaacaacuggggcggcucccucucccucggccaccccuucggcgccaccggcugccgccucgucauggccgccgccaaccgccuccgcaaggagggcggccaguacggccucgucgccgccugcgccgccggcggccagggccacgccaugaucgucgaggccuaccccaaguga

SEQ ID NO: 44025 - RNA, 996 nt, Artificial Sequence
  derived and/or modified sequence opt2 from HADH__Homo_sapiens__NP_001171634
auggccuucgucacccgccaguucaugcgcuccgucuccuccuccuccaccgccuccgccuccgccaagaagaucaucgucaagcacgucaccgucaucggcggcggccucaugggcgccggcaucgcccaggucgccgccgccaccggccacaccgucguccucgucgaccagaccgaggacauccucgccaaguccaagaagggcaucgaggagucccuccgcaaggucgccaagaagaaguucgccgagaaccccaaggccggcgacgaguucgucgagaagacccucuccaccaucgccaccuccaccgacgccgccuccgucguccacuccaccgaccucgucgucgaggccaucgucgagaaccucaaggucaagaacgagcucuucaagcgccucgacaaguucgccgccgagcacaccaucuucgccuccaacaccuccucccuccagaucaccuccaucgccaacgccaccacccgccaggaccgcuucgccggccuccacuucuucaaccccguccccgucaugaagcucgucgaggucaucaagacccccaugaccucccagaagaccuucgagucccucgucgacuucuccaaggcccucggcaagcaccccgucuccugcaaggacacccccggcuucaucgucaaccgccuccucguccccuaccucauggaggccauccgccucuacgagcgcgacuuccagaccugcggcgacuccaacuccggccucggcuucucccucaagggcgacgccuccaaggaggacaucgacaccgccaugaagcucggcgccggcuaccccaugggccccuucgagcuccucgacuacgucggccucgacaccaccaaguucaucgucgacggcuggcacgagauggacgccgagaacccccuccaccagcccucccccucccucaacaagcucgucgccgagaacaaguucggcaagaagaccggcgagggcuucuacaaguacaaguga

SEQ ID NO: 44026 - RNA, 783 nt, Artificial Sequence
  derived and/or modified sequence opt2 from HAGH__Homo_sapiens__NP_001035517
augaaggucgagguccuccccgcccucaccgacaacuacauguaccucgucaucgacgacgagaccaaggaggccgccaucgucgaccccguccagccccagaaggucgucgacgccgcccgcaagcacggcgucaagcucaccaccguccucaccacccaccaccacugggaccacgccggcggcaacgagaagcucgucaagcucgaguccggccucaaggucuacggcggcgacgaccgcaucggcgcccucacccacaagaucacccaccucuccacccuccaggucggcucccucaacgucaagugccucgccacccccugccacaccuccggccacaucugcuacuucgucuccaagcccggcggcuccgagccccccgccgucuucaccggcgacacccucuucgucgccggcugcggcaaguucuacgagggcaccgccgacgagaugugcaaggcccuccucgagguccucggccgccucccccccgacacccgcgucuacugcggccacgaguacaccaucaacaaccucaaguucgcccgccacgucgagcccggcaacgccgccauccgcgagaagcucgccugggccaaggagaaguacuccaucggcgagcccaccguccccuccacccucgccgaggaguucaccuacaaccccuucaugcgcguccgcgagaagaccguccagcagcacgccggcgagaccgaccccgucaccaccaugcgcgccguccgccgcgagaaggaccaguucaagaugccccgcgacuga

SEQ ID NO: 44027 - RNA, 1350 nt, Artificial Sequence
  derived and/or modified sequence opt2 from HAL__Homo_sapiens__NP_001245262
augcuccucgcccuccgcaucaacguccucgccaagggcuacuccggcaucucccucgagacccucaagcaggucaucgagauguucaacgccuccugccuccccuacguccccgagaagggcaccgucggcgccuccggcgaccucgccccccucucccaccucgcccucggccucgucggcgagggcaagauguggucccccaaguccggcugggccgacgccaaguacguccucgaggcccacggccucaagcccgucauccucaagcccaaggagggccucgcccucaucaacggcacccagaugaucaccucccucggcugcgaggccgucgagcgcgccuccgccaucgcccgccaggccgacaucgucgccgcccucacccucgagguccucaagggcaccaccaaggccuucgacaccgacauccacgcccuccgcccccaccgcggccagaucgaggucgccuuccgcuuccgcucccuccucgacuccgaccaccaccccuccgagaucgccgagucccaccgcuucugcgaccgcguccaggacgccuacacccuccgcugcugcccccagguccacggcgucgucaacgacaccaucgccuucgucaagaacaucaucaccaccgagcucaacuccgccaccgacaaccccauggucuucgccaaccgcggcgagaccgucuccggcggcaacuuccacggcgaguaccccgccaaggcccucgacuaccucgccaucggcauccacgagcucgccgccaucuccgagcgccgcaucgagcgccucugcaaccccucccucuccgagcuccccgccuuccucgucgccgagggcggccucaacuccggcuucaugaucgcccacugcaccgccgccgcccucgucuccgagaacaaggcccucugccaccccuccuccgucgacucccucuccaccuccgccgccaccgaggaccacgucuccaugggcggcugggccgcccgcaaggcccuccgcgucaucgagcacgucgagcagguccucgccaucgagcuccucgccgccugccagggcaucgaguuccuccgcccccucaagaccaccaccccccucgagaaggucuacgaccucguccgcuccgucguccgccccuggaucaaggaccgcuucauggcccccgacaucgaggccgcccaccgccuccuccucgagcagaaggucugggaggucgccgcccccuacaucgagaaguaccgcauggagcacauccccgagucccgcccccucucccccaccgccuucucccuccaguuccuccacaagaaguccaccaagauccccgaguccgaggaccucuga

SEQ ID NO: 44028 - RNA, 255 nt, Artificial Sequence
  derived and/or modified sequence opt2 from HAMP__Homo_sapiens__NP_066998
auggcccucuccucccagaucugggccgccugccuccuccuccuccuccuccucgccucccucaccuccggcuccgucuucccccagcagaccggccagcucgccgagcuccagccccaggaccgcgccggcgcccgcgccuccuggaugcccauguuccagcgccgccgccgccgcgacacccacuuccccaucugcaucuucugcugcggcugcugccaccgcuccaagugcggcaugugcugcaagaccuga

SEQ ID NO: 44029 - RNA, 648 nt, Artificial Sequence
  derived and/or modified sequence opt2 from HAND1__Homo_sapiens__NP_004812
augaaccucgucggcuccuacgcccaccaccaccaccaccaccacccccaccccgcccaccccaugcuccacgagcccuuccucuucggccccgccucccgcugccaccaggagcgccccuacuuccaguccuggcuccucucccccgccgacgccgcccccgacuuccccgccggcggccccccccccgccgccgccgccgccgccaccgccuacggccccgacgcccgccccggccagucccccggccgccucgaggcccucggcggccgccucggccgccgcaagggcuccggccccaagaaggagcgccgccgcaccgaguccaucaacuccgccuucgccgagcuccgcgagugcauccccaacguccccgccgacaccaagcucuccaagaucaagacccuccgccucgccaccuccuacaucgccuaccucauggacguccucgccaaggacgcccaguccggcgaccccgaggccuucaaggccgagcucaagaaggccgacggcggccgcgaguccaagcgcaagcgcgagcuccagcagcacgagggcuucccccccgcccucggccccgucgagaagcgcaucaagggccgcaccggcuggccccagcaggucugggcccucgagcucaaccaguga

SEQ ID NO: 44030 - RNA, 654 nt, Artificial Sequence
  derived and/or modified sequence opt2 from HAND2__Homo_sapiens__NP_068808
augucccucgucggcggcuucccccaccaccccgucguccaccacgagggcuaccccuucgccgccgccgccgccgccgccgccgccgccgccgccucccgcugcucccacgaggagaaccccuacuuccacggcuggcucaucggccaccccgagauguccccccccgacuacuccauggcccucuccuacucccccgaguacgccuccggcgccgccggccucgaccacucccacuacggcggcgucccccccggcgccggcccccccggccucggcggcccccgccccgucaagcgccgcggcaccgccaaccgcaaggagcgccgccgcacccaguccaucaacuccgccuucgccgagcuccgcgagugcauccccaacguccccgccgacaccaagcucuccaagaucaagacccuccgccucgccaccuccuacaucgccuaccucauggaccuccucgccaaggacgaccagaacggcgaggccgaggccuucaaggccgagaucaagaagaccgacgucaaggaggagaagcgcaagaaggagcucaacgagauccucaaguccaccgucuccuccaacgacaagaagaccaagggccgcaccggcuggccccagcacgucugggcccucgagcucaagcaguga

SEQ ID NO: 44031 - RNA, 1113 nt, Artificial Sequence
  derived and/or modified sequence opt2 from HAO1__Homo_sapiens__NP_060015
augcucccccgccucaucugcaucaacgacuacgagcagcacgccaaguccguccuccccaaguccaucuacgacuacuaccgcuccggcgccaacgacgaggagacccucgccgacaacaucgccgccuucucccgcuggaagcucuacccccgcaugcuccgcaacgucgccgagaccgaccucuccaccuccguccucggccagcgcgucuccaugcccaucugcgucggcgccaccgccaugcagcgcauggcccacgucgacggcgagcucgccaccguccgcgccugccagucccucggcaccggcaugaugcucuccuccugggccaccuccuccaucgaggaggucgccgaggccggccccgaggcccuccgcuggcuccagcucuacaucuacaaggaccgcgaggucaccaagaagcucguccgccaggccgagaagaugggcuacaaggccaucuucgucaccgucgacacccccuaccucggcaaccgccucgacgacguccgcaaccgcuucaagcuccccccccagcuccgcaugaagaacuucgagaccuccacccucuccuucucccccgaggagaacuucggcgacgacuccggccucgccgccuacgucgccaaggccaucgaccccuccaucuccugggaggacaucaaguggcuccgccgccucaccucccuccccaucgucgccaagggcauccuccgcggcgacgacgcccgcgaggccgucaagcacggccucaacggcauccucgucuccaaccacggcgcccgccagcucgacggcguccccgccaccaucgacguccuccccgagaucgucgaggccgucgagggcaaggucgaggucuuccucgacggcggcguccgcaagggcaccgacguccucaaggcccucgcccucggcgccaaggccgucuucgucggccgccccaucgucuggggccucgccuuccagggcgagaagggcguccaggacguccucgagauccucaaggaggaguuccgccucgccauggcccucuccggcugccagaacgucaaggucaucgacaagacccucguccgcaagaacccccucgccgucuccaagaucuga

SEQ ID NO: 44032 - RNA, 1149 nt, Artificial Sequence
  derived and/or modified sequence opt2 from HAO2__Homo_sapiens__XP_011539860
augucccucgucugccucaccgacuuccaggcccacgcccgcgagcagcucuccaaguccacccgcgacuucaucgagggcggcgccgacgacuccaucacccgcgacgacaacaucgccgccuucaagcgcauccgccuccgcccccgcuaccuccgcgacgucuccgaggucgacacccgcaccaccauccagggcgaggagaucuccgcccccaucugcaucgcccccaccggcuuccacugccucgucuggcccgacggcgagauguccaccgcccgcgcccccgagggccuccgcugguuccagcucuacguccaccccgaccuccagcucaacaagcagcucauccagcgcgucgagucccucggcuucaaggcccucgucaucacccucgacacccccgucugcggcaaccgccgccacgacauccgcaaccagcuccgccgcaaccucacccucaccgaccuccagucccccaagaagggcaacgccauccccuacuuccagaugacccccaucuccaccucccucugcuggaacgaccucuccugguuccaguccaucacccgccuccccaucauccucaagggcauccucaccaaggaggacgccgagcucgccgucaagcacaacguccagggcaucaucgucuccaaccacggcggccgccagcucgacgagguccucgccuccaucgacgcccucaccgaggucgucgccgccgucaagggcaagaucgaggucuaccucgacggcggcguccgcaccggcaacgacguccucaaggcccucgcccucggcgccaagugcaucuuccucggccgccccauccucuggggccucgccugcaaggccgccggccgcucccuccgcuccaucgagaccugguccuccuuccccggcugcaagaagaagggccccaucacccgccuccuccgccuccccaccggcggcucccagacccacuccaccgucugcgacgccguccuccccggcccccacuccguccgccgccucauggcccacaucucccacaucuccaacaccaccacccccguccuccaggcccuccagacccccgucuuccccaagugcuccaugcccuucuucgucucccucaccaucaucugcugcucccucgccuga

SEQ ID NO: 44033 - RNA, 1809 nt, Artificial Sequence
  derived and/or modified sequence opt2 from HAP1__Homo_sapiens__NP_001073339
augcgccccaagcgccucggccgcugcugcgccggcucccgccucggccccggcgaccccgccgcccucaccugcgcccccucccccuccgccucccccgcccccgagcccuccgcccagccccaggcccgcggcaccggccagcgcgucggcucccgcgccaccuccggcucccaguuccucuccgaggcccgcaccggcgcccgccccgccuccgaggccggcgccaaggccggcgcccgccgccccuccgccuucuccgccauccagggcgacguccgcuccaugcccgacaacuccgacgcccccuggacccgcuucgucuuccagggccccuucggcucccgcgccaccggccgcggcaccggcaaggccgccggcaucuggaagacccccgccgccuacgucggccgccgccccggcgucuccggccccgagcgcgccgccuucauccgcgagcucgaggaggcccucugccccaaccuccccccccccgucaagaagaucacccaggaggacgucaaggucaugcucuaccuccucgaggaggucugcaccgccuuccucauccagcuccucccccccgucugggaguccgucaccuacggcaugguccuccagcgcgagcgcgaccucaacaccgccgcccgcaucggccagucccucgucaagcagaacuccguccucauggaggagaacuccaagcucgaggcccuccucggcuccgccaaggaggagauccucuaccuccgccaccaggucaaccuccgcgacgagcuccuccagcucuacuccgacuccgacgaggaggacgaggacgaggaggaggaggaggaggagaaggaggccgaggaggagcaggaggaggaggaggccgaggaggaccuccagugcgcccaccccugcgacgcccccaagcucaucucccaggaggcccuccuccaccagcaccacugcccccagcucgaggcccuccaggagaagcuccgccuccucgaggaggagaaccaccagcuccgcgaggaggccucccagcucgacacccucgaggacgaggagcagaugcucauccucgagugcgucgagcaguucuccgaggccucccagcagauggccgagcucuccgagguccucguccuccgccucgagaacuacgagcgccagcagcaggaggucgcccgccuccaggcccagguccucaagcuccagcagcgcugccgcauggagacccuccccggcuuccaggagacccucgccgaggagcuccgcaccucccuccgccgcaugaucuccgaccccgucuacuucauggagcgcaacuacgagaugccccgcggcgacaccuccucccuccgcuacgacuuccgcuacuccgaggaccgcgagcagguccgcggcuucgaggccgaggagggccucaugcucgccgccgacaucaugcgcggcgaggacuucacccccgccgaggaguucgucccccaggaggagcucggcgccgccaagaagguccccgccgaggagggcgucauggaggaggccgagcucgucuccgaggagaccgagggcugggaggaggucgagcucgagcucgacgaggccacccgcaugaacgucgucaccuccgcccucgaggccuccggccucggccccucccaccucgacaugaacuacguccuccagcagcucgccaacuggcaggacgcccacuaccgccgccagcuccgcuggaagaugcuccagaagggcgagugcccccacggcgcccuccccgccgccucccgcaccuccugccgcuccuccugccgcuga

SEQ ID NO: 44034 - RNA, 1065 nt, Artificial Sequence
  derived and/or modified sequence opt2 from HAPLN1__Homo_sapiens__NP_001875
augaagucccuccuccuccucguccucaucuccaucugcugggccgaccaccucuccgacaacuacacccucgaccacgaccgcgccauccacauccaggccgagaacggcccccaccuccucgucgaggccgagcaggccaaggucuucucccaccgcggcggcaacgucacccuccccugcaaguucuaccgcgaccccaccgccuucggcuccggcauccacaagauccgcaucaaguggaccaagcucaccuccgacuaccucaaggaggucgacgucuucgucuccaugggcuaccacaagaagaccuacggcggcuaccagggccgcgucuuccucaagggcggcuccgacuccgacgccucccucgucaucaccgaccucacccucgaggacuacggccgcuacaagugcgaggucaucgagggccucgaggacgacaccgucgucgucgcccucgaccuccagggcgucgucuuccccuacuucccccgccucggccgcuacaaccucaacuuccacgaggcccagcaggccugccucgaccaggacgccgucaucgccuccuucgaccagcucuacgacgccuggcgcggcggccucgacuggugcaacgccggcuggcucuccgacggcuccguccaguaccccaucaccaagccccgcgagcccugcggcggccagaacaccguccccggcguccgcaacuacggcuucugggacaaggacaagucccgcuacgacgucuucugcuucaccuccaacuucaacggccgcuucuacuaccucauccaccccaccaagcucaccuacgacgaggccguccaggccugccucaacgacggcgcccagaucgccaaggucggccagaucuucgccgccuggaagauccucggcuacgaccgcugcgacgccggcuggcucgccgacggcuccguccgcuaccccaucucccgcccccgccgccgcugcucccccaccgaggccgccguccgcuucgucggcuuccccgacaagaagcacaagcucuacggcgucuacugcuuccgcgccuacaacuga

SEQ ID NO: 44035 - RNA, 1209 nt, Artificial Sequence
  derived and/or modified sequence opt2 from HAPLN4__Homo_sapiens__NP_075378
auggucugcgcccgcgccgcccucggccccggcgcccucugggccgccgccuggggcguccuccuccucaccgcccccgccggcgcccagcgcggccgcaagaaggucguccacguccucgagggcgaguccggcuccgucgucguccagaccgcccccggccaggucgucucccaccgcggcggcaccaucguccuccccugccgcuaccacuacgaggccgccgcccacggccacgacggcguccgccucaaguggaccaaggucgucgacccccucgccuucaccgacgucuucgucgcccucggcccccagcaccgcgccuucggcuccuaccgcggccgcgccgagcuccagggcgacggccccggcgacgccucccucguccuccgcaacgucacccuccaggacuacggccgcuacgagugcgaggucaccaacgagcucgaggacgacgccggcauggucaagcucgaccucgagggcgucgucuuccccuaccacccccgcggcggccgcuacaagcucaccuucgccgaggcccagcgcgccugcgccgagcaggacggcauccucgccuccgccgagcagcuccacgccgccuggcgcgacggccucgacuggugcaacgccggcuggcuccgcgacggcuccguccaguaccccgucaaccgcccccgcgagcccugcggcggccucggcggcaccggcuccgccggcggcggcggcgacgccaacggcggccuccgcaacuacggcuaccgccacaacgccgaggagcgcuacgacgccuucugcuucaccuccaaccuccccggccgcgucuucuuccucaagccccuccgccccguccccuucuccggcgccgcccgcgccugcgccgcccgcggcgccgccgucgccaaggucggccagcucuucgccgccuggaagcuccagcuccucgaccgcugcaccgccggcuggcucgccgacggcuccgcccgcuaccccaucgucaacccccgcgcccgcugcggcggccgccgccccggcguccgcucccucggcuuccccgacgccacccgccgccucuucggcgucuacugcuaccgcgcccccggcgcccccgaccccgcccccggcggcuggggcuggggcugggccggcggcggcggcugggccggcggcgcccgcgaccccgccgccuggaccccccuccacgucuga

SEQ ID NO: 44036 - RNA, 1446 nt, Artificial Sequence
  derived and/or modified sequence opt2 from HARS2__Homo_sapiens__NP_001265660
augccccuccucggccuccucccccgccgcgccugggccucccuccucucccagcuccuccgcccccccugcgccuccugcaccggcgccguccgcugccagucccagggcacccgcgaccucuccccccagcacauggucguccgcgagaagauccucgaccucgucaucuccugcuucaagcgccacggcgccaagggcauggacacccccgccuucgagcucaaggagacccucaccgagaaguacggcgaggacuccggccucauguacgaccucaaggaccagggcggcgagcuccucucccuccgcuacgaccucaccguccccuucgcccgcuaccucgccaugaacaaggucaagaagaugaagcgcuaccacgucggcaaggucuggcgccgcgagucccccaccaucguccagggccgcuaccgcgaguucugccagugcgacuucgacaucgccggccaguucgaccccaugauccccgacgccgagugccucaagaucaugugcgagauccucuccggccuccagcucggcgacuuccucaucaaggucaacgaccgccgcaucgucgacggcauguucgccgucugcggcguccccgaguccaaguuccgcgccaucugcuccuccaucgacaagcucgacaagauggccuggaaggacguccgccacgagauggucgucaagaagggccucgcccccgaggucgccgaccgcaucggcgacuacguccagugccacggcggcgucucccucgucgagcagauguuccaggacccccgccucucccagaacaagcaggcccucgagggccucggcgaccucaagcuccucuucgaguaccucacccucuucggcaucgccgacaagaucuccuucgaccucucccucgcccgcggccucgacuacuacaccggcgucaucuacgaggccguccuccuccagacccccacccaggccggcgaggagccccucaacgucggcuccgucgccgccggcggccgcuacgacggccucgucggcauguucgaccccaagggccacaagguccccugcgucggccucuccaucggcgucgagcgcaucuucuacaucgucgagcagcgcaugaagaccaagggcgagaagguccgcaccaccgagacccaggucuucgucgccaccccccagaagaacuuccuccaggagcgccucaagcucaucgccgagcucugggacuccggcaucaaggccgagaugcucuacaagaacaaccccaagcuccucacccagcuccacuacugcgaguccaccggcaucccccucgucgucaucaucggcgagcaggagcucaaggagggcgucaucaagauccgcuccgucgccucccgcgaggaggucgccaucaagcgcgagaacuucgucgccgagauccagaagcgccucuccgaguccuga

SEQ ID NO: 44037 - RNA, 1410 nt, Artificial Sequence
  derived and/or modified sequence opt2 from HARS__Homo_sapiens__NP_001244969
auggccgagcgcgccgcccucgaggagcucgucaagcuccagggcgagcgcguccgcggccucaagcagcagaaggccuccgccgagcucaucgaggaggaggucgccaagcuccucaagcucaaggcccagcucggccccgacgaguccaagcagaaguucguccucaagacccccaaggagacccucaugggcaaguacggcgaggacuccaagcucaucuacgaccucaaggaccagggcggcgagcuccucucccuccgcuacgaccucaccguccccuucgcccgcuaccucgccaugaacaagcucaccaacaucaagcgcuaccacaucgccaaggucuaccgccgcgacaaccccgccaugacccgcggccgcuaccgcgaguucuaccagugcgacuucgacaucgccggcaacuucgaccccaugauccccgacgccgagugccucaagaucaugugcgagauccucuccucccuccagaucggcgacuuccucgucaaggucaacgaccgccgcauccucgacggcauguucgccaucugcggcgucuccgacuccaaguuccgcaccaucugcuccuccgucgacaagcucgacaaggucuccugggaggaggucaagaacgagauggucggcgagaagggccucgcccccgaggucgccgaccgcaucggcgacuacguccagcagcacggcggcgucucccucgucgagcagcuccuccaggaccccaagcucucccagaacaagcaggcccucgagggccucggcgaccucaagcuccucuucgaguaccucacccucuucggcaucgacgacaagaucuccuucgaccucucccucgcccgcggccucgacuacuacaccggcgucaucuacgaggccguccuccuccagacccccgcccaggccggcgaggagccccucggcgucggcuccgucgccgccggcggccgcuacgacggccucgucggcauguucgaccccaagggccgcaagguccccugcgucggccucuccaucggcgucgagcgcaucuucuccaucgucgagcagcgccucgaggcccucgaggagaagauccgcaccaccgagacccagguccucgucgccuccgcccagaagaagcuccucgaggagcgccucaagcucgucuccgagcucugggacgccggcaucaaggccgagcuccucuacaagaagaaccccaagcuccucaaccagcuccaguacugcgaggaggccggcaucccccucgucgccaucaucggcgagcaggagcucaaggacggcgucaucaagcuccgcuccgucaccucccgcgaggaggucgacguccgccgcgaggaccucgucgaggagaucaagcgccgcaccggccagccccucugcaucugcuga

SEQ ID NO: 44038 - RNA, 1734 nt, Artificial Sequence
  derived and/or modified sequence opt2 from HAS1__Homo_sapiens__NP_001284365
augcgccaggacgcccccaagcccacccccgccgccugccgcugcuccggccucgcccgccgcguccucaccaucgccuucgcccuccucauccucggccucaugaccugggccuacgccgccggcgucccccucgccuccgaccgcuacggccuccucgccuucggccucuacggcgccuuccucuccgcccaccucgucgcccagucccucuucgccuaccucgagcaccgccgcgucgccgccgccgcccgcggcccccucgacgccgccaccgcccgcuccgucgcccucaccaucuccgccuaccaggaggaccccgccuaccuccgccagugccucgccuccgcccgcgcccuccucuacccccgcgcccgccuccgcguccucauggucgucgacggcaaccgcgccgaggaccucuacauggucgacauguuccgcgaggucuucgccgacgaggaccccgccaccuacgucugggacggcaacuaccaccagcccugggagcccgccgccgccggcgccgucggcgccggcgccuaccgcgaggucgaggccgaggaccccggccgccucgccgucgaggcccucguccgcacccgccgcugcgucugcgucgcccagcgcuggggcggcaagcgcgaggucauguacaccgccuucaaggcccucggcgacuccgucgacuacguccaggucugcgacuccgacacccgccucgaccccauggcccuccucgagcucguccgcguccucgacgaggacccccgcgucggcgccgucggcggcgacguccgcauccucaacccccucgacuccugggucuccuuccucuccucccuccgcuacugggucgccuucaacgucgagcgcgccugccaguccuacuuccacugcgucuccugcaucuccggcccccucggccucuaccgcaacaaccuccuccagcaguuccucgaggccugguacaaccagaaguuccucggcacccacugcaccuucggcgacgaccgccaccucaccaaccgcaugcucuccaugggcuacgccaccaaguacaccucccgcucccgcugcuacuccgagacccccuccuccuuccuccgcuggcucucccagcagacccgcugguccaaguccuacuuccgcgaguggcucuacaacgcccucugguggcaccgccaccacgccuggaugaccuacgaggccgucgucuccggccucuuccccuucuucgucgccgccaccguccuccgccucuucuacgccggccgccccugggcccuccucuggguccuccucugcguccagggcgucgcccucgccaaggccgccuucgccgccuggcuccgcggcugccuccgcaugguccuccucucccucuacgccccccucuacaugugcggccuccuccccgccaaguuccucgcccucgucaccaugaaccaguccggcuggggcaccuccggccgccgcaagcucgccgccaacuacgucccccuccucccccucgcccucugggcccuccuccuccucggcggccucguccgcuccgucgcccacgaggcccgcgccgacugguccggccccucccgcgccgccgaggccuaccaccucgccgccggcgccggcgccuacgucggcuacugggucgccaugcucacccucuacugggucggcguccgccgccucugccgccgccgcaccggcggcuaccgcguccaggucuga

SEQ ID NO: 44039 - RNA, 1659 nt, Artificial Sequence
  derived and/or modified sequence opt2 from HAS2__Homo_sapiens__XP_011515304
augcacugcgagcgcuuccucugcauccuccgcaucaucggcaccacccucuucggcgucucccuccuccucggcaucaccgccgccuacaucgucggcuaccaguucauccagaccgacaacuacuacuucuccuucggccucuacggcgccuuccucgccucccaccucaucauccagucccucuucgccuuccucgagcaccgcaagaugaagaagucccucgagacccccaucaagcucaacaagaccgucgcccucugcaucgccgccuaccaggaggaccccgacuaccuccgcaagugccuccaguccgucaagcgccucaccuaccccggcaucaaggucgucauggucaucgacggcaacuccgaggacgaccucuacaugauggacaucuucuccgaggucaugggccgcgacaaguccgccaccuacaucuggaagaacaacuuccacgagaagggccccggcgagaccgacgagucccacaaggaguccucccagcacgucacccagcucguccucuccaacaaguccaucugcaucaugcagaaguggggcggcaagcgcgaggucauguacaccgccuuccgcgcccucggccgcuccgucgacuacguccaggucugcgacuccgacaccaugcucgaccccgccuccuccgucgagauggucaagguccucgaggaggaccccauggucggcggcgucggcggcgacguccagauccucaacaaguacgacuccuggaucuccuuccucuccuccguccgcuacuggauggccuucaacaucgagcgcgccugccaguccuacuucggcugcguccagugcaucuccggcccccucggcauguaccgcaacucccuccuccacgaguucgucgaggacugguacaaccaggaguucaugggcaaccagugcuccuucggcgacgaccgccaccucaccaaccgcguccucucccucggcuacgccaccaaguacaccgcccgcuccaagugccucaccgagacccccaucgaguaccuccgcuggcucaaccagcagacccgcugguccaaguccuacuuccgcgaguggcucuacaacgccaugugguuccacaagcaccaccucuggaugaccuacgaggccaucaucaccggcuucuuccccuucuuccucaucgccaccgucauccagcucuucuaccgcggcaagaucuggaacauccuccucuuccuccucaccguccagcucgucggccucaucaaguccuccuucgccuccugccuccgcggcaacaucgucauggucuucaugucccucuacuccguccucuacauguccucccuccuccccgccaagauguucgccaucgccaccaucaacaaggccggcuggggcaccuccggccgcaagaccaucgucgucaacuucaucggccucauccccgucuccgucugguucaccauccuccucggcggcgucaucuucaccaucuacaaggaguccaagcgccccuucuccgaguccaagcagaccguccucaucgucggcacccuccucuacgccugcuacugggucaugcuccucacccucuacgucguccucaucaacaagugcggccgccgcaagaagggccagcaguacgacaugguccucgacgucuga

SEQ ID NO: 44040 - RNA, 1662 nt, Artificial Sequence
  derived and/or modified sequence opt2 from HAS3__Homo_sapiens__NP_005320
augcccguccagcucaccaccgcccuccgcgucgucggcaccucccucuucgcccucgccguccucggcggcauccucgccgccuacgucaccggcuaccaguucauccacaccgagaagcacuaccucuccuucggccucuacggcgccauccucggccuccaccuccucauccagucccucuucgccuuccucgagcaccgccgcaugcgccgcgccggccaggcccucaagcuccccuccccccgccgcggcuccgucgcccucugcaucgccgccuaccaggaggaccccgacuaccuccgcaagugccuccgcuccgcccagcgcaucuccuuccccgaccucaaggucgucauggucgucgacggcaaccgccaggaggacgccuacaugcucgacaucuuccacgagguccucggcggcaccgagcaggccggcuucuucgucuggcgcuccaacuuccacgaggccggcgagggcgagaccgaggccucccuccaggagggcauggaccgcguccgcgacgucguccgcgccuccaccuucuccugcaucaugcagaaguggggcggcaagcgcgaggucauguacaccgccuucaaggcccucggcgacuccgucgacuacauccaggucugcgacuccgacaccguccucgaccccgccugcaccaucgagaugcuccgcguccucgaggaggacccccaggucggcggcgucggcggcgacguccagauccucaacaaguacgacuccuggaucuccuuccucuccuccguccgcuacuggauggccuucaacgucgagcgcgccugccaguccuacuucggcugcguccagugcaucuccggcccccucggcauguaccgcaacucccuccuccagcaguuccucgaggacugguaccaccagaaguuccucggcuccaagugcuccuucggcgacgaccgccaccucaccaaccgcguccucucccucggcuaccgcaccaaguacaccgcccgcuccaagugccucaccgagacccccaccaaguaccuccgcuggcucaaccagcagacccgcugguccaaguccuacuuccgcgaguggcucuacaacucccucugguuccacaagcaccaccucuggaugaccuacgaguccgucgucaccggcuucuuccccuucuuccucaucgccaccgucauccagcucuucuaccgcggccgcaucuggaacauccuccucuuccuccucaccguccagcucgucggcaucaucaaggccaccuacgccugcuuccuccgcggcaacgccgagaugaucuucaugucccucuacucccuccucuacauguccucccuccuccccgccaagaucuucgccaucgccaccaucaacaaguccggcuggggcaccuccggccgcaagaccaucgucgucaacuucaucggccucauccccgucuccaucugggucgccguccuccucggcggccucgccuacaccgccuacugccaggaccucuucuccgagaccgagcucgccuuccucgucuccggcgccauccucuacggcugcuacugggucgcccuccucaugcucuaccucgccaucaucgcccgccgcugcggcaagaagcccgagcaguacucccucgccuucgccgaggucuga

SEQ ID NO: 44041 - RNA, 1260 nt, Artificial Sequence
  derived and/or modified sequence opt2 from HAT1__Homo_sapiens__NP_003633
auggccggcuucggcgccauggagaaguuccucgucgaguacaaguccgccgucgagaagaagcucgccgaguacaagugcaacaccaacaccgccaucgagcucaagcucguccgcuuccccgaggaccucgagaacgacauccgcaccuucuuccccgaguacacccaccagcucuucggcgacgacgagaccgccuucggcuacaagggccucaagauccuccucuacuacaucgccggcucccucuccaccauguuccgcgucgaguacgccuccaaggucgacgagaacuucgacugcgucgaggccgacgacgucgagggcaagauccgccagaucaucccccccggcuucugcaccaacaccaacgacuuccucucccuccucgagaaggaggucgacuucaagcccuucggcacccuccuccacaccuacuccguccucucccccaccggcggcgagaacuucaccuuccagaucuacaaggccgacaugaccugccgcggcuuccgcgaguaccacgagcgccuccagaccuuccucaugugguucaucgagaccgccuccuucaucgacgucgacgacgagcgcuggcacuacuuccucgucuucgagaaguacaacaaggacggcgccacccucuucgccaccgucggcuacaugaccgucuacaacuacuacgucuaccccgacaagacccgcccccgcgucucccagaugcucauccucacccccuuccagggccagggccacggcgcccagcuccucgagaccguccaccgcuacuacaccgaguuccccaccguccucgacaucaccgccgaggaccccuccaaguccuacgucaagcuccgcgacuucguccucgucaagcucugccaggaccuccccugcuucucccgcgagaagcucaugcagggcuucaacgaggacauggccaucgaggcccagcagaaguucaagaucaacaagcagcacgcccgccgcgucuacgagauccuccgccuccucgucaccgacauguccgacgccgagcaguaccgcuccuaccgccucgacaucaagcgccgccucaucucccccuacaagaagaagcagcgcgaccucgccaagaugcgcaagugccuccgccccgaggagcucaccaaccagaugaaccagaucgagaucuccaugcagcacgagcagcucgaggaguccuuccaggagcucgucgaggacuaccgccgcgucaucgagcgccucgcccaggaguga

SEQ ID NO: 44042 - RNA, 1095 nt, Artificial Sequence
  derived and/or modified sequence opt2 from HAVCR1__Homo_sapiens__NP_001166864
augcacccccaggucgucauccucucccucauccuccaccucgccgacuccgucgccggcuccgucaaggucggcggcgaggccggccccuccgucacccuccccugccacuacuccggcgccgucaccuccaugugcuggaaccgcggcuccugcucccucuucaccugccagaacggcaucgucuggaccaacggcacccacgucaccuaccgcaaggacacccgcuacaagcuccucggcgaccucucccgccgcgacgucucccucaccaucgagaacaccgccgucuccgacuccggcgucuacugcugccgcgucgagcaccgcggcugguucaacgacaugaagaucaccgucucccucgagaucgucccccccaaggucaccaccacccccaucgucaccaccguccccaccgucaccaccguccgcaccuccaccaccguccccaccaccaccaccguccccaugaccaccguccccaccaccaccguccccaccaccauguccauccccaccaccaccaccguccucaccaccaugaccgucuccaccaccaccuccguccccaccaccaccuccauccccaccaccaccuccguccccgucaccaccaccgucuccaccuucgucccccccaugccccucccccgccagaaccacgagcccgucgccaccucccccuccuccccccagcccgccgagacccaccccaccacccuccagggcgccauccgccgcgagcccaccuccuccccccucuacuccuacaccaccgacggcaacgacaccgucaccgaguccuccgacggccucuggaacaacaaccagacccagcucuuccucgagcacucccuccucaccgccaacaccaccaagggcaucuacgccggcgucugcaucuccguccucguccuccucgcccuccucggcgucaucaucgccaagaaguacuucuucaagaaggagguccagcagcucuccgucuccuucuccucccuccagaucaaggcccuccagaacgccgucgagaaggagguccaggccgaggacaacaucuacaucgagaacucccucuacgccaccgacuga

SEQ ID NO: 44043 - RNA, 906 nt, Artificial Sequence
  derived and/or modified sequence opt2 from HAVCR2__Homo_sapiens__NP_116171
auguucucccaccuccccuucgacugcguccuccuccuccuccuccuccuccucacccgcuccuccgaggucgaguaccgcgccgaggucggccagaacgccuaccuccccugcuucuacacccccgccgcccccggcaaccucguccccgucugcuggggcaagggcgccugccccgucuucgagugcggcaacgucguccuccgcaccgacgagcgcgacgucaacuacuggaccucccgcuacuggcucaacggcgacuuccgcaagggcgacgucucccucaccaucgagaacgucacccucgccgacuccggcaucuacugcugccgcauccagauccccggcaucaugaacgacgagaaguucaaccucaagcucgucaucaagcccgccaaggucacccccgcccccacccgccagcgcgacuucaccgccgccuucccccgcaugcucaccacccgcggccacggccccgccgagacccagacccucggcucccuccccgacaucaaccucacccagaucuccacccucgccaacgagcuccgcgacucccgccucgccaacgaccuccgcgacuccggcgccaccauccgcaucggcaucuacaucggcgccggcaucugcgccggccucgcccucgcccucaucuucggcgcccucaucuucaagugguacucccacuccaaggagaagauccagaaccucucccucaucucccucgccaaccucccccccuccggccucgccaacgccgucgccgagggcauccgcuccgaggagaacaucuacaccaucgaggagaacgucuacgaggucgaggagcccaacgaguacuacugcuacgucuccucccgccagcagcccucccagccccucggcugccgcuucgccaugcccuga

SEQ ID NO: 44044 - RNA, 696 nt, Artificial Sequence
  derived and/or modified sequence opt2 from HAX1__Homo_sapiens__NP_001018238
augucccucuucgaccucuuccgcggcuucuucggcuuccccggcccccgcuccuucucccccggcggcggcauccgcuuccacgacaacuucggcuucgacgaccucguccgcgacuucaacuccaucuucuccgacaugggcgccuggacccuccccucccacccccccgagcuccccggccccgaguccgagacccccggcgagcgccuccgcgagggccagacccuccgcgacuccaugcucaaguaccccgacucccaccagccccgcaucuucggcggcguccucgaguccgacgcccgcuccgaguccccccagcccgcccccgacuggggcucccagcgccccuuccaccgcuucgacgacgucuggcccauggacccccacccccgcacccgcgaggacaacgaccucgacucccaggucucccaggagggccucggccccguccuccagccccagcccaaguccuacuucaaguccaucuccgucaccaagaucaccaagcccgacggcaucgucgaggagcgccgcaccgucgucgacuccgagggccgcaccgagaccaccgucacccgccacgaggccgacuccuccccccgcggcgaccccgaguccccccgcccccccgcccucgacgacgccuucuccauccucgaccucuuccucggccgcugguuccgcucccgcuga

SEQ ID NO: 44045 - RNA, 429 nt, Artificial Sequence
  derived and/or modified sequence opt2 from HBA2__Homo_sapiens__NP_000508
augguccucucccccgccgacaagaccaacgucaaggccgccuggggcaaggucggcgcccacgccggcgaguacggcgccgaggcccucgagcgcauguuccucuccuuccccaccaccaagaccuacuucccccacuucgaccucucccacggcuccgcccaggucaagggccacggcaagaaggucgccgacgcccucaccaacgccgucgcccacgucgacgacaugcccaacgcccucuccgcccucuccgaccuccacgcccacaagcuccgcgucgaccccgucaacuucaagcuccucucccacugccuccucgucacccucgccgcccaccuccccgccgaguucacccccgccguccacgccucccucgacaaguuccucgccuccgucuccaccguccucaccuccaaguaccgcuga

SEQ ID NO: 44046 - RNA, 444 nt, Artificial Sequence
  derived and/or modified sequence opt2 from HBB__Homo_sapiens__NP_000509
augguccaccucacccccgaggagaaguccgccgucaccgcccucuggggcaaggucaacgucgacgaggucggcggcgaggcccucggccgccuccucgucgucuaccccuggacccagcgcuucuucgaguccuucggcgaccucuccacccccgacgccgucaugggcaaccccaaggucaaggcccacggcaagaagguccucggcgccuucuccgacggccucgcccaccucgacaaccucaagggcaccuucgccacccucuccgagcuccacugcgacaagcuccacgucgaccccgagaacuuccgccuccucggcaacguccucgucugcguccucgcccaccacuucggcaaggaguucaccccccccguccaggccgccuaccagaaggucgucgccggcgucgccaacgcccucgcccacaaguaccacuga

SEQ ID NO: 44047 - RNA, 444 nt, Artificial Sequence
  derived and/or modified sequence opt2 from HBD__Homo_sapiens__NP_000510
augguccaccucacccccgaggagaagaccgccgucaacgcccucuggggcaaggucaacgucgacgccgucggcggcgaggcccucggccgccuccucgucgucuaccccuggacccagcgcuucuucgaguccuucggcgaccucuccucccccgacgccgucaugggcaaccccaaggucaaggcccacggcaagaagguccucggcgccuucuccgacggccucgcccaccucgacaaccucaagggcaccuucucccagcucuccgagcuccacugcgacaagcuccacgucgaccccgagaacuuccgccuccucggcaacguccucgucugcguccucgcccgcaacuucggcaaggaguucaccccccagaugcaggccgccuaccagaaggucgucgccggcgucgccaacgcccucgcccacaaguaccacuga

SEQ ID NO: 44048 - RNA, 444 nt, Artificial Sequence
  derived and/or modified sequence opt2 from HBE1__Homo_sapiens__NP_005321
augguccacuucaccgccgaggagaaggccgccgucaccucccucugguccaagaugaacgucgaggaggccggcggcgaggcccucggccgccuccucgucgucuaccccuggacccagcgcuucuucgacuccuucggcaaccucuccucccccuccgccauccucggcaaccccaaggucaaggcccacggcaagaagguccucaccuccuucggcgacgccaucaagaacauggacaaccucaagcccgccuucgccaagcucuccgagcuccacugcgacaagcuccacgucgaccccgagaacuucaagcuccucggcaacgucauggucaucauccucgccacccacuucggcaaggaguucacccccgagguccaggccgccuggcagaagcucgucuccgccgucgccaucgcccucgcccacaaguaccacuga

SEQ ID NO: 44049 - RNA, 627 nt, Artificial Sequence
  derived and/or modified sequence opt2 from HBEGF__Homo_sapiens__NP_001936
augaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacuga

SEQ ID NO: 44050 - RNA, 444 nt, Artificial Sequence
  derived and/or modified sequence opt2 from HBG1__Homo_sapiens__NP_000550
augggccacuucaccgaggaggacaaggccaccaucaccucccucuggggcaaggucaacgucgaggacgccggcggcgagacccucggccgccuccucgucgucuaccccuggacccagcgcuucuucgacuccuucggcaaccucuccuccgccuccgccaucaugggcaaccccaaggucaaggcccacggcaagaagguccucaccucccucggcgacgccaccaagcaccucgacgaccucaagggcaccuucgcccagcucuccgagcuccacugcgacaagcuccacgucgaccccgagaacuucaagcuccucggcaacguccucgucaccguccucgccauccacuucggcaaggaguucacccccgagguccaggccuccuggcagaagauggucaccgccgucgccuccgcccucuccucccgcuaccacuga

SEQ ID NO: 44051 - RNA, 444 nt, Artificial Sequence
  derived and/or modified sequence opt2 from HBG2__Homo_sapiens__NP_000175
augggccacuucaccgaggaggacaaggccaccaucaccucccucuggggcaaggucaacgucgaggacgccggcggcgagacccucggccgccuccucgucgucuaccccuggacccagcgcuucuucgacuccuucggcaaccucuccuccgccuccgccaucaugggcaaccccaaggucaaggcccacggcaagaagguccucaccucccucggcgacgccaucaagcaccucgacgaccucaagggcaccuucgcccagcucuccgagcuccacugcgacaagcuccacgucgaccccgagaacuucaagcuccucggcaacguccucgucaccguccucgccauccacuucggcaaggaguucacccccgagguccaggccuccuggcagaagauggucaccggcgucgccuccgcccucuccucccgcuaccacuga

SEQ ID NO: 44052 - RNA, 426 nt, Artificial Sequence
  derived and/or modified sequence opt2 from HBM__Homo_sapiens__NP_001003938
augcucuccgcccaggagcgcgcccagaucgcccaggucugggaccucaucgccggccacgaggcccaguucggcgccgagcuccuccuccgccucuucaccgucuaccccuccaccaaggucuacuucccccaccucuccgccugccaggacgccacccagcuccucucccacggccagcgcaugcucgccgccgucggcgccgccguccagcacgucgacaaccuccgcgccgcccucuccccccucgccgaccuccacgcccucguccuccgcgucgaccccgccaacuucccccuccucauccagugcuuccacgucguccucgccucccaccuccaggacgaguucaccguccagaugcaggccgccugggacaaguuccucaccggcgucgccgucguccucaccgagaaguaccgcuga

SEQ ID NO: 44053 - RNA, 1575 nt, Artificial Sequence
  derived and/or modified sequence opt2 from HBP1__Homo_sapiens__NP_001231191
auggccaccggccucuccgagcaccacaacauggucugggaggucaagaccaaccagaugcccaacgccguccagaagcuccuccucgucauggacaagcgcgccuccggcaugaacgacucccucgagcuccuccagugcaacgagaaccuccccuccucccccggcuacaacuccugcgacgagcacauggagcucgacgaccuccccgagcuccaggccguccaguccgaccccacccaguccggcauguaccagcucuccuccgacgucucccaccaggaguacccccgcuccuccuggaaccagaacaccuccgacauccccgagaccaccuaccgcgagaacgaggucgacuggcucaccgagcucgccaacaucgccaccuccccccaguccccccucaugcagugcuccuucuacaaccgcuccucccccguccacaucaucgccaccuccaagucccuccacuccuacgcccgccccccccccgucuccuccuccuccaaguccgagcccgccuucccccaccaccacuggaaggaggagacccccguccgccacgagcgcgccaacuccgaguccgaguccggcaucuucugcauguccucccucuccgacgacgacgaccucggcuggugcaacuccuggcccuccaccgucuggcacugcuuccucaagggcacccgccucugcuuccacaagggcuccaacaaggaguggcaggacgucgaggacuucgcccgcgccgagggcugcgacaacgaggaggaccuccagaugggcauccacaagggcuacggcuccgacggccucaagcuccucucccacgaggaguccgucuccuucggcgaguccguccucaagcucaccuucgaccccggcaccgucgaggacggccuccucaccgucgagugcaagcucgaccaccccuucuacgucaagaacaagggcugguccuccuucuaccccucccucaccgucguccagcacggcauccccugcugcgagguccacaucggcgacgucugccucccccccggccaccccgacgccaucaacuucgacgacuccggcgucuucgacaccuucaaguccuacgacuucacccccauggacuccuccgccgucuacguccucuccuccauggcccgccagcgccgcgccucccucuccugcggcggccccggcggccaggacuucgcccgcuccggcuucuccaagaacugcggcucccccggcuccucccagcucuccuccaacucccucuacgccaaggccgucaagaaccacuccuccggcaccgucuccgccaccucccccaacaagugcaagcgccccaugaacgccuucaugcucuucgccaagaaguaccgcgucgaguacacccagauguaccccggcaaggacaaccgcgccaucuccgucauccucggcgaccgcuggaagaagaugaagaacgaggagcgccgcauguacacccucgaggccaaggcccucgccgaggagcagaagcgccucaaccccgacugcuggaagcgcaagcgcaccaacuccggcucccagcagcacuga

SEQ ID NO: 44054 - RNA, 429 nt, Artificial Sequence
  derived and/or modified sequence opt2 from HBQ1__Homo_sapiens__NP_005322
auggcccucuccgccgaggaccgcgcccucguccgcgcccucuggaagaagcucggcuccaacgucggcgucuacaccaccgaggcccucgagcgcaccuuccucgccuuccccgccaccaagaccuacuucucccaccucgaccucucccccggcuccucccagguccgcgcccacggccagaaggucgccgacgcccucucccucgccgucgagcgccucgacgaccucccccacgcccucuccgcccucucccaccuccacgccugccagcuccgcgucgaccccgccuccuuccagcuccucggccacugccuccucgucacccucgcccgccacuaccccggcgacuucucccccgcccuccaggccucccucgacaaguuccucucccacgucaucuccgcccucgucuccgaguaccgcuga

SEQ ID NO: 44055 - RNA, 1929 nt, Artificial Sequence
  derived and/or modified sequence opt2 from HBS1L__Homo_sapiens__NP_001138630
auggcccgccaccgcaacguccgcggcuacaacuacgacgaggacuucgaggacgacgaccucuacggccaguccgucgaggacgacuacugcaucucccccuccaccgcccgccucuacuccugccucgaccacaugcgcgagguccucggcgacgccguccccgacgagauccucaucgaggccguccucaagaacaaguucgacguccagaaggcccucuccggcguccucgagcaggaccgcguccagucccucaaggacaagaacgaggccaccgucuccaccggcaagaucgccaagggcaagcccgucgacucccagaccucccgcuccgaguccgagaucguccccaaggucgccaagaugaccgucuccggcaagaagcagaccaugggcuucgagguccccggcgucuccuccgaggagaacggccacuccuuccacaccccccagaagggcccccccaucgaggacgccaucgccuccuccgacguccucgagaccgccuccaaguccgccaaccccccccacaccauccaggccuccgaggagcaguccuccacccccgcccccgucaagaaguccggcaagcuccgccagcagaucgacgucaaggccgagcucgagaagcgccagggcggcaagcagcuccucaaccucgucgucaucggccacgucgacgccggcaaguccacccucaugggccacaugcucuaccuccucggcaacaucaacaagcgcaccaugcacaaguacgagcaggaguccaagaaggccggcaaggccuccuucgccuacgccuggguccucgacgagaccggcgaggagcgcgagcgcggcgucaccauggacgucggcaugaccaaguucgagaccaccaccaaggucaucacccucauggacgcccccggccacaaggacuucauccccaacaugaucaccggcgccgcccaggccgacgucgccguccucgucgucgacgccucccgcggcgaguucgaggccggcuucgagaccggcggccagacccgcgagcacggccuccucguccgcucccucggcgucacccagcucgccgucgccgucaacaagauggaccaggucaacuggcagcaggagcgcuuccaggagaucaccggcaagcucggccacuuccucaagcaggccggcuucaaggaguccgacgucggcuucauccccaccuccggccucuccggcgagaaccucaucacccgcucccaguccuccgagcucaccaagugguacaagggccucugccuccucgagcagaucgacuccuucaagcccccccagcgcuccaucgacaagcccuuccgccucugcgucuccgacgucuucaaggaccagggcuccggcuucugcaucaccggcaagaucgaggccggcuacauccagaccggcgaccgccuccucgccaugccccccaacgagaccugcaccgucaagggcaucacccuccacgacgagcccgucgacugggccgccgccggcgaccacgucucccucacccucgucggcauggacaucaucaagaucaacgucggcugcaucuucugcggccccaagguccccaucaaggccugcacccgcuuccgcgcccgcauccucaucuucaacaucgagauccccaucaccaagggcuuccccguccuccuccacuaccagaccgucuccgagcccgccgucaucaagcgccucaucuccguccucaacaaguccaccggcgaggucaccaagaagaagcccaaguuccucaccaagggccagaacgcccucgucgagcuccagacccagcgccccaucgcccucgagcucuacaaggacuucaaggagcucggccgcuucaugcuccgcuacggcggcuccaccaucgccgccggcgucgucaccgagaucaaggaguga

SEQ ID NO: 44056 - RNA, 429 nt, Artificial Sequence
  derived and/or modified sequence opt2 from HBZ__Homo_sapiens__NP_005323
augucccucaccaagaccgagcgcaccaucaucgucuccaugugggccaagaucuccacccaggccgacaccaucggcaccgagacccucgagcgccucuuccucucccacccccagaccaagaccuacuucccccacuucgaccuccaccccggcuccgcccagcuccgcgcccacggcuccaaggucgucgccgccgucggcgacgccgucaaguccaucgacgacaucggcggcgcccucuccaagcucuccgagcuccacgccuacauccuccgcgucgaccccgucaacuucaagcuccucucccacugccuccucgucacccucgccgcccgcuuccccgccgacuucaccgccgaggcccacgccgccugggacaaguuccucuccgucgucuccuccguccucaccgagaaguaccgcuga

SEQ ID NO: 44057 - RNA, 1041 nt, Artificial Sequence
  derived and/or modified sequence opt2 from HCAR1__Homo_sapiens__NP_115943
auguacaacggcuccugcugccgcaucgagggcgacaccaucucccaggucaugcccccccuccucaucgucgccuucguccucggcgcccucggcaacggcgucgcccucugcggcuucugcuuccacaugaagaccuggaagcccuccaccgucuaccucuucaaccucgccgucgccgacuuccuccucaugaucugccuccccuuccgcaccgacuacuaccuccgccgccgccacugggccuucggcgacauccccugccgcgucggccucuucacccucgccaugaaccgcgccggcuccaucgucuuccucaccgucgucgccgccgaccgcuacuucaaggucguccacccccaccacgccgucaacaccaucuccacccgcgucgccgccggcaucgucugcacccucugggcccucgucauccucggcaccgucuaccuccuccucgagaaccaccucugcguccaggagaccgccgucuccugcgaguccuucaucauggaguccgccaacggcuggcacgacaucauguuccagcucgaguucuucaugccccucggcaucauccucuucugcuccuucaagaucgucuggucccuccgccgccgccagcagcucgcccgccaggcccgcaugaagaaggccacccgcuucaucauggucgucgccaucgucuucaucaccugcuaccuccccuccgucuccgcccgccucuacuuccucuggaccguccccuccuccgccugcgaccccuccguccacggcgcccuccacaucacccucuccuucaccuacaugaacuccaugcucgacccccucgucuacuacuucuccucccccuccuuccccaaguucuacaacaagcucaagaucugcucccucaagcccaagcagcccggccacuccaagacccagcgccccgaggagaugcccaucuccaaccucggccgccgcuccugcaucuccgucgccaacuccuuccagucccaguccgacggccagugggacccccacaucgucgaguggcacuga

SEQ ID NO: 44058 - RNA, 1092 nt, Artificial Sequence
  derived and/or modified sequence opt2 from HCAR2__Homo_sapiens__NP_808219
augaaccgccaccaccuccaggaccacuuccucgagaucgacaagaagaacugcugcgucuuccgcgacgacuucaucgucaagguccucccccccguccucggccucgaguucaucuucggccuccucggcaacggccucgcccucuggaucuucugcuuccaccucaaguccuggaaguccucccgcaucuuccucuucaaccucgccgucgccgacuuccuccucaucaucugccuccccuuccucauggacaacuacguccgccgcugggacuggaaguucggcgacauccccugccgccucaugcucuucaugcucgccaugaaccgccagggcuccaucaucuuccucaccgucgucgccgucgaccgcuacuuccgcgucguccacccccaccacgcccucaacaagaucuccaaccgcaccgccgccaucaucuccugccuccucuggggcaucaccaucggccucaccguccaccuccucaagaagaagaugcccauccagaacggcggcgccaaccucugcuccuccuucuccaucugccacaccuuccaguggcacgaggccauguuccuccucgaguucuuccucccccucggcaucauccucuucugcuccgcccgcaucaucuggucccuccgccagcgccagauggaccgccacgccaagaucaagcgcgccaucaccuucaucauggucgucgccaucgucuucgucaucugcuuccuccccuccgucgucguccgcauccgcaucuucuggcuccuccacaccuccggcacccagaacugcgaggucuaccgcuccgucgaccucgccuucuucaucacccucuccuucaccuacaugaacuccaugcucgaccccgucgucuacuacuucuccucccccuccuuccccaacuucuucuccacccucaucaaccgcugccuccagcgcaagaugaccggcgagcccgacaacaaccgcuccaccuccgucgagcucaccggcgaccccaacaagacccgcggcgcccccgaggcccucauggccaacuccggcgagcccuggucccccuccuaccucggccccaccucccccuga

SEQ ID NO: 44059 - RNA, 1164 nt, Artificial Sequence
  derived and/or modified sequence opt2 from HCAR3__Homo_sapiens__NP_006009
augaaccgccaccaccuccaggaccacuuccucgagaucgacaagaagaacugcugcgucuuccgcgacgacuucaucgccaagguccucccccccguccucggccucgaguucaucuucggccuccucggcaacggccucgcccucuggaucuucugcuuccaccucaaguccuggaaguccucccgcaucuuccucuucaaccucgccgucgccgacuuccuccucaucaucugccuccccuucgucauggacuacuacguccgccgcuccgacuggaaguucggcgacauccccugccgccucguccucuucauguucgccaugaaccgccagggcuccaucaucuuccucaccgucgucgccgucgaccgcuacuuccgcgucguccacccccaccacgcccucaacaagaucuccaacuggaccgccgccaucaucuccugccuccucuggggcaucaccgucggccucaccguccaccuccucaagaagaagcuccucauccagaacggcaccgccaacgucugcaucuccuucuccaucugccacaccuuccgcuggcacgaggccauguuccuccucgaguucuuccucccccucggcaucauccucuucugcuccgcccgcaucaucuggucccuccgccagcgccagauggaccgccacgccaagaucaagcgcgccaucaccuucaucauggucgucgccaucgucuucgucaucugcuuccuccccuccgucgucguccgcauccacaucuucuggcuccuccacaccuccggcacccagaacugcgaggucuaccgcuccgucgaccucgccuucuucaucacccucuccuucaccuacaugaacuccaugcucgaccccgucgucuacuacuucuccucccccuccuuccccaacuucuucuccacccucaucaaccgcugccuccagcgcaagaucaccggcgagcccgacaacaaccgcuccaccuccgucgagcucaccggcgaccccaacaagacccgcggcgcccccgaggcccucaucgccaacuccggcgagcccuggucccccuccuaccucggccccaccuccaacaaccacuccaagaagggccacugccaccaggagcccgccucccucgagaagcagcucggcugcugcaucgaguga

SEQ ID NO: 44060 - RNA, 807 nt, Artificial Sequence
  derived and/or modified sequence opt2 from HCCS__Homo_sapiens__NP_001116080
augggccucucccccuccgcccccgccgucgccguccaggccuccaacgccuccgccuccccccccuccggcugccccaugcacgagggcaagaugaagggcugccccgucaacaccgagcccuccggccccaccugcgagaagaagaccuacuccguccccgcccaccaggagcgcgccuacgaguacgucgagugccccauccgcggcaccgccgccgagaacaaggagaaccucgaccccuccaaccucaugcccccccccaaccagacccccgcccccgaccagcccuucgcccucuccaccguccgcgaggaguccuccaucccccgcgccgacuccgagaagaagugggucuaccccuccgagcagauguucuggaacgccaugcucaagaagggcuggaaguggaaggacgaggacaucucccagaaggacauguacaacaucauccgcauccacaaccagaacaacgagcaggccuggaaggagauccucaagugggaggcccuccacgccgccgagugccccugcggccccucccucauccgcuucggcggcaaggccaaggaguacuccccccgcgcccgcauccgcuccuggaugggcuacgagcuccccuucgaccgccacgacuggaucaucaaccgcugcggcaccgagguccgcuacgucaucgacuacuacgacggcggcgaggucaacaaggacuaccaguucaccauccucgacguccgccccgcccucgacucccucuccgccgucugggaccgcaugaaggucgccugguggcgcuggaccuccuga

SEQ ID NO: 44061 - RNA, 6108 nt, Artificial Sequence
  derived and/or modified sequence opt2 from HCFC1__Homo_sapiens__NP_005325
auggccuccgccgucucccccgccaaccuccccgccguccuccuccagccccgcuggaagcgcgucgucggcugguccggccccgucccccgcccccgccacggccaccgcgccgucgccaucaaggagcucaucgucgucuucggcggcggcaacgagggcaucgucgacgagcuccacgucuacaacaccgccaccaaccagugguucauccccgccguccgcggcgacaucccccccggcugcgccgccuacggcuucgucugcgacggcacccgccuccucgucuucggcggcauggucgaguacggcaaguacuccaacgaccucuacgagcuccaggccucccgcugggaguggaagcgccucaaggccaagacccccaagaacggccccccccccugcccccgccucggccacuccuucucccucgucggcaacaagugcuaccucuucggcggccucgccaacgacuccgaggaccccaagaacaacaucccccgcuaccucaacgaccucuacauccucgagcuccgccccggcuccggcgucgucgccugggacauccccaucaccuacggcguccucccccccccccgcgagucccacaccgccgucgucuacaccgagaaggacaacaagaaguccaagcucgucaucuacggcggcauguccggcugccgccucggcgaccucuggacccucgacaucgacacccucaccuggaacaagcccucccucuccggcgucgccccccucccccgcucccuccacuccgccaccaccaucggcaacaagauguacgucuucggcggcugggucccccucgucauggacgacgucaaggucgccacccacgagaaggaguggaagugcaccaacacccucgccugccucaaccucgacaccauggccugggagaccauccucauggacacccucgaggacaacaucccccgcgcccgcgccggccacugcgccgucgccaucaacacccgccucuacaucugguccggccgcgacggcuaccgcaaggccuggaacaaccaggucugcugcaaggaccucugguaccucgagaccgagaagccccccccccccgcccgcguccagcucguccgcgccaacaccaacucccucgaggucuccuggggcgccgucgccaccgccgacuccuaccuccuccagcuccagaaguacgacauccccgccaccgccgccaccgccaccucccccacccccaaccccguccccuccguccccgccaacccccccaagucccccgcccccgccgccgccgcccccgccguccagccccucacccaggucggcaucacccuccucccccaggccgcccccgccccccccaccaccaccaccauccagguccuccccaccguccccggcuccuccaucuccguccccaccgccgcccgcacccagggcguccccgccguccucaaggucaccggcccccaggccaccaccggcaccccccucgucaccaugcgccccgccucccaggccggcaaggcccccgucaccgucaccucccuccccgccggcguccgcauggucguccccacccaguccgcccagggcaccgucaucggcuccuccccccagauguccggcauggccgcccucgccgccgccgccgccgccacccagaagaucccccccuccuccgcccccaccguccucuccguccccgccggcaccaccaucgucaagaccauggccgucacccccggcaccaccacccuccccgccaccgucaaggucgccuccucccccgucauggucuccaaccccgccacccgcaugcucaagaccgccgccgcccaggucggcaccuccgucuccuccgccaccaacaccuccacccgccccaucaucaccguccacaaguccggcaccgucaccgucgcccagcaggcccaggucgucaccaccgucgucggcggcgucaccaagaccaucacccucgucaagucccccaucuccguccccggcggcuccgcccucaucuccaaccucggcaaggucauguccgucguccagaccaagcccguccagaccuccgccgucaccggccaggccuccaccggccccgucacccagaucauccagaccaagggcccccuccccgccggcaccauccucaagcucgucaccuccgccgacggcaagcccaccaccaucaucaccaccacccaggccuccggcgccggcaccaagcccaccauccucggcaucuccuccgucucccccuccaccaccaagcccggcaccaccaccaucaucaagaccauccccauguccgccaucaucacccaggccggcgccaccggcgucaccuccucccccggcaucaagucccccaucaccaucaucaccaccaaggucaugaccuccggcaccggcgcccccgccaagaucaucaccgccguccccaagaucgccaccggccacggccagcagggcgucacccaggucguccucaagggcgcccccggccagcccggcaccauccuccgcaccguccccaugggcggcguccgccucgucacccccgucaccgucuccgccgucaagcccgccgucaccacccucgucgucaagggcaccaccggcgucaccacccucggcaccgucaccggcaccgucuccaccucccucgccggcgccggcggccacuccaccuccgccucccucgccacccccaucaccacccucggcaccaucgccacccucuccucccaggucaucaaccccaccgccaucaccgucuccgccgcccagaccacccucaccgccgccggcggccucaccacccccaccaucaccaugcagcccgucucccagcccacccaggucacccucaucaccgcccccuccggcgucgaggcccagcccguccacgaccuccccgucuccauccucgccucccccaccaccgagcagcccaccgccaccgucaccaucgccgacuccggccagggcgacguccagcccggcaccgucacccucgucugcuccaacccccccugcgagacccacgagaccggcaccaccaacaccgccaccaccaccgucgucgccaaccucggcggccacccccagcccacccagguccaguucgucugcgaccgccaggaggccgccgccucccucgucaccuccaccgucggccagcagaacggcuccgucguccgcgucugcuccaacccccccugcgagacccacgagaccggcaccaccaacaccgccaccaccgccaccuccaacauggccggccagcacggcugcuccaacccccccugcgagacccacgagaccggcaccaccaacaccgccaccaccgccauguccuccgucggcgccaaccaccagcgcgacgcccgccgcgccugcgccgccggcacccccgccgucauccgcaucuccgucgccaccggcgcccucgaggccgcccagggcuccaagucccagugccagacccgccagaccuccgccaccuccaccaccaugaccgucauggccaccggcgcccccugcuccgccggcccccuccucggccccuccauggcccgcgagcccggcggccgcucccccgccuucguccagcucgccccccucuccuccaagguccgccucuccucccccuccaucaaggaccuccccgccggccgccacucccacgccgucuccaccgccgccaugacccgcuccuccgucggcgccggcgagccccgcauggcccccgucugcgagucccuccagggcggcucccccuccaccaccgucaccgucaccgcccucgaggcccuccucugccccuccgccaccgucacccaggucugcuccaacccccccugcgagacccacgagaccggcaccaccaacaccgccaccaccuccaacgccggcuccgcccagcgcgucugcuccaacccccccugcgagacccacgagaccggcaccacccacaccgccaccaccgccaccuccaacggcggcaccggccagcccgagggcggccagcagccccccgccggccgccccugcgagacccaccagaccaccuccaccggcaccaccauguccgucuccgucggcgcccuccuccccgacgccaccuccucccaccgcaccgucgaguccggccucgaggucgccgccgcccccuccgucaccccccaggccggcaccgcccuccucgcccccuuccccacccagcgcgucugcuccaacccccccugcgagacccacgagaccggcaccacccacaccgccaccaccgucaccuccaacauguccuccaaccaggaccccccccccgccgccuccgaccagggcgaggucgaguccacccagggcgacuccgucaacaucaccuccuccuccgccaucaccaccaccgucuccuccacccucacccgcgccgucaccaccgucacccaguccacccccguccccggccccuccguccccccccccgaggagcuccaggucucccccggcccccgccagcagcuccccccccgccagcuccuccaguccgccuccaccgcccucaugggcgaguccgccgagguccucuccgccucccagacccccgagcuccccgccgccgucgaccucuccuccaccggcgagcccuccuccggccaggaguccgccggcuccgccgucgucgccaccgucgucguccagccccccccccccacccaguccgaggucgaccagcucucccucccccaggagcucauggccgaggcccaggccggcaccaccacccucauggucaccggccucacccccgaggagcucgccgucaccgccgccgccgaggccgccgcccaggccgccgccaccgaggaggcccaggcccucgccauccaggccguccuccaggccgcccagcaggccgucaugggcaccggcgagcccauggacaccuccgaggccgccgccaccgucacccaggccgagcucggccaccucuccgccgagggccaggagggccaggccaccaccauccccaucguccucacccagcaggagcucgccgcccucguccagcagcagcagcuccaggaggcccaggcccagcagcagcaccaccaccuccccaccgaggcccucgcccccgccgacucccucaacgaccccgccaucgaguccaacugccucaacgagcucgccggcaccguccccuccaccgucgcccuccuccccuccaccgccaccgagucccucgcccccuccaacaccuucgucgccccccagcccgucgucgucgccucccccgccaagcuccaggccgccgccacccucaccgaggucgccaacggcaucgagucccucggcgucaagcccgaccucccccccccccccuccaaggcccccaugaagaaggagaaccagugguucgacgucggcgucaucaagggcaccaacgucauggucacccacuacuuccucccccccgacgacgccguccccuccgacgacgaccucggcaccguccccgacuacaaccagcucaagaagcaggagcuccagcccggcaccgccuacaaguuccgcgucgccggcaucaacgccugcggccgcggccccuucuccgagaucuccgccuucaagaccugccuccccggcuuccccggcgcccccugcgccaucaagaucuccaagucccccgacggcgcccaccucaccugggagccccccuccgucaccuccggcaagaucaucgaguacuccgucuaccucgccauccaguccucccaggccggcggcgagcucaaguccuccacccccgcccagcucgccuucaugcgcgucuacugcggccccucccccuccugccucguccaguccuccucccucuccaacgcccacaucgacuacaccaccaagcccgccaucaucuuccgcaucgccgcccgcaacgagaagggcuacggccccgccacccagguccgcuggcuccaggagaccuccaaggacuccuccggcaccaagcccgccaacaagcgccccauguccucccccgagaugaaguccgcccccaagaaguccaaggccgacggccaguga

SEQ ID NO: 44062 - RNA, 2379 nt, Artificial Sequence
  derived and/or modified sequence opt2 from HCFC2__Homo_sapiens__NP_037452
auggccgcccccucccuccucaacuggcgccgcgucuccuccuucaccggccccgucccccgcgcccgccacggccaccgcgccgucgccauccgcgagcucaugaucaucuucggcggcggcaacgagggcaucgccgacgagcuccacgucuacaacaccgccaccaaccagugguuccuccccgccguccgcggcgacaucccccccggcugcgccgcccacggcuucgucugcgacggcacccgcauccucgucuucggcggcauggucgaguacggccgcuacuccaacgagcucuacgagcuccaggccucccgcuggcucuggaagaaggucaagccccaccccccccccuccggccucccccccugcccccgccucggccacuccuucucccucuacggcaacaagugcuaccucuucggcggccucgccaacgaguccgaggacuccaacaacaacgucccccgcuaccucaacgacuucuacgagcucgagcuccagcacggcuccggcgucgucggcugguccauccccgucaccaagggcgucguccccuccccccgcgagucccacaccgccgucaucuacugcaagaaggacuccggcucccccaagauguacgucuucggcggcaugugcggcgcccgccucgacgaccucuggcagcucgaccucgagaccauguccugguccaagcccgagaccaagggcaccgucccccucccccgcucccuccacaccgccuccgucaucggcaacaagauguacaucuucggcggcugggucccccacaagggcgagaacaccgagaccuccccccacgacugcgaguggcgcugcaccuccuccuucuccuaccucaaccucgacaccaccgaguggaccacccucgucuccgacucccaggaggacaagaagaacucccgcccccgcccccgcgccggccacugcgccgucgccaucggcacccgccucuacuucugguccggccgcgacggcuacaagaaggcccucaacucccaggucugcugcaaggaccucugguaccucgacaccgagaagccccccgcccccucccagguccagcucaucaaggccaccaccaacuccuuccacgucaagugggacgaggucuccaccgucgagggcuaccuccuccagcucuccaccgaccuccccuaccaggccgccuccuccgacuccuccgccgcccccaacaugcagggcguccgcauggacccccaccgccagggcuccaacaacaucguccccaacuccaucaacgacaccaucaacuccaccaagaccgagcagcccgccaccaaggagaccuccaugaagaacaagcccgacuucaaggcccucaccgacuccaacgccauccucuaccccucccucgccuccaacgccuccaaccacaacucccacgucgucgacaugcuccgcaagaacgagggcccccacaccuccgccaacgucggcguccucuccuccugccucgacguccgcaccgucauccccgagaccuccgucuccuccaccgucuccuccacccagaccauggucacccagcagaccaucaagaccgaguccuccuccaccaacggcgccgucgucaaggacgagaccucccucaccaccuucuccaccaaguccgaggucgacgagaccuacgcccuccccgccaccaagaucucccgcgucgagacccacgccaccgccacccccuucuccaaggagacccccuccaaccccgucgccaccgucaaggccggcgagcgccaguggugcgacgucggcaucuucaagaacaacaccgcccucgucucccaguucuaccuccuccccaagggcaagcaguccaucuccaaggucggcaacgccgacguccccgacuacucccuccucaagaagcaggaccucguccccggcaccggcuaccgcuuccgcgucgccgccaucaacggcugcggcaucggccccuucuccaagaucuccgaguucaagaccugcauccccggcuuccccggcgcccccuccgccguccgcaucuccaagaacgucgagggcauccaccucuccugggagccccccaccucccccuccggcaacauccucgaguacuccgccuaccucgccauccgcaccgcccagauccaggacaaccccucccagcucgucuucaugcgcaucuacugcggccucaagaccuccugcaucgucaccgccggccagcucgccaacgcccacaucgacuacaccucccgccccgccaucgucuuccgcaucuccgccaagaacgagaagggcuacggccccgccacccagguccgcuggcuccagggcaacaacaagaaggccccccucaacuga

SEQ ID NO: 44063 - RNA, 1578 nt, Artificial Sequence
  derived and/or modified sequence opt2 from HCK__Homo_sapiens__NP_001165601
augggcggccgcuccuccugcgaggaccccggcugcccccgcgacgaggagcgcgccccccgcaugggcugcaugaaguccaaguuccuccaggucggcggcaacaccuucuccaagaccgagaccuccgccuccccccacugccccgucuacguccccgaccccaccuccaccaucaagcccggccccaacucccacaacuccaacacccccggcauccgcgagggcuccgaggacaucaucgucgucgcccucuacgacuacgaggccauccaccacgaggaccucuccuuccagaagggcgaccagauggucguccucgaggaguccggcgagugguggaaggcccgcucccucgccacccgcaaggagggcuacauccccuccaacuacgucgcccgcgucgacucccucgagaccgaggagugguucuucaagggcaucucccgcaaggacgccgagcgccagcuccucgcccccggcaacaugcucggcuccuucaugauccgcgacuccgagaccaccaagggcuccuacucccucuccguccgcgacuacgacccccgccagggcgacaccgucaagcacuacaagauccgcacccucgacaacggcggcuucuacaucuccccccgcuccaccuucuccacccuccaggagcucgucgaccacuacaagaagggcaacgacggccucugccagaagcucuccguccccugcauguccuccaagccccagaagcccugggagaaggacgccugggagaucccccgcgagucccucaagcucgagaagaagcucggcgccggccaguucggcgaggucuggauggccaccuacaacaagcacaccaaggucgccgucaagaccaugaagcccggcuccauguccgucgaggccuuccucgccgaggccaacgucaugaagacccuccagcacgacaagcucgucaagcuccacgccgucgucaccaaggagcccaucuacaucaucaccgaguucauggccaagggcucccuccucgacuuccucaaguccgacgagggcuccaagcagccccuccccaagcucaucgacuucuccgcccagaucgccgagggcauggccuucaucgagcagcgcaacuacauccaccgcgaccuccgcgccgccaacauccucgucuccgccucccucgucugcaagaucgccgacuucggccucgcccgcgucaucgaggacaacgaguacaccgcccgcgagggcgccaaguuccccaucaaguggaccgcccccgaggccaucaacuucggcuccuucaccaucaaguccgacgucugguccuucggcauccuccucauggagaucgucaccuacggccgcauccccuaccccggcauguccaaccccgaggucauccgcgcccucgagcgcggcuaccgcaugccccgccccgagaacugccccgaggagcucuacaacaucaugaugcgcugcuggaagaaccgccccgaggagcgccccaccuucgaguacauccaguccguccucgacgacuucuacaccgccaccgagucccaguaccagcagcagcccuga

SEQ ID NO: 44064 - RNA, 1461 nt, Artificial Sequence
  derived and/or modified sequence opt2 from HCLS1__Homo_sapiens__NP_005326
auguggaaguccgucgucggccacgacgucuccgucuccgucgagacccagggcgacgacugggacaccgaccccgacuucgucaacgacaucuccgagaaggagcagcgcuggggcgccaagaccaucgagggcuccggccgcaccgagcacaucaacauccaccagcuccgcaacaaggucuccgaggagcacgacguccuccgcaagaaggagauggaguccggccccaaggccucccacggcuacggcggccgcuucggcgucgagcgcgaccgcauggacaaguccgccgucggccacgaguacgucgccgaggucgagaagcacuccucccagaccgacgccgccaagggcuucggcggcaaguacggcgucgagcgcgaccgcgccgacaaguccgccgucggcuucgacuacaagggcgaggucgagaagcacaccucccagaaggacuacucccgcggcuucggcggccgcuacggcgucgagaaggacaagugggacaaggccgcccucggcuacgacuacaagggcgagaccgagaagcacgagucccagcgcgacuacgccaagggcuucggcggccaguacggcauccagaaggaccgcgucgacaaguccgccgucggcuucaacgagauggaggcccccaccaccgccuacaagaagaccacccccaucgaggccgccuccuccggcacccgcggccucaaggccaaguucgaguccauggccgaggagaagcgcaagcgcgaggaggaggagaaggcccagcaggucgcccgccgccagcaggagcgcaaggccgucaccaagcgcucccccgaggccccccagcccgucaucgccauggaggagcccgccguccccgccccccuccccaagaagaucuccuccgaggccuggccccccgucggcaccccccccuccuccgaguccgagcccguccgcaccucccgcgagcaccccgucccccuccuccccauccgccagacccuccccgaggacaacgaggagccccccgcccuccccccccgcacccucgagggccuccaggucgaggaggagcccgucuacgaggccgagcccgagcccgagcccgagcccgagcccgagcccgagaacgacuacgaggacgucgaggagauggaccgccacgagcaggaggacgagcccgagggcgacuacgaggagguccucgagcccgaggacuccuccuucuccuccgcccucgccggcuccuccggcugccccgccggcgccggcgccggcgccgucgcccucggcaucuccgccgucgcccucuacgacuaccagggcgagggcuccgacgagcucuccuucgaccccgacgacgucaucaccgacaucgagauggucgacgagggcugguggcgcggccgcugccacggccacuucggccucuuccccgccaacuacgucaagcuccucgaguga

SEQ ID NO: 44065 - RNA, 2673 nt, Artificial Sequence
  derived and/or modified sequence opt2 from HCN1__Homo_sapiens__NP_066550
auggagggcggcggcaagcccaacuccuccuccaacucccgcgacgacggcaacuccgucuuccccgccaaggccuccgccaccggcgccggccccgccgccgccgagaagcgccucggcaccccccccggcggcggcggcgccggcgccaaggagcacggcaacuccgucugcuucaaggucgacggcggcggcggcggcggcggcggcggcggcggcggcgaggagcccgccggcggcuucgaggacgccgagggcccccgccgccaguacggcuucaugcagcgccaguucaccuccaugcuccagcccggcgucaacaaguucucccuccgcauguucggcucccagaaggccgucgagaaggagcaggagcgcgucaagaccgccggcuucuggaucauccaccccuacuccgacuuccgcuucuacugggaccucaucaugcucaucaugauggucggcaaccucgucaucauccccgucggcaucaccuucuucaccgagcagaccaccacccccuggaucaucuucaacgucgccuccgacaccgucuuccuccucgaccucaucaugaacuuccgcaccggcaccgucaacgaggacuccuccgagaucauccucgaccccaaggucaucaagaugaacuaccucaaguccugguucgucgucgacuucaucuccuccauccccgucgacuacaucuuccucaucgucgagaagggcauggacuccgaggucuacaagaccgcccgcgcccuccgcaucguccgcuucaccaagauccucucccuccuccgccuccuccgccucucccgccucauccgcuacauccaccagugggaggagaucuuccacaugaccuacgaccucgccuccgccgucguccgcaucuucaaccucaucggcaugaugcuccuccucugccacugggacggcugccuccaguuccucgucccccuccuccaggacuucccccccgacugcugggucucccucaacgagauggucaacgacuccuggggcaagcaguacuccuacgcccucuucaaggccaugucccacaugcucugcaucggcuacggcgcccaggcccccgucuccauguccgaccucuggaucaccaugcucuccaugaucgucggcgccaccugcuacgccauguucgucggccacgccaccgcccucauccagucccucgacuccucccgccgccaguaccaggagaaguacaagcaggucgagcaguacauguccuuccacaagcuccccgccgacaugcgccagaagauccacgacuacuacgagcaccgcuaccagggcaagaucuucgacgaggagaacauccucaacgagcucaacgacccccuccgcgaggagaucgucaacuucaacugccgcaagcucgucgccaccaugccccucuucgccaacgccgaccccaacuucgucaccgccaugcucuccaagcuccgcuucgaggucuuccagcccggcgacuacaucauccgcgagggcgccgucggcaagaagauguacuucauccagcacggcgucgccggcgucaucaccaaguccuccaaggagaugaagcucaccgacggcuccuacuucggcgagaucugccuccucaccaagggccgccgcaccgccuccguccgcgccgacaccuacugccgccucuacucccucuccgucgacaacuucaacgagguccucgaggaguaccccaugaugcgccgcgccuucgagaccgucgccaucgaccgccucgaccgcaucggcaagaagaacuccauccuccuccagaaguuccagaaggaccucaacaccggcgucuucaacaaccaggagaacgagauccucaagcagaucgucaagcacgaccgcgagaugguccaggccaucgcccccaucaacuacccccagaugaccacccucaacuccaccuccuccaccaccacccccaccucccgcaugcgcacccaguccccccccgucuacaccgccaccucccucucccacuccaaccuccacucccccucccccuccacccagaccccccagcccuccgccauccucucccccugcuccuacaccaccgccgucugcuccccccccguccaguccccccucgccgcccgcaccuuccacuacgccucccccaccgccucccagcucucccucaugcagcagcagccccagcagcagguccagcagucccagcccccccagacccagccccagcagcccuccccccagccccagacccccggcuccuccacccccaagaacgagguccacaaguccacccaggcccuccacaacaccaaccucacccgcgagguccgcccccucuccgccucccagcccucccucccccacgaggucuccacccucaucucccgcccccaccccaccgucggcgagucccucgccuccaucccccagcccgucaccgccguccccggcaccggccuccaggccggcggccgcuccaccgucccccagcgcgucacccucuuccgccagauguccuccggcgccaucccccccaaccgcggcgucccccccgccccccccccccccgccgccgcccucccccgcgaguccuccuccguccucaacaccgaccccgacgccgagaagccccgcuucgccuccaaccucuga

SEQ ID NO: 44066 - RNA, 2670 nt, Artificial Sequence
  derived and/or modified sequence opt2 from HCN2__Homo_sapiens__NP_001185
auggacgcccgcggcggcggcggccgccccggcgagucccccggcgccacccccgcccccggccccccccccccccccccccccgcccccccccagcagcagcccccccccccccccccccccgcccccccccccggccccggccccgcccccccccagcaccccccccgcgccgaggcccucccccccgaggccgccgacgagggcggcccccgcggccgccuccgcucccgcgacuccuccugcggccgccccggcacccccggcgccgccuccaccgccaagggcucccccaacggcgagugcggccgcggcgagccccagugcucccccgccggccccgagggccccgcccgcggccccaaggucuccuucuccugccgcggcgccgccuccggccccgcccccggccccggccccgccgaggaggccggcuccgaggaggccggccccgccggcgagccccgcggcucccaggccuccuucaugcagcgccaguucggcgcccuccuccagcccggcgucaacaaguucucccuccgcauguucggcucccagaaggccgucgagcgcgagcaggagcgcgucaaguccgccggcgccuggaucauccaccccuacuccgacuuccgcuucuacugggacuucaccaugcuccucuucauggucggcaaccucaucaucauccccgucggcaucaccuucuucaaggacgagaccaccgcccccuggaucgucuucaacgucgucuccgacaccuucuuccucauggaccucguccucaacuuccgcaccggcaucgucaucgaggacaacaccgagaucauccucgaccccgagaagaucaagaagaaguaccuccgcaccugguucgucgucgacuucgucuccuccauccccgucgacuacaucuuccucaucgucgagaagggcaucgacuccgaggucuacaagaccgcccgcgcccuccgcaucguccgcuucaccaagauccucucccuccuccgccuccuccgccucucccgccucauccgcuacauccaccagugggaggagaucuuccacaugaccuacgaccucgccuccgccgucaugcgcaucugcaaccucaucuccaugaugcuccuccucugccacugggacggcugccuccaguuccucguccccaugcuccaggacuucccccgcaacugcugggucuccaucaacggcauggucaaccacuccugguccgagcucuacuccuucgcccucuucaaggccaugucccacaugcucugcaucggcuacggccgccaggcccccgaguccaugaccgacaucuggcucaccaugcucuccaugaucgucggcgccaccugcuacgccauguucaucggccacgccaccgcccucauccagucccucgacuccucccgccgccaguaccaggagaaguacaagcaggucgagcaguacauguccuuccacaagcuccccgccgacuuccgccagaagauccacgacuacuacgagcaccgcuaccagggcaagauguucgacgaggacuccauccucggcgagcucaacggcccccuccgcgaggagaucgucaacuucaacugccgcaagcucgucgccuccaugccccucuucgccaacgccgaccccaacuucgucaccgccaugcucaccaagcucaaguucgaggucuuccagcccggcgacuacaucauccgcgagggcaccaucggcaagaagauguacuucauccagcacggcgucgucuccguccucaccaagggcaacaaggagaugaagcucuccgacggcuccuacuucggcgagaucugccuccucacccgcggccgccgcaccgccuccguccgcgccgacaccuacugccgccucuacucccucuccgucgacaacuucaacgagguccucgaggaguaccccaugaugcgccgcgccuucgagaccgucgccaucgaccgccucgaccgcaucggcaagaagaacuccauccuccuccacaagguccagcacgaccucaacuccggcgucuucaacaaccaggagaacgccaucauccaggagaucgucaaguacgaccgcgagaugguccagcaggccgagcucggccagcgcgucggccucuucccccccccccccccccccccccaggucaccuccgccaucgccacccuccagcaggccgccgccauguccuucugcccccaggucgcccgcccccucgucggcccccucgcccucggcuccccccgccucguccgccgccccccccccggccccgcccccgccgccgccucccccggcccccccccccccgccuccccccccggcgcccccgccuccccccgcgccccccgcaccucccccuacggcggccuccccgccgccccccucgccggccccgcccuccccgcccgccgccucucccgcgccucccgcccccucuccgccucccagcccucccucccccacggcgcccccggccccgccgccuccacccgccccgccuccuccuccaccccccgccucggccccacccccgccgcccgcgccgccgcccccucccccgaccgccgcgacuccgccucccccggcgccgccggcggccucgacccccaggacuccgcccgcucccgccucuccuccaaccucuga

SEQ ID NO: 44067 - RNA, 2325 nt, Artificial Sequence
  derived and/or modified sequence opt2 from HCN3__Homo_sapiens__NP_065948
auggaggccgagcagcgccccgccgccggcgccuccgagggcgccacccccggccucgaggccgucccccccgucgcccccccccccgccaccgccgccuccggccccauccccaaguccggccccgagcccaagcgccgccaccucggcacccuccuccagcccaccgucaacaaguucucccuccgcgucuucggcucccacaaggccgucgagaucgagcaggagcgcgucaaguccgccggcgccuggaucauccaccccuacuccgacuuccgcuucuacugggaccucaucaugcuccuccucauggucggcaaccucaucguccuccccgucggcaucaccuucuucaaggaggagaacuccccccccuggaucgucuucaacguccucuccgacaccuucuuccuccucgaccucguccucaacuuccgcaccggcaucgucgucgaggagggcgccgagauccuccucgccccccgcgccauccgcacccgcuaccuccgcaccugguuccucgucgaccucaucuccuccauccccgucgacuacaucuuccucgucgucgagcucgagccccgccucgacgccgaggucuacaagaccgcccgcgcccuccgcaucguccgcuucaccaagauccucucccuccuccgccuccuccgccucucccgccucauccgcuacauccaccagugggaggagaucuuccacaugaccuacgaccucgccuccgccgucguccgcaucuucaaccucaucggcaugaugcuccuccucugccacugggacggcugccuccaguuccucguccccaugcuccaggacuucccccccgacugcugggucuccaucaaccacauggucaaccacuccuggggccgccaguacucccacgcccucuucaaggccaugucccacaugcucugcaucggcuacggccagcaggcccccgucggcaugcccgacgucuggcucaccaugcucuccaugaucgucggcgccaccugcuacgccauguucaucggccacgccaccgcccucauccagucccucgacuccucccgccgccaguaccaggagaaguacaagcaggucgagcaguacauguccuuccacaagcuccccgccgacacccgccagcgcauccacgaguacuacgagcaccgcuaccagggcaagauguucgacgaggaguccauccucggcgagcucuccgagccccuccgcgaggagaucaucaacuucaccugccgcggccucgucgcccacaugccccucuucgcccacgccgaccccuccuucgucaccgccguccucaccaagcuccgcuucgaggucuuccagcccggcgaccucgucguccgcgagggcuccgucggccgcaagauguacuucauccagcacggccuccucuccguccucgcccgcggcgcccgcgacacccgccucaccgacggcuccuacuucggcgagaucugccuccucacccgcggccgccgcaccgccuccguccgcgccgacaccuacugccgccucuacucccucuccgucgaccacuucaacgccguccucgaggaguuccccaugaugcgccgcgccuucgagaccgucgccauggaccgccuccuccgcaucggcaagaagaacuccauccuccagcgcaagcgcuccgagcccucccccggcuccuccggcggcaucauggagcagcaccucguccagcacgaccgcgacauggcccgcggcguccgcggccgcgcccccuccaccggcgcccagcucuccggcaagcccguccucugggagccccucguccacgccccccuccaggccgccgccgucaccuccaacgucgccaucgcccucacccaccagcgcggcccccucccccucucccccgacucccccgccacccuccucgcccgcuccgccuggcgcuccgccggcucccccgccuccccccucguccccguccgcgccggccccugggccuccaccucccgccuccccgccccccccgcccgcacccuccacgccucccucucccgcgccggccgcucccaggucucccuccucggccccccccccggcggcggcggccgccgccucggcccccgcggccgcccccucuccgccucccagcccucccucccccagcgcgccaccggcgacggcucccccggccgcaagggcuccggcuccgagcgccucccccccuccggccuccucgccaagcccccccgcaccgcccagcccccccgcccccccguccccgagcccgccaccccccgcggccuccagcucuccgccaacauguga

SEQ ID NO: 44068 - RNA, 3612 nt, Artificial Sequence
  derived and/or modified sequence opt2 from HCN4__Homo_sapiens__NP_005468
auggacaagcucccccccuccaugcgcaagcgccucuacucccucccccagcaggucggcgccaaggccuggaucauggacgaggaggaggacgccgaggaggagggcgccggcggccgccaggaccccucccgccgcuccauccgccuccgcccccuccccucccccucccccuccgccgccgccggcggcaccgagucccgcuccuccgcccucggcgccgccgacuccgagggccccgcccgcggcgccggcaaguccuccaccaacggcgacugccgccgcuuccgcggcucccucgccucccucggcucccgcggcggcggcuccggcggcaccggcuccggcuccucccacggccaccuccacgacuccgccgaggagcgccgccucaucgccgagggcgacgccucccccggcgaggaccgcaccccccccggccucgccgccgagcccgagcgccccggcgccuccgcccagcccgccgccucccccccccccccccagcagcccccccagcccgccuccgccuccugcgagcagcccuccgucgacaccgccaucaaggucgagggcggcgccgccgccggcgaccagauccuccccgaggccgagguccgccucggccaggccggcuucaugcagcgccaguucggcgccaugcuccagcccggcgucaacaaguucucccuccgcauguucggcucccagaaggccgucgagcgcgagcaggagcgcgucaaguccgccggcuucuggaucauccaccccuacuccgacuuccgcuucuacugggaccucaccaugcuccuccucauggucggcaaccucaucaucauccccgucggcaucaccuucuucaaggacgagaacaccacccccuggaucgucuucaacgucgucuccgacaccuucuuccucaucgaccucguccucaacuuccgcaccggcaucgucgucgaggacaacaccgagaucauccucgacccccagcgcaucaagaugaaguaccucaaguccugguucauggucgacuucaucuccuccauccccgucgacuacaucuuccucaucgucgagacccgcaucgacuccgaggucuacaagaccgcccgcgcccuccgcaucguccgcuucaccaagauccucucccuccuccgccuccuccgccucucccgccucauccgcuacauccaccagugggaggagaucuuccacaugaccuacgaccucgccuccgccgucguccgcaucgucaaccucaucggcaugaugcuccuccucugccacugggacggcugccuccaguuccucguccccaugcuccaggacuuccccgacgacugcugggucuccaucaacaacauggucaacaacuccuggggcaagcaguacuccuacgcccucuucaaggccaugucccacaugcucugcaucggcuacggccgccaggcccccgucggcauguccgacgucuggcucaccaugcucuccaugaucgucggcgccaccugcuacgccauguucaucggccacgccaccgcccucauccagucccucgacuccucccgccgccaguaccaggagaaguacaagcaggucgagcaguacauguccuuccacaagcucccccccgacacccgccagcgcauccacgacuacuacgagcaccgcuaccagggcaagauguucgacgaggaguccauccucggcgagcucuccgagccccuccgcgaggagaucaucaacuucaacugccgcaagcucgucgccuccaugccccucuucgccaacgccgaccccaacuucgucaccuccaugcucaccaagcuccgcuucgaggucuuccagcccggcgacuacaucauccgcgagggcaccaucggcaagaagauguacuucauccagcacggcgucgucuccguccucaccaagggcaacaaggagaccaagcucgccgacggcuccuacuucggcgagaucugccuccucacccgcggccgccgcaccgccuccguccgcgccgacaccuacugccgccucuacucccucuccgucgacaacuucaacgagguccucgaggaguaccccaugaugcgccgcgccuucgagaccgucgcccucgaccgccucgaccgcaucggcaagaagaacuccauccuccuccacaagguccagcacgaccucaacuccggcgucuucaacuaccaggagaacgagaucauccagcagaucguccagcacgaccgcgagauggcccacugcgcccaccgcguccaggccgccgccuccgccacccccacccccacccccgucaucuggaccccccucauccaggccccccuccaggccgccgccgccaccaccuccgucgccaucgcccucacccaccacccccgccuccccgccgccaucuuccgccccccccccggcuccggccucggcaaccucggcgccggccagaccccccgccaccucaagcgccuccagucccucauccccuccgcccucggcuccgccucccccgccuccucccccucccaggucgacacccccuccuccuccuccuuccacauccagcagcucgccggcuucuccgcccccgccggccucuccccccuccuccccuccuccuccuccucccccccccccggcgccugcggcucccccuccgcccccacccccuccgccggcgucgccgccaccaccaucgccggcuucggccacuuccacaaggcccucggcggcucccucuccuccuccgacuccccccuccucaccccccuccagcccggcgcccgcuccccccaggccgcccagcccucccccgccccccccggcgcccgcggcggccucggccuccccgagcacuuccucccccccccccccuccucccgcucccccuccuccucccccggccagcucggccagccccccggcgagcucucccucggccucgccaccggcccccucuccacccccgagacccccccccgccagcccgagccccccucccucgucgccggcgccuccggcggcgccucccccgucggcuucaccccccgcggcggccucuccccccccggccacucccccggccccccccgcaccuuccccuccgcccccccccgcgccuccggcucccacggcucccuccuccucccccccgccuccucccccccccccccccaggucccccagcgccgcggcacccccccccucacccccggccgccucacccaggaccucaagcucaucuccgccucccagcccgcccucccccaggacggcgcccagacccuccgccgcgccuccccccacuccuccggcgaguccauggccgccuucccccucuucccccgcgccggcggcggcuccggcggcuccggcuccuccggcggccucggcccccccggccgccccuacggcgccauccccggccagcacgucacccucccccgcaagaccuccuccggcucccucccccccccccucucccucuucggcgcccgcgccaccuccuccggcggccccccccucaccgccggcccccagcgcgagcccggcgcccgccccgagcccguccgcuccaagcuccccuccaaccucuga

SEQ ID NO: 44069 - RNA, 396 nt, Artificial Sequence
  derived and/or modified sequence opt2 from HCRT__Homo_sapiens__NP_001515
augaaccuccccuccaccaaggucuccugggccgccgucacccuccuccuccuccuccuccuccucccccccgcccuccucuccuccggcgccgccgcccagccccuccccgacugcugccgccagaagaccugcuccugccgccucuacgagcuccuccacggcgccggcaaccacgccgccggcauccucacccucggcaagcgccgcuccggcccccccggccuccagggccgccuccagcgccuccuccaggccuccggcaaccacgccgccggcauccucaccaugggccgccgcgccggcgccgagcccgccccccgccccugccucggccgccgcugcuccgcccccgccgccgccuccgucgcccccggcggccaguccggcaucuga

SEQ ID NO: 44070 - RNA, 1335 nt, Artificial Sequence
  derived and/or modified sequence opt2 from HCRTR2__Homo_sapiens__NP_001517
auguccggcaccaagcucgaggacuccccccccugccgcaacugguccuccgccuccgagcucaacgagacccaggagcccuuccucaaccccaccgacuacgacgacgaggaguuccuccgcuaccucuggcgcgaguaccuccaccccaaggaguacgaguggguccucaucgccggcuacaucaucgucuucgucgucgcccucaucggcaacguccucgucugcgucgccgucuggaagaaccaccacaugcgcaccgucaccaacuacuucaucgucaaccucucccucgccgacguccucgucaccaucaccugccuccccgccacccucgucgucgacaucaccgagaccugguucuucggccagucccucugcaaggucauccccuaccuccagaccgucuccgucuccgucuccguccucacccucuccugcaucgcccucgaccgcugguacgccaucugccacccccucauguucaaguccaccgccaagcgcgcccgcaacuccaucgucaucaucuggaucgucuccugcaucaucaugaucccccaggccaucgucauggagugcuccaccgucuuccccggccucgccaacaagaccacccucuucaccgucugcgacgagcgcuggggcggcgagaucuaccccaagauguaccacaucugcuucuuccucgucaccuacauggccccccucugccucaugguccucgccuaccuccagaucuuccgcaagcucuggugccgccagauccccggcaccuccuccgucguccagcgcaaguggaagccccuccagcccgucucccagccccgcggccccggccagcccaccaagucccgcauguccgccgucgccgccgagaucaagcagauccgcgcccgccgcaagaccgcccgcaugcucaugaucguccuccucgucuucgccaucugcuaccuccccaucuccauccucaacguccucaagcgcgucuucggcauguucgcccacaccgaggaccgcgagaccgucuacgccugguucaccuucucccacuggcucgucuacgccaacuccgccgccaaccccaucaucuacaacuuccucuccggcaaguuccgcgaggaguucaaggccgccuucuccugcugcugccucggcguccaccaccgccaggaggaccgccucacccgcggccgcaccuccaccgagucccgcaagucccucaccacccagaucuccaacuucgacaacaucuccaagcucuccgagcaggucguccucaccuccaucuccacccuccccgccgccaacggcgccggcccccuccagaacugguga

SEQ ID NO: 44071 - RNA, 279 nt, Artificial Sequence
  derived and/or modified sequence opt2 from HCST__Homo_sapiens__NP_001007470
augauccaccucggccacauccucuuccuccuccuccuccccgucgccgccgcccagaccacccccggcgagcgcuccucccuccccgccuucuaccccggcaccuccggcuccugcuccggcugcggcucccucucccucccccuccucgccggccucgucgccgccgacgccgucgccucccuccucaucgucggcgccgucuuccucugcgcccgcccccgccgcucccccgcccaggacggcaaggucuacaucaacaugcccggccgcggcuga

SEQ ID NO: 44072 - RNA, 1950 nt, Artificial Sequence
  derived and/or modified sequence opt2 from HDAC10__Homo_sapiens__NP_001152758
augggcaccgcccucgucuaccacgaggacaugaccgccacccgccuccucugggacgaccccgagugcgagaucgagcgccccgagcgccucaccgccgcccucgaccgccuccgccagcgcggccucgagcagcgcugccuccgccucuccgcccgcgaggccuccgaggaggagcucggccucguccacucccccgaguacgucucccucguccgcgagacccagguccucggcaaggaggagcuccaggcccucuccggccaguucgacgccaucuacuuccaccccuccaccuuccacugcgcccgccucgccgccggcgccggccuccagcucgucgacgccguccucaccggcgccguccagaacggccucgcccucguccgcccccccggccaccacggccagcgcgccgccgccaacggcuucugcgucuucaacaacgucgccaucgccgccgcccacgccaagcagaagcacggccuccaccgcauccucgucgucgacugggacguccaccacggccagggcauccaguaccucuucgaggacgaccccuccguccucuacuucuccuggcaccgcuacgagcacggccgcuucuggcccuuccuccgcgaguccgacgccgacgccgucggccgcggccagggccucggcuucaccgucaaccuccccuggaaccaggucggcaugggcaacgccgacuacgucgccgccuuccuccaccuccuccucccccucgccuucgagggccagaugcaggccacccccgagugcuucgcccaccucacccagcuccuccagguccucgccggcggccgcgucugcgccguccucgagggcggcuaccaccucgagucccucgccgaguccgucugcaugaccguccagacccuccucggcgaccccgcccccccccucuccggccccauggcccccugccaguccgcccucgaguccauccaguccgcccgcgccgcccaggccccccacuggaagucccuccagcagcaggacgucaccgccguccccaugucccccuccucccacucccccgagggccgcccccccccccuccuccccggcggccccgucugcaaggccgccgccuccgcccccuccucccuccucgaccagcccugccucugccccgcccccuccguccgcaccgccgucgcccucaccacccccgacaucacccucguccucccccccgacgucauccagcaggaggccuccgcccuccgcgaggagaccgaggccugggcccgcccccacgagucccucgcccgcgaggaggcccucaccgcccucggcaagcuccucuaccuccucgacggcaugcucgacggccaggucaacuccggcaucgccgccacccccgccuccgccgccgccgccacccucgacgucgccguccgccgcggccucucccacggcgcccagcgccuccucugcgucgcccucggccagcucgaccgcccccccgaccucgcccacgacggccgcucccucuggcucaacauccgcggcaaggaggccgccgcccucuccauguuccacgucuccaccccccuccccgucaugaccggcggcuuccucuccugcauccucggccucguccucccccucgccuacggcuuccagcccgaccucguccucgucgcccucggccccggccacggccuccagggcccccacgccgcccuccucgccgccaugcuccgcggccucgccggcggccgcguccucgcccuccucgaggagaacuccaccccccagcucgccggcauccucgcccgcguccucaacggcgaggccccccccucccucggccccuccuccgucgccucccccgaggacguccaggcccucauguaccuccgcggccagcucgagccccaguggaagaugcuccagugccacccccaccucgucgccuga

SEQ ID NO: 44073 - RNA, 891 nt, Artificial Sequence
  derived and/or modified sequence opt2 from HDAC11__Homo_sapiens__NP_001129513
augggccucgagaagcuccaccccuucgacgccggcaaguggggcaaggucaucaacuuccucaaggaggagaagcuccucuccgacuccaugcucgucgaggcccgcgaggccuccgaggaggaccuccucgucguccacacccgccgcuaccucaacgagcucaagcgcaagguccuccgcccccuccgcacccagaccggcggcaccaucauggccggcaagcucgccgucgagcgcggcugggccaucaacgucggcggcggcuuccaccacugcuccuccgaccgcggcggcggcuucugcgccuacgccgacaucacccucgccaucaaguuccucuucgagcgcgucgagggcaucucccgcgccaccaucaucgaccucgacgcccaccagggcaacggccacgagcgcgacuucauggacgacaagcgcgucuacaucauggacgucuacaaccgccacaucuaccccggcgaccgcuucgccaagcaggccauccgccgcaaggucgagcucgaguggggcaccgaggacgacgaguaccucgacaaggucgagcgcaacaucaagaagucccuccaggagcaccuccccgacgucgucgucuacaacgccggcaccgacauccucgagggcgaccgccucggcggccucuccaucucccccgccggcaucgucaagcgcgacgagcucgucuuccgcaugguccgcggccgccgcguccccauccucauggucaccuccggcggcuaccagaagcgcaccgcccgcaucaucgccgacuccauccucaaccucuucggccucggccucaucggccccgagucccccuccgucuccgcccagaacuccgacaccccccuccucccccccgccguccccuga

SEQ ID NO: 44074 - RNA, 870 nt, Artificial Sequence
  derived and/or modified sequence opt2 from HDAC1__Homo_sapiens__XP_011539611
augaccgucuccuuccacaaguacggcgaguacuuccccggcaccggcgaccuccgcgacaucggcgccggcaagggcaaguacuacgccgucaacuacccccuccgcgacggcaucgacgacgaguccuacgaggccaucuucaagcccgucauguccaaggucauggagauguuccagcccuccgccgucguccuccagugcggcuccgacucccucuccggcgaccgccucggcugcuucaaccucaccaucaagggccacgccaagugcgucgaguucgucaaguccuucaaccuccccaugcucaugcucggcggcggcggcuacaccauccgcaacgucgcccgcugcuggaccuacgagaccgccgucgcccucgacaccgagauccccaacgagcuccccuacaacgacuacuucgaguacuucggccccgacuucaagcuccacaucucccccuccaacaugaccaaccagaacaccaacgaguaccucgagaagaucaagcagcgccucuucgagaaccuccgcaugcucccccacgcccccggcguccagaugcaggccauccccgaggacgccauccccgaggaguccggcgacgaggacgaggacgaccccgacaagcgcaucuccaucugcuccuccgacaagcgcaucgccugcgaggaggaguucuccgacuccgaggaggagggcgagggcggccgcaagaacuccuccaacuucaagaaggccaagcgcgucaagaccgaggacgagaaggagaaggaccccgaggagaagaaggaggucaccgaggaggagaagaccaaggaggagaagcccgaggccaagggcgucaaggaggaggucaagcucgccuga

SEQ ID NO: 44075 - RNA, 1467 nt, Artificial Sequence
  derived and/or modified sequence opt2 from HDAC2__Homo_sapiens__NP_001518
auggccuacucccagggcggcggcaagaagaaggucugcuacuacuacgacggcgacaucggcaacuacuacuacggccagggccaccccaugaagccccaccgcauccgcaugacccacaaccuccuccucaacuacggccucuaccgcaagauggagaucuaccgcccccacaaggccaccgccgaggagaugaccaaguaccacuccgacgaguacaucaaguuccuccgcuccauccgccccgacaacauguccgaguacuccaagcagaugcagcgcuucaacgucggcgaggacugccccgucuucgacggccucuucgaguucugccagcucuccaccggcggcuccgucgccggcgccgucaagcucaaccgccagcagaccgacauggccgucaacugggccggcggccuccaccacgccaagaaguccgaggccuccggcuucugcuacgucaacgacaucguccucgccauccucgagcuccucaaguaccaccagcgcguccucuacaucgacaucgacauccaccacggcgacggcgucgaggaggccuucuacaccaccgaccgcgucaugaccgucuccuuccacaaguacggcgaguacuuccccggcaccggcgaccuccgcgacaucggcgccggcaagggcaaguacuacgccgucaacuuccccaugcgcgacggcaucgacgacgaguccuacggccagaucuucaagcccaucaucuccaaggucauggagauguaccagcccuccgccgucguccuccagugcggcgccgacucccucuccggcgaccgccucggcugcuucaaccucaccgucaagggccacgccaagugcgucgaggucgucaagaccuucaaccucccccuccucaugcucggcggcggcggcuacaccauccgcaacgucgcccgcugcuggaccuacgagaccgccgucgcccucgacugcgagauccccaacgagcuccccuacaacgacuacuucgaguacuucggccccgacuucaagcuccacaucucccccuccaacaugaccaaccagaacacccccgaguacauggagaagaucaagcagcgccucuucgagaaccuccgcaugcucccccacgcccccggcguccagaugcaggccauccccgaggacgccguccacgaggacuccggcgacgaggacggcgaggaccccgacaagcgcaucuccauccgcgccuccgacaagcgcaucgccugcgacgaggaguucuccgacuccgaggacgagggcgagggcggccgccgcaacgucgccgaccacaagaagggcgccaagaaggcccgcaucgaggaggacaagaaggagaccgaggacaagaagaccgacgucaaggaggaggacaaguccaaggacaacuccggcgagaagaccgacaccaagggcaccaaguccgagcagcucuccaaccccuga

SEQ ID NO: 44076 - RNA, 1287 nt, Artificial Sequence
  derived and/or modified sequence opt2 from HDAC3__Homo_sapiens__NP_003874
auggccaagaccgucgccuacuucuacgaccccgacgucggcaacuuccacuacggcgccggccaccccaugaagccccaccgccucgcccucacccacucccucguccuccacuacggccucuacaagaagaugaucgucuucaagcccuaccaggccucccagcacgacaugugccgcuuccacuccgaggacuacaucgacuuccuccagcgcgucucccccaccaacaugcagggcuucaccaagucccucaacgccuucaacgucggcgacgacugccccgucuuccccggccucuucgaguucugcucccgcuacaccggcgccucccuccagggcgccacccagcucaacaacaagaucugcgacaucgccaucaacugggccggcggccuccaccacgccaagaaguucgaggccuccggcuucugcuacgucaacgacaucgucaucggcauccucgagcuccucaaguaccacccccgcguccucuacaucgacaucgacauccaccacggcgacggcguccaggaggccuucuaccucaccgaccgcgucaugaccgucuccuuccacaaguacggcaacuacuucuuccccggcaccggcgacauguacgaggucggcgccgaguccggccgcuacuacugccucaacgucccccuccgcgacggcaucgacgaccaguccuacaagcaccucuuccagcccgucaucaaccaggucgucgacuucuaccagcccaccugcaucguccuccagugcggcgccgacucccucggcugcgaccgccucggcugcuucaaccucuccauccgcggccacggcgagugcgucgaguacgucaaguccuucaacaucccccuccucguccucggcggcggcggcuacaccguccgcaacgucgcccgcugcuggaccuacgagaccucccuccucgucgaggaggccaucuccgaggagcuccccuacuccgaguacuucgaguacuucgcccccgacuucacccuccaccccgacgucuccacccgcaucgagaaccagaacucccgccaguaccucgaccagauccgccagaccaucuucgagaaccucaagaugcucaaccacgcccccuccguccagauccacgacguccccgccgaccuccucaccuacgaccgcaccgacgaggccgacgccgaggagcgcggccccgaggagaacuacucccgccccgaggcccccaacgaguucuacgacggcgaccacgacaacgacaaggaguccgacgucgagaucuga

SEQ ID NO: 44077 - RNA, 3255 nt, Artificial Sequence
  derived and/or modified sequence opt2 from HDAC4__Homo_sapiens__NP_006028
auguccucccagucccaccccgacggccucuccggccgcgaccagcccgucgagcuccucaaccccgcccgcgucaaccacaugcccuccaccgucgacgucgccaccgcccucccccuccaggucgcccccuccgccguccccauggaccuccgccucgaccaccaguucucccuccccgucgccgagcccgcccuccgcgagcagcagcuccagcaggagcuccucgcccucaagcagaagcagcagauccagcgccagauccucaucgccgaguuccagcgccagcacgagcagcucucccgccagcacgaggcccagcuccacgagcacaucaagcagcagcaggagaugcucgccaugaagcaccagcaggagcuccucgagcaccagcgcaagcucgagcgccaccgccaggagcaggagcucgagaagcagcaccgcgagcagaagcuccagcagcucaagaacaaggagaagggcaaggaguccgccgucgccuccaccgaggucaagaugaagcuccaggaguucguccucaacaagaagaaggcccucgcccaccgcaaccucaaccacugcaucuccuccgacccccgcuacugguacggcaagacccagcacuccucccucgaccaguccucccccccccaguccggcgucuccaccuccuacaaccaccccguccucggcauguacgacgccaaggacgacuucccccuccgcaagaccgccuccgagcccaaccucaagcuccgcucccgccucaagcagaaggucgccgagcgccgcuccuccccccuccuccgccgcaaggacggccccgucgucaccgcccucaagaagcgcccccucgacgucaccgacuccgccugcuccuccgcccccggcuccggccccuccucccccaacaacuccuccggcuccgucuccgccgagaacggcaucgcccccgccguccccuccauccccgccgagaccucccucgcccaccgccucgucgcccgcgagggcuccgccgccccccucccccucuacaccucccccucccuccccaacaucacccucggccuccccgccaccggccccuccgccggcaccgccggccagcaggacgccgagcgccucacccuccccgcccuccagcagcgccucucccucuuccccggcacccaccucacccccuaccucuccaccuccccccucgagcgcgacggcggcgccgcccacuccccccuccuccagcacaugguccuccucgagcagccccccgcccaggccccccucgucaccggccucggcgcccucccccuccacgcccagucccucgucggcgccgaccgcgucucccccuccauccacaagcuccgccagcaccgcccccucggccgcacccaguccgccccccucccccagaacgcccaggcccuccagcaccucgucauccagcagcagcaccagcaguuccucgagaagcacaagcagcaguuccagcagcagcagcuccagaugaacaagaucauccccaagcccuccgagcccgcccgccagcccgagucccaccccgaggagaccgaggaggagcuccgcgagcaccaggcccuccucgacgagcccuaccucgaccgccuccccggccagaaggaggcccacgcccaggccggcguccaggucaagcaggagcccaucgaguccgacgaggaggaggccgagcccccccgcgaggucgagcccggccagcgccagcccuccgagcaggagcuccucuuccgccagcaggcccuccuccucgagcagcagcgcauccaccagcuccgcaacuaccaggccuccauggaggccgccggcauccccgucuccuucggcggccaccgcccccucucccgcgcccaguccucccccgccuccgccaccuuccccgucuccguccaggagccccccaccaagccccgcuucaccaccggccucgucuacgacacccucaugcucaagcaccagugcaccugcggcuccuccuccucccaccccgagcacgccggccgcauccaguccaucuggucccgccuccaggagaccggccuccgcggcaagugcgagugcauccgcggccgcaaggccacccucgaggagcuccagaccguccacuccgaggcccacacccuccucuacggcaccaacccccucaaccgccagaagcucgacuccaagaagcuccucggcucccucgccuccgucuucguccgccuccccugcggcggcgucggcgucgacuccgacaccaucuggaacgagguccacuccgccggcgccgcccgccucgccgucggcugcgucgucgagcucgucuucaaggucgccaccggcgagcucaagaacggcuucgccgucguccgcccccccggccaccacgccgaggaguccacccccaugggcuucugcuacuucaacuccgucgccgucgccgccaagcuccuccagcagcgccucuccgucuccaagauccucaucgucgacugggacguccaccacggcaacggcacccagcaggccuucuacuccgaccccuccguccucuacaugucccuccaccgcuacgacgacggcaacuucuuccccggcuccggcgcccccgacgaggucggcaccggccccggcgucggcuucaacgucaacauggccuucaccggcggccucgacccccccaugggcgacgccgaguaccucgccgccuuccgcaccgucgucaugcccaucgccuccgaguucgcccccgacgucguccucgucuccuccggcuucgacgccgucgagggccaccccaccccccucggcggcuacaaccucuccgcccgcugcuucggcuaccucaccaagcagcucaugggccucgccggcggccgcaucguccucgcccucgagggcggccacgaccucaccgccaucugcgacgccuccgaggccugcgucuccgcccuccucggcaacgagcucgacccccuccccgagaagguccuccagcagcgccccaacgccaacgccguccgcuccauggagaaggucauggagauccacuccaaguacuggcgcugccuccagcgcaccaccuccaccgccggccgcucccucaucgaggcccagaccugcgagaacgaggaggccgagaccgucaccgccauggccucccucuccgucggcgucaagcccgccgagaagcgccccgacgaggagcccauggaggaggagcccccccucuga

SEQ ID NO: 44078 - RNA, 3372 nt, Artificial Sequence
  derived and/or modified sequence opt2 from HDAC5__Homo_sapiens__XP_005256961
augaacucccccaacgaguccgccgacggcauguccggccgcgagcccucccucgagauccucccccgcaccucccuccacuccauccccgucaccgucgaggucaagcccguccucccccgcgccaugcccuccuccaugggcggcggcggcggcggcucccccucccccgucgagcuccgcggcgcccucgucggcuccgucgaccccacccuccgcgagcagcagcuccagcaggagcuccucgcccucaagcagcagcagcagcuccagaagcagcuccucuucgccgaguuccagaagcagcacgaccaccucacccgccagcacgagguccagcuccagaagcaccucaagcagcagcaggagaugcucgccgccaagcagcagcaggagaugcucgccgccaagcgccagcaggagcucgagcagcagcgccagcgcgagcagcagcgccaggaggagcucgagaagcagcgccucgagcagcagcuccucauccuccgcaacaaggagaaguccaaggaguccgccaucgccuccaccgaggucaagcuccgccuccaggaguuccuccucuccaaguccaaggagcccacccccggcggccucaaccacucccucccccagcaccccaagugcuggggcgcccaccacgccucccucgaccaguccucccccccccaguccggcccccccggcaccccccccuccuacaagcucccccuccccggccccuacgacucccgcgacgacuucccccuccgcaagaccgccuccgagcccaaccucaagguccgcucccgccucaagcagaaggucgccgagcgccgcuccuccccccuccuccgccgcaaggacggcaccgucaucuccaccuucaagaagcgcgccgucgagaucaccggcgccggccccggcgccuccuccgucugcaacuccgcccccggcuccggccccuccucccccaacuccucccacuccaccaucgccgagaacggcuucaccggcuccguccccaacauccccaccgagaugcucccccagcaccgcgcccucccccucgacuccucccccaaccaguucucccucuacaccucccccucccuccccaacaucucccucggccuccaggccaccgucaccgucaccaacucccaccucaccgccucccccaagcucuccacccagcaggaggccgagcgccaggcccuccagucccuccgccagggcggcacccucaccggcaaguucauguccaccuccuccauccccggcugccuccucggcgucgcccucgagggcgacggcuccccccacggccacgccucccuccuccagcacguccuccuccucgagcaggcccgccagcaguccacccucaucgccgucccccuccacggccaguccccccucgucaccggcgagcgcgucgccaccuccaugcgcaccgucggcaagcucccccgccaccgcccccucucccgcacccaguccuccccccucccccaguccccccaggcccuccagcagcucgucaugcagcagcagcaccagcaguuccucgagaagcagaagcagcagcagcuccagcucggcaagauccucaccaagaccggcgagcucccccgccagcccaccacccaccccgaggagaccgaggaggagcucaccgagcagcaggagguccuccucggcgagggcgcccucaccaugccccgcgagggcuccaccgaguccgaguccacccaggaggaccucgaggaggaggacgaggaggacgacggcgaggaggaggaggacugcauccaggucaaggacgaggagggcgaguccggcgccgaggagggccccgaccucgaggagcccggcgccggcuacaagaagcucuucuccgacgcccagccccuccagccccuccaggucuaccaggccccccucucccucgccaccgucccccaccaggcccucggccgcacccaguccucccccgccgcccccggcggcaugaaguccccccccgaccagcccgucaagcaccucuucaccaccggcgucgucuacgacaccuucaugcucaagcaccagugcaugugcggcaacacccacguccaccccgagcacgccggccgcauccaguccaucuggucccgccuccaggagaccggccuccucuccaagugcgagcgcauccgcggccgcaaggccacccucgacgagauccagaccguccacuccgaguaccacacccuccucuacggcaccuccccccucaaccgccagaagcucgacuccaagaagcuccucggccccaucucccagaagauguacgccguccuccccugcggcggcaucggcgucgacuccgacaccgucuggaacgagaugcacuccuccuccgccguccgcauggccgucggcugccuccucgagcucgccuucaaggucgccgccggcgagcucaagaacggcuucgccaucauccgcccccccggccaccacgccgaggaguccaccgccaugggcuucugcuucuucaacuccgucgccaucaccgccaagcuccuccagcagaagcucaacgucggcaagguccucaucgucgacugggacauccaccacggcaacggcacccagcaggccuucuacaacgaccccuccguccucuacaucucccuccaccgcuacgacaacggcaacuucuuccccggcuccggcgcccccgaggaggucggcggcggccccggcgucggcuacaacgucaacgucgccuggaccggcggcgucgacccccccaucggcgacgucgaguaccucaccgccuuccgcaccgucgucaugcccaucgcccacgaguucucccccgacgucguccucgucuccgccggcuucgacgccgucgagggccaccucuccccccucggcggcuacuccgucaccgcccgcugcuucggccaccucacccgccagcucaugacccucgccggcggccgcgucguccucgcccucgagggcggccacgaccucaccgccaucugcgacgccuccgaggccugcgucuccgcccuccucuccgucgagcuccagccccucgacgaggccguccuccagcagaagcccaacaucaacgccgucgccacccucgagaaggucaucgagauccaguccaagcacugguccugcguccagaaguucgccgccggccucggccgcucccuccgcgaggcccaggccggcgagaccgaggaggccgagaccgucuccgccauggcccuccucuccgucggcgccgagcaggcccaggccgccgccgcccgcgagcacuccccccgccccgccgaggagcccauggagcaggagcccgcccucuga

SEQ ID NO: 44079 - RNA, 3648 nt, Artificial Sequence
  derived and/or modified sequence opt2 from HDAC6__Homo_sapiens__NP_006035
augaccuccaccggccaggacuccaccaccacccgccagcgccgcucccgccagaacccccagucccccccccaggacuccuccgucaccuccaagcgcaacaucaagaagggcgccgucccccgcuccauccccaaccucgccgaggucaagaagaagggcaagaugaagaagcucggccaggccauggaggaggaccucaucgucggccuccagggcauggaccucaaccucgaggccgaggcccucgccggcaccggccucguccucgacgagcagcucaacgaguuccacugccucugggacgacuccuuccccgagggccccgagcgccuccacgccaucaaggagcagcucauccaggagggccuccucgaccgcugcgucuccuuccaggcccgcuucgccgagaaggaggagcucaugcucguccacucccucgaguacaucgaccucauggagaccacccaguacaugaacgagggcgagcuccgcguccucgccgacaccuacgacuccgucuaccuccaccccaacuccuacuccugcgccugccucgccuccggcuccguccuccgccucgucgacgccguccucggcgccgagauccgcaacggcauggccaucauccgcccccccggccaccacgcccagcacucccucauggacggcuacugcauguucaaccacgucgccgucgccgcccgcuacgcccagcagaagcaccgcauccgccgcguccucaucgucgacugggacguccaccacggccagggcacccaguucaccuucgaccaggaccccuccguccucuacuucuccauccaccgcuacgagcagggccgcuucuggccccaccucaaggccuccaacugguccaccaccggcuucggccagggccagggcuacaccaucaacguccccuggaaccaggucggcaugcgcgacgccgacuacaucgccgccuuccuccacguccuccuccccgucgcccucgaguuccagccccagcucguccucgucgccgccggcuucgacgcccuccagggcgaccccaagggcgagauggccgccacccccgccggcuucgcccagcucacccaccuccucaugggccucgccggcggcaagcucauccucucccucgagggcggcuacaaccuccgcgcccucgccgagggcgucuccgccucccuccacacccuccucggcgaccccugccccaugcucgagucccccggcgcccccugccgcuccgcccaggccuccgucuccugcgcccucgaggcccucgagcccuucugggagguccucguccgcuccaccgagaccgucgagcgcgacaacauggaggaggacaacgucgaggaguccgaggaggagggccccugggagccccccguccuccccauccucaccuggcccguccuccagucccgcaccggccucgucuacgaccagaacaugaugaaccacugcaaccucugggacucccaccaccccgaggucccccagcgcauccuccgcaucaugugccgccucgaggagcucggccucgccggccgcugccucacccucaccccccgccccgccaccgaggccgagcuccucaccugccacuccgccgaguacgucggccaccuccgcgccaccgagaagaugaagacccgcgagcuccaccgcgaguccuccaacuucgacuccaucuacaucugccccuccaccuucgccugcgcccagcucgccaccggcgccgccugccgccucgucgaggccguccucuccggcgagguccucaacggcgccgccgucguccgcccccccggccaccacgccgagcaggacgccgccugcggcuucugcuucuucaacuccgucgccgucgccgcccgccacgcccagaccaucuccggccacgcccuccgcauccucaucgucgacugggacguccaccacggcaacggcacccagcacauguucgaggacgaccccuccguccucuacgucucccuccaccgcuacgaccacggcaccuucuuccccaugggcgacgagggcgccuccucccagaucggccgcgccgccggcaccggcuucaccgucaacgucgccuggaacggcccccgcaugggcgacgccgacuaccucgccgccuggcaccgccucguccuccccaucgccuacgaguucaaccccgagcucguccucgucuccgccggcuucgacgccgcccgcggcgacccccucggcggcugccaggucucccccgagggcuacgcccaccucacccaccuccucaugggccucgccuccggccgcaucauccucauccucgagggcggcuacaaccucaccuccaucuccgaguccauggccgccugcacccgcucccuccucggcgacccccccccccuccucacccucccccgccccccccucuccggcgcccucgccuccaucaccgagaccauccagguccaccgccgcuacuggcgcucccuccgcgucaugaaggucgaggaccgcgagggccccuccuccuccaagcucgucaccaagaaggccccccagcccgccaagccccgccucgccgagcgcaugaccacccgcgagaagaagguccucgaggccggcaugggcaaggucaccuccgccuccuucggcgaggaguccacccccggccagaccaacuccgagaccgccgucgucgcccucacccaggaccagcccuccgaggccgccaccggcggcgccacccucgcccagaccaucuccgaggccgccaucggcggcgccaugcucggccagaccaccuccgaggaggccgucggcggcgccacccccgaccagaccaccuccgaggagaccgucggcggcgccauccucgaccagaccaccuccgaggacgccgucggcggcgccacccucggccagaccaccuccgaggaggccgucggcggcgccacccucgcccagaccaccuccgaggccgccauggagggcgccacccucgaccagaccaccuccgaggaggcccccggcggcaccgagcucauccagaccccccucgccuccuccaccgaccaccagaccccccccaccucccccguccagggcaccaccccccagaucucccccuccacccucaucggcucccuccgcacccucgagcucggcuccgagucccagggcgccuccgagucccaggcccccggcgaggagaaccuccucggcgaggccgccggcggccaggacauggccgacuccaugcucaugcagggcucccgcggccucaccgaccaggccaucuucuacgccgucaccccccuccccuggugcccccaccucgucgccgucugccccauccccgccgccggccucgacgucacccagcccugcggcgacugcggcaccauccaggagaacugggucugccucuccugcuaccaggucuacugcggccgcuacaucaacggccacaugcuccagcaccacggcaacuccggccacccccucguccucuccuacaucgaccucuccgccuggugcuacuacugccaggccuacguccaccaccaggcccuccucgacgucaagaacaucgcccaccagaacaaguucggcgaggacaugccccacccccacuga

SEQ ID NO: 44080 - RNA, 2865 nt, Artificial Sequence
  derived and/or modified sequence opt2 from HDAC7__Homo_sapiens__NP_001091886
augcacucccccggcgccgacggcacccaggucucccccggcgcccacuacugcucccccaccggcgccggcugcccccgccccugcgccgacacccccggcccccagccccagcccauggaccuccgcgucggccagcgcccccccgucgagcccccccccgagcccacccuccucgcccuccagcgcccccagcgccuccaccaccaccucuuccucgccggccuccagcagcagcgcuccgucgagcccaugcgccucuccauggacacccccaugcccgagcuccaggucggcccccaggagcaggagcuccgccagcuccuccacaaggacaaguccaagcgcuccgccgucgccuccuccgucgucaagcagaagcucgccgaggucauccucaagaagcagcaggccgcccucgagcgcaccguccaccccaacucccccggcauccccuaccgcacccucgagccccucgagaccgagggcgccacccgcuccaugcucuccuccuuccucccccccguccccucccuccccuccgacccccccgagcacuucccccuccgcaagaccgucuccgagcccaaccucaagcuccgcuacaagcccaagaagucccucgagcgccgcaagaacccccuccuccgcaaggaguccgccccccccucccuccgccgccgccccgccgagacccucggcgacuccucccccuccuccuccuccacccccgccuccggcugcuccucccccaacgacuccgagcacggccccaaccccauccucggcuccgaggccgacuccgaccgccgcacccaccccacccucggcccccgcggccccauccucggcuccccccacaccccccucuuccucccccacggccucgagcccgaggccggcggcacccuccccucccgccuccagcccauccuccuccucgaccccuccggcucccacgccccccuccucaccguccccggccucggcccccuccccuuccacuucgcccagucccucaugaccaccgagcgccucuccggcuccggccuccacuggccccucucccgcacccgcuccgagccccucccccccuccgccaccgccccccccccccccggccccaugcagccccgccucgagcagcucaagacccacguccaggucaucaagcgcuccgccaagcccuccgagaagccccgccuccgccagauccccuccgccgaggaccucgagaccgacggcggcggccccggccaggucgucgacgacggccucgagcaccgcgagcucggccacggccagcccgaggcccgcggccccgccccccuccagcagcacccccagguccuccucugggagcagcagcgccucgccggccgccucccccgcggcuccaccggcgacaccguccuccucccccucgcccagggcggccaccgcccccucucccgcgcccaguccucccccgccgcccccgccucccucuccgcccccgagcccgccucccaggcccgcguccucuccuccuccgagacccccgcccgcacccuccccuucaccaccggccucaucuacgacuccgucaugcucaagcaccagugcuccugcggcgacaacucccgccaccccgagcacgccggccgcauccaguccaucuggucccgccuccaggagcgcggccuccgcucccagugcgagugccuccgcggccgcaaggccucccucgaggagcuccaguccguccacuccgagcgccacguccuccucuacggcaccaacccccucucccgccucaagcucgacaacggcaagcucgccggccuccucgcccagcgcauguucgucaugcuccccugcggcggcgucggcgucgacaccgacaccaucuggaacgagcuccacuccuccaacgccgcccgcugggccgccggcuccgucaccgaccucgccuucaaggucgccucccgcgagcucaagaacggcuucgccgucguccgcccccccggccaccacgccgaccacuccaccgccaugggcuucugcuucuucaacuccgucgccaucgccugccgccagcuccagcagcaguccaaggccuccaagauccucaucgucgacugggacguccaccacggcaacggcacccagcagaccuucuaccaggaccccuccguccucuacaucucccuccaccgccacgacgacggcaacuucuuccccggcuccggcgccgucgacgaggucggcgccggcuccggcgagggcuucaacgucaacgucgccugggccggcggccucgacccccccaugggcgaccccgaguaccucgccgccuuccgcaucgucgucaugcccaucgcccgcgaguucucccccgaccucguccucgucuccgccggcuucgacgccgccgagggccaccccgccccccucggcggcuaccacgucuccgccaagugcuucggcuacaugacccagcagcucaugaaccucgccggcggcgccgucguccucgcccucgagggcggccacgaccucaccgccaucugcgacgccuccgaggccugcgucgccgcccuccucggcaaccgcgucgacccccucuccgaggagggcuggaagcagaagcccaaccucaacgccauccgcucccucgaggccgucauccgcguccacuccaaguacuggggcugcaugcagcgccucgccuccugccccgacuccugggucccccgcguccccggcgccgacaaggaggaggucgaggccgucaccgcccucgccucccucuccgucggcauccucgccgaggaccgccccuccgagcagcucgucgaggaggaggagcccaugaaccucuga

SEQ ID NO: 44081 - RNA, 861 nt, Artificial Sequence
  derived and/or modified sequence opt2 from HDAC8__Homo_sapiens__NP_001159890
auggaggagcccgaggagcccgccgacuccggccagucccucguccccgucuacaucuacucccccgaguacgucuccaugugcgacucccucgccaagauccccaagcgcgccuccaugguccacucccucaucgaggccuacgcccuccacaagcagaugcgcgacgaggccuccggcuucugcuaccucaacgacgccguccucggcauccuccgccuccgccgcaaguucgagcgcauccucuacgucgaccucgaccuccaccacggcgacggcgucgaggacgccuucuccuucaccuccaaggucaugaccgucucccuccacaaguucucccccggcuucuuccccggcaccggcgacgucuccgacgucggccucggcaagggccgcuacuacuccgucaacguccccauccaggacggcauccaggacgagaaguacuaccagaucugcgaguccguccucaaggaggucuaccaggccuucaaccccaaggccgucguccuccagcucggcgccgacaccaucgccggcgaccccaugugcuccuucaacaugacccccgucggcaucggcaagugccucaaguacauccuccaguggcagcucgccacccucauccucggcggcggcggcuacaaccucgccaacaccgcccgcugcuggaccuaccucaccggcgucauccucggcaagacccucuccuccgagauccccgaccacgaguucuucaccgccuacggccccgacuacguccucgagaucacccccuccugccgccccgaccgcaacgagccccaccgcauccagcagauccucaacuacaucaagggcaaccucaagcacgucgucuga

SEQ ID NO: 44082 - RNA, 1767 nt, Artificial Sequence
  derived and/or modified sequence opt2 from HDAC9__Homo_sapiens__NP_001191073
augauguccucccccgcccagcccgaccucauguggaaccucguccccuggguccucuucugcggcugcugccgcaucuuccccgacggcgucgccggccgcgagcagcuccucgcccagcagcgcaugcacuccaugaucuccuccgucgacgucaaguccgagguccccgucggccucgagcccaucuccccccucgaccuccgcaccgaccuccgcaugaugaugcccgucgucgaccccgucguccgcgagaagcagcuccagcaggagcuccuccucauccagcagcagcagcagauccagaagcagcuccucaucgccgaguuccagaagcagcacgagaaccucacccgccagcaccaggcccagcuccaggagcacaucaaggagcuccucgccaucaagcagcagcaggagcuccucgagaaggagcagaagcucgagcagcagcgccaggagcaggaggucgagcgccaccgccgcgagcagcagcuccccccccuccgcggcaaggaccgcggccgcgagcgcgccgucgccuccaccgaggucaagcagaagcuccaggaguuccuccucuccaaguccgccaccaaggacacccccaccaacggcaagaaccacuccgucucccgccaccccaagcucugguacaccgccgcccaccacaccucccucgaccaguccucccccccccucuccggcaccucccccuccuacaaguacacccuccccggcgcccaggacgccaaggacgacuucccccuccgcaagaccgaguccuccgucuccuccuccucccccggcuccggccccuccucccccaacaacggccccaccggcuccgucaccgagaacgagaccuccguccucccccccaccccccacgccgagcagauggucucccagcagcgcauccucauccacgaggacuccaugaaccuccucucccucuacaccucccccucccuccccaacaucacccucggccuccccgccguccccucccagcucaacgccuccaacucccucaaggagaagcagaagugcgagacccagacccuccgccagggcgucccccuccccggccaguacggcggcuccauccccgccuccuccucccacccccacgucacccucgagggcaagccccccaacuccucccaccaggcccuccuccagcaccuccuccucaaggagcagaugcgccagcagaagcuccucgucgccggcggcgucccccuccacccccaguccccccucgccaccaaggagcgcaucucccccggcauccgcggcacccacaagcucccccgccaccgcccccucaaccgcacccaguccgccccccucccccaguccacccucgcccagcucgucauccagcagcagcaccagcaguuccucgagaagcagaagcaguaccagcagcagauccacaugaacaagcuccucuccaaguccaucgagcagcucaagcagcccggcucccaccucgaggaggccgaggaggagcuccagggcgaccaggccaugcaggaggaccgcgcccccuccuccggcaacuccacccgcuccgacuccuccgccugcgucgacgacacccucggccaggucggcgccgucaaggucaaggaggagcccgucgacuccgacgaggacgcccagauccaggagauggaguccggcgagcaggccgccuucaugcagcaggucaucggcaaggaccucgcccccggcuucgucaucaaggucaucaucuga

SEQ ID NO: 44083 - RNA, 1989 nt, Artificial Sequence
  derived and/or modified sequence opt2 from HDC__Homo_sapiens__NP_002103
augauggagcccgaggaguaccgcgagcgcggccgcgagauggucgacuacaucugccaguaccucuccaccguccgcgagcgccgcgucacccccgacguccagcccggcuaccuccgcgcccagcuccccgaguccgcccccgaggaccccgacuccugggacuccaucuucggcgacaucgagcgcaucaucaugcccggcgucguccacuggcaguccccccacaugcacgccuacuaccccgcccucaccuccuggcccucccuccucggcgacaugcucgccgacgccaucaacugccucggcuucaccugggccuccucccccgccugcaccgagcucgagaugaacgucauggacuggcucgccaagaugcucggccuccccgagcacuuccuccaccaccaccccuccucccagggcggcggcguccuccaguccaccgucuccgaguccacccucaucgcccuccucgccgcccgcaagaacaagauccucgagaugaagaccuccgagcccgacgccgacgaguccugccucaacgcccgccucgucgccuacgccuccgaccaggcccacuccuccgucgagaaggccggccucaucucccucgucaagaugaaguuccuccccgucgacgacaacuucucccuccgcggcgaggcccuccagaaggccaucgaggaggacaagcagcgcggccucguccccgucuucgucugcgccacccucggcaccaccggcgucugcgccuucgacugccucuccgagcucggccccaucugcgcccgcgagggccucuggcuccacaucgacgccgccuacgccggcaccgccuuccucugccccgaguuccgcggcuuccucaagggcaucgaguacgccgacuccuucaccuucaaccccuccaaguggaugaugguccacuucgacugcaccggcuucugggucaaggacaaguacaagcuccagcagaccuucuccgucaaccccaucuaccuccgccacgccaacuccggcgucgccaccgacuucaugcacuggcagaucccccucucccgccgcuuccgcuccgucaagcucugguucgucauccgcuccuucggcgucaagaaccuccaggcccacguccgccacggcaccgagauggccaaguacuucgagucccucguccgcaacgaccccuccuucgagauccccgccaagcgccaccucggccucgucgucuuccgccucaagggccccaacugccucaccgagaacguccucaaggagaucgccaaggccggccgccucuuccucauccccgccaccauccaggacaagcucaucauccgcuucaccgucaccucccaguucaccacccgcgacgacauccuccgcgacuggaaccucauccgcgacgccgccacccucauccucucccagcacugcaccucccagcccuccccccgcgucggcaaccucaucucccagauccgcggcgcccgcgccugggccugcggcaccucccuccaguccgucuccggcgccggcgacgaccccguccaggcccgcaagaucaucaagcagccccagcgcgucggcgccggccccaugaagcgcgagaacggccuccaccucgagacccuccucgaccccgucgacgacugcuucuccgaggaggcccccgacgccaccaagcacaagcucuccuccuuccucuucuccuaccucuccguccagaccaagaagaagaccguccgcucccucuccugcaacuccguccccgucuccgcccagaagccccuccccaccgaggccuccgucaagaacggcggcuccucccgcguccgcaucuucucccgcuuccccgaggacaugaugaugcucaagaaguccgccuucaagaagcucaucaaguucuacuccguccccuccuuccccgagugcuccucccagugcggccuccagcuccccugcugcccccuccaggccauggucuga

SEQ ID NO: 44084 - RNA, 615 nt, Artificial Sequence
  derived and/or modified sequence opt2 from HDDC2__Homo_sapiens__NP_057147
auggccuccgucuccuccgccaccuucuccggccacggcgcccgcucccuccuccaguuccuccgccucgucggccagcucaagcgcgucccccgcaccggcugggucuaccgcaacguccagcgccccgaguccgucuccgaccacauguaccgcauggccgucauggccauggucaucaaggacgaccgccucaacaaggaccgcugcguccgccucgcccucguccacgacauggccgagugcaucgucggcgacaucgcccccgccgacaacauccccaaggaggagaagcaccgccgcgaggaggaggccaugaagcagaucacccagcuccuccccgaggaccuccgcaaggagcucuacgagcucugggaggaguacgagacccaguccuccgccgaggccaaguucgucaagcagcucgaccagugcgagaugauccuccaggccuccgaguacgaggaccucgagcacaagcccggccgccuccaggacuucuacgacuccaccgccggcaaguucaaccaccccgagaucguccagcucgucuccgagcucgaggccgagcgcuccaccaacaucgccgccgccgccuccgagccccacuccuga

SEQ ID NO: 44085 - RNA, 771 nt, Artificial Sequence
  derived and/or modified sequence opt2 from HDGF__Homo_sapiens__NP_001119522
augcaccccgagggcggccaguucgucccccagcuccucggccaccuccucgccaccaagcucaagcgcuuccuccucuccaagggcggccgccgcgcccagauccccgacgucucccgcgccaccccccacaccaucgacgagaugcccgaggccgccgucaaguccaccgccaacaaguaccaggucuucuucuucggcacccacgagaccgccuuccucggccccaaggaccucuuccccuacgaggaguccaaggagaaguucggcaagcccaacaagcgcaagggcuucuccgagggccucugggagaucgagaacaaccccaccgucaaggccuccggcuaccaguccucccagaagaaguccugcgucgaggagcccgagcccgagcccgaggccgccgagggcgacggcgacaagaagggcaacgccgagggcuccuccgacgaggagggcaagcucgucaucgacgagcccgccaaggagaagaacgagaagggcgcccucaagcgccgcgccggcgaccuccucgaggacucccccaagcgccccaaggaggccgagaaccccgagggcgaggagaaggaggccgccacccucgaggucgagcgcccccuccccauggaggucgagaagaacuccacccccuccgagcccggcuccggccgcggccccccccaggaggaggaggaggaggaggacgaggaggaggaggccaccaaggaggacgccgaggcccccggcauccgcgaccacgagucccucuga

SEQ ID NO: 44086 - RNA, 756 nt, Artificial Sequence
  derived and/or modified sequence opt2 from HDGFL1__Homo_sapiens__NP_612641
auguccgccuacggcaugcccauguacaaguccggcgaccucgucuucgccaagcucaagggcuacgcccacuggcccgcccgcaucgagcacaugacccagcccaaccgcuaccaggucuucuucuucggcacccacgagaccgccuuccucucccccaagcgccucuuccccuacaaggagugcaaggagaaguucggcaagcccaacaagcgccgcggcuucuccgccggccucugggagaucgagaacaaccccaccguccaggccuccgacugcccccucgccuccgagaagggcuccggcgacggccccuggcccgagcccgaggccgccgagggcgacgaggacaagcccacccacgccggcggcggcggcgacgagcucggcaagcccgacgacgacaagcccaccgaggaggagaagggcccccucaagcgcuccgccggcgacccccccgaggacgcccccaagcgccccaaggaggccgcccccgaccaggaggaggaggccgaggccgagcgcgccgccgaggccgagcgcgccgccgccgccgccgccgccaccgccgucgacgaggagucccccuuccucgucgccgucgagaacggcuccgcccccuccgagcccggccucgucugcgagcccccccagcccgaggaggaggagcuccgcgaggaggaggucgccgacgaggaggccucccaggaguggcacgccgaggcccccggcggcggcgaccgcgacucccucuga

SEQ ID NO: 44087 - RNA, 612 nt, Artificial Sequence
  derived and/or modified sequence opt2 from HDGFRP3__Homo_sapiens__NP_057157
auggcccgcccccgcccccgcgaguacaaggccggcgaccucgucuucgccaagaugaagggcuacccccacuggcccgcccgcaucgacgagcuccccgagggcgccgucaagccccccgccaacaaguaccccaucuucuucuucggcacccacgagaccgccuuccucggccccaaggaccucuuccccuacaaggaguacaaggacaaguucggcaaguccaacaagcgcaagggcuucaacgagggccucugggagaucgagaacaaccccggcgucaaguucaccggcuaccaggccauccagcagcaguccuccuccgagaccgagggcgagggcggcaacaccgccgacgccuccuccgaggaggagggcgaccgcgucgaggaggacggcaagggcaagcgcaagaacgagaaggccggcuccaagcgcaagaaguccuacaccuccaagaaguccuccaagcagucccgcaagucccccggcgacgaggacgacaaggacugcaaggaggaggagaacaaguccuccuccgagggcggcgacgccggcaacgacacccgcaacaccaccuccgaccuccagaagaccuccgagggcaccuga

SEQ ID NO: 44088 - RNA, 756 nt, Artificial Sequence
  derived and/or modified sequence opt2 from HDHD1__Homo_sapiens__NP_001129037
auggccgcccccccccagcccgucacccaccucaucuucgacauggacggccuccuccucggcuacaccggcuccaucgucgccgccgccuccggcgaguccucccgcggccuccagucccgcuggaccgacaccgagcgccucuacuccgucgucuuccaggagaucugcaaccgcuacgacaagaaguacuccugggacgucaagucccucgucaugggcaagaaggcccucgaggccgcccagaucaucaucgacguccuccagcuccccauguccaaggaggagcucgucgaggagucccagaccaagcucaaggaggucuuccccaccgccgcccucaugcccggcgccgagaagcucaucauccaccuccgcaagcacggcauccccuucgcccucgccaccuccuccggcuccgccuccuucgacaugaagaccucccgccacaaggaguucuucucccucuucucccacaucguccucggcgacgaccccgagguccagcacggcaagcccgaccccgacaucuuccucgccugcgccaagcgcuucucccccccccccgccauggagaagugccucgucuucgaggacgcccccaacggcgucgaggccgcccucgccgccggcaugcaggucgucaugguccccgacggcaaccucucccgcgaccucaccaccaaggccacccucguccucaacucccuccaggacuuccagcccgagcucuucggccuccccuccuacgaguga

SEQ ID NO: 44089 - RNA, 3708 nt, Artificial Sequence
  derived and/or modified sequence opt2 from HDLBP__Homo_sapiens__NP_001230829
augcaccucgccgagcgcgaccgcuggcucuucgucgccaccgucaugaugcacuucgucuccaucaaguccggcuuccccggccucugcgucggcguccgcuccaccauguccuccgucgccguccucacccaggaguccuucgccgagcaccgcuccggccucgucccccagcagaucaaggucgccacccucaacuccgaggaggaguccgacccccccaccuacaaggacgccuuccccccccuccccgagaaggccgccugccucgaguccgcccaggagcccgccggcgccuggggcaacaagauccgccccaucaaggccuccgucaucacccaggucuuccacgucccccucgaggagcgcaaguacaaggacaugaaccaguucggcgagggcgagcaggccaagaucugccucgagaucaugcagcgcaccggcgcccaccucgagcucucccucgccaaggaccagggccucuccaucauggucuccggcaagcucgacgccgucaugaaggcccgcaaggacaucgucgcccgccuccagacccaggccuccgccaccgucgccauccccaaggagcaccaccgcuucgucaucggcaagaacggcgagaagcuccaggaccucgagcucaagaccgccaccaagauccagaucccccgccccgacgaccccuccaaccagaucaagaucaccggcaccaaggagggcaucgagaaggcccgccacgagguccuccucaucuccgccgagcaggacaagcgcgccgucgagcgccucgaggucgagaaggccuuccaccccuucaucgccggccccuacaaccgccucgucggcgagaucaugcaggagaccggcacccgcaucaacauccccccccccuccgucaaccgcaccgagaucgucuucaccggcgagaaggagcagcucgcccaggccgucgcccgcaucaagaagaucuacgaggagaaggccaacuccuucaccgucuccuccgucgccgcccccuccuggcuccaccgcuucaucaucggcaagaagggccagaaccucgccaagaucacccagcagaugcccaagguccacaucgaguucaccgagggcgaggacaagaucacccucgagggccccaccgaggacgucaacgucgcccaggagcagaucgagggcauggucaaggaccucaucaaccgcauggacuacgucgagaucaacaucgaccacaaguuccaccgccaccucaucggcaaguccggcgccaacaucaaccgcaucaaggaccaguacaaggucuccguccgcaucccccccgacuccgagaaguccaaccucauccgcaucgagggcgacccccagggcguccagcaggccaagcgcgagcuccucgagcucgccucccgcauggagaacgagcgcaccaaggaccucaucaucgagcagcgcuuccaccgcaccaucaucggccagaagggcgagcgcauccgcgagauccgcgacaaguuccccgaggucaucaucaacuuccccgaccccgcccagaaguccgacaucguccagcuccgcggccccaagaacgaggucgagaagugcaccaaguacaugcagaagauggucgccgaccucgucgagaacuccuacuccaucuccguccccaucuucaagcaguuccacaagaacaucaucggcaagggcggcgccaacaucaagaagauccgcgaggaguccaacaccaagaucgaccuccccgccgagaacuccaacuccgagaccaucaucaucaccggcaagcgcgccaacugcgaggccgcccgcucccgcauccucuccauccagaaggaccucgccaacaucgccgaggucgaggucuccauccccgccaagcuccacaacucccucaucggcaccaagggccgccucauccgcuccaucauggaggagugcggcggcguccacauccacuuccccgucgagggcuccggcuccgacaccgucgucauccgcggccccuccuccgacgucgagaaggccaagaagcagcuccuccaccucgccgaggagaagcagaccaaguccuucaccgucgacauccgcgccaagcccgaguaccacaaguuccucaucggcaagggcggcggcaagauccgcaagguccgcgacuccaccggcgcccgcgucaucuuccccgccgccgaggacaaggaccaggaccucaucaccaucaucggcaaggaggacgccguccgcgaggcccagaaggagcucgaggcccucauccagaaccucgacaacgucgucgaggacuccaugcucgucgaccccaagcaccaccgccacuucgucauccgccgcggccagguccuccgcgagaucgccgaggaguacggcggcgucauggucuccuucccccgcuccggcacccaguccgacaaggucacccucaagggcgccaaggacugcgucgaggccgccaagaagcgcauccaggagaucaucgaggaccucgaggcccaggucacccucgagugcgccaucccccagaaguuccaccgcuccgucaugggccccaagggcucccgcauccagcagaucacccgcgacuucuccguccagaucaaguuccccgaccgcgaggagaacgccguccacuccaccgagcccgucguccaggagaacggcgacgaggccggcgagggccgcgaggccaaggacugcgaccccggcuccccccgccgcugcgacaucaucaucaucuccggccgcaaggagaagugcgaggccgccaaggaggcccucgaggcccucguccccgucaccaucgaggucgagguccccuucgaccuccaccgcuacgucaucggccagaagggcuccggcauccgcaagaugauggacgaguucgaggucaacauccacguccccgcccccgagcuccaguccgacaucaucgccaucaccggccucgccgccaaccucgaccgcgccaaggccggccuccucgagcgcgucaaggagcuccaggccgagcaggaggaccgcgcccuccgcuccuucaagcucuccgucaccgucgaccccaaguaccaccccaagaucaucggccgcaagggcgccgucaucacccagauccgccucgagcacgacgucaacauccaguuccccgacaaggacgacggcaaccagccccaggaccagaucaccaucaccggcuacgagaagaacaccgaggccgcccgcgacgccauccuccgcaucgucggcgagcucgagcagauggucuccgaggacgucccccucgaccaccgcguccacgcccgcaucaucggcgcccgcggcaaggccauccgcaagaucauggacgaguucaaggucgacauccgcuucccccaguccggcgcccccgaccccaacugcgucaccgucaccggccuccccgagaacgucgaggaggccaucgaccacauccucaaccucgaggaggaguaccucgccgacgucgucgacuccgaggcccuccaggucuacaugaagccccccgcccacgaggaggccaaggcccccucccgcggcuucgucguccgcgacgcccccuggaccgccuccuccuccgagaaggcccccgacauguccuccuccgaggaguuccccuccuucggcgcccaggucgcccccaagacccuccccuggggccccaagcgcuga

SEQ ID NO: 44090 - RNA, 6435 nt, Artificial Sequence
  derived and/or modified sequence opt2 from HEATR1__Homo_sapiens__NP_060542
augaccucccucgcccagcagcuccagcgccucgcccucccccaguccgacgccucccuccucucccgcgacgaggucgccucccuccucuucgaccccaaggaggccgccaccaucgaccgcgacaccgccuucgccaucggcugcaccggccucgaggagcuccucggcaucgaccccuccuucgagcaguucgaggccccccucuucucccagcucgccaagacccucgagcgcuccguccagaccaaggccgucaacaagcagcucgacgagaacaucucccucuuccucauccaccucucccccuacuuccuccucaagcccgcccagaagugccucgaguggcucauccaccgcuuccacauccaccucuacaaccaggacucccucaucgccugcguccuccccuaccacgagacccgcaucuucguccgcgucauccagcuccucaagaucaacaacuccaagcaccgcugguucuggcuccuccccgucaagcaguccggcgucccccucgccaagggcacccucaucacccacugcuacaaggaccucggcuucauggacuucaucugcucccucgucaccaaguccgucaaggucuucgccgaguaccccggcuccuccgcccagcuccgcguccuccucgccuucuacgccuccaccaucgucuccgcccucgucgccgccgaggacgucuccgacaacaucaucgccaagcucuuccccuacauccagaagggccucaaguccucccuccccgacuaccgcgccgccaccuacaugaucaucugccagaucuccgucaaggucaccauggagaacaccuucgucaacucccucgccucccagaucaucaagacccucaccaagauccccucccucaucaaggacggccucuccugccucaucguccuccuccagcgccagaagcccgagucccucggcaagaagcccuucccccaccucugcaacguccccgaccucaucaccauccuccacggcaucuccgagaccuacgacgucuccccccuccuccacuacaugcucccccaccucgucgucuccaucauccaccacgucaccggcgaggagaccgagggcauggacggccagaucuacaagcgccaccucgaggccauccucaccaagaucucccucaagaacaaccucgaccaccuccucgccucccuccucuucgaggaguacaucuccuacuccucccaggaggagauggacuccaacaaggucucccuccucaacgagcaguuccucccccucauccgccuccucgaguccaaguacccccgcacccucgacgucguccucgaggagcaccucaaggagaucgccgaccucaagaagcaggagcucuuccaccaguucgucucccucuccaccuccggcggcaaguaccaguuccucgccgacuccgacaccucccucaugcucucccucaaccacccccucgcccccguccgcauccucgccaugaaccaccucaagaagaucaugaagaccuccaaggagggcgucgacgaguccuucaucaaggaggccguccucgcccgccucggcgacgacaacaucgacgucguccucuccgccaucuccgccuucgagaucuucaaggagcacuucuccuccgaggucaccaucuccaaccuccucaaccucuuccagcgcgccgagcucuccaagaacggcgagugguacgagguccucaagaucgccgccgacauccucaucaaggaggagauccucuccgagaacgaccagcucuccaaccaggucgucgucugccuccuccccuucauggucaucaacaacgacgacaccgaguccgccgagaugaagaucgccaucuaccucuccaaguccggcaucugcucccuccacccccuccuccgcggcugggaggaggcccucgagaacgucaucaaguccaccaagcccggcaagcucaucggcgucgccaaccagaagaugaucgagcuccucgccgacaacaucaaccucggcgaccccuccuccaugcucaagauggucgaggaccucaucuccgucggcgaggaggaguccuucaaccucaagcagaaggucaccuuccacgucauccucuccguccucgucuccugcugcuccucccucaaggagacccacuuccccuucgccauccgcgucuucucccuccuccagaagaagaucaagaagcucgaguccgucaucaccgccgucgagauccccuccgaguggcacaucgagcucaugcucgaccgcggcauccccgucgagcucugggcccacuacgucgaggagcucaacuccacccagcgcgucgccgucgaggacuccgucuuccucgucuucucccucaagaaguucaucuacgcccucaaggcccccaaguccuuccccaagggcgacaucugguggaaccccgagcagcucaaggaggacucccgcgacuaccuccaccuccucaucggccucuucgagaugaugcucaacggcgccgacgccguccacuuccgcguccucaugaagcucuucaucaagguccaccucgaggacgucuuccagcucuucaaguucugcuccguccucuggaccuacggcuccucccucuccaacccccucaacugcuccgucaagaccguccuccagacccaggcccucuacgucggcugcgccaugcucuccucccagaagacccagugcaagcaccagcucgccuccaucuccucccccgucgucaccucccuccucaucaaccucggcucccccgucaaggagguccgccgcgccgccauccagugccuccaggcccucuccggcgucgccucccccuucuaccucaucaucgaccaccucaucuccaaggccgaggagaucaccuccgacgccgccuacgucauccaggaccucgccacccucuucgaggagcuccagcgcgagaagaagcucaagucccaccagaagcucuccgagacccucaagaaccuccucuccugcgucuacuccugccccuccuacaucgccaaggaccucaugaagguccuccagggcgucaacggcgagaugguccucucccagcuccuccccauggccgagcagcuccucgagaagauccagaaggagcccaccgccguccucaaggacgaggccaugguccuccaccucacccucggcaaguacaacgaguucuccgucucccuccucaacgaggaccccaagucccucgacaucuucaucaaggccguccacaccaccaaggagcucuacgccggcaugcccaccauccagaucaccgcccucgagaagaucaccaagcccuucuucgccgccaucuccgacgagaagguccagcagaagcuccuccgcaugcucuucgaccuccucgucaacugcaagaacucccacugcgcccagaccgucuccuccgucuucaagggcaucuccgucaacgccgagcagguccgcaucgagcucgagccccccgacaaggccaagccccucggcaccguccagcagaagcgccgccagaagaugcagcagaagaagucccaggaccucgaguccguccaggaggucggcggcuccuacuggcagcgcgucacccucauccucgagcuccuccagcacaagaagaagcuccgcuccccccagauccucguccccacccucuucaaccuccucucccgcugccucgagccccucccccaggagcagggcaacauggaguacaccaagcagcucauccucuccugccuccucaacaucugccagaagcucucccccgacggcggcaagauccccaaggacauccucgacgaggagaaguucaacgucgagcucaucguccagugcauccgccucuccgagaugccccagacccaccaccacgcccuccuccuccucggcaccgucgccggcaucuuccccgacaagguccuccacaacaucauguccaucuucaccuucaugggcgccaacgucaugcgccucgacgacaccuacuccuuccaggucaucaacaagaccgucaagauggucauccccgcccucauccaguccgacuccggcgacuccaucgaggucucccgcaacgucgaggagaucgucgucaagaucaucuccgucuucgucgacgcccucccccacguccccgagcaccgccgccuccccauccucguccagcucgucgacacccucggcgccgagaaguuccucuggauccuccucauccuccucuucgagcaguacgucaccaagaccguccucgccgccgccuacggcgagaaggacgccauccucgaggccgacaccgaguucugguucuccgucugcugcgaguucuccguccagcaccagauccagucccucaugaacauccuccaguaccuccucaagcuccccgaggagaaggaggagaccauccccaaggccgucuccuucaacaaguccgagucccaggaggagaugcuccaggucuucaacgucgagacccacaccuccaagcagcuccgccacuucaaguuccucuccgucuccuucaugucccagcuccucuccuccaacaacuuccucaagaaggucgucgaguccggcggccccgagauccucaagggccucgaggagcgccuccucgagaccguccucggcuacaucuccgccgucgcccaguccauggagcgcaacgccgacaagcucaccgucaaguucuggcgcgcccuccucuccaaggccuacgaccuccucgacaaggucaacgcccuccuccccaccgagaccuucauccccgucauccgcggccucgucggcaacccccuccccuccguccgccgcaaggcccucgaccuccucaacaacaagcuccagcagaacaucuccuggaagaagaccaucgucacccgcuuccucaagcucguccccgaccuccucgccaucguccagcgcaagaagaaggagggcgaggaggagcaggccaucaaccgccagaccgcccucuacacccucaagcuccucugcaagaacuucggcgccgagaaccccgaccccuucguccccguccucaacaccgccgucaagcucaucgcccccgagcgcaaggaggagaagaacguccucggcuccgcccuccucugcaucgccgaggucaccuccacccucgaggcccucgccaucccccagcuccccucccucaugcccucccuccucaccaccaugaagaacaccuccgagcucgucuccuccgaggucuaccuccucuccgcccucgccgcccuccagaaggucgucgagacccucccccacuucaucucccccuaccucgagggcauccucucccaggucauccaccucgagaagaucaccuccgagaugggcuccgccucccaggccaacauccgccucaccucccucaagaagacccucgccaccacccucgccccccgcguccuccuccccgccaucaagaagaccuacaagcagaucgagaagaacuggaagaaccacaugggccccuucauguccauccuccaggagcacaucggcgucaugaagaaggaggagcucaccucccaccagucccagcucaccgccuucuuccucgaggcccucgacuuccgcgcccagcacuccgagaacgaccucgaggaggucggcaagaccgagaacugcaucaucgacugccucgucgccauggucgucaagcucuccgaggucaccuuccgcccccucuucuucaagcucuucgacugggccaagaccgaggacgcccccaaggaccgccuccucaccuucuacaaccucgccgacugcaucgccgagaagcucaagggccucuucacccucuucgccggccaccucgucaagcccuucgccgacacccucaaccaggucaacaucuccaagaccgacgaggccuucuucgacuccgagaacgaccccgagaagugcugccuccuccuccaguucauccucaacugccucuacaagaucuuccucuucgacacccagcacuucaucuccaaggagcgcgccgaggcccucaugaugccccucgucgaccagcucgagaaccgccucggcggcgaggagaaguuccaggagcgcgucaccaagcaccucauccccugcaucgcccaguucuccgucgccauggccgacgacucccucuggaagccccucaacuaccagauccuccucaagacccgcgacuccucccccaagguccgcuucgccgcccucaucaccguccucgcccucgccgagaagcucaaggagaacuacaucguccuccuccccgaguccauccccuuccucgccgagcucauggaggacgagugcgaggaggucgagcaccagugccagaagaccauccagcagcucgagaccguccucggcgagccccuccaguccuacuucuga

SEQ ID NO: 44091 - RNA, 2043 nt, Artificial Sequence
  derived and/or modified sequence opt2 from HEATR3__Homo_sapiens__NP_891552
augggcaagucccgcaccaagcgcuucaagcgcccccaguucucccccaccggcgacugccaggccgaggccgccgccgccgccaacggcaccggcggcgaggaggacgacggccccgccgccgagcuccucgagaagcuccagcaccccuccgccgagguccgcgagugcgccugcgccggccucgcccgccucguccagcagcgccccgcccuccccggccucgcccgccgcgacgccguccgccgccucggcccccuccuccucgaccccucccucgccguccgcgagaccgccgccggcgcccuccgcaaccucuccgccugcggcggcuucgaggucugcgacgacauggucaccaaggacaucaugaccccccucgucgcccuccucaaggagugcuccgccggccucgacuccaacgagaugucccuccaggagaagaaggaccagaaccgcaacuccaucgagaacaucgccaacgagaccgucaacguccucuggaacaucugcgagugcuccucccgcgccgucuccaucuucaacaaggagggcugccucgagaucguccucaaguaccucucccgcuuccccaccaacgucgaccucgccaucuccgucgccuacugccuccagaccgucaccgaggacaaccccgagcuccucaaguccuucuccgccaccgcccucaacaugcucgaguccgcccuccucucccccgucuccuccauggagucccuccuccucaagacccucgucgccggcaccaucuggaaccucaaggacaucauccccugcaagucccaggccgagaucaucaacgcccuccucaagauccucuccgagguccucggcauggacgccggcgagauggucauccagaugaaggaggccgagacccagcgccucaagaccgccgccgaggccgaggagauccucgagaacaccaacggcgacgaccucaucgaggacgacgagauggagggcaucucccacaagcgccgcguccgccgcaagaccuucgucuccgaccuccucccccccaccgacaaggagcuccgcgagaccaucgcccuccucaccgcccagcagaccgcccucgagaucaucgucaacaugugcugcaacgaggaccccuccgacgacgagugggaggagcucuccuccuccgacgaguccgacgccuucauggagaacuccuucuccgagugcggcggccagcucuucuccccccucugccucucccacgagguccacaccgcccucaccaacuaccucauccccaagaagaucuucgagaagaccgccuuccccaacuccaucgccgucgaccucugcucccgcaaccccaccuggaagccccucauccgcaagaugaacaccauccagugccgcgcccucuucugccuccagucccucgucucccuccucgacgucgagcaccucggcggcgccgccgcccuccagacccucgcccagcaccucucccagcuccucuucucccagcccgacuucgccaagcacgucgacuuccucgaggccaucuccuccgcccuccgcgcccuccuccagaccauggccuccaagaacaucucccagugcaugacccccgaccagcucaugacccucugcaaggccggcauccacuccuccaacgucggcguccgcgucaacgucgucuccauccucggcaucaccggcuccguccucgccaaggaggacggcacccucgagacccucaagaacaucggcugcuuccuccucgaggucaccaccaaggaccccucccucgucgucgccggcgaggcccucgacgcccucuucgacgucuucgccgacggcaaggaggccgagcgcgccuccauccagaucaagcuccucuccgcccucaaggaguuccagcccgucuucaagaugaagauccgcaaggagggccgcggcaacuacuccaccgaccagcucugcguccucgacaacgucaagaugaaccuccgccgcuucaucgccuaccaggagaccgucgagaagcgccucaccuccuga

SEQ ID NO: 44092 - RNA, 6216 nt, Artificial Sequence
  derived and/or modified sequence opt2 from HEATR5B__Homo_sapiens__NP_061897
auggagcucgcccacucccuccuccucaacgaggaggcccucgcccagaucaccgaggccaagcgccccgucuucaucuucgaguggcuccgcuuccucgacaagguccucgucgccgccaacaagaccgacgucaaggagaagcagaagaagcucgucgagcagcucaccggccucaucuccuccucccccggcccccccacccgcaagcuccucgccaagaaccucgccgcccucuacuccaucggcgacaccuucaccgucuuccagacccucgacaagugcaacgacaucauccgcaacaaggacgacaccgccgccuaccuccccaccaagcucgccgccgucgccugcgucggcgccuucuacgagaagaugggccgcaugcucggcuccgccuuccccgagaccgucaacaaccuccucaagucccucaaguccgccgagucccagggccgcuccgagauccucaugucccuccagaagguccucuccggccucggcggcgccgccgccuccucccaccgcgacaucuacaagaacgcccgcucccuccucaccgaccgcuccauggccguccgcugcgccgucgccaagugccuccucgagcuccagaacgaggccgucuucauguggaccgccgagcucgagaacaucgccacccucugcuucaaggcccucgagaacuccaacuacggcguccgcgucgccgucuccaagcuccucggcaccgucauggccaccgcccucaugcccaagcaggccaccgucaugcgccagaacgucaagcgcgccaccuucgacgagguccucgagcucauggccaccggcuuccuccgcggcggcuccggcuuccucaaguccggcggcgagaugcucaaggucggcggcuccgucaaccgcgagguccgcgucggcgucacccaggccuacgucgucuucgucaccacccucggcggccaguggcucgagcgcuccuucgccaccuuccucucccacguccucgaccucgucucccacccccgcgccacccagacccacgucgaggccgucuacucccgccgcugcgucuccuucauccuccgcgccaccgucggcucccuccucggcgagaaggcccagaucgccgccgccaaggagaucugccaggccaucggcaagcagaugaaggccgucgaggccgucgucaacgacaccuccggcgagaacaaguccggcgccgccgacaucgccgccucccagcacgucauggucugcgcccuccaggagcucggcucccucguccagucccucaacgccaccgccuccccccucauccaggaggccuccaucggccuccucgagaucgucaccuccguccuccuccaccccuccauggccgcccgccucgccgccgccuggugccuccgcugcgucgccgucgcccuccccuuccagcucacccccuuccucgaccgcugcgccgagcgccucaacaaccucaagaccucccccgaggccgucuccggcuacuccuucgccauggccgcccuccucggcggcguccaccagugcccccucggcaucccccacgccaagggcaagauggucgucuccaucgccgaggaccuccuccgcaccgccgcccagaacucccgccucucccuccagcgcacccaggccggcuggcuccuccucggcgcccucaugacccucggccccuccgucguccgcuaccaccuccccaagaugcuccuccucuggcgcaacgucuucccccgcucccucaaggagcucgaggccgagaaggcccgcggcgacuccuucaccuggcaggucacccucgagggccgcgccggcgcccucugcgccaugcgcuccuucgucgcccacugccccgagcuccucaccgaggacgucauccgcaagcucaugacccccaucgagugcgccaugaccaugaugucccacauccccuccgucaugaaggcccacggcgcccaccucaaggccuccgccgccaugguccgccuccgccucuacgacauccucgcccuccucccccccaagaccuacgagggcuccuucaacgcccuccuccgcgagcucgucgccgaguucacccucaccgacaacuccgccaacaccaccaccucccuccuccgcucccucugccacuacgacgacuccguccuccucggcuccuggcuccaggagaccgaccacaaguccaucgaggaccagcuccagcccaacuccgccuccggcuccggcgcccucgagcacgaccccuccuccaucuaccuccgcauccccgccggcgaggccguccccggcccccucccccucggcgucuccgucaucgacgccuccgucgcccucuucggcgucgucuucccccacgucuccuacaagcaccgccuccagaugcucgaccacuucgccgagugcgucaagcaggccaagggcguccgccagcaggccguccagcucaacaucuucaccgccguccucuccgcccucaagggccucgccgagaacaaguccacccucggccccgaggagguccgcaaguccgcccucacccucgucaugggcccccucgacaaccccaaccccauccuccgcugcgccgccggcgaggcccucggccgcauggcccaggucgucggcgaggccaccuucaucgcccgcauggcccaguacuccuucgacaagcucaaguccgcccgcgacgucgucucccgcaccggccacucccucgcccucggcugccuccaccgcuacgucggcggcaucggcuccggccagcaccucaagaccuccgucuccauccuccucgcccucgcccaggacggcaccucccccgagguccagaccuggucccuccacucccucgcccucaucgucgacuccuccggccccauguaccgcggcuacgucgagcccacccucucccucguccucacccuccuccucaccgucccccccucccacaccgagguccaccagugccucggccgcugccucggcgccaucaucaccaccgucggccccgagcuccagggcaacggcgccaccaccuccaccauccgcuccuccugccucgucggcugcgccaucacccaggaccacuccgacucccucguccaggccgccgccaucuccugccuccagcagcuccacauguucgccccccgccacgucaaccucuccucccucguccccucccucugcguccaccucugcuccucccaccuccuccuccgccgcgccgccgucgccugccuccgccagcucgcccagcgcgaggccgccgaggucugcgaguacgccaugucccucgccaagaacaccggcgacaaggaguccuccuccgccaacgucucccccuucgcccccggcgucuccucccgcaccgacauccacugccgccaccagggcgucaacaucaccgagaccggccucgagggccuccucuucggcaugcucgaccgcgagaccgaccgcaagcucugcuccgacauccacgacacccucggccacaugcucuccucccucgccgucgagaagcucucccacuggcucaugcucugcaaggacguccucgccgccuccuccgacauguccaccgccacccuccucuccuccggcaaggacgaggaggccgagaagaaggacgagauggacgacgacaccauguucaccacccucggcgaggaggacaaguccaagcccuucgucgccccccgcugggccacccgcgucuucgccgccgacugccucugccgcaucaucaaccucugcgagaacgccgaccaggcccacuucgaccucgcccucgcccgcuccgccaagcuccgcaaccccaccaacgaccuccucguccuccaccucuccgaccucauccgcauggccuucauggccgccaccgaccacuccaaccagcuccgcauggccggccuccaggcccucgaggacaucaucaagaaguucgccuccguccccgagcccgaguuccccggccacgucauccucgagcaguaccaggccaacgucggcgccgcccuccgccccgccuucucccaggacacccccuccgacaucaucgccaaggccugccaggucugcuccaccuggaucggcuccggcgucgucuccgaccucaacgaccuccgccgcguccacaaccuccucgucuccucccucgacaagguccaggccggcaagggcuccuccucccagcucuaccgcgaguccgccaccaccauggagaagcucgccguccucaaggccugggccgaggucuacgucgucgccaugaacaucaagaaggaggccgaguccaagcccaagcgcgccaucaagaacaccgacgacgacgacgacgacugcggcaccaucgacgagcucccccccgacucccucaucacccucguccagcccgagcuccccacccucucccgccucuggcucgccgcccucaaggacuacgcccuccucacccuccccgccgaguucuccucccagcucccccccgacggcggcgccuucuacacccccgagaccaucgacaccgcccgccuccacuaccgcaacuccugggcccccauccuccacgccgucgcccucuggcucaacuccaccggcuucaccugcuccgaguccaccgaggccgccgccaucuccggccuccagaagcgcuccaccuccgucaaccucaaccaggccuccggcgccgucggcuccgccaagucccuccccgagaucaacaaggaccgcaugcaccucauccucggcgucuccauccaguuccucugcuccccccgccccgaggagcccaucgagcacgucaccgccugccuccaggcccuccacacccuccucgacucccccuacgcccgcguccacaucgccgaggaccagcucaucggcgucgagcuccucuccguccuccaccgccuccuccucaccuggaaccccuccuccguccagcuccucgucaccggcgucguccagcagaucguccgcgccgcccaggacuaccuccaggagaagcgcaacacccucaacgaggacgacauggagaaggaggccugcaccguccucggcgagggcggcgacuccggcggccucauccccggcaagucccucgucuucgccaccauggagcuccucauguucauccucguccgccacaugccccaccucuccaccaaggucuccgacucccccucccacaucgccaccaagacccgccucuccgaggaguccgcccgccucgucgccgccaccgucaccauccucuccgaccuccccucccucugcucccccgccggcugcaugaccauccuccccaccauccucuuccucaucgcccgcauccucaaggacaccgccaucaaguccgccgacaaccagguccccccccccgucuccgccgcccuccagggcaucaaguccaucgucacccucuccauggccaagaccgaggccggcguccagaagcaguggaccgcccucauccgcuccacccucgccugcauccucgaguacucccagcccgaggacuccguccccacccccgacgaggucuccaugcucaccgccaucgcccucuuccucugguccgccuccaacgagaucaucggcguccagucccuccagaacggcugcaugaaccgcuucaagaacgcccucaacuccugcgaccccuggguccaggccaagugcuaccagcuccuccucuccgucuuccagcacuccaaccgcgcccucuccacccccuacauccacucccucgcccccaucgucgucgagaagcucaaggccgucgagcgcaaccgccccgccuccaacaucgagcuccucgccguccaggagggcaucaagguccucgagacccucgucgcccucggcgaggagcagaaccgcguccagcuccucgcccuccucguccccacccucaucuccuaccuccucgacgagaacuccuucgccuccgccuccuccgccuccaaggaccuccacgaguucgcccuccagaaccucaugcacaucggcccccucuacccccacgccuucaagaccgucaugggcgccgcccccgagcucaagguccgccucgagaccgccguccgcgccucccaggccuccaaggccaaggccgccgcccgccagcccgcccccgccauccacuccgcccccaccaucaagcucaagaccuccuucuucuga

SEQ ID NO: 44093 - RNA, 3546 nt, Artificial Sequence
  derived and/or modified sequence opt2 from HEATR6__Homo_sapiens__NP_071353
auggccgccguccaggucgucggcuccuggcccuccguccagccccgcgaggccccccgcgaggccauccccgagcgcggcaacggcuuccgccuccucuccgcccgccucugcgcccuccgccccgacgacuccuccuccgcccgcaccgagauccaccuccucuucgaccagcucaucuccgagaacuacuccgagggcuccggcgucgcccccgaggacgucuccgcccuccucguccaggccugccgccucgucccccucaaccagaaccaccucgucuccaaggucucccagcucauccaccaccuccucaaccgccuccaggucaucgucgacgagcagcaccucgacuuccuccucgccuacaccaucuccgccauccaccagugcuccuccuggacccaccgcgagauccuccaggcccucgccgcccucgucuacugcaacggcuccaagugccagaaguaccuccccgagcuccucggcaacaccggccuccucaugaagcucuccgaccucgcccaguccgaccccgagguccgccgcgccgccguccacugcauggccaaccucugccucuccguccccggccagcccuaccucgaggagcccuaccagaacgucugcuuccaggccuuccucaccauccuccagucccccaaguccuccgacauggacgacaucaccuucugcaugcuccuccagaacgcccucaagggcauccagucccuccucaacggcggccgcaugaagcucacccagaccgacgagcucggcgcccuccucgccguccucaagaaguucauguuccacggccuccccggccucaacaucgagaugcccaccguccucuaccccaccccccucccccaguacgacggccgcacccccaucaagccccagcaguccgaguccuccgccucccgccccacccucaacaagaagaagaaguccaaggucaagcccaagaagauccagcagggcgaggaggaggagaaggaguccuccggcgagaucgaggccgcccccgucaccggcaccggccgcgucaaccuccacgagggcaacaccuggugccccuccucccucggcguccagucccucccccucgacggcuccggcgccgccgagaaggacggcgucuccuccuccuucuccuccuccuccuggaagcgcgucuccuccuccgaguccgacuucuccgacgccgagggcggcaugcaguccaagaugcgcuccuaccaggccaagguccgccagggcgcccucgucugcuuccucuccaccaucaaguccaucgagaagaagguccucuacggcuacugguccgccuucauccccgacacccccgagcucggcuccccccaguccgucucccucaugacccucacccucaaggaccccucccccaagacccgcgccugcgcccuccagguccucuccgccauccucgagggcuccaagcaguuccucuccgucgccgaggacaccuccgaccaccgccgcgccuucacccccuucuccgucaugaucgccugcuccauccgcgagcuccaccgcugccuccuccucgcccucgucgccgaguccuccucccagaccgucacccagaucaucaagugccucgccaaccucgucuccaacgcccccuacgaccgccucaagcucucccuccucaccaaggucuggaaccagaucaagcccuacauccgccacaaggacgucaacguccgcgucuccucccucacccuccucggcgccaucgucuccacccacgccccccuccccgagguccagcuccuccuccagcagcccugcuccuccggccucggcaacuccaacuccgccaccccccaccucuccccccccgacugguggaagaaggcccccgccggccccucccucgaggagaccuccgucuccucccccaagggcuccuccgagcccugcuggcucauccgccucugcaucuccaucgucguccuccccaaggaggacuccugcuccggcuccgacgccggcuccgccgccggcuccaccuacgagcccucccccaugcgccucgaggcccuccagguccucacccuccucgcccgcggcuacuucuccaugacccaggccuaccucauggagcucggcgaggucaucugcaagugcaugggcgaggccgaccccuccauccagcuccacggcgccaagcuccucgaggagcucggcaccggccucauccagcaguacaagcccgacuccaccgccgcccccgaccagcgcgcccccgucuuccucgucgucauguucuggaccaugaugcucaacggcccccucccccgcgcccuccagaacuccgagcaccccacccuccaggccuccgccugcgacgcccucuccuccauccuccccgaggccuucuccaaccuccccaacgaccgccagaugcucugcaucaccguccuccucggccucaacgacuccaagaaccgccucgucaaggccgccaccucccgcgcccucggcgucuacguccucuuccccugccuccgccaggacgucaucuucgucgccgacgccgccaacgccauccucaugucccucgaggacaagucccucaacguccgcgccaaggccgccuggucccucggcaaccucaccgacacccucaucgucaacauggagacccccgaccccuccuuccaggaggaguucuccggccuccuccuccucaagaugcuccgcuccgccaucgaggccuccaaggacaaggacaaggucaaguccaacgccguccgcgcccucggcaaccuccuccacuuccuccagcccucccacaucgagaagcccaccuucgccgagaucaucgaggaguccauccaggcccucaucuccaccguccucaccgaggccgccaugaagguccgcuggaacgccugcuacgccaugggcaacgucuucaagaaccccgcccucccccucggcaccgcccccuggaccucccaggccuacaacgcccucaccuccgucgucaccuccugcaagaacuucaagguccgcauccgcuccgccgccgcccucuccguccccggcaagcgcgagcaguacggcuccgucgaccaguacgcccgcaucuggaacgcccucgucaccgcccuccagaaguccgaggacaccaucgacuuccucgaguucaaguacugcgucucccuccgcacccagaucugccaggcccucauccaccuccucucccucgccuccgccuccgaccuccccugcaugaaggagacccucgagcucuccggcaacaugguccaguccuacauccuccaguuccucaaguccggcgccgagggcgacgacaccggcgccccccacuccccccaggagcgcgaccagaugguccgcauggcccucaagcacaugggcuccauccaggcccccaccggcgacaccgcccgccgcgccaucaugggcuuccucgaggagauccucgccgucugcuucgacuccuccggcucccagggcgcccuccccggccucaccaaccaguga

SEQ ID NO: 44094 - RNA, 570 nt, Artificial Sequence
  derived and/or modified sequence opt2 from HEBP1__Homo_sapiens__NP_057071
augcucggcaugaucaagaacucccucuucggcuccgucgagaccuggcccuggcagguccucuccaagggcgacaaggaggaggucgccuacgaggagcgcgccugcgagggcggcaaguucgccaccgucgaggucaccgacaagcccgucgacgaggcccuccgcgaggccaugcccaaggucgccaaguacgccggcggcaccaacgacaagggcaucggcaugggcaugaccguccccaucuccuucgccgucuuccccaacgaggacggcucccuccagaagaagcucaaggucugguuccgcauccccaaccaguuccaguccgacccccccgcccccuccgacaaguccgucaagaucgaggagcgcgagggcaucaccgucuacuccaugcaguucggcggcuacgccaaggaggccgacuacgucgcccaggccacccgccuccgcgccgcccucgagggcaccgccaccuaccgcggcgacaucuacuucugcaccggcuacgacccccccaugaagcccuacggccgccgcaacgagaucuggcuccucaagaccuga

SEQ ID NO: 44095 - RNA, 618 nt, Artificial Sequence
  derived and/or modified sequence opt2 from HEBP2__Homo_sapiens__NP_055135
auggccgagccccuccagcccgaccccggcgccgccgaggacgccgccgcccaggccgucgagacccccggcuggaaggcccccgaggacgccggcccccagcccggcuccuacgagauccgccacuacggccccgccaagugggucuccaccuccgucgaguccauggacugggacuccgccauccagaccggcuucaccaagcucaacuccuacauccagggcaagaacgagaaggagaugaagaucaagaugaccgcccccgucaccuccuacgucgagcccggcuccggccccuucuccgaguccaccaucaccaucucccucuacauccccuccgagcagcaguucgaccccccccgcccccucgaguccgacgucuucaucgaggaccgcgccgagaugaccgucuucguccgcuccuucgacggcuucuccuccgcccagaagaaccaggagcagcuccucacccucgccuccauccuccgcgaggacggcaaggucuucgacgagaaggucuacuacaccgccggcuacaacucccccgucaagcuccucaaccgcaacaacgaggucuggcucauccagaagaacgagcccaccaaggagaacgaguga

SEQ ID NO: 44096 - RNA, 1632 nt, Artificial Sequence
  derived and/or modified sequence opt2 from HECA__Homo_sapiens__NP_057301
augcccaaccccaagaacuccaagggcggccgcaagaacaagcgcgccaacuccuccggcgacgagcaggagaacggcgccggcgcccucgccgccgccggcgccgccggcgccgccgccggcggcgcccucgccgccgccgccggcugcggcgccgccgccgccggcgcccccggcgccggcggcgccgccggcgccggcggcgccggcaccggcgccgccaacgccgccgccgccgccggcgccgccgccgccggcgacgccaagaacgaggcccccugcgccaccccccucaucugcuccuucggccgccccgucgaccucgagaaggacgacuaccagaaggucgucugcaacaacgagcacugccccugcuccaccuggaugcaccuccagugcuucuacgagugggaguccuccauccucguccaguucaacugcaucggccgcgcccgcuccuggaacgagaagcagugccgccagaacauguggaccaagaagggcuacgaccucgccuuccgcuucugcuccugccgcugcggccagggccaccucaagaaggacaccgacugguaccaggucaagcgcaugcaggacgagaagaagaagaaguccggcuccgagaagaacaccggccgcccccccggcgaggccgccgaggaggccaagaagugccgcccccccaacaagccccagaagggccccucccacgaccucccccgccgccacuccauggaccgccagaacucccaggagaaggccgucggcgccgccgccuacggcgcccgcucccccggcggcucccccggccaguccccccccaccggcuacuccauccucucccccgcccacuucuccggcccccgcuccucccgcuaccucggcgaguuccucaagaacgccauccaccucgagccccacaagaaggccauggccggcggccacgucuuccgcaacgcccacuucgacuacucccccgccggccucgccguccaccgcggcggccacuucgacacccccguccaguuccuccgccgccucgaccucuccgagcuccucacccacaucccccgccacaagcucaacaccuuccacguccgcauggaggacgacgcccaggucggccagggcgaggaccuccgcaaguucauccucgccgcccucuccgccucccaccgcaacgucgucaacugcgcccucugccaccgcgcccuccccgucuucgagcaguucccccucgucgacggcacccucuuccucucccccucccgccacgacgagaucgaguacgacguccccugccaccuccagggccgccucaugcaccucuacgccgucugcgucgacugccucgagggcguccacaagaucaucugcaucaagugcaagucccgcugggacggcuccuggcaccagcucggcaccauguacaccuacgacauccucgccgccucccccugcugccaggcccgccucaacugcaagcacugcggcaagcccgucaucgacguccgcaucggcaugcaguacuucuccgaguacuccaacguccagcagugcccccacugcggcaaccucgacuaccacuucgucaagcccuucuccuccuucaagguccucgaggccuacuga

SEQ ID NO: 44097 - RNA, 2343 nt, Artificial Sequence
  derived and/or modified sequence opt2 from HECTD2__Homo_sapiens__NP_001271203
auguccgaggccguccgcguccccucccccgccaccccccucgucgucgccgccgccgcccccgaggagcgcaagggcaaggaguccgagcgcgagaagcucccccccaucgucuccgccggcgccggcgccaccgccggccucgaccgcggcgccaagggccagaucuccaccuucuccuccuucaucuccgccgucucccccaagaaggaggccgccgagaaccgcuccucccccgcccaccucgucuuccccaacaucaagaacguccgcgagcccccccccaucugccucgacguccgccagaagcagcgcaccuccauggacgccuccuccuccgagaugaaggcccccguccuccccgagcccauccuccccauccagcccaagaccgucaaggacuuccaggaggacgucgagaaggucaaguccuccggcgacuggaaggccguccacgacuucuaccucaccaccuucgacuccuuccccgagcucaacgccgccuucaagaaggacgccaccgccuccuucaacaccaucgaggacuccggcaucaacgccaaguucgucaacgccgucuacgacacccuccucaacaccccccaggacguccagaagaccguccucaagggcaucaucaacucccuccuccgcgaguggaagggcccccgcaccaaggacgaccuccgcgccuacuucauccuccuccagaacccccaguucaacaacaccuccaccuacgucaucuacgcccaccuccuccgccagaucgccacccucgucgaggccgaccaccacuuccucguccacugguucaagaagcaguacucccgccucucccagaagcgcuucaagcagcucgucgagcgccuccuccaguucaucucccuccgccucuuccccgccaagcccgaggaguucccccccaucaccaagugcuccugguggauccccuccgccgccaagguccucgcccuccucaacaccgccaacaaccucguccaccccccccucauccccuacaccgacuucuacaacuccacccucgaccacaucgaccucauggaggaguaccacaccuggcagaacuucggcaacucccaccgcuucuccuucugccaguaccccuucgucaucuccgucgccgccaagaagaucaucauccagcgcgacuccgagcagcagaugaucaacaucgcccgccagucccucgucgacaaggucucccgccgccagcgccccgacaugaacauccucuuccucaacaugaagguccgccgcacccaccucgucuccgacucccucgacgagcucacccgcaagcgcgccgaccucaagaagaagcucaaggucaccuucgucggcgaggccggccucgacaugggcggccucaccaaggagugguuccuccuccucauccgccagaucuuccaccccgacuacggcauguucaccuaccacaaggacucccacugccacugguucuccuccuucaagugcgacaacuacuccgaguuccgccucgucggcauccucaugggccucgccgucuacaacuccaucacccucgacauccgcuucccccccugcugcuacaagaagcuccucuccccccccaucauccccuccgaccagaacauccccgucggcaucugcaacgucaccgucgacgaccucugccagaucaugcccgagcucgcccacggccucuccgagcuccucucccacgagggcaacgucgaggaggacuucuacuccaccuuccaggucuuccaggaggaguucggcaucaucaaguccuacaaccucaagcccggcggcgacaagaucuccgucaccaaccagaaccgcaaggaguacguccagcucuacaccgacuuccuccucaacaaguccaucuacaagcaguucgccgccuucuacuacggcuuccacuccgucugcgccuccaacgcccucaugcuccuccgccccgaggaggucgagauccucgucugcggcucccccgaccucgacaugcacgcccuccagcgcuccacccaguacgacggcuacgccaagaccgaccucaccaucaaguacuucugggacgucguccucggcuucccccucgaccuccagaagaagcuccuccacuucaccaccggcuccgaccgcguccccgucggcggcauggccgaccucaacuucaagaucuccaagaacgagaccuccaccaacugccuccccgucgcccacaccugcuucaaccagcucugccucccccccuacaaguccaagaaggaccucaagcagaagcucaucaucggcaucuccaacuccgagggcuucggccucgaguga

SEQ ID NO: 44098 - RNA, 12855 nt, Artificial Sequence
  derived and/or modified sequence opt2 from HECTD4__Homo_sapiens__NP_001103132
augggccuccuccucgucuucccccucauccagucccagucccgcaccgaccccucccucugcaacaucaccgccgagguccuccucaacugccuccgcgacugccagccccucucccucaccaaggagcccgccgacugccucaacggcaucgagacccuccucugcuccuggcucgaggagaccuccgacaccggccgccacaucccccacaagcagaaggagaacgccgccgccgcccucgucgcccucgccugcgcccgcggcucccucaagaccuucguccacaccguccaccuccuccagaagcagaccgaccucggcucccuccccgucgccgacguccucuaccgccuccuccuccucgagggcggccccggcucccccuccugccuccucggcggcaagcacaucgucuccuggggcuacgaggacaugcuccccgcccccgacuccaacaccggcuccuccuccgagaacaaggacgccgaccucggccgcugccucaccgccgacggccucuaccucuacaccaccaacuccgucggccgcggcgucuccaagcucggcuccggccuccacggcacccuccgcggcuucgucuacugccgcaacgaggagcucgagcccggcugggucgccuucggcuccggcucccuccuccaccgccccgucuccuucgacaacaagccccacucccucuuccaggucaucgaccagaacacccuccaggucugccaggucguccccaugcccgccaaccaccuccccaucggcuccaccauguccaccguccaccucuccuccgacggcaccuacuucuacuggaucuggucccccgccucccucaacgagaagacccccaagggccacuccgucuucauggacaucuucgagcucgucgucgagaacggcgucuucgucgccaacccccuccaggagcgcaccauccucaugcgcaaggagggcgaguccgccaaguccaucaacgagaugcuccucucccgccucucccgcuaccgcgccucccccuccgccacccucgccgcccucaccggcuccaccaucuccaacacccucaaggaggaccaggccgccaacaccuccugcggccucccccucaagaugcuccgcaagacccccaucuacaccugcggcaccuaccucgucaugcucguccccccccccggcggcuccggcuccuccgccacccgcucccucuucggcggcaccuccggccucuccucccucaagauccucgccuccucccucgucuacaacaucuccgacggccaguucaccucccgcgccgaccucaucgacgccgccggcuccucccucggccgcggcgcccucguccccggccucggcgccugcuacgacaccgucaacaacaugcucuggaccugcuccaacgacuacaucgaccaguggugcaaccccggcaaccaggccuuccacuacgucugccagcgccucggcgucucccacaucaucaccgagcccaaggaggaggccaucaccaccaacgaggucaucaaccagcuccuccaccacgucggcgccaugugcauccaccagcucaaccuccucgccaccaaccccaaccuccccaucaccuccguccucggcaagcagcaccccaucgaggcccaccaccucuccuccaucugcgacaucauggagaaggccauggucaacggcgacaccugcaucauccgcugcauccucgucgucuuccaggucgucuucaaguucuucuucuccccccagaccgagcgcaaccgcgacaucauccgccgcuccggccuccuccucuggcagcuccucauggcccccaaggaccagaucugccccgagauccagaaggaggucugccucgccaucuccuccggccucaacauccucuaccccggcgagaccgagaucaacaaccuccucaagcucguccucaccgagggcgagcgcaacuccggccucucccagcuccgcgacgucauccucaccaaccucgccgagcagcuccagaacaaccgcuucggcuccgacgaggacgaccacuaccgccucaacgacgagcuccuccacuacauccucaagaucgucguccgcgaguccugcauccucaucaccaagugccagaccgucuccaaggacgacuuccagaagcuccucuccaccguccccgccgccuccuccugccuccgcuaccucauggccguccagaaccaccuccucuccaacaccauccucaucaagcccgacgagaacgacgacuccgacuccucccuccagggcgagacccucaagguccaggagcucaaggucuccauccucgcccucgccacccagauccucaccggcugcgacgagguccucgagaugcuccagcaggucaccaccgcccucaucaacuccgacaucgccgaccgcgagcagcgccucaagggccucgagcaggucaccaaggccaccaugcucggccaccuccuccccguccuccucaccucccucaugcaccccaaccuccagacccucaucauggccgacgcccucaugccccagcucguccagcucguccucuacaccucccagaccgcccuccuccucaagacccagugccccgucuucgccgaggucggcugcucccccugcggcgcccccgaccagaagugccgccucuuccccgacgagcgcaugcucgaggagaaggaggagcccggcuuccucaccggccucaagauccccgcccccugggccgccggcaagaccgucgagaccguccaccccguccgcgacaacuacaaguucaaggagaccguccacauccccggcgcccgcugccucuaccuccgcuucgacucccgcugcuccucccaguacgacuacgacaagcucgucaucuacgccggccccaacaccaacucccgcaaggucgccgaguacggcggcaacacccucggcuacggcucccgcuccguccucggcaccggcuggcccaaggaccucgucaagugcaucuccccccccucccucaacuucaaggucgagggcgacaccgucaccuucuccuucgagaugcgcuccggccgcgagcacaacacccccgacaaggccauguggggcuucgccugcaccguccgcgcccaggaguccuccgaggacgucuccggcggccuccccuuccucgucgaccucgcccucggccucuccguccucgccugcuccaugcuccgcauccucuacaacggccccgagaucaccaaggaggaggaggccugccaggagcuccuccgcuccaagcuccuccagcgcugccaguggcaggucgaggccaacggcgucaucucccccgcccucacccccucccccuccccccucccccucaccaucgaggaggaccgcgaguucaccuaccccuccgacguccucgucccccccgucggcaacuacuucgaccucccccgcauccgccucccccccggcaucaugaucaagcuccgcgagaucuccggccgcgcccgcccccaguuccgccccuccaucaaggaggucauccagcccgacgucauggaggagauggucgucuccugcgucaucaagcaccucaaccucgucgacgcccuccagucccucaucaacuuccaguaccaggaggagcacgccgaggaguacgaccuccucugcaagaucaugggcgagaccuucaagaagcucaacgccauggagcgccagcuccaguccgucgccgagcucgagcagaaguggcaguccgaggucgacgacgccaugcagggcaagcucgagaacaacaugcccuucuucuacgacuaccacuucaacgagaacaagaugaaggagcucgagcuccucugcuccaugaaggaggucuccuucgacggcaacgaccucgagaacaugguccucucccuccgcgagaaguuccuccaggaggucaacucccucauccagaagcccucccacccccucgccaagaccaagacccucgucaagucccucaugaaccgcgccgagcuccuccuccacgucaccaucgccgcccaguccggccucacccgcuccaucuccggcacccccgccgagacccccgccugcaaguccgccuccgagaccaaggucaucucccacgccguccgccagcccgucuuccuccgcuccauguccgcccccuccgaccucgagaugaucggcaacgaggaccucgaguucacccgcgccaaccagcgccgccgccacgucaccucccaccgcuccuccuccuucacccuccuccagucccucgccaucgaggacucccgcgacaagcccaccuacuccguccuccucggccagcucuucgccuucaucggcaccaaccccgaccaggccgucuccuccuccuccuuccuccucgccgcccagacccgcuggcgccgcggcaacacccgcaagcaggcccucguccacaugcgcgagcuccucaccgccgccguccgcgucggcggcgucacccaccucgucggccccgucaccaugguccuccagggcggcccccgcaucgaggagcucaccugcggcggcauggucgagcagguccaggaggccuucggcgagaccaugaccuccgucgucucccucugcgcccgcuaccccaucgccugcgccaacuccaucggccuccucugcaccauccccuacacccgcuccgaggagaagugccucguccgcuccggccucguccagcucauggaccgccucugcucccucuccaaccagaccgaguccuccuccuccgagaagcagaccaagaagcagaaggucgccaccauggccugggccgccuuccagguccucgccaaccgcugcgucgagugggagaaggaggagggcggcuccaccgaggccguccacuccggccucgcccgccaggucuccucccuccucaccaaccaccucgcccgcgccaccgagugcugcggcaaccaggccgccggcaacgacgcccuccaggacguccucucccuccucaacgaccucucccgcucccacaucggcaaggccauccucucccagcccgccugcgucuccaagcuccucucccuccuccucgaccagcgccccucccccaagcucguccucaucauccuccagcucugccgcgccgcccucccccucauguccgucgaggacugcggcaacgucgagcucccccccugguccuacuccguccccucccucaacuccgagcaggaggaccccuccgaccccgccuccaagaucgccucccuccuccucgccaagcucgccgacuacgucguccccggcugccagaccguccucucccccaccgccuccgagcccgacaccacccucaccaagaccucccccaagaacucccucaagggcgacaaggaccccggcgaggaguccgaggccgucgacggcaagcucuccaucuucauccacaagcgcgaggaccaguccucccacgagguccuccagccccuccucuccuccuccgagggccgccccuuccgccucggcaccggcgccaacauggagaaggucgucaagauggaccgcgacaugaccaagggcggcugcugcgaggucaucaccgaggaggccgccgccgcccuccgcaaggccaccaagugggcccaguccggccucaucgucuccaucggcccccccgucgaguccaucaaccccgagaccgucuccggccucuccaccggcgacaagaagaagaccgcccagaccuccaucugccgcgagcgcaacuccgagcucgcccgcaccgaccccguccgccccuucaucuccggccacgucgccaacuccauggccgccgaggucaucgcccuccuccacucccuccucauggcccccgaguccaacgccgcccagaucuggaccaccaccgccgagaagguccucucccgcgcccucauguacaucccccagcucggcaaguacgccgaguccauccucgagaacggcuccuccuccggccgcaagcucgccaagcuccagcgcaucgcccgccaggccgucgccgcccucugcgcccucggcggcuucaaggagaccaucaagaucggcuccgagguccagguccucggccgcggcaucuccggcuccaucggcgucgucgccuccaucaacgagcaggagggcaucgccaccguccgcuucccccccaucgacugccgcaagaccucccaggccuccgacacccucaccaucccccucucccgccucugcgucccccgcuccgaggcccucccccuccacaagcucuccaucaccgagaaggucguccaggccguccaguccaugcuccucccccaggagggcucccucuccauccacaccucccuccccgccaccggcgacggcuccgcccccgucauggccgucguccgccuccucgccgagauccgcacccgcgccugccucgucauggcccagcuccucgaggacucccucuucugcgaggaguucauccagcagugccccgccgccgucgagguccucaaccucgucgcccaggagugcuccgccggcgagcgccucgccgucgucgagguccagugcgagcgccuccgcaugcucuaccgcgacugcgcccgcccccccccccccccccuccaggccgaccgccgccagcccaaggagaucaccuggucccccucccgcgucuucccccccguccgcgccugcauguucuccucccaccucaccuccgucaccuuccucgccgaccccuccgccggcggcggccucccccgcggcaccuucaucuacgccaccuccccccuccccguccaggcccccuccuucuacugggagaucgagaucgucuccuacggcgacaccgacgacgacaccggccccaucgucuccuucggcuucaccaccgaggccgagaagcgcgacggcgccuggaccaaccccgucggcaccugccucuuccacaacaacggccgcgccguccacuacaacggcuccucccuccuccaguggaaguccguccgccucgacgucacccucucccccggcgacgucgccggcaucggcugggagcgcaccgagggcaccccccccccccccggccagcccgccaagggccgcgucuacuucaccuacugcggccagcgccucucccccuaccucgaggacgucuccggcggcauguggcccgucguccacauccagaagaagaacaccaagacccgcgccaacuucggcucccgccccuucgccuacgccgagggccaggcccaccgcaacgccgccgaccucugcaccgaccucgccgaggagaucuccgccaacuucgaggcccuccccuucgccauggccuccgacuccgacaacgacgccggcaccuccaucgccuccgaccccggcacccacggcccccccugccgcaucgccgccgucgccaccgcccagcagcaguacgacuccgacaccuccugccacuacaaggucgagcucuccuacgagaacuucaucaccuccggccccgacccccaccccccccccaucgccgacgacgaguccgacgacgacgacgacgacgacaucccccaggaggaccacuacgcccuccucgucaaggccugggagaccaaggucuuccccaccauccgccgccgcuuccgcaacgaggccgagcgcaaguccggccucgaccagaucaagggcgcccuccagcucggcauggucgacaucgcccgccagaccgucgaguuccucuacgaggagaacggcggcaucccccgcgaccucuaccuccccaccaucgaggacaucaaggacgaggccaacaaguucaccaucgacaagguccgcaagggccucaccgucgucacccgcucccccgacuccaacaacgucgccuccuccgccgucggcaccgcccuccccaaguucgccauccgcggcaugcucaagaccuucggccuccacggcgucguccucgacgucgacuccgucaacgagcucguccaggucgagaccuaccuccgcuccgagggcguccucguccgcuacugguaccccaucgacaugcucgagcgcccccccgccggcuaccgccgcaccgccaccaacggccucgucacccucgacaacaccaaccuccagauccaccgcgagcuccuccgcugcgaggccgcccucgcccgccucuacugccgcauggcccuccucaacaucuucgcccccaagcucccccaccucuucacccgccucuuccacauccccgccauccgcgacaucacccucgagcaccuccagcuccucuccaaccagcuccucgcccccccccuccccgacggcaccaucuccuccuccuccauccuccucgcccagucccuccagcacugcauccacucccagaacugcuccgccaccgaccucuucuaccagggcaacucccagaccguccgcgaguggcucaacgucgccaucacccgcacccuccaccagggcgaggagucccuccucgagcucaccaagcagaucugcuccuuccuccagaccgcccccgagcaguuccccuccgaggaguuccccaucuccgaguccaaggucaacauggacgucaacuuccccggcgccgccuucgucgucgucuccugcaaggagucccaguccggcuuccgcaaggacuccucccucuacaaggcccccugggcccgcguccucgucuacggccucggccacaaggucaagcgcaacggccagcucaaccucaucgaggccgccugcuacccccgcgacgccucccccgccaacaccggccucgcccccccccccaccgccgaccaguaccccuccgucguccucuccaccgaccgcguccacaucaagcucggcgucucccccccccccggcgccguccucguccuccacucccucccccucgaguucccccucgccauggccuucgccgagcagcuccucuccuggaaguccgaggacuccgagggcaaguccgaggacgagcccgacaccauccccaccuccguccuccuccaggucgucgagcuccucggcaacuuccucuggaccaccgacauggccgccugcgucaaggagcucgucuuccaccuccucgccgagcuccuccgcaccguccacacccucgagcagcgccgccaccccgccggccucuccuccuccaucgcccuccagcucaaccccugccucgccaugcucauggcccuccaguccgagcuccacaagcucuacgacgaggagacccagaacugggucuccggcggcgccugcggcggcuccggcggcgccgccgccggcgaccagggccgcuucuccaccuacuuccacgcccucauggagggcugccucgccgucgccgaggucacccuccccaccaacauguccgucaccgccuccggcgucaccuccgccaccgcccccaaccucuccgacuccuccuccuccuccuccuccucccccggccagaccccccagucccccucccuccucuccaagcgcaagaaggucaagaugaagcgcgagaaggccuccuccuccggcaagcgccaguccucccgcaccgucgacuccgaccccaccguccucuccaucggcggcuccaagcccgaggacaugcucugguuccaccgcgcccucacccuccucaucauccuccgccaccucacccgcaaggacccccagggccucggcgucaccuccgacgccaucgccgacgccugccaggcccucgucggccccaccgcccacucccgccuccucgucaucuccggcauccccacccaccucgacgagggcgucguccgcggcgccauccgcaaggccugcaacgcccacggcggcgucuucaaggacgagaucuacaucccccuccaggaggaggacaccaagaagcccaaggacaaggccgagggcggcgacggcaaggucgagcccgagaagacccucgccuuccccggcaccgacuccauggaggucuccaccuccuccucccucacccccgccauguccaucuccgccuccgccuccaccucccaggccuccaucugcuccucccagggcaucucccagaccgucuccgaccucuccgucgacccccuccccgccggccucgagcuccccaucccccccggccuccucgagccccacgccgucuccucccaggagucccucgacaucucccucugcuccaccggcucccucggcucccucggcucccucggcgagccccucgacaacgccgagaccgccuccgucuccgacaugggcuccauguacaccgucaccucccucgacaaccagccccucgccgcccgccccaucaagggcuucgccgucgucgagauccgcucccgcgccaagaucgagaagauccgcgccucccucuucaacaacaacgaccucaucggccucuccucccucgacggcgaggacgagcucauggagauguccaccgaggagauccucaccgucuccgucgucaaccagucccucuucgacacccagggcucccccggccucgaggacuacuucaacgacaaguccaucaagggcgagaagcucguccccggcgcccgcgagguccucaccgagaucuucaaguccugcgcccacuccgagcagacccucucccucacccccgccaagcccauccgcgucuccgacaucuaccucuccaaggagcagaucaacucccagacccccggcaaccuccuccaccucuucuucaccaacguccgcccccccaagaagguccucgaggaccagcucacccagauccuccgcaaguacggcguccccaagcccaaguucgacaaguccaaguacuccaaggccggcaaggagcagcaccccgucaaggucgucuccaccaagcgccccaucaccaagccccccgccaaggacaaggccguccucaacuccgucucccgcaccgcccucuccgagaagaagcccaccgucaagcccaagucccccgagaaguccaagcccgacgagaaggaccccgagaagucccccaccaagaagcaggagguccccgaggagaaguaccucacccucgagggcuuccacaaguucgucaucgaccgcgcccgccaggacauccgcuccgucuggcgcgccauccucuccugcggcuacgaccuccacuucgagcgcugcgccugcaucgacguccgccacgcccagaaggccucccgcaaguggacccucgagauggacgucgcccucguccaguacaucaaccagcucugccgccaccucgccaucacccccgcccgccuccacccccacgaggucuaccucgaccccgccgacgccgccgacccccgcgucgccugccuccucaacguccccaucgagucccuccgccuccgcuucgcccuccuccagucccucaacaccacccucgagaccuucuuccucccccucgucgagcuccgccagacccccauguacacccacuccaucgccgcccuccucaaggaggccaagggccucaucuucuacgacaccaaggucaccgucaugaaccgcguccucaacgccaccguccagcgcaccgccgaccacgccgcccccgagaucacccucgacccccucgagaucgucggcggcgagauccgcgccuccgagaacuccuacuucugccaggccgcccgccagcucgccuccguccccuccucccagcucugcgucaagcucgccuccggcggcgaccccaccuacgccuucaacauccgcuucaccggcgaggagguccacggcaccuccggcuccuuccgccacuuccucuggcaggucugcaaggagcuccaguccuccucccucucccuccuccuccucugccccuccuccgccgucaacaagaacaagggcaaguacauccucacccccucccccaucaccuacggcgaggagcagcuccuccacuuccucggccagcuccucggcaucgccauccgcgccgacgucccccucccccucgaccuccuccccuccuucuggaagacccucgucggcgagccccucgaccccgagcaggaccuccaggaggccgacauccucaccuacaacuacgucaagaaguucgaguccaucaacgacgagaccgagcucgaggcccucugcgccgagaucgccucccagcaccucgccaccgagucccccgacucccccaacaagcccugcugccgcuucaccuaccucaccaugaccggcgaggaggucgagcucugcucccgcggccgccacauccucgucgccugggagaacaaggacaucuacgccgccgccauccgcucccuccgccuccgcgagcuccagaacgucgagugcgucaccgccguccgcgccggccucggcuccaucaucccccuccagcuccucaccaugcucuccccccucgagauggagcuccgcaccugcggccuccccuacaucaaccucgaguuccucaaggcccacaccauguaccaggucggccucauggagaccgaccagcacaucgaguucuucuggggcgcccucgagauguucacccaggaggagcucugcaaguucaucaaguucgccugcaaccaggagcgcauccccuucaccugccccugcaaggacggcggccccgacaccgcccacgucccccccuaccccaugaagaucgccccccccgacggcaccgccggcucccccgacucccgcuacauccgcgucgagaccugcauguucaugaucaagcucccccaguacuccucccucgagaucaugcucgagaagcuccgcugcgccauccacuaccgcgaggacccccucuccggcuga

SEQ ID NO: 44099 - RNA, 4719 nt, Artificial Sequence
  derived and/or modified sequence opt2 from HECW1__Homo_sapiens__NP_001273988
augcuccuccaccucugcuccgucaagaaccucuaccagaaccgcuuccucggccucgccgccauggccucccccucccgcaacucccagucccgccgccgcugcaaggagccccuccgcuacuccuacaaccccgaccaguuccacaacauggaccuccgcggcggcccccacgacggcgucaccaucccccgcuccaccuccgacaccgaccucgucaccuccgacucccgcuccacccucauggucuccuccuccuacuacuccaucggccacucccaggaccucgucauccacugggacaucaaggaggaggucgacgccggcgacuggaucggcauguaccucaucgacgagguccucuccgagaacuuccucgacuacaagaaccgcggcgucaacggcucccaccgcggccagaucaucuggaagaucgacgccuccuccuacuucgucgagcccgagaccaagaucugcuucaaguacuaccacggcgucuccggcgcccuccgcgccaccacccccuccgucaccgucaagaacuccgccgcccccaucuucaaguccaucggcgccgacgagaccguccagggccagggcucccgccgccucaucuccuucucccucuccgacuuccaggccaugggccucaagaagggcauguucuucaaccccgaccccuaccucaagaucuccauccagcccggcaagcacuccaucuuccccgcccucccccaccacggccaggagcgccgcuccaagaucaucggcaacaccgucaaccccaucuggcaggccgagcaguucuccuucgucucccuccccaccgacguccucgagaucgaggucaaggacaaguucgccaagucccgccccaucaucaagcgcuuccucggcaagcucuccaugcccguccagcgccuccucgagcgccacgccaucggcgaccgcgucgucuccuacacccucggccgccgccuccccaccgaccacgucuccggccagcuccaguuccgcuucgagaucaccuccuccauccaccccgacgacgaggagaucucccucuccaccgagcccgaguccgcccagauccaggacucccccaugaacaaccucauggaguccggcuccggcgagccccgcuccgaggcccccgaguccuccgaguccuggaagcccgagcagcucggcgagggcuccguccccgacggccccggcaaccaguccaucgagcucucccgccccgccgaggaggccgccgucaucaccgaggccggcgaccagggcauggucuccgucggccccgagggcgccggcgagcuccucgcccagguccagaaggacauccagcccgcccccuccgccgaggagcucgccgagcagcucgaccucggcgaggaggccuccgcccuccuccucgaggacggcgaggcccccgccuccaccaaggaggagccccucgaggaggaggccaccacccagucccgcgccggccgcgaggaggaggagaaggagcaggaggaggagggcgacgucuccacccucgagcagggcgagggccgccuccagcuccgcgccuccgucaagcgcaagucccgccccugcucccuccccgucuccgagcucgagaccgucaucgccuccgccugcggcgaccccgagaccccccgcacccacuacauccgcauccacacccuccuccacuccaugcccuccgcccagggcggcuccgccgccgaggaggaggacggcgccgaggaggaguccacccucaaggacuccuccgagaaggacggccucuccgaggucgacaccgucgccgccgaccccuccgcccucgaggaggaccgcgaggagcccgagggcgccacccccggcaccgcccaccccggccacuccggcggccacuuccccucccucgccaacggcgccgcccaggacggcgacacccaccccuccaccggcuccgaguccgacuccuccccccgccagggcggcgaccacuccugcgagggcugcgacgccuccugcugcucccccuccugcuacuccuccuccugcuacuccaccuccugcuacuccuccuccugcuacuccgccuccugcuacucccccuccugcuacaacggcaaccgcuucgccucccacacccgcuucuccuccgucgacuccgccaagaucuccgaguccaccgucuucuccucccaggacgacgaggaggaggagaacuccgccuucgaguccguccccgacuccaugcagucccccgagcucgaccccgaguccaccaacggcgccggccccuggcaggacgagcucgccgcccccuccggccacgucgagcgcucccccgagggccucgagucccccgucgccggccccuccaaccgccgcgaggacugggaggcccgcaucgacucccacggccgcgucuucuacgucgaccacgucaaccgcaccaccaccuggcagcgccccaccgccgccgccacccccgacggcaugcgccgcuccggcuccauccagcagauggagcagcucaaccgccgcuaccagaacauccagcgcaccaucgccaccgagcgcuccgaggaggacuccggcucccaguccugcgagcaggcccccgccggcggcggcggcggcggcggcuccgacuccgaggccgaguccucccaguccucccucgaccuccgccgcgagggcucccucucccccgucaacucccagaagaucacccuccuccuccagucccccgccgucaaguucaucaccaaccccgaguucuucaccguccuccacgccaacuacuccgccuaccgcgucuucaccuccuccaccugccucaagcacaugauccucaagguccgccgcgacgcccgcaacuucgagcgcuaccagcacaaccgcgaccucgucaacuucaucaacauguucgccgacacccgccucgagcucccccgcggcugggagaucaagaccgaccagcagggcaaguccuucuucgucgaccacaacucccgcgccaccaccuucaucgacccccgcaucccccuccagaacggccgccuccccaaccaccucacccaccgccagcaccuccagcgccuccgcuccuacuccgccggcgaggccuccgaggucucccgcaaccgcggcgccucccuccucgcccgccccggccacucccucgucgccgccauccgcucccagcaccagcacgagucccucccccucgccuacaacgacaagaucgucgccuuccuccgccagcccaacaucuucgagaugcuccaggagcgccagcccucccucgcccgcaaccacacccuccgcgagaagauccacuacauccgcaccgagggcaaccacggccucgagaagcucuccugcgacgccgaccucgucauccuccucucccucuucgaggaggagaucauguccuacgucccccuccaggccgccuuccaccccggcuacuccuucuccccccgcugcucccccugcuccuccccccagaacucccccggccuccagcgcgccuccgcccgcgcccccucccccuaccgccgcgacuucgaggccaagcuccgcaacuucuaccgcaagcucgaggccaagggcuucggccagggccccggcaagaucaagcucaucauccgccgcgaccaccuccucgagggcaccuucaaccaggucauggccuacucccgcaaggagcuccagcgcaacaagcucuacgucaccuucgucggcgaggagggccucgacuacuccggccccucccgcgaguucuucuuccuccucucccaggagcucuucaaccccuacuacggccucuucgaguacuccgccaacgacaccuacaccguccagaucucccccauguccgccuucgucgagaaccaccucgagugguuccgcuucuccggccgcauccucggccucgcccucauccaccaguaccuccucgacgccuucuucacccgccccuucuacaaggcccuccuccgccuccccugcgaccucuccgaccucgaguaccucgacgaggaguuccaccagucccuccaguggaugaaggacaacaacaucaccgacauccucgaccucaccuucaccgucaacgaggaggucuucggccaggucaccgagcgcgagcucaaguccggcggcgccaacacccaggucaccgagaagaacaagaaggaguacaucgagcgcauggucaaguggcgcgucgagcgcggcgucguccagcagaccgaggcccucguccgcggcuucuacgaggucgucgacucccgccucgucuccgucuucgacgcccgcgagcucgagcucgucaucgccggcaccgccgagaucgaccucaacgacuggcgcaacaacaccgaguaccgcggcggcuaccacgacggccaccucgucauccgcugguucugggccgccgucgagcgcuucaacaacgagcagcgccuccgccuccuccaguucgucaccggcaccuccuccguccccuacgagggcuucgccgcccuccgcggcuccaacggccuccgccgcuucugcaucgagaaguggggcaagaucaccucccucccccgcgcccacaccugcuucaaccgccucgaccucccccccuaccccuccuacuccaugcucuacgagaagcuccucaccgccgucgaggagaccuccaccuucggccucgaguga

SEQ ID NO: 44100 - RNA, 4719 nt, Artificial Sequence
  derived and/or modified sequence opt2 from HECW2__Homo_sapiens__NP_065811
auggccuccuccgcccgcgagcaccuccucuucguccgccgccgcaacccccagaugcgcuacacccucucccccgagaaccuccagucccucgccgcccaguccuccaugcccgagaacaugacccuccagcgcgccaacuccgacaccgaccucgucaccuccgagucccgcuccucccucaccgccuccauguacgaguacacccucggccaggcccagaaccucaucaucuucugggacaucaaggaggaggucgaccccuccgacuggaucggccucuaccacaucgacgagaacucccccgccaacuucugggacuccaagaaccgcggcgucaccggcacccagaagggccagaucgucuggcgcaucgagcccggccccuacuucauggagcccgagaucaagaucugcuucaaguacuaccacggcaucuccggcgcccuccgcgccaccacccccugcaucaccgucaagaaccccgccgucaugaugggcgccgagggcauggagggcggcgccuccggcaaccuccacucccgcaagcucgucuccuucacccucuccgaccuccgcgccgucggccucaagaagggcauguucuucaaccccgaccccuaccucaagauguccauccagcccggcaagaaguccuccuuccccaccugcgcccaccacggccaggagcgccgcuccaccaucaucuccaacaccaccaaccccaucuggcaccgcgagaaguacuccuucuucgcccuccucaccgacguccucgagaucgagaucaaggacaaguucgccaagucccgccccaucaucaagcgcuuccucggcaagcucaccauccccguccagcgccuccucgagcgccaggccaucggcgaccagaugcucuccuacaaccucggccgccgccuccccgccgaccacgucuccggcuaccuccaguucaaggucgaggucaccuccuccguccacgaggacgccucccccgaggccgucggcaccauccucggcgucaacuccgucaacggcgaccucggcucccccuccgacgacgaggacaugcccggcucccaccacgacucccaggucugcuccaacggccccgucuccgaggacuccgccgccgacggcacccccaagcacuccuuccgcaccuccuccacccucgagaucgacaccgaggagcucaccuccaccuccucccgcaccucccccccccgcggccgccaggacucccucaacgacuaccucgacgccaucgagcacaacggccacucccgccccggcaccgccaccugcuccgagcgcuccaugggcgccucccccaagcuccgcuccuccuuccccaccgacacccgccucaacgccaugcuccacaucgacuccgacgaggaggaccacgaguuccagcaggaccucggcuaccccuccucccucgaggaggagggcggccucaucauguucucccgcgccucccgcgccgacgacggcucccucaccucccagaccaagcucgaggacaaccccgucgagaacgaggaggccuccacccacgaggccgccuccuucgaggacaagcccgagaaccuccccgagcucgccgaguccucccuccccgccggccccgcccccgaggagggcgagggcggccccgagccccagcccuccgccgaccagggcuccgccgagcucugcggcucccaggaggucgaccagcccaccuccggcgccgacaccggcaccuccgacgccuccggcggcucccgccgcgccgucuccgagaccgagucccucgaccagggcuccgagcccucccaggucuccuccgagaccgagcccuccgaccccgcccgcaccgaguccgucuccgaggccuccacccgccccgagggcgaguccgaccucgagugcgccgacuccuccugcaacgaguccgucaccacccagcucuccuccgucgacacccgcugcuccucccucgaguccgcccgcuuccccgagacccccgccuucuccucccaggaggaggaggacggcgccugcgccgccgagcccaccuccuccggccccgccgagggcucccaggaguccgucugcaccgccggcucccuccccgucguccagguccccuccggcgaggacgagggccccggcgccgaguccgccaccguccccgaccaggaggagcucggcgaggucuggcagcgccgcggcucccucgagggcgccgccgccgccgccgagucccccccccaggaggagggcuccgccggcgaggcccagggcaccugcgagggcgccaccgcccaggaggagggcgccaccggcggcucccaggccaacggccaccagccccuccgcucccuccccuccguccgccaggacgucucccgcuaccagcgcgucgacgaggcccucccccccaacugggaggcccgcaucgacucccacggccgcaucuucuacgucgaccacgucaaccgcaccaccaccuggcagcgccccaccgccccccccgccccccagguccuccagcgcuccaacuccauccagcagauggagcagcucaaccgccgcuaccaguccauccgccgcaccaugaccaacgagcgccccgaggagaacaccaacgccaucgacggcgccggcgaggaggccgacuuccaccaggccuccgccgacuuccgccgcgagaacauccucccccacuccaccucccgcucccgcaucacccuccuccuccaguccccccccgucaaguuccucaucucccccgaguucuucaccguccuccacuccaaccccuccgccuaccgcauguucaccaacaacaccugccucaagcacaugaucaccaagguccgccgcgacacccaccacuucgagcgcuaccagcacaaccgcgaccucgucggcuuccucaacauguucgccaacaagcagcucgagcucccccgcggcugggagaugaagcacgaccaccagggcaaggccuucuucgucgaccacaacucccgcaccaccaccuucaucgacccccgccucccccuccaguccucccgccccaccuccgcccucguccaccgccagcaccucacccgccagcgcucccacuccgccggcgaggucggcgaggacucccgccacgccggcccccccguccucccccgccccuccuccaccuucaacaccgucucccgcccccaguaccaggacaugguccccgucgccuacaacgacaagaucgucgccuuccuccgccagcccaacaucuucgagauccuccaggagcgccagcccgaccucacccgcaaccacucccuccgcgagaagauccaguucauccgcaccgagggcacccccggccucguccgccucuccuccgacgccgaccucgucaugcuccucucccucuucgaggaggagaucauguccuacguccccccccacgcccuccuccaccccuccuacugccaguccccccgcggcucccccgucuccuccccccagaacucccccggcacccagcgcgccaacgcccgcgcccccgcccccuacaagcgcgacuucgaggccaagcuccgcaacuucuaccgcaagcucgagaccaagggcuacggccagggccccggcaagcucaagcucaucauccgccgcgaccaccuccucgaggacgccuucaaccagaucaugggcuacucccgcaaggaccuccagcgcaacaagcucuacgucaccuucgucggcgaggagggccucgacuacuccggccccucccgcgaguucuucuuccucgucucccgcgagcucuucaaccccuacuacggccucuucgaguacuccgccaacgacaccuacaccguccagaucucccccauguccgccuucgucgacaaccaccacgagugguuccgcuucuccggccgcauccucggccucgcccucauccaccaguaccuccucgacgccuucuucacccgccccuucuacaaggcccuccuccgcauccucugcgaccucuccgaccucgaguaccucgacgaggaguuccaccagucccuccaguggaugaaggacaacgacauccacgacauccucgaccucaccuucaccgucaacgaggaggucuucggccagaucaccgagcgcgagcucaagcccggcggcgccaacauccccgucaccgagaagaacaagaaggaguacaucgagcgcauggucaaguggcgcaucgagcgcggcgucguccagcagaccgagucccucguccgcggcuucuacgaggucgucgacgcccgccucgucuccgucuucgacgcccgcgagcucgagcucgucaucgccggcaccgccgagaucgaccucuccgacuggcgcaacaacaccgaguaccgcggcggcuaccacgacaaccacaucgucauccgcugguucugggccgccgucgagcgcuucaacaacgagcagcgccuccgccuccuccaguucgucaccggcaccuccuccauccccuacgagggcuucgccucccuccgcggcuccaacggcccccgccgcuucugcgucgagaaguggggcaagaucaccgcccucccccgcgcccacaccugcuucaaccgccucgaccucccccccuaccccuccuucuccaugcucuacgagaagcuccucaccgccgucgaggagaccuccaccuucggccucgaguga

SEQ ID NO: 44101 - RNA, 4146 nt, Artificial Sequence
  derived and/or modified sequence opt2 from HEG1__Homo_sapiens__NP_065784
auggccuccccccgcgccucccgcuggccccccccccuccuccuccuccuccucccccuccuccuccucccccccgccgcccccggcacccgcgaccccccccccucccccgcccgccgcgcccucucccucgccccccucgccggcgccggccucgagcuccagcucgagcgccgccccgagcgcgagcccccccccacccccccccgcgagcgccgcggccccgccacccccggccccuccuaccgcgcccccgagcccggcgccgccacccagcgcggccccuccggccgcgccccccgcggcggcuccgccgacgccgccuggaagcacuggcccgaguccaacaccgaggcccacgucgagaacaucaccuucuaccagaaccaggaggacuucuccaccgucuccuccaaggagggcgucaugguccagaccuccggcaagucccacgccgccuccgacgcccccgagaaccucacccuccucgccgagaccgccgacgcccgcggccgcuccggcuccuccucccgcaccaacuucaccauccuccccgucggcuacucccucgagaucgccaccgcccucaccucccaguccggcaaccucgccuccgagucccuccaccuccccuccuccuccuccgaguucgacgagcgcaucgccgccuuccagaccaaguccggcaccgccuccgagaugggcaccgagcgcgccaugggccucuccgaggaguggaccguccacucccaggaggccaccaccuccgccuggucccccuccuuccuccccgcccucgagaugggcgagcucaccacccccucccgcaagcgcaacuccuccggccccgaccucuccuggcuccacuucuaccgcaccgccgccuccuccccccuccucgaccucuccuccuccuccgaguccaccgagaagcucaacaacuccaccggccuccaguccuccuccgucucccagaccaagaccaugcacgucgccaccgucuucaccgacggcggcccccgcacccuccgcucccucaccgucucccucggccccgucuccaagaccgagggcuuccccaaggacucccgcaucgccaccaccuccuccuccguccuccucucccccuccgccgucgagucccgccgcaacucccgcgucaccggcaaccccggcgacgaggaguucaucgagcccuccaccgagaacgaguucggccucaccucccuccgcuggcagaacgacucccccaccuucggcgagcaccagcucgccuccuccuccgagguccagaacggcucccccaugucccagaccgagaccgucucccgcuccgucgcccccaugcgcggcggcgagaucaccgcccacuggcuccucaccaacuccaccaccuccgccgacgucaccggcuccuccgccuccuaccccgagggcgucaacgccuccguccucacccaguucuccgacuccaccguccaguccggcggcucccacaccgcccucggcgaccgcuccuacuccgaguccuccuccaccuccuccuccgagucccucaacuccuccgccccccgcggcgagcgcuccaucgccggcaucuccuacggccagguccgcggcaccgccaucgagcagcgcaccuccuccgaccacaccgaccacaccuaccucuccuccaccuucaccaagggcgagcgcgcccuccucuccaucaccgacaacuccuccuccuccgacaucgucgaguccuccaccuccuacaucaagaucuccaacuccucccacuccgaguacuccuccuucuuccacgcccagaccgagcgcuccaacaucuccuccuacgacggcgaguacgcccagcccuccaccgagucccccguccuccacaccuccaaccuccccuccuacacccccaccaucaacaugcccaacaccuccgucguccucgacaccgacgccgaguucgucuccgacuccuccuccuccuccuccuccuccuccuccuccuccuccuccggccccccccucccccuccccuccgucucccagucccaccaccucuucuccuccauccuccccuccacccgcgccuccguccaccuccucaaguccaccuccgacgccuccacccccugguccuccucccccuccccccuccccgucucccucaccaccuccaccuccgccccccucuccgucucccagaccacccucccccaguccuccuccacccccguccucccccgcgcccgcgagacccccgucaccuccuuccagaccuccaccaugaccuccuucaugaccaugcuccacuccucccagaccgccgaccucaagucccaguccaccccccaccaggagaaggucaucaccgaguccaagucccccucccucgucucccuccccaccgaguccaccaaggccgucaccaccaacuccccccucccccccucccucaccgaguccuccaccgagcagacccuccccgccaccuccaccaaccucgcccagaugucccccaccuucaccaccaccauccucaagaccucccagccccucaugaccacccccggcacccucuccuccaccgccucccucgucaccggccccaucgccguccagaccaccgccggcaagcagcucucccucacccaccccgagauccucgucccccagaucuccaccgagggcggcaucuccaccgagcgcaaccgcgucaucgucgacgccaccaccggccucaucccccucaccuccguccccaccuccgccaaggagaugaccaccaagcucggcgucaccgccgaguacucccccgccucccgcucccucggcaccucccccuccccccagaccaccgucgucuccaccgccgaggaccucgcccccaaguccgccaccuucgccguccaguccuccacccagucccccaccaccgucuccuccuccgccuccgucaacuccugcgccgucaaccccugccuccacaacggcgagugcgucgccgacaacaccucccgcggcuaccacugccgcugcccccccuccuggcagggcgacgacugcuccgucgacgucaacgagugccucuccaaccccugccccuccaccgccaugugcaacaacacccagggcuccuucaucugcaagugccccgucggcuaccagcucgagaagggcaucugcaaccucguccgcaccuucgucaccgaguucaagcucaagcgcaccuuccucaacaccaccgucgagaagcacuccgaccuccaggaggucgagaacgagaucaccaagacccucaacaugugcuucuccgcccuccccuccuacauccgcuccaccguccacgccucccgcgaguccaacgccgucgucaucucccuccagaccaccuucucccucgccuccaacgucacccucuucgaccucgccgaccgcaugcagaagugcgucaacuccugcaaguccuccgccgaggucugccagcuccucggcucccagcgccgcaucuuccgcgccggcucccucugcaagcgcaagucccccgagugcgacaaggacaccuccaucugcaccgaccucgacggcgucgcccucugccagugcaaguccggcuacuuccaguucaacaagauggaccacuccugccgcgccugcgaggacggcuaccgccucgagaacgagaccugcauguccugccccuucggccucggcggccucaacugcggcaaccccuaccagcucaucaccgucgucaucgccgccgccggcggcggccuccuccucauccucggcaucgcccucaucgucaccugcugccgcaagaacaagaacgacaucuccaagcucaucuucaaguccggcgacuuccagaugucccccuacgccgaguaccccaagaacccccgcucccaggaguggggccgcgaggccaucgagaugcacgagaacggcuccaccaagaaccuccuccagaugaccgacgucuacuacucccccaccuccguccgcaaccccgagcucgagcgcaacggccucuaccccgccuacaccggccuccccggcucccgccacuccugcaucuuccccggccaguacaaccccuccuucaucuccgacgagucccgccgccgcgacuacuucuga

SEQ ID NO: 44102 - RNA, 2655 nt, Artificial Sequence
  derived and/or modified sequence opt2 from HELLS__Homo_sapiens__NP_001275996
augcccgccgagcgccccgccggcuccggcggcuccgaggcccccgccauggucgagcagcucgacaccgccgucaucacccccgccaugcucgaggaggaggagcagcucgaggccgccggccucgagcgcgagcgcaagaugcucgagaaggcccgcauguccugggaccgcgaguccaccgagauccgcuaccgccgccuccagcaccuccucgagaaguccaacaucuacuccaaguuccuccucaccaagauggagcagcagcagcucgaggagcagaagaagaaggagaagcucgagcgcaagaaggagucccucaaggucaagaagggcaagaacuccaucgacgccuccgaggagaagcccgucaugcgcaagaagcgcggccgcgaggacgaguccuacaacaucuccgaggucauguccaaggaggagauccucuccgucgccaagaagaacaagaaggagaacgaggacgagaacuccuccuccaccaaccucugcgucgaggaccuccagaagaacaaggacuccaacuccaucaucaaggaccgccucuccgagaccguccgccagaacaccaaguucuucuucgaccccguccgcaagugcaacggccagcccguccccuuccagcagcccaagcacuucaccggcggcgucaugcgcugguaccaggucgagggcauggaguggcuccgcaugcucugggagaacggcaucaacggcauccucgccgacgagaugggccucggcaagaccguccagugcaucgccaccaucgcccucaugauccagcgcggcguccccggccccuuccucgucugcggcccccucuccacccuccccaacuggauggccgaguucaagcgcuucacccccgacauccccaccaugcucuaccacggcacccaggaggagcgccagaagcucguccgcaacaucuacaagcgcaagggcacccuccagauccaccccgucgucaucaccuccuucgagaucgccaugcgcgaccgcaacgcccuccagcacugcuacuggaaguaccucaucgucgacgagggccaccgcaucaagaacaugaagugccgccucauccgcgagcucaagcgcuucaacgccgacaacaagcuccuccucaccggcaccccccuccagaacaaccucuccgagcucuggucccuccucaacuuccuccuccccgacgucuucgacgaccucaaguccuucgaguccugguucgacaucaccucccucuccgagaccgccgaggacaucaucgccaaggagcgcgagcagaacguccuccacaugcuccaccaggagcgcaucccccgcauguacgucuccgaguucaccgacgagggcuucuucgagggcaagcuccccucccgcaaggaccucuacgacauccgccccuacgagaacaccuaccuccucaagcuccacaccaacuucgagauccucacccccuuccuccuccgccgccucaaguccgacgucgcccucgaggucccccccaagcgcgaggucgucgucuacgccccccucuccaagaagcaggagaucuucuacaccgccaucgucaaccgcaccaucgccaacauguucggcuccuccgagaaggagaccaucgagcucucccccaccggccgccccaagcgccgcacccgcaaguccaucaacuacuccaagaucgacgacuuccccaacgagcucgagaagcucaucucccagauccagcccgaggucgaccgcgagcgcgccgucgucgaggucaacauccccgucgaguccgaggucaaccucaagcuccagaacaucaugaugcuccuccgcaagugcugcaaccaccccuaccucaucgaguaccccaucgaccccgucacccaggaguucaagaucgacgaggagcucgucaccaacuccggcaaguuccucauccucgaccgcaugcuccccgagcucaagaagcgcggccacaagguccuccucuucucccagaugaccuccaugcucgacauccucauggacuacugccaccuccgcgacuucaacuucucccgccucgacggcuccauguccuacuccgagcgcgagaagaacaugcacuccuucaacaccgaccccgaggucuucaucuuccucgucuccacccgcgccggcggccucggcaucaaccucaccgccgccgacaccgucaucaucuacgacuccgacuggaacccccaguccgaccuccaggcccaggaccgcugccaccgcaucggccagaccaagcccgucgucgucuaccgccucgucaccgccaacaccaucgaccagaagaucgucgagcgcgccgccgccaagcgcaagcucgagaagcucaucauccacaagaaccacuucaagggcggccaguccggccucaaccucuccaagaacuuccucgaccccaaggagcucauggagcuccucaagucccgcgacuacgagcgcgagaucaagggcucccgcgagaaggucaucuccgacaaggaccucgagcuccuccucgaccgcuccgaccucaucgaccagaugaacgccuccggccccaucaaggagaagaugggcaucuucaagauccucgagaacuccgaggacuccucccccgagugccucuucuga

SEQ ID NO: 44103 - RNA, 3306 nt, Artificial Sequence
  derived and/or modified sequence opt2 from HELQ__Homo_sapiens__NP_598375
auggacgagugcggcucccgcauccgccgccgcgucucccuccccaagcgcaaccgccccucccucggcugcaucuucggcgcccccaccgccgccgagcucgagcccggcgacgagggcaaggaggaggaggagauggucgccgagaaccgccgccgcaagaccgccggcguccuccccgucgagguccagccccuccuccucuccgacucccccgagugccucguccucggcggcggcgacaccaaccccgaccuccuccgccacaugcccaccgaccgcggcgucggcgaccagcccaacgacuccgaggucgacauguucggcgacuacgacuccuucaccgagaacuccuucaucgcccaggucgacgaccucgagcagaaguacaugcagcuccccgagcacaagaagcacgccaccgacuucgccaccgagaaccucugcuccgaguccaucaagaacaagcucuccaucaccaccaucggcaaccucaccgagcuccagaccgacaagcacaccgagaaccaguccggcuacgagggcgucaccaucgagcccggcgccgaccuccucuacgacguccccuccucccaggccaucuacuucgagaaccuccagaacuccuccaacgaccucggcgaccacuccaugaaggagcgcgacuggaaguccuccucccacaacaccgucaacgaggagcucccccacaacugcaucgagcagccccagcagaacgacgaguccuccuccaagguccgcaccuccuccgacaugaaccgccgcaaguccaucaaggaccaccucaagaacgccaugaccggcaacgccaaggcccagacccccaucuucucccgcuccaagcagcucaaggacacccuccucuccgaggagaucaacgucgccaagaagaccgucgaguccuccuccaacgaccucggccccuucuacucccuccccuccaagguccgcgaccucuacgcccaguucaagggcaucgagaagcucuacgaguggcagcacaccugccucacccucaacuccguccaggagcgcaagaaccucaucuacucccuccccaccuccggcggcaagacccucgucgccgagauccucaugcuccaggagcuccucugcugccgcaaggacguccucaugauccuccccuacgucgccaucguccaggagaagaucuccggccucuccuccuucggcaucgagcucggcuucuucgucgaggaguacgccggcuccaagggccgcuucccccccaccaagcgccgcgagaagaagucccucuacaucgccaccaucgagaagggccacucccucgucaacucccucaucgagaccggccgcaucgacucccucggccucgucgucgucgacgagcuccacaugaucggcgagggcucccgcggcgccacccucgagaugacccucgccaagauccucuacaccuccaagaccacccagaucaucggcauguccgccacccucaacaacgucgaggaccuccagaaguuccuccaggccgaguacuacaccucccaguuccgccccgucgagcucaaggaguaccucaagaucaacgacaccaucuacgaggucgacuccaaggccgagaacggcaugaccuucucccgccuccucaacuacaaguacuccgacacccucaagaagauggaccccgaccaccucgucgcccucgucaccgaggucauccccaacuacuccugccucgucuucugccccuccaagaagaacugcgagaacgucgccgagaugaucugcaaguuccucuccaaggaguaccucaagcacaaggagaaggagaagugcgaggucaucaagaaccucaagaacaucggcaacggcaaccucugccccguccucaagcgcaccauccccuucggcgucgccuaccaccacuccggccucaccuccgacgagcgcaagcuccucgaggaggccuacuccaccggcguccucugccucuucaccugcaccuccacccucgccgccggcgucaaccuccccgcccgccgcgucauccuccgcgcccccuacgucgccaaggaguuccucaagcgcaaccaguacaagcagaugaucggccgcgccggccgcgccggcaucgacaccaucggcgaguccauccucauccuccaggagaaggacaagcagcagguccucgagcucaucaccaagccccucgagaacugcuacucccaccucguccaggaguucaccaagggcauccagacccucuuccucucccucaucggccucaagaucgccaccaaccucgacgacaucuaccacuucaugaacggcaccuucuucggcguccagcagaagguccuccucaaggagaagucccucugggagaucaccgucgagucccuccgcuaccucaccgagaagggccuccuccagaaggacaccaucuacaaguccgaggaggagguccaguacaacuuccacaucaccaagcucggccgcgccuccuucaagggcaccaucgaccucgccuacugcgacauccucuaccgcgaccucaagaagggccucgagggccucguccucgagucccuccuccaccucaucuaccucaccacccccuacgaccucgucucccagugcaaccccgacuggaugaucuacuuccgccaguucucccagcucucccccgccgagcagaacgucgccgccauccucggcgucuccgaguccuucaucggcaagaaggccuccggccaggccaucggcaagaaggucgacaagaacgucgucaaccgccucuaccucuccuucguccucuacacccuccucaaggagaccaacaucuggaccgucuccgagaaguucaacaugccccgcggcuacauccagaaccuccucaccggcaccgccuccuucuccuccugcguccuccacuucugcgaggagcucgaggaguucugggucuaccgcgcccuccucgucgagcucaccaagaagcucaccuacugcgucaaggccgagcucaucccccucauggaggucaccggcguccucgagggccgcgccaagcagcucuacuccgccggcuacaagucccucaugcaccucgccaacgccaaccccgagguccucguccgcaccaucgaccaccucucccgccgccaggccaagcagaucgucuccuccgccaagaugcuccuccacgagaaggccgaggcccuccaggaggaggucgaggagcuccuccgccuccccuccgacuuccccggcgccgucgccuccuccaccgacaaggccuga

SEQ ID NO: 44104 - RNA, 729 nt, Artificial Sequence
  derived and/or modified sequence opt2 from HELT__Homo_sapiens__NP_001287710
auguccgacaagcucaaggagcgcaagcgcacccccgucucccacaaggucaucgagaagcgccgccgcgaccgcaucaaccgcugccucaacgagcucggcaagaccguccccauggcccucgccaagcaguccuccggcaagcucgagaaggccgagauccucgagaugaccguccaguaccuccgcgcccuccacuccgccgacuucccccgcggccgcgagaaggccgagcuccucgccgaguucgccaacuacuuccacuacggcuaccacgagugcaugaagaaccucguccacuaccucaccaccgucgagcgcauggagaccaaggacaccaaguacgcccgcauccucgccuuccuccaguccaaggcccgccucggcgccgagcccgccuuccccccccucggcucccuccccgagcccgacuucuccuaccagcuccaccccgccggccccgaguucgccggccacucccccggcgaggccgccgucuucccccagggcuccggcgccggccccuuccccuggccccccggcgccgcccgcucccccgcccuccccuaccuccccuccgcccccgucccccucgccucccccgcccagcagcacucccccuuccucacccccguccagggccucgaccgccacuaccucaaccucaucggccacgcccaccccaacgcccucaaccuccacaccccccagcacccccccguccucuga

SEQ ID NO: 44105 - RNA, 7950 nt, Artificial Sequence
  derived and/or modified sequence opt2 from HELZ2__Homo_sapiens__NP_001032412
auggccgucugggaggccgagcagcucggcggccuccagcgcggcgaccuccucaccccccccgcccccgacggcgacggccgcaccgccccccucggccagccccccggcgcccagcucuacugccccgccugccucgucaccugccacucccaggaggccuucgagaaccacugcgccuccuccgagcacgcccagauggucgccuucgaccaggcccuccccugggagcaccgcucccccccccccggccucuccaaguucgagcucugccccaagcccgaccucugcgaguacggcgacgccugcaccaaggcccacuccgcccaggagcuccaggaguggguccgccgcacccaggccgucgagcuccgcggccaggccgccuggcaggacggccucguccccuaccaggagcgccuccucgccgaguaccagcgcuccuccuccgagguccucguccucgccgagacccucgacggcguccgcgucaccugcaaccagccccucauguaccaggcccaggagcgcaagacccaguacuccuggaccuucgccguccacuccgaggagccccuccuccacgucgcccuccucaagcaggagcccggcgccgacuucucccucgucgcccccggccucccccccggccgccucuacgcccgcggcgagcgcuuccgcguccccuccuccaccgccgacuuccaggucggcguccgcguccaggccgccuccuucggcaccuucgagcagugggucgucuucgacuucggccgccgccccguccuccuccagaagcucggccuccagcucggccagggccgccgccccggccccugccgcaaccucgcccucggccaccccgaggagauggagcgcuggcacaccggcaaccgccacgucguccccggcgucgagcgcaccgccgagcagaccgcccucauggccaaguacaagggccccgcccucgcccucgaguucaaccgcuccuccgucgccuccggccccaucucccccaccaacuaccgccagcgcaugcaccaguuccucuacgaggaggaggccgcccagcagcagcucgucgccaagcucacccuccgcggccaggucuuccucaagaccgcccuccagacccccgcccucaacaugcucuucgccccccccggcgcccucuacgccgagguccccguccccuccucccucaugcccgacaccgaccagggcuuccuccucggccgcgccgucuccaccgcccucgucgcccccguccccgcccccgacaacaccgucuucgagguccgccucgagcgccgcgccuccuccgagcaggcccucuggcuccuccuccccgcccgcugcugccucgcccucggccuccagcccgaggcccgccucguccucgagguccaguuccagaucgaccccaugaccuuccgccucuggcaccaggccgucgacacccuccccgaggagcagcucgucguccccgaccuccccaccugcgcccucccccgccccugguccguccccccccuccgccgcggcaaccgcaagcaggagcucgccgucgcccucaucgccggcuggggccccggcgacggccgccgcguccccccccuccucaucuacggccccuucggcaccggcaagaccuacacccucgccauggccucccucgaggucauccgccgccccgagaccaagguccucaucugcacccacaccaacuccgccgccgacaucuacauccgcgaguacuuccacucccacgucuccggcggccaccccgaggccaccccccuccgcgucauguacaccgaccgcccccucucccagaccgaccccgucacccuccaguacugcugccucaccgacgaccgccaggccuuccgcccccccacccgcgccgagcucgcccgccaccgcgucgucgucaccaccaccucccaggcccgcgagcuccgcguccccgucggcuucuucucccacauccucaucgacgaggccgcccagaugcucgagugcgaggcccucaccccccucgccuacgccucccacggcacccgccucguccucgccggcgaccacaugcaggucaccccccgccucuucuccgucgcccgcgcccgcgccgccgagcacacccuccuccaccgccucuuccucugcuaccagcaggagacccacgaggucgcccgccagucccgccucgucuuccacgagaacuaccgcugcaccgacgccaucgucuccuucaucucccgccacuucuacgucgccaagggcaaccccauccacgcccgcggcaagguccccccccacccccgccacuacccccucauguucugccacgucgccggcucccccgaccgcgacauguccauggccuccuggcucaaccucgccgagaucgcccaggucgucgagaagguccaggaggccuacaacaccuggcccuccugcuggggcggccgcgagcagcgcugcaucugcgucgucucccacggcgcccaggucuccgcccuccgccaggagcuccgccgccgcgaccucggccaggucuccgucggcuccuucgagauccuccccggccgccaguuccgcgucgucguccucuccaccguccacaccugccagucccuccucucccccggcgcccucgcccccgaguucuucaccgacgcccgcguccucaacaccguccucacccgcgcccagucccagcucgucgucgucggcgacgccgucgcccucugcuccuucggcgccugcggcaagcucugggaguccuucauccgcgagugcgucgagcgccacuccgucugccccgagggccucuccauggagcaggucgagcagggcgucgcccagcgccgccgcuggcccccccgcggcacccaggccggcgccgccggcaacugggaggccgcccccgagcccgucggcgaccucgccgaggagcaggccgccgucgucaccgccauggucaaggccgagcccggcgacgaggcccucucccccgccucccgcgacaucaccgccaccaccgcccagaccgaggccgccgccgcccccgccggcgacgccgucaaggaggacgucguccccggcgccugcgccgccggcgccgccgccgccgccggcgucgaguccaccgaggccgaggacgccgaggccgacuucuggcccugggacggcgagcucaacgccgacgacgccauccuccgcgagcuccucgacgagucccagaaggucauggucaccgucggcgaggacggccuccucgacaccgucgcccgccccgagucccuccagcaggcccgccucuacgagaaccucccccccgccgcccuccgcaagcuccuccacgccgagcccgagcgcuaccgccacugcuccuucguccccgagaccuucgagcgcgccuccgccaucccccucgacgacgccuccuccggccccauccagguccgcggccgccucgacugcggcauggccuucgccggcgacgagguccucguccagcuccucuccggcgacaaggcccccgagggccgccuccgcggccgcguccucggcguccucaagcgcaagcgccacgagcucgccuucgucugccgcauggacaccugggacccccgcaucaugguccccaucaacggcuccgucaccaagaucuucgucgccgagcucaaggaccccucccagguccccaucuacucccuccgcaagggccgccuccagcgcgucggccucgagcgccucaccgccgaggcccgccacucccgccucuucuggguccagaucguccucuggcgccagggcuucuacuacccccucggcaucguccgcgagguccuccccgaggccuccaccugggagcagggccuccgcauccucggccucgaguacucccuccgcgucccccccuccgaccaggccaccaucaccaagguccuccagaaguaccacaccgagcucggccgcgucgccggccgccgcgaggacugccgcgccuuccucaccuucaccgucgacccccagggcgccugcaaccucgacgacgcccucuccguccgcgaccucggcccccgcugcgaggucgccguccacaucaccgacgucgccuccuucgucccccgcgacggcguccucgacgucgaggcccgccgccagggcgccgccuucuacgcccccggccgcgagcccguccccaugcuccccgccucccucugccaggacguccucucccuccuccccggccgcgaccgccucgccaucucccucuuccucaccauggagaaggccuccggccagcucaagucccuccgcuucgcccccuccgucguccaguccgaccgccagcucuccuacgaggaggccgaggaggucauccgccagcaccccggcgccggccgcgagcuccccgcccgccucgacuccgucgacgccugcgucgucgccgccugcuacuucucccgccuccuccgccgccaccgccuccgcuccgacugcuucuacgagcagcccgacgaggacggcacccucggcuuccgcgccgcccacaucauggucaaggaguacaugauccaguucaaccgccucgucgccgaguuccucgucggcuccgagugcacccgcaccgucaccccccuccgcuggcagcccgccccccgcucccagcagcucaaggcccucugcgagaagcacggcgaccgcgucccccucucccuccaccucggccaccaccuccacggcggcggcggcuccccccccgacacccgccuccaccuccucgccucccucuggaagcagguccaguucgccgcccgcacccaggacuacgagcagauggucgaccucgucaccaccgacgacaugcaccccuuccucgcccccgccggccgcgaccuccgcaaggcccucgagcgcuccgccuucggccgcugcgcccgcggccaccagcagcagggcggccacuacucccuccaggucgacugguacaccugggccaccucccccauccgccgcuaccucgacgucguccuccagcgccagauccuccucgcccucggccacggcggcuccgccuacuccgcccgcgacaucgacggccucugccaggccuucucccuccagcacgcccucgcccaguccuaccagcgccgcgcccgcucccuccaccucgccguccagcucaaggcccagccccucgacaagcucggcuucgucgucgacgucgaggccggcucccgcugcuuccgccuccucuuccccuccaaccgcgagacccuccccgaccccugccccguccccuacggcucccuccagcucgccgagcacccccacgcccucgccggccgccccggccuccgccuccucuggcgccgccgcgucuacuccgcccagggcuccucccccccccucccccuccccggcaccguccccgacccccacacccucgccgucgagaccgcccucuggaagcagcuccucgagcucgucgagcuccagcgcuggcccgaggccgccgcccucauccaggagaagggcgaggccucccagcgccgcgagcucguccagguccagcgcucccacugcggccacuuccucgaggucgcccgcgagcucggcuccggcgacacccuccagguccagcucggcaccucccuccagcacggcuuccucguccccuccccccagcucuggaccgucgcccccggcuucucccucugccucgagcacgucgagcgccccggcgacugcuucuccggccgcgucuaccgcgccccccgcgaccgcuaccgcgacgucgacgaguacgccugcgucugggagcccuucugcgcccucgaguccgccaccggcgccgucgccgagaacgacuccgucacccuccagcaccucuccgucuccugggaggccucccgcaccccccagggccagcuccagggcgccuuccgccucgaggccgccuuccucgaggagaacugcgccgacaucaacuucuccugcugcuaccucugcauccgccucgagggccuccccgcccccaccgccuccccccgccccggccccuccucccucggccccggccucaacgucgaccccggcaccuacaccugggucgcccacggccagacccaggacugggaccaggagcgccgcgccgaccgccaggaggccccccgccgcguccaccucuucguccaccacaugggcauggagaagguccccgaggagguccuccgccccggcacccucuucaccgucgagcuccuccccaagcagcuccccgaccuccgcaaggaggaggccguccgcggccucgaggaggccuccccccucgucaccuccaucgcccucggccgccccgucccccagccccucugccgcgucauccccucccgcuuccucgagcgccagaccuacaacauccccggcggccgccacaagcucaaccccucccagaacgucgccguccgcgaggcccucgagaagcccuucaccgucauccagggcccccccggcaccggcaagaccaucgucggccuccacaucgucuucugguuccacaaguccaaccaggagcagguccagcccggcggccccccccgcggcgagaagcgccucggcggccccugcauccucuacugcggccccuccaacaaguccgucgacguccucgccggccuccuccuccgccgcauggagcucaagccccuccgcgucuacuccgagcaggccgaggccuccgaguuccccgucccccgcgucggcucccgcaagcuccuccgcaaguccccccgcgagggccgccccaaccagucccuccgcuccaucacccuccaccaccgcauccgccaggcccccaaccccuacuccuccgagaucaaggccuucgacacccgccuccagcgcggcgagcucuucucccgcgaggaccucgucugguacaagaagguccucugggaggcccgcaaguucgagcucgaccgccacgaggucauccucugcaccugcuccugcgccgccuccgccucccucaagauccucgacguccgccagauccucgucgacgaggccggcauggccaccgagcccgagacccucaucccccucguccaguucccccaggccgagaaggucguccuccucggcgaccacaagcagcuccgccccgucgucaagaacgagcgccuccagaaccucggccucgaccgcucccucuucgagcgcuaccacgaggacgcccacaugcucgacacccaguaccgcaugcacgagggcaucugcgccuuccccuccgucgccuucuacaaguccaagcucaagaccuggcagggccuccgccgcccccccuccguccucggccacgccggcaaggaguccugccccgucaucuucggccacguccagggccacgagcgcucccuccucgucuccaccgacgagggcaacgagaacuccaaggccaaccucgaggaggucgccgaggucguccgcaucaccaagcagcucacccucggccgcaccgucgagccccaggacaucgccguccucacccccuacaacgcccaggccuccgagaucuccaaggcccuccgccgcgagggcaucgccggcgucgccgucuccuccaucaccaagucccagggcuccgaguggcgcuacguccucgucuccaccguccgcaccugcgccaaguccgaccucgaccagcgccccaccaaguccuggcucaagaaguuccucggcuucgucgucgaccccaaccaggucaacgucgccgucacccgcgcccaggagggccucugccucaucggcgaccaccuccuccuccgcugcugcccccucuggcgcucccuccucgacuucugcgaggcccagcagacccucguccccgccggccagguccgcgucugccgccgccccaccaugcccuccuga

SEQ ID NO: 44106 - RNA, 5829 nt, Artificial Sequence
  derived and/or modified sequence opt2 from HELZ__Homo_sapiens__NP_055692
auggaggaccgccgcgccgagaaguccugcgagcaggccugcgagucccucaagcgccaggacuacgagauggcccucaagcacugcaccgaggcccuccucucccucggccaguacuccauggccgacuucaccggccccugcccccucgagaucgagcgcaucaagaucgagucccuccucuaccgcaucgccuccuuccuccagcucaagaacuacguccaggccgacgaggacugccgccacguccucggcgagggccucgccaagggcgaggacgccuuccgcgccguccucugcugcaugcagcucaagggcaagcuccagcccgucuccaccauccucgccaagucccucaccggcgagucccucaacggcauggucaccaaggaccucacccgccucaagacccuccucuccgagaccgagaccgccaccuccaacgcccucuccggcuaccacgucgaggaccucgacgagggcuccugcaacggcuggcacuuccgcccccccccccgcggcaucaccuccuccgaggaguacacccucugcaagcgcuuccucgagcagggcaucugccgcuacggcgcccagugcaccuccgcccacucccaggaggagcucgccgaguggcagaagcgcuacgccucccgccucaucaagcucaagcagcagaacgagaacaagcagcucuccggcuccuacauggagacccucaucgagaaguggaugaacucccucucccccgagaagguccucuccgagugcaucgagggcgucaaggucgagcacaaccccgaccucuccgucaccgucuccaccaagaagucccaccagaccuggaccuucgcccucaccugcaagcccgcccgcaugcucuaccgcgucgcccuccucuacgacgcccaccgcccccacuucuccaucaucgccaucuccgccggcgacuccaccacccaggucucccaggagguccccgagaacugccaggaguggaucggcggcaagauggcccagaacggccucgaccacuacgucuacaaggucggcaucgccuucaacaccgagaucuucggcaccuuccgccagaccaucgucuucgacuucggccucgagcccguccucaugcagcgcgucaugaucgacgccgccuccaccgaggaccucgaguaccucaugcacgccaagcagcagcucgucaccaccgccaagcgcugggacuccuccuccaagaccaucaucgacuucgagcccaacgagaccaccgaccucgagaagucccuccucauccgcuaccagaucccccucuccgccgaccagcucuucacccaguccguccucgacaagucccucaccaaguccaacuaccagucccgccuccacgaccuccucuacaucgaggagaucgcccaguacaaggagaucuccaaguucaaccucaagguccagcuccagauccucgccuccuucaugcucaccggcgucuccggcggcgccaaguacgcccagaacggccagcucuucggccgcuucaagcucaccgagacccucuccgaggacacccucgccggccgccucgucaugaccaaggucaacgccgucuaccuccuccccguccccaagcagaagcucguccagacccagggcaccaaggagaaggucuacgaggccaccaucgaggagaagaccaaggaguacaucuuccuccgccucucccgcgagugcugcgaggagcucaaccuccgccccgacugcgacacccaggucgagcuccaguuccagcucaaccgccucccccucugcgagaugcacuacgcccucgaccgcaucaaggacaacggcguccucuuccccgacaucuccaugacccccaccauccccuggucccccaaccgccagugggacgagcagcucgacccccgccucaacgccaagcagaaggaggccguccucgccaucaccaccccccucgccauccagcucccccccguccucaucaucggccccuacggcaccggcaagaccuucacccucgcccaggccgucaagcacauccuccagcagcaggagacccgcauccucaucugcacccacuccaacuccgccgccgaccucuacaucaaggacuaccuccaccccuacgucgaggccggcaacccccaggcccgcccccuccgcgucuacuuccgcaaccgcugggucaagaccguccaccccgucguccaccaguacugccucaucuccuccgcccacuccaccuuccagaugccccagaaggaggacauccucaagcaccgcgucgucgucgucacccucaacaccucccaguaccucugccagcucgaccucgagcccggcuucuucacccacauccuccucgacgaggccgcccaggccauggagugcgagaccaucaugccccucgcccucgccacccagaacacccgcaucguccucgccggcgaccacaugcagcucucccccuucgucuacuccgaguucgcccgcgagcgcaaccuccacgucucccuccucgaccgccucuacgagcacuaccccgccgaguuccccugccgcauccuccucugcgagaacuaccgcucccacgaggccaucaucaacuacaccuccgagcucuucuacgagggcaagcucauggccuccggcaagcagcccgcccacaaggacuucuacccccucaccuucuucaccgcccgcggcgaggacguccaggagaagaacuccaccgccuucuacaacaacgccgaggucuucgaggucgucgagcgcgucgaggagcuccgccgcaaguggcccgucgccuggggcaagcucgacgacggcuccaucggcgucgucacccccuacgccgaccaggucuuccgcauccgcgccgagcuccgcaagaagcgccucuccgacgucaacgucgagcgcguccucaacguccagggcaagcaguuccgcguccucuuccucuccaccguccgcacccgccacaccugcaagcacaagcagacccccaucaagaagaaggagcagcuccucgaggacuccaccgaggaccucgacuacggcuuccucuccaacuacaagcuccucaacaccgccaucacccgcgcccagucccucgucgccgucgucggcgaccccaucgcccucugcuccaucggccgcugccgcaaguucugggagcgcuucaucgcccucugccacgagaacuccucccuccacggcaucaccuucgagcagaucaaggcccagcucgaggcccucgagcucaagaagaccuacguccucaacccccucgcccccgaguucaucccccgcgcccuccgccuccagcacuccggcuccaccaacaagcagcagcaguccccccccaagggcaagucccuccaccacacccagaacgaccacuuccagaacgacggcaucguccagcccaaccccuccguccucaucggcaaccccauccgcgccuacacccccccccccccccucggcccccaccccaaccucggcaagucccccucccccguccagcgcaucgacccccacaccggcaccuccauccucuacguccccgccgucuacggcggcaacgucgucauguccgucccccuccccguccccuggaccggcuaccagggccgcuucgccgucgacccccgcaucaucacccaccaggccgccauggccuacaacaugaaccuccuccagacccacggccgcggcucccccauccccuacggccucggccaccacccccccgucaccaucggccagccccagaaccagcaccaggagaaggaccagcacgagcagaaccgcaacggcaaguccgacaccaacaacuccggccccgagaucaacaagauccgcacccccgagaagaagcccaccgagcccaagcaggucgaccucgaguccaacccccagaaccgcucccccgagucccgccccuccgucgucuaccccuccaccaaguucccccgcaaggacaaccucaacccccgccacaucaaccucccccuccccgccccccacgcccaguacgccauccccaaccgccacuuccacccccucccccagcucccccgcccccccuuccccaucccccagcagcacacccuccucaaccagcagcagaacaaccuccccgagcagcccaaccagauccccccccagcccaaccaggucguccagcagcagucccagcucaaccagcagccccagcagccccccccccagcucucccccgccuaccaggccggccccaacaacgccuucuucaacuccgccgucgcccaccgcccccaguccccccccgccgaggccgucauccccgagcagcagcccccccccaugcuccaggagggccacuccccccuccgcgccaucgcccagcccggccccauccuccccucccaccucaacuccuucaucgacgagaaccccuccggccuccccaucggcgaggcccucgaccgcauccacggcuccgucgcccucgagacccuccgccagcagcaggcccgcuuccagcagugguccgagcaccacgccuuccucucccagggcuccguccccuacccccaccaccaccacccccaccuccagcaccucccccagcccccccucggccuccaccagccccccguccgcgccgacuggaagcucaccuccuccgccgaggacgaggucgagaccaccuacucccgcuuccaggaccucauccgcgagcucucccaccgcgaccaguccgagacccgcgagcucgccgagaugccccccccccagucccgccuccuccaguaccgccagguccagucccgcuccccccccgccguccccuccccccccuccuccaccgaccacuccucccacuucuccaacuucaacgacaacucccgcgacaucgaggucgccuccaaccccgccuucccccagcgccuccccccccagaucuucaacucccccuucucccuccccuccgagcaccucgccccccccccccucaaguaccucgcccccgacggcgccuggaccuucgccaaccuccagcagaaccaccucaugggccccggcuuccccuacggccuccccccccucccccaccgccccccccagaaccccuucguccagauccagaaccaccagcacgccaucggccaggagcccuuccacccccucuccucccgcaccgucuccuccuccucccuccccucccucgaggaguacgagccccgcggccccggccgcccccucuaccagcgccgcaucuccuccuccuccguccagcccugcuccgaggaggucuccaccccccaggacucccucgcccagugcaaggagcuccaggaccacuccaaccaguccuccuucaacuucuccucccccgaguccugggucaacaccaccuccuccacccccuaccagaacauccccugcaacggcuccucccgcaccgcccagccccgcgagcucaucgccccccccaagaccgucaagccccccgaggaccagcucaaguccgagaaccucgaggucuccuccuccuucaacuacuccguccuccagcaccucggccaguuccccccccucaugcccaacaagcagaucgccgaguccgccaacuccuccuccccccaguccuccgccggcggcaagcccgccauguccuacgccuccgcccuccgcgccccccccaagccccgccccccccccgagcaggccaagaaguccuccgacccccucucccucuuccaggagcucucccucggcuccuccuccggcuccaacggcuucuacuccuacuucaaguga

SEQ ID NO: 44107 - RNA, 1455 nt, Artificial Sequence
  derived and/or modified sequence opt2 from HEMGN__Homo_sapiens__XP_011517148
auggaccucggcaaggaccagucccaccucaagcaccaccagacccccgacccccaccaggaggagaaccacucccccgaggucaucggcaccuggucccuccgcaaccgcgagcuccuccgcaagcgcaaggccgagguccacgagaaggagaccucccaguggcucuucggcgagcagaagaagcgcaagcagcagcgcaccggcaagggcaaccgccgcggccgcaagcgccagcagaacaccgagcucaaggucgagccccagccccagaucgagaaggagaucgucgagaaggcccucgcccccaucgagaagaagaccgagccccccggcuccaucaccaaggucuuccccuccgucgccuccccccagaaggucguccccgaggagcacuucuccgagaucugccaggaguccaacaucuaccaggagaacuucuccgaguaccaggagaucgccguccagaaccacuccuccgagaccugccagcacgucuccgagcccgaggaccucucccccaagauguaccaggagaucuccguccuccaggacaacuccuccaagaucugccaggacaugaaggagcccgaggacaacucccccaacaccugccaggucaucuccgucauccaggaccaccccuucaagauguaccaggacauggccaagcgcgaggaccucgcccccaagaugugccaggaggccgccguccccaagauccuccccugccccaccuccgaggacaccgccgaccucgccggcugcucccuccaggccuaccccaagcccgacguccccaagggcuacauccucgacaccgaccagaaccccgccgagcccgaggaguacaacgagaccgaccagggcaucgccgagaccgagggccucuuccccaagauccaggagaucgccgagcccaaggaccucuccaccaagacccaccaggaguccgccgagcccaaguaccucccccacaagaccugcaacgagaucaucguccccaaggcccccucccacaagaccauccaggagaccccccacuccgaggacuacuccaucgagaucaaccaggagacccccggcuccgagaaguacucccccgagaccuaccaggagauccccggccucgaggaguacucccccgagaucuaccaggagaccucccagcucgaggaguacucccccgagaucuaccaggagacccccggccccgaggaccucuccaccgagaccuacaagaacaaggacguccccaaggagugcuuccccgagccccaccaggagaccggcggcccccagggccaggaccccaaggcccaccaggaggacgccaaggacgccuacaccuucccccaggagaugaaggagaagcccaaggaggagcccggcauccccgccauccucaacgagucccaccccgagaacgacgucuacuccuacguccucuucuga

SEQ ID NO: 44108 - RNA, 1251 nt, Artificial Sequence
  derived and/or modified sequence opt2 from HEPACAM__Homo_sapiens__NP_689935
augaagcgcgagcgcggcgcccucucccgcgccucccgcgcccuccgccucgcccccuucgucuaccuccuccucauccagaccgacccccucgagggcgucaacaucaccucccccguccgccucauccacggcaccgucggcaaguccgcccuccucuccguccaguacuccuccaccuccuccgaccgccccgucgucaaguggcagcucaagcgcgacaagcccgucaccgucguccaguccaucggcaccgaggucaucggcacccuccgccccgacuaccgcgaccgcauccgccucuucgagaacggcucccuccuccucuccgaccuccagcucgccgacgagggcaccuacgaggucgagaucuccaucaccgacgacaccuucaccggcgagaagaccaucaaccucaccgucgacguccccaucucccgcccccagguccucgucgccuccaccaccguccucgagcucuccgaggccuucacccucaacugcucccacgagaacggcaccaagcccuccuacaccuggcucaaggacggcaagccccuccucaacgacucccgcaugcuccucucccccgaccagaagguccucaccaucacccgcguccucauggaggacgacgaccucuacuccugcauggucgagaaccccaucucccagggccgcucccuccccgucaagaucaccgucuaccgccgcuccucccucuacaucauccucuccaccggcggcaucuuccuccucgucacccucgucaccgucugcgccugcuggaagcccuccaagcgcaagcagaagaagcucgagaagcagaacucccucgaguacauggaccagaacgacgaccgccucaagcccgaggccgacacccucccccgcuccggcgagcaggagcgcaagaaccccauggcccucuacauccucaaggacaaggacucccccgagaccgaggagaaccccgcccccgagccccgcuccgccaccgagcccggcccccccggcuacuccgucucccccgccguccccggccgcucccccggccuccccauccgcuccgcccgccgcuacccccgcucccccgcccgcucccccgccaccggccgcacccacuccucccccccccgcgcccccuccucccccggccgcucccgcuccgccucccgcacccuccgcaccgccggcguccacaucauccgcgagcaggacgaggccggccccgucgagaucuccgccuga

SEQ ID NO: 44109 - RNA, 3483 nt, Artificial Sequence
  derived and/or modified sequence opt2 from HEPH__Homo_sapiens__NP_001124332
augugggccauggaguccggccaccuccucugggcccuccucuucaugcagucccucuggccccagcucaccgacggcgccacccgcgucuacuaccucggcauccgcgacguccaguggaacuacgcccccaagggccgcaacgucaucaccaaccagccccucgacuccgacaucgucgccuccuccuuccucaaguccgacaagaaccgcaucggcggcaccuacaagaagaccaucuacaaggaguacaaggacgacuccuacaccgacgaggucgcccagcccgccuggcucggcuuccucggccccguccuccaggccgaggucggcgacgucauccucauccaccucaagaacuucgccacccgccccuacaccauccacccccacggcgucuucuacgagaaggacuccgagggcucccucuaccccgacggcuccuccggcccccucaaggccgacgacuccgucccccccggcggcucccacaucuacaacuggaccauccccgagggccacgcccccaccgacgccgaccccgccugccucaccuggaucuaccacucccacgucgacgccccccgcgacaucgccaccggccucaucggcccccucaucaccugcaagcgcggcgcccucgacggcaacucccccccccagcgccaggacgucgaccacgacuucuuccuccucuucuccgucgucgacgagaaccucuccuggcaccucaacgagaacaucgccaccuacugcuccgaccccgccuccgucgacaaggaggacgagaccuuccaggaguccaaccgcaugcacgccaucaacggcuucgucuucggcaaccuccccgagcucaacaugugcgcccagaagcgcgucgccuggcaccucuucggcaugggcaacgagaucgacguccacaccgccuucuuccacggccagaugcucaccacccgcggccaccacaccgacgucgccaacaucuuccccgccaccuucgucaccgccgagaugguccccugggagcccggcaccuggcucaucuccugccaggucaacucccacuuccgcgacggcaugcaggcccucuacaaggucaaguccugcuccauggccccccccgucgaccuccucaccggcaagguccgccaguacuucaucgaggcccacgagauccagugggacuacggccccaugggccacgacggcuccaccggcaagaaccuccgcgagcccggcuccaucuccgacaaguucuuccagaaguccuccucccgcaucggcggcaccuacuggaagguccgcuacgaggccuuccaggacgagaccuuccaggagaagaugcaccucgaggaggaccgccaccucggcauccucggccccgucauccgcgccgaggucggcgacaccauccaggucgucuucuacaaccgcgccucccagcccuucuccaugcagccccacggcgucuucuacgagaaggacuacgagggcaccgucuacaacgacggcuccuccuaccccggccucgucgccaagcccuucgagaaggucaccuaccgcuggaccguccccccccacgccggccccaccgcccaggaccccgccugccucaccuggauguacuucuccgccgccgaccccauccgcgacaccaacuccggccucgucggcccccuccucgucugccgcgccggcgcccucggcgccgacggcaagcagaagggcgucgacaaggaguucuuccuccucuucaccguccucgacgagaacaaguccugguacuccaacgccaaccaggccgccgccaugcucgacuuccgccuccucuccgaggacaucgagggcuuccaggacuccaaccgcaugcacgccaucaacggcuuccucuucuccaaccucccccgccucgacaugugcaagggcgacaccgucgccuggcaccuccucggccucggcaccgagaccgacguccacggcgucauguuccagggcaacaccguccagcuccagggcaugcgcaagggcgccgccaugcucuucccccacaccuucgucauggccaucaugcagcccgacaaccucggcaccuucgagaucuacugccaggccggcucccaccgcgaggccggcaugcgcgccaucuacaacgucucccagugccccggccaccaggccaccccccgccagcgcuaccaggccgcccgcaucuacuacaucauggccgaggaggucgagugggacuacugccccgaccgcuccugggagcgcgaguggcacaaccaguccgagaaggacuccuacggcuacaucuuccucuccaacaaggacggccuccucggcucccgcuacaagaaggccgucuuccgcgaguacaccgacggcaccuuccgcaucccccgcccccgcaccggccccgaggagcaccucggcauccucggcccccucaucaagggcgaggucggcgacauccucaccgucgucuucaagaacaacgccucccgccccuacuccguccacgcccacggcguccucgaguccaccaccgucuggccccucgccgccgagcccggcgaggucgucaccuaccaguggaacauccccgagcgcuccggccccggccccaacgacuccgccugcgucuccuggaucuacuacuccgccgucgaccccaucaaggacauguacuccggccucgucggcccccucgccaucugccagaagggcauccucgagccccacggcggccgcuccgacauggaccgcgaguucgcccuccucuuccucaucuucgacgagaacaaguccugguaccucgaggagaacgucgccacccacggcucccaggaccccggcuccaucaaccuccaggacgagaccuuccucgaguccaacaagaugcacgccaucaacggcaagcucuacgccaaccuccgcggccucaccauguaccagggcgagcgcgucgccugguacaugcucgccaugggccaggacgucgaccuccacaccauccacuuccacgccgaguccuuccucuaccgcaacggcgagaacuaccgcgccgacgucgucgaccucuuccccggcaccuucgaggucgucgagauggucgccuccaaccccggcaccuggcucaugcacugccacgucaccgaccacguccacgccggcauggagacccucuucaccgucuucucccgcaccgagcaccucuccccccucaccgucaucaccaaggagaccgagaagguccccccccgcgacaucgaggagggcaacgucaagaugcucggcaugcagauccccaucaagaacgucgagaugcucgccuccguccucgucgccaucuccgucacccuccuccucgucguccucgcccucggcggcgucgucugguaccagcaccgccagcgcaagcuccgccgcaaccgccgcuccauccucgacgacuccuucaagcuccucuccuucaagcaguga

SEQ ID NO: 44110 - RNA, 267 nt, Artificial Sequence
  derived and/or modified sequence opt2 from HEPN1__Homo_sapiens__NP_001032647
augggcaacuggggccucggcaucgcccccugggucgacggcgaguccgagcucgaguuccgccgccucggcaugcagggcccccucgaggcccuccgccgccgcgaguggaacacccagcgcgccuccuucuccuucuccuuccucaucgcccucuccccccacaccgucgacuacugccacuccuacgagcucuucaaccgccgcuggcacggccacguccucgccacccagcgccccucccucuucauccucaugcucgucuga

SEQ ID NO: 44111 - RNA, 14586 nt, Artificial Sequence
  derived and/or modified sequence opt2 from HERC1__Homo_sapiens__NP_003913
auggccaccaugaucccccccgucaagcucaaguggcucgagcaccucaacuccuccuggaucaccgaggacuccgaguccaucgccacccgcgagggcgucgccguccucuacuccaagcucgucuccaacaaggaggucgucccccucccccagcagguccucugccucaagggcccccagcuccccgacuucgagcgcgagucccucuccuccgacgagcaggaccacuaccucgacgcccuccucuccucccagcucgcccucgccaagauggucugcuccgacucccccuucgccggcgcccuccgcaagcgccuccucguccuccagcgcgucuucuacgcccucuccaacaaguaccacgacaagggcaaggucaagcagcagcagcacucccccgaguccuccuccggcuccgccgacguccacuccgucuccgagcgcccccgcuccuccaccgacgcccucaucgagaugggcguccgcaccggccucucccuccucuucgcccuccuccgccaguccuggaugaugcccgucuccggccccggccucucccucugcaacgacgucauccacaccgccaucgaggucgucuccucccuccccccccucucccucgccaacgaguccaagaucccccccaugggccucgacugccucucccaggucaccaccuuccucaagggcgucaccauccccaacuccggcgccgacacccucggccgccgccucgccuccgagcuccuccucggccucgccgcccagcgcggcucccuccgcuaccuccucgaguggaucgagauggcccucggcgccuccgccgucguccacaccauggagaagggcaagcuccucuccucccaggagggcaugaucuccuucgacugcuucaugaccauccucaugcagaugcgccgcucccucggcuccuccgccgaccgcucccaguggcgcgagcccacccgcaccuccgacggccucugcucccucuacgaggccgcccucugccucuucgaggaggucugccgcauggccuccgacuacucccgcaccugcgccucccccgacuccauccagaccggcgacgcccccaucgucuccgagaccugcgaggucuacgucuggggcuccaacuccucccaccagcucgucgagggcacccaggagaagauccuccagcccaagcucgcccccuccuucuccgacgcccagaccaucgaggccggccaguacugcaccuucgucaucuccaccgacggcuccguccgcgccugcggcaagggcuccuacggccgccucggccucggcgacuccaacaaccaguccacccucaagaagcucaccuucgagccccaccgcuccaucaagaaggucuccuccuccaagggcuccgacggccacacccucgccuucaccaccgagggcgaggucuucuccuggggcgacggcgacuacggcaagcucggccacggcaacuccuccacccagaaguaccccaagcucauccagggcccccuccagggcaaggucgucgucugcgucuccgccggcuaccgccacuccgccgccgucaccgaggacggcgagcucuacaccuggggcgagggcgacuucggccgccucggccacggcgacuccaacucccgcaacauccccacccucgucaaggacaucuccaacgucggcgaggucuccugcggcuccucccacaccaucgcccucuccaaggacggccgcaccgucugguccuucggcggcggcgacaacggcaagcucggccacggcgacaccaaccgcgucuacaagcccaaggucaucgaggcccuccagggcauguucauccgcaaggucugcgccggcucccaguccucccucgcccucaccuccaccggccaggucuacgccuggggcugcggcgccugccucggcugcggcuccuccgaggccaccgcccuccgccccaagcucaucgaggagcucgccgccacccgcaucgucgacgucuccaucggcgacucccacugccucgcccucucccacgacaacgaggucuacgccuggggcaacaacuccaugggccagugcggccagggcaacuccaccggccccaucaccaagcccaagaaggucuccggccucgacggcaucgccauccagcagaucuccgccggcaccucccacucccucgccuggaccgcccucccccgcgaccgccaggucgucgccuggcaccgccccuacugcgucgaccucgaggaguccaccuucucccaccuccgcuccuuccucgagcgcuacugcgacaagaucaacuccgagauccccccccuccccuuccccuccucccgcgagcaccacuccuuccucaagcucugccucaagcuccucuccaaccaccucgcccucgcccucgccggcggcgucgccaccuccauccucggccgccaggccggcccccuccgcaaccuccucuuccgccucauggacuccaccguccccgacgagauccaggaggucgucaucgagacccucuccgucggcgccaccaugcuccuccccccccuccgcgagcgcauggagcuccuccacucccuccucccccagggccccgaccgcugggagucccucuccaagggccagcgcaugcagcucgacaucauccucaccucccuccaggaccacacccacgucgccucccuccucggcuacuccucccccuccgacgccgccgaccucuccuccgucugcaccggcuacggcaaccucuccgaccagcccuacggcacccaguccugccaccccgacacccaccucgccgagauccucaugaagacccuccuccgcaaccucggcuucuacaccgaccaggccuucggcgagcucgagaagaacuccgacaaguuccuccucggcaccuccuccuccgagaacucccagcccgcccaccuccacgagcuccucugcucccuccagaagcagcuccucgccuucugccacaucaacaacaucuccgagaacuccuccuccgucgcccuccuccacaagcaccuccagcuccuccucccccacgccaccgacaucuacucccgcuccgccaaccuccucaaggagucccccuggaacggcuccgucggcgagaagcuccgcgacgucaucuacgucuccgccgccggcuccaugcucugccagaucgucaacucccuccuccuccuccccgucuccgucgcccgcccccuccucuccuaccuccucgaccuccuccccccccucgacugccucaaccgccuccuccccgccgccgaccuccucgaggaccaggagcuccaguggccccuccacggcggccccgagcucaucgaccccgccggccucccccucccccagcccgcccaguccugggucuggcucgucgaccucgagcgcaccaucgcccuccucaucggccgcugccucggcggcaugcuccagggcucccccgucucccccgaggagcaggacaccgccuacuggaugaagaccccccucuucuccgacggcgucgagauggacaccccccagcucgacaagugcauguccugccuccucgaggucgcccucuccggcaacgaggagcagaagcccuucgacuacaagcuccgccccgagaucgccgucuacgucgaccucgcccucggcugcuccaaggagcccgcccgcucccucuggaucuccaugcaggacuacgccgucuccaaggacugggacuccgccacccucuccaacgagucccuccucgacaccgucucccgcuucguccucgccgcccuccucaagcacaccaaccuccucucccaggccugcggcgagucccgcuaccagcccggcaagcaccucuccgaggucuaccgcugcgucuacaagguccgcucccgccuccucgccugcaagaaccucgagcucauccagacccgcuccuccucccgcgaccgcuggaucuccgagaaccaggacuccgccgacgucgacccccaggagcacuccuucacccgcaccaucgacgaggaggccgagauggaggagcaggccgagcgcgaccgcgaggagggccaccccgagcccgaggacgaggaggaggagcgcgagcacgaggucaugaccgccggcaagaucuuccagugcuuccucuccgcccgcgaggucgcccgcucccgcgaccgcgaccgcaugaacuccggcgccggcuccggcgcccgcgccgacgacccccccccccagucccagcaggagcgccgcgucuccaccgaccuccccgagggccaggacgucuacaccgccgccugcaacuccgucauccaccgcugcgcccuccucauccucggcgucucccccgucaucgacgagcuccagaagcgccgcgaggagggccagcuccagcagcccuccaccuccgccuccgagggcggcggccucaugacccgcuccgagucccucaccgccgagucccgccucguccacaccucccccaacuaccgccucaucaagucccgcuccgaguccgaccucucccagcccgaguccgacgaggagggcuacgcccucuccggccgccgcaacgucgaccucgaccucgccgccucccaccgcaagcgcggccccaugcacucccagcucgagucccucuccgacuccugggcccgccucaagcacucccgcgacuggcucugcaacuccuccuacuccuucgaguccgacuucgaccucaccaagucccucggcguccacacccucaucgagaacgucgucuccuucgucuccggcgacgucggcaacgcccccggcuucaaggagcccgaggaguccauguccaccuccccccaggccuccaucaucgccauggagcagcagcagcuccgcgccgagcuccgccucgaggcccuccaccagauccucguccuccucuccggcauggaggagaagggcuccaucucccucgccggcucccgccucuccuccggcuuccaguccuccacccuccucaccuccguccgccuccaguuccucgccggcugcuucggccucggcaccgucggccacaccggcggcaagggcgaguccggccgccuccaccacuaccaggacggcauccgcgccgccaagcgcaacauccagaucgagauccaggucgccguccacaagaucuaccagcagcucuccgccacccucgagcgcgcccuccaggccaacaagcaccacaucgaggcccagcagcgccuccuccucgucaccgucuucgcccucuccguccacuaccagcccgucgacgucucccucgccaucuccaccggccuccucaacguccucucccagcucugcggcaccgacaccaugcucggccagccccuccagcuccuccccaagaccggcgucucccagcucuccaccgcccucaaggucgccuccacccgccuccuccagauccucgccaucaccaccggcaccuacgccgacaagcucucccccaaggucguccagucccuccucgaccuccucugcucccagcucaagaaccuccucucccagaccggcguccuccacauggccuccuucggcgagggcgagcaggaggacggcgaggaggaggagaagaaggucgacuccuccggcgagaccgagaagaaggacuuccgcgccgcccuccgcaagcagcacgccgccgagcuccaccucggcgacuuccucgucuuccuccgccgcgucgucuccuccaaggccauccaguccaagauggccucccccaaguggaccgagguccuccucaacaucgccucccagaagugcuccuccggcaucccccucgucggcaaccuccgcacccgccuccucgcccuccacguccucgaggccguccuccccgccugcgaguccggcgucgaggacgaccagauggcccagaucgucgagcgccucuucucccuccucuccgacugcaugugggagacccccaucgcccaggccaagcacgccauccagaucaaggagaaggagcaggagaucaagcuccagaagcagggcgagcucgaggaggaggacgagaaccuccccauccaggaggucuccuucgaccccgagaaggcccagugcugccucgucgagaacggccagauccucacccacggcuccggcggcaagggcuacggccucgccuccaccggcgucaccuccggcugcuaccaguggaaguucuacaucgucaaggagaaccgcggcaacgagggcaccugcgucggcgucucccgcuggcccguccacgacuucaaccaccgcaccaccuccgacauguggcucuaccgcgccuacuccggcaaccucuaccacaacggcgagcagacccucacccucuccuccuucacccagggcgacuucaucaccugcguccucgacauggaggcccgcaccaucuccuucggcaagaacggcgaggagcccaagcucgccuucgaggacgucgacgccgccgagcucuaccccugcgucauguucuacuccuccaaccccggcgagaaggucaagaucugcgacaugcagaugcgcggcaccccccgcgaccuccuccccggcgaccccaucugcucccccgucgccgccguccucgccgaggccaccauccagcucauccgcauccuccaccgcaccgaccgcuggaccuacugcaucaacaagaagaugauggagcgccuccacaagaucaagaucugcaucaaggaguccggccagaagcucaagaagucccgcuccguccagucccgcgaggagaacgagaugcgcgaggagaaggaguccaaggaggaggagaagggcaagcacacccgccacggccucgccgaccucuccgagcuccagcuccgcacccucugcaucgaggucuggcccguccucgccgucaucggcggcgucgacgccggccuccgcgucggcggccgcugcguccacaagcagaccggccgccacgccacccuccucggcgucgucaaggagggcuccaccuccgccaagguccagugggacgaggccgagaucaccaucuccuuccccaccuucuggucccccuccgacaccccccucuacaaccucgagcccugcgagccccuccccuucgacgucgcccgcuuccgcggccucaccgccuccguccuccucgaccucaccuaccucaccggcguccacgaggacaugggcaagcaguccaccaagcgccacgagaagaagcaccgccacgaguccgaggagaagggcgacgucgagcagaagcccgaguccgaguccgcccucgacaugcgcaccggccucaccuccgacgacgucaagucccaguccaccaccuccuccaaguccgagaacgagaucgccuccuucucccucgaccccacccuccccuccgucgagucccagcaccagaucaccgagggcaagcgcaagaaccacgagcacauguccaagaaccacgacgucgcccaguccgagauccgcgccguccagcucuccuaccucuaccucggcgccaugaagucccucuccgcccuccucggcugcuccaaguacgccgagcuccuccucauccccaagguccucgccgagaacggccacaacuccgacugcgccuccucccccgucguccacgaggacgucgagaugcgcgccgcccuccaguuccucaugcgccacauggucaagcgcgccgucaugcgcucccccaucaagcgcgcccucggccucgccgaccucgagcgcgcccaggccaugaucuacaagcucgucguccacggccuccucgaggaccaguucggcggcaagaucaagcaggagaucgaccagcaggccgaggaguccgaccccgcccagcaggcccagacccccgucaccaccucccccuccgccuccuccaccaccuccuucauguccuccucccucgaggacaccaccaccgccaccacccccgucaccgacaccgagaccguccccgccuccgagucccccggcgucaugccccucucccuccuccgccagauguucuccuccuaccccaccaccaccguccuccccacccgccgcgcccagaccccccccaucuccucccuccccaccucccccuccgacgaggucggccgccgccagucccucaccucccccgacucccaguccgcccgccccgccaaccgcaccgcccucuccgaccccuccucccgccucuccaccuccccccccccccccgccaucgccgucccccuccucgagaugggcuucucccuccgccagaucgccaaggccauggaggccaccggcgcccgcggcgaggccgacgcccagaacaucaccguccucgccauguggaugaucgagcaccccggccacgaggacgaggaggagccccaguccggcuccaccgccgacucccgccccggcgccgccguccucggcuccggcggcaaguccaacgaccccugcuaccuccagucccccggcgacauccccuccgccgacgccgccgagauggaggagggcuucuccgagucccccgacaaccucgaccacaccgagaacgccgccuccggcuccggccccuccgcccgcggccgcuccgccgucacccgccgccacaaguucgaccucgccgcccgcacccuccucgcccgcgccgccggccucuaccgcuccguccaggcccaccgcaaccagucccgccgcgagggcaucucccuccagcaggaccccggcgcccucuacgacuucaaccucgacgaggagcucgagaucgaccucgacgacgaggccauggaggccauguucggccaggaccucaccuccgacaacgacauccucggcauguggauccccgagguccucgacuggcccaccuggcacgucugcgaguccgaggaccgcgaggaggucgucgucugcgagcucugcgagugcuccgucgucuccuucaaccagcacaugaagcgcaaccaccccggcugcggccgcuccgccaaccgccagggcuaccgcuccaacggcuccuacgucgacggcugguucggcggcgagugcggcuccggcaaccccuacuaccuccucugcggcaccugccgcgagaaguaccucgccaugaagaccaaguccaaguccaccuccuccgagcgcuacaagggccaggcccccgaccucaucggcaagcaggacuccgucuacgaggaggacugggacaugcucgacgucgacgaggacgagaagcucaccggcgaggaggaguucgagcuccucgccggcccccucggccucaacgaccgccgcaucguccccgagcccguccaguuccccgacuccgacccccucggcgccuccgucgccauggucaccgccaccaacuccauggaggagacccucaugcagaucggcugccacggcuccgucgagaaguccuccuccggccgcaucacccucggcgagcaggccgccgcccucgccaacccccacgaccgcgucgucgcccuccgccgcgucaccgccgccgcccagguccuccucgcccgcaccauggucaugcgcgcccucucccuccucuccgucuccggcuccuccugcucccucgccgccggccucgagucccucggccucaccgacauccgcacccucguccgccucaugugccucgccgccgccggccgcgccggccucuccaccucccccuccgccauggccuccaccuccgagcgcucccgcggcggccacuccaaggccaacaagcccaucuccugccucgccuaccucuccaccgccgucggcugccucgccuccaacgcccccuccgccgccaagcuccucguccagcucugcacccagaaccucaucuccgccgccaccggcgucaaccucaccaccgucgacgacuccauccagcgcaaguuccuccccuccuuccuccgcggcaucgccgaggagaacaagcucgucaccucccccaacuucgucgucacccaggcccucgucgcccuccucgccgacaagggcgccaagcuccgccccaacuacgacaaguccgaggucgagaagaagggcccccucgagcucgccaacgcccucgccgccugcugccucuccucccgccucuccucccagcaccgccagugggccgcccagcagcucguccgcacccucgccgcccacgaccgcgacaaccagaccacccuccagacccucgccgacaugggcggcgaccuccgcaagugcuccuucaucaagcucgaggcccaccagaaccgcgucaugaccugcgucuggugcaacaagaagggccuccucgccaccuccggcaacgacggcaccauccgcgucuggaacgucaccaagaagcaguacucccuccagcagaccugcgucuucaaccgccucgagggcgacgccgaggagucccucggcucccccuccgaccccuccuucucccccgucuccugguccaucuccggcaaguaccucgccggcgcccucgagaagauggucaacaucuggcaggucaacggcggcaagggccucgucgacauccagccccacugggucuccgcccucgccuggcccgaggagggccccgccaccgccugguccggcgagucccccgagcuccuccucgucggccgcauggacggcucccucggccucaucgaggucgucgacgucuccaccaugcaccgccgcgagcucgagcacugcuaccgcaaggacgucuccgucaccugcaucgccugguucuccgaggaccgccccuucgccgucggcuacuucgacggcaagcuccuccucggcaccaaggagccccucgagaagggcggcaucguccucaucgacgcccacaaggacacccucaucuccaugaagugggaccccaccggccacauccucaugaccugcgccaaggaggacuccgucaagcucuggggcuccaucuccggcugcuggugcugccuccacucccucugccaccccuccaucgucaacggcaucgccuggugccgccuccccggcaagggcuccaagcuccagcuccucauggccaccggcugccaguccggccucgucugcgucuggcgcaucccccaggacaccacccagaccaacgucaccuccgccgagggcuggugggagcaggaguccaacugccaggacggcuaccgcaaguccuccggcgccaagugcgucuaccagcuccgcggccacaucacccccguccgcaccgucgccuucuccuccgacggccucgcccucgucuccggcggccucggcggccucaugaacaucuggucccuccgcgacggcuccguccuccagaccgucgucaucggcuccggcgccauccagaccaccgucuggauccccgaggucggcgucgccgccugcuccaaccgcuccaaggacguccucgucgucaacugcaccgccgagugggccgccgccaaccacguccucgccaccugccgcaccgcccucaagcagcagggcguccucggccucaacauggcccccugcaugcgcgccuuccucgagcgccuccccaugaugcuccaggagcaguacgccuacgagaagccccacgucgucugcggcgaccagcucguccacucccccuacaugcagugccucgccucccucgccgucggccuccaccucgaccagcuccucugcaacccccccguccccccccaccaccagaacugccuccccgaccccgccuccuggaaccccaacgagugggccuggcucgagugcuucuccaccaccaucaaggccgccgaggcccucaccaacggcgcccaguuccccgaguccuucaccguccccgaccucgagcccguccccgaggacgagcucgucuuccucauggacaacuccaaguggaucaacggcauggacgagcagaucauguccugggccaccucccgccccgaggacuggcaccucggcggcaagugcgacgucuaccucuggggcgccggccgccacggccagcucgccgaggccggccgcaacgucaugguccccgccgccgcccccuccuucucccaggcccagcaggucaucugcggccagaacugcaccuucgucauccaggccaacggcaccguccucgccugcggcgagggcuccuacggccgccucggccagggcaacuccgacgaccuccacguccucaccgucaucuccgcccuccagggcuucgucgucacccagcucgucaccuccugcggcuccgacggccacuccauggcccucaccgaguccggcgaggucuucuccuggggcgacggcgacuacggcaagcucggccacggcaacuccgaccgccagcgccgcccccgccagaucgaggcccuccagggcgaggaggucguccagauguccugcggcuucaagcacuccgccgucgucaccuccgacggcaagcucuucaccuucggcaacggcgacuacggccgccucggccucggcaacaccuccaacaagaagcuccccgagcgcgucaccgcccucgagggcuaccagaucggccaggucgccugcggccucaaccacacccucgccgucuccgccgacggcuccauggucugggccuucggcgacggcgacuacggcaagcucggccucggcaacuccaccgccaaguccuccccccagaagaucgacguccucugcggcaucggcaucaagaaggucgccugcggcacccaguucuccgucgcccucaccaaggacggccacgucuacaccuucggccaggaccgccucaucggccuccccgagggccgcgcccgcaaccacaaccgcccccagcagauccccguccucgccggcgucaucaucgaggacgucgccgucggcgccgagcacacccucgcccucgccuccaacggcgacgucuacgccuggggcuccaacuccgagggccagcucggccucggccacaccaaccacguccgcgagcccacccucgucaccggccuccagggcaagaacguccgccagaucuccgccggccgcugccacuccgccgccuggaccgccccccccguccccccccgcgcccccggcgucuccgucccccuccagcucggccuccccgacaccguccccccccaguacggcgcccuccgcgaggucuccauccacaccguccgcgcccgccuccgccuccucuaccacuucuccgaccucauguacuccuccuggcgccuccucaaccucucccccaacaaccagaacuccaccucccacuacaacgccggcaccuggggcaucguccagggccagcuccgcccccuccucgccccccgcgucuacacccuccccaugguccgcuccaucggcaagaccaugguccagggcaagaacuacggcccccagaucaccgucaagcgcaucuccacccgcggccgcaagugcaagcccaucuucguccagaucgcccgccaggucgucaagcucaacgccuccgaccuccgccuccccucccgcgccuggaaggucaagcucgucggcgagggcgccgacgacgccggcggcgucuucgacgacaccaucaccgagaugugccaggagcucgagaccggcaucgucgaccuccucauccccucccccaacgccaccgccgaggucggcuacaaccgcgaccgcuuccucuucaaccccuccgccugccucgacgagcaccucaugcaguucaaguuccucggcauccucaugggcgucgccauccgcaccaagaagccccucgaccuccaccucgccccccucgucuggaagcagcucugcugcgucccccucacccucgaggaccucgaggaggucgaccuccucuacguccagacccucaacuccauccuccacaucgaggacuccggcaucaccgaggaguccuuccacgagaugaucccccucgacuccuucgucggccaguccgccgacggcaagaugguccccaucauccccggcggcaacuccaucccccucaccuucuccaaccgcaaggaguacgucgagcgcgccaucgaguaccgccuccacgagauggaccgccaggucgccgccguccgcgagggcauguccuggaucguccccgucccccuccucucccuccucaccgccaagcagcucgagcagauggucugcggcaugcccgagaucuccgucgagguccucaagaaggucguccgcuaccgcgaggucgacgagcagcaccagcucguccagugguucuggcacacccucgaggaguucuccaacgaggagcgcguccucuucaugcgcuucgucuccggccgcucccgccuccccgccaacaccgccgacaucucccagcgcuuccagaucaugaaggucgaccgccccuacgacucccuccccaccucccagaccugcuucuuccagcuccgccucccccccuacuccucccagcucgucauggccgagcgccuccgcuacgccaucaacaacugccgcuccaucgacauggacaacuacaugcucucccgcaacgucgacaacgccgagggcuccgacaccgacuacuga

SEQ ID NO: 44112 - RNA, 14505 nt, Artificial Sequence
  derived and/or modified sequence opt2 from HERC2__Homo_sapiens__NP_004658
augcccuccgaguccuucugccucgccgcccaggcccgccucgacuccaaguggcucaagaccgacauccagcucgccuucacccgcgacggccucugcggccucuggaacgagauggucaaggacggcgagaucgucuacaccggcaccgaguccacccagaacggcgagcuccccccccgcaaggacgacuccgucgagcccuccggcaccaagaaggaggaccucaacgacaaggagaagaaggacgaggaggagacccccgcccccaucuaccgcgccaaguccauccucgacuccugggucuggggcaagcagcccgacgucaacgagcucaaggagugccucuccguccucgucaaggagcagcaggcccucgccguccaguccgccaccaccacccucuccgcccuccgccucaagcagcgccucgucauccucgagcgcuacuucaucgcccucaaccgcaccgucuuccaggagaacgucaaggucaaguggaaguccuccggcaucucccucccccccgucgacaagaaguccucccgccccgccggcaagggcgucgagggccucgcccgcgucggcucccgcgccgcccucuccuucgccuucgccuuccuccgccgcgccuggcgcuccggcgaggacgccgaccucugcuccgagcuccuccaggagucccucgacgcccuccgcgcccuccccgaggccucccucuucgacgaguccaccgucuccuccgucuggcucgaggucgucgagcgcgccacccgcuuccuccgcuccgucgucaccggcgacguccacggcacccccgccaccaagggccccggcuccaucccccuccaggaccagcaccucgcccucgccauccuccucgagcucgccguccagcgcggcacccucucccagaugcucuccgccauccuccuccuccuccagcucugggacuccggcgcccaggagaccgacaacgagcgcuccgcccagggcaccuccgccccccuccucccccuccuccagcgcuuccaguccaucaucugccgcaaggacgccccccacuccgagggcgacaugcaccuccucuccggcccccucucccccaacgaguccuuccuccgcuaccucacccucccccaggacaacgagcucgccaucgaccuccgccagaccgccgucgucgucauggcccaccucgaccgccucgccacccccugcaugcccccccucugcuccucccccaccucccacaagggcucccuccaggaggucaucggcuggggccucaucggcuggaaguacuacgccaacgucaucggccccauccagugcgagggccucgccaaccucggcgucacccagaucgccugcgccgagaagcgcuuccucauccucucccgcaacggccgcgucuacacccaggccuacaacuccgacacccucgccccccagcucguccagggccucgccucccgcaacaucgucaagaucgccgcccacuccgacggccaccacuaccucgcccucgccgccaccggcgaggucuacuccuggggcugcggcgacggcggccgccucggccacggcgacaccgucccccucgaggagcccaaggucaucuccgccuucuccggcaagcaggccggcaagcacgucguccacaucgccugcggcuccaccuacuccgccgccaucaccgccgagggcgagcucuacaccuggggccgcggcaacuacggccgccucggccacggcuccuccgaggacgaggccauccccaugcucgucgccggccucaagggccucaaggucaucgacgucgccugcggcuccggcgacgcccagacccucgccgucaccgagaacggccaggucugguccuggggcgacggcgacuacggcaagcucggccgcggcggcuccgacggcugcaagacccccaagcucaucgagaagcuccaggaccucgacgucgucaagguccgcugcggcucccaguucuccaucgcccucaccaaggacggccaggucuacuccuggggcaagggcgacaaccagcgccucggccacggcaccgaggagcacguccgcuaccccaagcuccucgagggccuccagggcaagaaggucaucgacgucgccgccggcuccacccacugccucgcccucaccgaggacuccgagguccacuccuggggcuccaacgaccagugccagcacuucgacacccuccgcgucaccaagcccgagcccgccgcccuccccggccucgacaccaagcacaucgucggcaucgccugcggccccgcccaguccuucgccugguccuccugcuccgagugguccaucggccuccgcguccccuucgucgucgacaucugcuccaugaccuucgagcagcucgaccuccuccuccgccaggucuccgagggcauggacggcuccgccgacuggccccccccccaggagaaggagugcgucgccgucgccacccucaaccuccuccgccuccagcuccacgccgccaucucccaccaggucgaccccgaguuccucggccucggccucggcuccauccuccucaacucccucaagcagaccgucgucacccucgccuccuccgccggcguccucuccaccguccaguccgccgcccaggccguccuccaguccggcugguccguccuccuccccaccgccgaggagcgcgcccgcgcccucuccgcccuccuccccugcgccgucuccggcaacgaggucaacaucucccccggccgccgcuucaugaucgaccuccucgucggcucccucauggccgacggcggccucgaguccgcccuccacgccgccaucaccgccgagauccaggacaucgaggccaagaaggaggcccagaaggagaaggagaucgacgagcaggaggccaacgccuccaccuuccaccgcucccgcaccccccucgacaaggaccucaucaacaccggcaucugcgaguccuccggcaagcagugccucccccucguccagcucauccagcagcuccuccgcaacaucgccucccagaccgucgcccgccucaaggacgucgcccgccgcaucuccuccugccucgacuucgagcagcacucccgcgagcgcuccgccucccucgaccuccuccuccgcuuccagcgccuccucaucuccaagcucuaccccggcgaguccaucggccagaccuccgacaucuccucccccgagcucaugggcgucggcucccuccucaagaaguacaccgcccuccucugcacccacaucggcgacauccuccccgucgccgccuccaucgccuccaccuccuggcgccacuucgccgaggucgccuacaucgucgagggcgacuucaccggcguccuccuccccgagcucgucgucuccaucguccuccuccucuccaagaacgccggccucaugcaggaggccggcgccgucccccuccucggcggccuccucgagcaccucgaccgcuucaaccaccucgcccccggcaaggagcgcgacgaccacgaggagcucgccuggcccggcaucauggaguccuucuucaccggccagaacugccgcaacaacgaggaggucacccucauccgcaaggccgaccucgagaaccacaacaaggacggcggcuucuggaccgucaucgacggcaaggucuacgacaucaaggacuuccagacccagucccucaccggcaacuccauccucgcccaguucgccggcgaggaccccgucgucgcccucgaggccgcccuccaguucgaggacacccgcgaguccaugcacgccuucugcgucggccaguaccucgagcccgaccaggagaucgucaccauccccgaccucggcucccucuccuccccccucaucgacaccgagcgcaaccucggccuccuccucggccuccacgccuccuaccucgccauguccaccccccucucccccgucgagaucgagugcgccaaguggcuccaguccuccaucuucuccggcggccuccagaccucccagauccacuacuccuacaacgaggagaaggacgaggaccacugcuccucccccggcggcacccccgccuccaagucccgccucugcucccaccgccgcgcccucggcgaccacucccaggccuuccuccaggccaucgccgacaacaacauccaggaccacaacgucaaggacuuccucugccagaucgagcgcuacugccgccagugccaccucaccacccccaucauguucccccccgagcaccccgucgaggaggucggccgccuccuccucugcugccuccucaagcacgaggaccucggccacgucgcccucucccucguccacgccggcgcccucggcaucgagcaggucaagcaccgcacccuccccaaguccgucgucgacgucugccgcgucgucuaccaggccaagugcucccucaucaagacccaccaggagcagggccgcuccuacaaggaggucugcgcccccgucaucgagcgccuccgcuuccucuucaacgagcuccgccccgccgucugcaacgaccucuccaucauguccaaguucaagcuccucuccucccucccccgcuggcgccgcaucgcccagaagaucauccgcgagcgccgcaagaagcgcguccccaagaagcccgaguccaccgacgacgaggagaagaucggcaacgaggaguccgaccucgaggaggccugcauccucccccacucccccaucaacgucgacaagcgccccaucgccaucaagucccccaaggacaaguggcagccccuccucuccaccgucaccggcguccacaaguacaaguggcucaagcagaacguccagggccucuacccccaguccccccuccucuccaccaucgccgaguucgcccucaaggaggagcccgucgacgucgagaagaugcgcaagugccuccucaagcagcucgagcgcgccgagguccgccucgagggcaucgacaccauccucaagcucgccuccaagaacuuccuccuccccuccguccaguacgccauguucugcggcuggcagcgccucauccccgagggcaucgacaucggcgagccccucaccgacugccucaaggacgucgaccucaucccccccuucaaccgcaugcuccucgaggucaccuucggcaagcucuacgccugggccguccagaacauccgcaacguccucauggacgccuccgccaaguucaaggagcucggcauccagcccgucccccuccagaccaucaccaacgagaaccccuccggccccucccucggcaccaucccccaggcccgcuuccuccucgucaugcucuccaugcucacccuccagcacggcgccaacaaccucgaccuccuccucaacuccggcaugcucgcccucacccagaccgcccuccgccucaucggccccuccugcgacaacgucgaggaggacaugaacgccuccgcccagggcgccuccgccaccguccucgaggagacccgcaaggagaccgcccccguccagcuccccgucuccggccccgagcucgccgccaugaugaagaucggcacccgcgucaugcgcggcgucgacuggaaguggggcgaccaggacggccccccccccggccucggccgcgucaucggcgagcucggcgaggacggcuggauccgcguccagugggacaccggcuccaccaacuccuaccgcaugggcaaggagggcaaguacgaccucaagcucgccgagcuccccgccgccgcccagcccuccgccgaggacuccgacaccgaggacgacuccgaggccgagcagaccgagcgcaacauccaccccaccgccaugauguucaccuccaccaucaaccuccuccagacccucugccucuccgccggcguccacgccgagaucaugcaguccgaggccaccaagacccucugcggccuccuccgcaugcucgucgaguccggcaccaccgacaagaccuccucccccaaccgccucgucuaccgcgagcagcaccgcuccuggugcacccucggcuucguccgcuccaucgcccucaccccccaggucugcggcgcccucuccuccccccaguggaucacccuccucaugaaggucgucgagggccacgcccccuucaccgccaccucccuccagcgccagauccucgccguccaccuccuccaggccguccuccccuccugggacaagaccgagcgcgcccgcgacaugaagugccucgucgagaagcucuucgacuuccucggcucccuccucaccaccugcuccuccgacgucccccuccuccgcgaguccacccuccgccgccgccgcguccgcccccaggccucccucaccgccacccacuccuccacccucgccgaggaggucgucgcccuccuccgcacccuccacucccucacccaguggaacggccucaucaacaaguacaucaacucccagcuccgcuccaucacccacuccuucgucggccgccccuccgagggcgcccagcucgaggacuacuuccccgacuccgagaaccccgaggucggcggccucauggccguccucgccgucaucggcggcaucgacggccgccuccgccucggcggccaggucaugcacgacgaguucggcgagggcaccgucacccgcaucacccccaagggcaagaucaccguccaguucuccgacaugcgcaccugccgcgucugcccccucaaccagcucaagccccuccccgccgucgccuucaacgucaacaaccuccccuucaccgagcccaugcucuccgucugggcccagcucgucaaccucgccggcuccaagcucgagaagcacaagaucaagaaguccaccaagcaggccuucgccggccaggucgaccucgaccuccuccgcugccagcagcucaagcucuacauccucaaggccggccgcgcccuccucucccaccaggacaagcuccgccagauccucucccagcccgccguccaggagaccggcaccguccacaccgacgacggcgccgucgucucccccgaccucggcgacaugucccccgagggcccccagccccccaugauccuccuccagcagcuccucgccuccgccacccagcccucccccgucaaggccaucuucgacaagcaggagcucgaggccgccgcccucgccgucugccagugccucgccgucgaguccacccaccccuccucccccggcuucgaggacugcuccuccuccgaggccaccacccccgucgccguccagcacauccgccccgcccgcgucaagcgccgcaagcagucccccguccccgcccuccccaucgucguccagcucauggagaugggcuucucccgccgcaacaucgaguucgcccucaagucccucaccggcgccuccggcaacgccuccucccuccccggcgucgaggcccucgucggcuggcuccucgaccacuccgacauccaggucaccgagcucuccgacgccgacaccgucuccgacgaguacuccgacgaggaggucgucgaggacgucgacgacgccgccuacuccauguccaccggcgccgucgucaccgagucccagaccuacaagaagcgcgccgacuuccucuccaacgacgacuacgccgucuacguccgcgagaacauccaggucggcaugaugguccgcugcugccgcgccuacgaggaggucugcgagggcgacgucggcaaggucaucaagcucgaccgcgacggccuccacgaccucaacguccagugcgacuggcagcagaagggcggcaccuacuggguccgcuacauccacgucgagcucaucggcuaccccccccccuccuccuccucccacaucaagaucggcgacaagguccgcgucaaggccuccgucaccacccccaaguacaaguggggcuccgucacccaccaguccgucggcgucgucaaggccuucuccgccaacggcaaggacaucaucgucgacuucccccagcagucccacuggaccggccuccucuccgagauggagcucguccccuccauccaccccggcgucaccugcgacggcugccagauguuccccaucaacggcucccgcuucaagugccgcaacugcgacgacuucgacuucugcgagaccugcuucaagaccaagaagcacaacacccgccacaccuucggccgcaucaacgagcccggccaguccgccgucuucugcggccgcuccggcaagcagcucaagcgcugccacuccucccagcccggcaugcuccucgacuccuggucccgcauggucaagucccucaacgucuccuccuccgucaaccaggccucccgccucaucgacggcuccgagcccugcuggcaguccuccggcucccagggcaagcacuggauccgccucgagaucuuccccgacguccucguccaccgccucaagaugaucgucgaccccgccgacuccuccuacaugcccucccucgucgucgucuccggcggcaacucccucaacaaccucaucgagcucaagaccaucaacaucaaccccuccgacaccaccgucccccuccucaacgacugcaccgaguaccaccgcuacaucgagaucgccaucaagcagugccgcuccuccggcaucgacugcaagauccacggccucauccuccucggccgcauccgcgccgaggaggaggaccucgccgccguccccuuccucgccuccgacaacgaggaggaggaggacgagaagggcaacuccggcucccucauccgcaagaaggccgccggccucgaguccgccgccaccauccgcaccaaggucuucgucuggggccucaacgacaaggaccagcucggcggccucaagggcuccaagaucaagguccccuccuucuccgagacccucuccgcccucaacgucguccaggucgccggcggcuccaagucccucuucgccgucaccgucgagggcaaggucuacgccugcggcgaggccaccaacggccgccucggccucggcaucuccuccggcaccguccccaucccccgccagaucaccgcccucuccuccuacgucgucaagaaggucgccguccacuccggcggccgccacgccaccgcccucaccgucgacggcaaggucuucuccuggggcgagggcgacgacggcaagcucggccacuucucccgcaugaacugcgacaagccccgccucaucgaggcccucaagaccaagcgcauccgcgacaucgccugcggcuccucccacuccgccgcccucaccuccuccggcgagcucuacaccuggggccucggcgaguacggccgccucggccacggcgacaacaccacccagcucaagcccaagauggucaagguccuccucggccaccgcgucauccaggucgccugcggcucccgcgacgcccagacccucgcccucaccgacgagggccucgucuucuccuggggcgacggcgacuucggcaagcucggccgcggcggcuccgagggcugcaacaucccccagaacaucgagcgccucaacggccagggcgucugccagaucgagugcggcgcccaguucucccucgcccucaccaaguccggcgucgucuggaccuggggcaagggcgacuacuuccgccucggccacggcuccgacguccacguccgcaagccccaggucgucgagggccuccgcggcaagaagaucguccacgucgccgucggcgcccuccacugccucgccgucaccgacuccggccaggucuacgccuggggcgacaacgaccacggccagcagggcaacggcaccaccaccgucaaccgcaagcccacccucguccagggccucgagggccagaagaucacccgcgucgccugcggcuccucccacuccgucgccuggaccaccgucgacgucgccacccccuccguccacgagcccguccucuuccagaccgcccgcgacccccucggcgccuccuaccucggcguccccuccgacgccgacuccuccgccgccuccaacaagaucuccggcgccuccaacuccaagcccaaccgccccucccucgccaagauccuccucucccucgacggcaaccucgccaagcagcaggcccucucccacauccucaccgcccuccagaucauguacgcccgcgacgccgucgucggcgcccucaugcccgccgccaugaucgcccccgucgagugccccuccuucuccuccgccgcccccuccgacgccuccgccauggccucccccaugaacggcgaggagugcaugcucgccgucgacaucgaggaccgccucucccccaaccccuggcaggagaagcgcgagaucgucuccuccgaggacgccgucacccccuccgccgucacccccuccgcccccuccgccuccgcccgccccuucauccccgucaccgacgaccucggcgccgccuccaucaucgccgagaccaugaccaagaccaaggaggacgucgagucccagaacaaggccgccggccccgagccccaggcccucgacgaguucaccucccuccucaucgccgacgacacccgcgucgucgucgaccuccucaagcucuccgucugcucccgcgccggcgaccgcggccgcgacguccucuccgccguccucuccggcaugggcaccgccuacccccaggucgccgacaugcuccucgagcucugcgucaccgagcucgaggacgucgccaccgacucccaguccggccgccucuccucccagcccgucgucgucgaguccucccaccccuacaccgacgacaccuccaccuccggcaccgucaagauccccggcgccgagggccuccgcgucgaguucgaccgccagugcuccaccgagcgccgccacgacccccucaccgucauggacggcgucaaccgcaucgucuccguccgcuccggccgcgagugguccgacugguccuccgagcuccgcauccccggcgacgagcucaaguggaaguucaucuccgacggcuccgucaacggcuggggcuggcgcuucaccgucuaccccaucaugcccgccgccggccccaaggagcuccucuccgaccgcugcguccucuccugccccuccauggaccucgucaccugccuccucgacuuccgccucaaccucgccuccaaccgcuccaucgucccccgccucgccgccucccucgccgccugcgcccagcucuccgcccucgccgccucccaccgcaugugggcccuccagcgccuccgcaagcuccucaccaccgaguucggccaguccaucaacaucaaccgccuccucggcgagaacgacggcgagacccgcgcccucuccuucaccggcuccgcccucgccgcccucgucaagggccuccccgaggcccuccagcgccaguucgaguacgaggaccccaucguccgcggcggcaagcagcuccuccacucccccuucuucaagguccucgucgcccucgccugcgaccucgagcucgacacccuccccugcugcgccgagacccacaagugggccugguuccgccgcuacugcauggccucccgcgucgccgucgcccucgacaagcgcaccccccucccccgccucuuccucgacgaggucgccaagaagauccgcgagcucauggccgacuccgagaacauggacguccuccacgagucccacgacaucuucaagcgcgagcaggacgagcagcucguccaguggaugaaccgccgccccgacgacuggacccucuccgccggcggcuccggcaccaucuacggcuggggccacaaccaccgcggccagcucggcggcaucgagggcgccaaggucaagguccccacccccugcgaggcccucgccacccuccgccccguccagcucaucggcggcgagcagacccucuucgccgucaccgccgacggcaagcucuacgccaccggcuacggcgccggcggccgccucggcaucggcggcaccgaguccgucuccacccccacccuccucgaguccauccagcacgucuucaucaagaaggucgccgucaacuccggcggcaagcacugccucgcccucuccuccgagggcgaggucuacuccuggggcgaggccgaggacggcaagcucggccacggcaaccgcucccccugcgaccgcccccgcgucaucgagucccuccgcggcaucgaggucgucgacgucgccgccggcggcgcccacuccgccugcgucaccgccgccggcgaccucuacaccuggggcaagggccgcuacggccgccucggccacuccgacuccgaggaccagcucaagcccaagcucgucgaggcccuccagggccaccgcgucgucgacaucgccugcggcuccggcgacgcccagacccucugccucaccgacgacgacaccgucugguccuggggcgacggcgacuacggcaagcucggccgcggcggcuccgacggcugcaagguccccaugaagaucgacucccucaccggccucggcgucgucaaggucgagugcggcucccaguucuccgucgcccucaccaaguccggcgccgucuacaccuggggcaagggcgacuaccaccgccucggccacggcuccgacgaccacguccgccgcccccgccagguccagggccuccagggcaagaaggucaucgccaucgccaccggcucccuccacugcgucugcugcaccgaggacggcgaggucuacaccuggggcgacaacgacgagggccagcucggcgacggcaccaccaacgccauccagcgcccccgccucgucgccgcccuccagggcaagaaggucaaccgcgucgccugcggcuccgcccacacccucgccugguccaccuccaagcccgccuccgccggcaagcuccccgcccagguccccauggaguacaaccaccuccaggagauccccaucaucgcccuccgcaaccgccuccuccuccuccaccaccucuccgagcucuucugccccugcauccccauguucgaccucgagggcucccucgacgagaccggccucggccccuccgucggcuucgacacccuccgcggcauccucaucucccagggcaaggaggccgccuuccgcaaggucguccaggccaccaugguccgcgaccgccagcacggccccgucgucgagcucaaccgcauccaggucaagcgcucccgcuccaagggcggccucgccggccccgacggcaccaaguccgucuucggccagaugugcgccaagauguccuccuucggccccgacucccuccuccucccccaccgcgucuggaaggucaaguucgucggcgaguccgucgacgacugcggcggcggcuacuccgaguccaucgccgagaucugcgaggagcuccagaacggccucaccccccuccucaucgucacccccaacggccgcgacgaguccggcgccaaccgcgacugcuaccuccucucccccgccgcccgcgcccccguccacuccuccauguuccgcuuccucggcguccuccucggcaucgccauccgcaccggcuccccccucucccucaaccucgccgagcccgucuggaagcagcucgccggcaugucccucaccaucgccgaccucuccgaggucgacaaggacuucauccccggccucauguacauccgcgacaacgaggccaccuccgaggaguucgaggccaugucccuccccuucaccguccccuccgccuccggccaggacauccagcucuccuccaagcacacccacaucacccucgacaaccgcgccgaguacguccgccucgccaucaacuaccgccuccacgaguucgacgagcaggucgccgccguccgcgagggcauggcccgcgucguccccgucccccuccucucccucuucaccggcuacgagcucgagaccauggucugcggcucccccgacaucccccuccaccuccucaaguccgucgccaccuacaagggcaucgagcccuccgccucccucauccagugguucugggaggucauggaguccuucuccaacaccgagcgcucccucuuccuccgcuucgucuggggccgcacccgccucccccgcaccaucgccgacuuccgcggccgcgacuucgucauccagguccucgacaaguacaacccccccgaccacuuccuccccgaguccuacaccugcuucuuccuccucaagcucccccgcuacuccugcaagcagguccucgaggagaagcucaaguacgccauccacuucugcaaguccaucgacaccgacgacuacgcccgcaucgcccucaccggcgagcccgccgccgacgacuccuccgacgacuccgacaacgaggacgucgacuccuucgccuccgacuccacccaggacuaccucaccggccacuga

SEQ ID NO: 44113 - RNA, 2799 nt, Artificial Sequence
  derived and/or modified sequence opt2 from HERC3__Homo_sapiens__NP_001258531
augaccaccgaggacuccgucgccgucccccgccucauccagaagcucaaccagcagaccauccuccaggucuccugcggcaacuggcacugccucgcccucgccgccgacggccaguucuucaccuggggcaagaacucccacggccagcucggccucggcaaggaguuccccucccaggccuccccccagcgcguccgcucccucgagggcaucccccucgcccaggucgccgccggcggcgcccacuccuucgcccucucccucuccggcgccgucuucggcuggggcaugaacaacgccggccagcucggccucuccgacgagaaggaccgcgagucccccugccacgucaagcuccuccgcacccagaaggucgucuacaucuccugcggcgaggagcacaccgccguccucaccaaguccggcggcgucuucaccuucggcgccggcuccugcggccagcucggccacgacuccaugaacgacgaggucaacccccgccgcguccucgagcucaugggcuccgaggucacccagaucgccugcggccgccagcacacccucgccuucguccccuccuccggccucaucuacgccuucggcugcggcgcccgcggccagcucggcaccggccacaccugcaacgucaagugccccucccccgucaagggcuacugggccgcccacuccggccagcucuccgcccgcgccgaccgcuucaaguaccacaucgucaagcagaucuucuccggcggcgaccagaccuucguccucugcuccaaguacgagaacuacucccccgccgucgacuuccgcaccaugaaccaggcccacuacaccucccucaucaacgacgagaccaucgccgucuggcgccagaagcucuccgagcacaacaacgccaacaccaucaacggcgucguccagauccucuccuccgccgccugcuggaacggcuccuuccucgagaagaagaucgacgagcacuucaagaccucccccaagauccccggcaucgaccucaacuccacccgcguccucuucgagaagcucaugaacucccagcacuccaugauccucgagcagauccucaacuccuucgaguccugccucaucccccagcucuccuccuccccccccgacgucgaggccaugcgcaucuaccucauccuccccgaguucccccuccuccaggacuccaaguacuacaucacccucaccaucccccucgccauggccauccuccgccucgacaccaaccccuccaagguccucgacaacugguggucccaggucugccccaaguacuucaugaagcucgucaaccucuacaagggcgccguccucuaccuccuccgcggccgcaagaccuuccucauccccguccucuucaacaacuacaucaccgccgcccucaagcuccucgagaagcucuacaaggucaaccucaaggucaagcacgucgaguacgacaccuucuacauccccgagaucuccaaccucgucgacauccaggaggacuaccucaugugguuccuccaccaggccggcaugaaggcccgccccuccaucauccaggacaccgucacccucugcuccuaccccuucaucuucgacgcccaggccaagaccaagaugcuccagaccgacgccgagcuccagaugcaggucgccgucaacggcgccaaccuccagaacgucuucaugcuccucacccucgagccccuccucgcccgcucccccuuccucguccuccacguccgccgcaacaaccucgucggcgacgcccuccgcgagcucuccauccacuccgacaucgaccucaagaagccccucaaggucaucuucgacggcgaggaggccgucgacgccggcggcgucaccaaggaguucuuccuccuccuccucaaggagcuccucaaccccaucuacggcauguucaccuacuaccaggacuccaaccuccucugguucuccgacaccugcuucgucgagcacaacugguuccaccucaucggcaucaccugcggccucgccaucuacaacuccaccgucgucgaccuccacuucccccucgcccucuacaagaagcuccucaacgucaagcccggccucgaggaccucaaggagcucucccccaccgagggccgcucccuccaggagcuccucgacuaccccggcgaggacgucgaggagaccuucugccucaacuucaccaucugccgcgaguccuacggcgucaucgagcagaagaagcucauccccggcggcgacaacgucaccgucugcaaggacaaccgccaggaguucgucgacgccuacgucaacuacgucuuccagaucuccguccacgagugguacaccgccuucuccuccggcuuccucaaggucugcggcggcaagguccucgagcucuuccagcccuccgagcuccgcgccaugauggucggcaacuccaacuacaacugggaggagcucgaggagaccgccaucuacaagggcgacuacuccgccacccaccccaccgucaagcucuucugggagaccuuccacgaguucccccucgagaagaagaagaaguuccuccucuuccucaccggcuccgaccgcauccccaucuacggcauggccucccuccagaucgucauccaguccaccgccuccggcgaggaguaccuccccgucgcccacaccugcuacaaccuccucgaccuccccaaguacuccuccaaggagauccucuccgcccgccucacccaggcccucgacaacuacgagggcuucucccucgccuga

SEQ ID NO: 44114 - RNA, 3075 nt, Artificial Sequence
  derived and/or modified sequence opt2 from HERC5__Homo_sapiens__NP_057407
auggagcgccgcucccgccgcaagucccgccgcaacggccgcuccaccgccggcaaggccgccgccacccagcccgccaagucccccggcgcccagcucuggcucuuccccuccgccgccggccuccaccgcgcccuccuccgccgcgucgaggucacccgccagcucugcugcucccccggccgccucgccguccucgagcgcggcggcgccggcguccagguccaccagcuccucgccggcuccggcggcgcccgcacccccaagugcaucaagcucggcaagaacaugaagauccacuccgucgaccagggcgccgagcacaugcucauccucuccuccgacggcaagcccuucgaguacgacaacuacuccaugaagcaccuccgcuucgaguccauccuccaggagaagaagaucauccagaucaccugcggcgacuaccacucccucgcccucuccaagggcggcgagcucuucgccuggggccagaaccuccacggccagcucggcgucggccgcaaguuccccuccaccaccaccccccagaucgucgagcaccucgccggcgucccccucgcccagaucuccgccggcgaggcccacuccauggcccucuccauguccggcaacaucuacuccuggggcaagaacgagugcggccagcucggccucggccacaccgaguccaaggacgaccccucccucaucgagggccucgacaaccagaaggucgaguucgucgccugcggcggcucccacuccgcccuccucacccaggacggccuccucuucaccuucggcgccggcaagcacggccagcucggccacaacuccacccagaacgagcuccgccccugccucgucgccgagcucgucggcuaccgcgucacccagaucgccugcggccgcuggcacacccucgccuacgucuccgaccucggcaaggucuucuccuucggcuccggcaaggacggccagcucggcaacggcggcacccgcgaccagcucaugccccuccccgucaaggucuccuccuccgaggagcucaagcucgagucccacaccuccgagaaggagcucaucaugaucgccggcggcaaccaguccauccuccucuggaucaagaaggagaacuccuacgucaaccucaagcgcaccauccccacccucaacgagggcaccgucaagcgcuggaucgccgacgucgagaccaagcgcuggcaguccaccaagcgcgagauccaggagaucuucuccucccccgccugccucaccggcuccuuccuccgcaagcgccgcaccaccgagaugaugcccgucuaccucgaccucaacaaggcccgcaacaucuucaaggagcucacccagaaggacuggaucaccaacaugaucaccaccugccucaaggacaaccuccucaagcgccuccccuuccacucccccccccaggaggcccucgagaucuucuuccuccuccccgagugccccaugaugcacaucuccaacaacugggagucccucgucguccccuucgccaaggucgucugcaagauguccgaccaguccucccucguccucgaggaguacugggccacccuccaggaguccaccuucuccaagcucguccagauguucaagaccgccgucaucugccagcucgacuacugggacgaguccgccgaggagaacggcaacguccaggcccuccucgagaugcucaagaagcuccaccgcgucaaccaggucaagugccagcuccccgaguccaucuuccaggucgacgagcuccuccaccgccucaacuucuucgucgaggucugccgccgcuaccucuggaagaugaccgucgacgccuccgagaacguccagugcugcgucaucuucucccacuuccccuucaucuucaacaaccucuccaagaucaagcuccuccacaccgacacccuccucaagaucgaguccaagaagcacaaggccuaccuccgcuccgccgccaucgaggaggagcgcgaguccgaguucgcccuccgccccaccuucgaccucaccguccgccgcaaccaccucaucgaggacguccucaaccagcucucccaguucgagaacgaggaccuccgcaaggagcucugggucuccuucuccggcgagaucggcuacgaccucggcggcgucaagaaggaguucuucuacugccucuucgccgagaugauccagcccgaguacggcauguucauguaccccgagggcgccuccugcaugugguuccccgucaagcccaaguucgagaagaagcgcuacuucuucuucggcguccucugcggccucucccucuucaacugcaacgucgccaaccuccccuucccccucgcccucuucaagaagcuccucgaccagaugcccucccucgaggaccucaaggagcucucccccgaccucggcaagaaccuccagacccuccucgacgacgagggcgacaacuucgaggaggucuucuacauccacuucaacguccacugggaccgcaacgacaccaaccucauccccaacggcuccuccaucaccgucaaccagaccaacaagcgcgacuacgucuccaaguacaucaacuacaucuucaacgacuccgucaaggccgucuacgaggaguuccgccgcggcuucuacaagaugugcgacgaggacaucaucaagcucuuccaccccgaggagcucaaggacgucaucgucggcaacaccgacuacgacuggaagaccuucgagaagaacgcccgcuacgagcccggcuacaacuccucccaccccaccaucgucauguucuggaaggccuuccacaagcucacccucgaggagaagaagaaguuccucgucuuccucaccggcaccgaccgccuccagaugaaggaccucaacaacaugaagaucaccuucugcugccccgaguccuggaacgagcgcgaccccauccgcgcccucaccugcuucuccguccucuuccuccccaaguacuccaccauggagaccgucgaggaggcccuccaggaggccaucaacaacaaccgcggcuucggcuga

SEQ ID NO: 44115 - RNA, 2961 nt, Artificial Sequence
  derived and/or modified sequence opt2 from HERC6__Homo_sapiens__NP_001158608
auguacuucugcuggggcgccgacucccgcgagcuccagcgccgccgcaccgccggcucccccggcgccgagcuccuccaggccgccuccggcgagcgccacucccuccuccuccucaccaaccaccgcguccucuccugcggcgacaacucccgcggccagcucggccgccgcggcgcccagcgcggcgagcuccccgagcccauccaggcccucgagacccucaucgucgaccucgucuccugcggcaaggagcacucccucgccgucugccacaagggccgcgucuucgccuggggcgccggcuccgagggccagcucggcaucggcgaguucaaggagaucuccuucacccccaagaagaucaugacccucaacgacaucaagaucauccaggucuccugcggccacuaccacucccucgcccucuccaaggacucccaggucuucuccuggggcaagaacucccacggccagcucggccucggcaaggaguuccccucccaggccuccccccagcgcguccgcucccucgagggcaucccccucgcccaggucgccgccggcggcgcccacuccuucgcccucucccucugcggcaccuccuucggcuggggcuccaacuccgccggccagcucgcccucuccggccgcaacguccccguccaguccaacaagccccucuccgucggcgcccucaagaaccucggcgucgucuacaucuccugcggcgacgcccacaccgccguccucacccaggacggcaaggucuucaccuucggcgacaaccgcuccggccagcucggcuacucccccacccccgagaagcgcggcccccagcucgucgagcgcaucgacggccucgucucccagaucgacugcggcuccuaccacacccucgccuacguccacaccaccggccaggucgucuccuucggccacggccccuccgacaccuccaagcccacccaccccgaggcccucaccgagaacuucgacaucuccugccucaucuccgccgaggacuucgucgacguccaggucaagcacaucuucgccggcaccuacgccaacuucgucaccacccaccaggacaccuccuccacccgcgcccccggcaagacccuccccgagaucucccgcaucucccaguccauggccgagaaguggaucgccgucaagcgccgcuccaccgagcacgagauggccaaguccgagauccgcaugaucuucuccucccccgccugccucaccgccuccuuccucaagaagcgcggcaccggcgagaccaccuccaucgacgucgaccucgagauggcccgcgacaccuucaagaagcucaccaagaaggaguggaucuccuccaugaucaccaccugccucgaggacgaccuccuccgcgcccuccccugccacuccccccaccaggaggcccucuccgucuuccuccuccuccccgagugccccgucaugcacgacuccaagaacuggaagaaccucgucguccccuucgccaaggccgucugcgagauguccaagcagucccuccagguccucaagaagugcugggccuuccuccaggaguccucccucaacccccucauccagaugcucaaggccgccaucaucucccagcuccuccaccagaccaagaccgagcaggaccacugcaacgucaaggcccuccucggcaugaugaaggagcuccacaaggucaacaaggccaacugccgccuccccgagaacaccuucaacaucaacgagcucuccaaccuccucaacuucuacaucgaccgcggccgccagcucuuccgcgacaaccaccucauguccgagaagaaggccuacaugcucaugcacgagaccauccuccagaagaaggacgaguucccccccuccccccgcuucauccuccgcguccgccgcucccgccucgucaaggacgcccuccgccagcucucccaggccgaggccaccgacuucugcaagguccucgucgucgaguucaucaacgagaucugccccgaguccggcggcgucuccuccgaguucuuccacugcauguucgaggagaugaccaagcccgaguacggcauguucauguaccccgagaugggcuccugcaugugguuccccgccaagcccaagcccgagaagaagcgcuacuuccucuucggcaugcucugcggccucucccucuucaaccucaacgucgccaaccuccccuucccccucgcccucuacaagaagcuccucgaccagaagcccucccucgaggaccucaaggagcucuccccccgccucggcaagucccuccaggagguccucgacgacgccgccgacgacaucggcgacgcccucugcauccgcuucuccauccacugggaccagaacgacgucgaccucauccccaacggcaucuccauccccgucgaccagaccaacaagcgcgacuacgucuccaaguacaucgacuacaucuucaacgucuccgucaaggccgucuacgaggaguuccagcgcggcuucuaccgcgucugcgagaaggagauccuccgccacuucuaccccgaggagcucaugaccgccaucaucggcaacaccgacuacgacuggaagcaguucgagcagaacuccaaguacgagcagggcuaccagaagucccaccccaccauccagcucuucuggaaggccuuccacaagcucacccucgacgagaagaagaaguuccucuucuuccucaccggccgcgaccgccuccacgcccgcggcauccagaagauggagaucgucuuccgcugccccgagaccuucuccgagcgcgaccaccccaccuccaucaccugccacaacauccucucccuccccaaguacuccaccauggagcgcauggaggaggcccuccaggucgccaucaacaacaaccgcggcuucgucucccccaugcucacccaguccuga

SEQ ID NO: 44116 - RNA, 1173 nt, Artificial Sequence
  derived and/or modified sequence opt2 from HERPUD1__Homo_sapiens__NP_001010989
auggaguccgagaccgagcccgagcccgucacccuccucgucaagucccccaaccagcgccaccgcgaccucgagcucuccggcgaccgcggcugguccgucggccaccucaaggcccaccucucccgcgucuaccccgagcgcccccgccccgaggaccagcgccucaucuacuccggcaagcuccuccucgaccaccagugccuccgcgaccuccuccccaaggagaagcgccacguccuccaccucgucugcaacgucaagucccccuccaagaugcccgagaucaacgccaaggucgccgaguccaccgaggagcccgccggcuccaaccgcggccaguaccccgaggacuccuccuccgacggccuccgccagcgcgagguccuccgcaaccucuccucccccggcugggagaacaucucccgccccgaggccgcccagcaggccuuccagggccucggccccggcuucuccggcuacacccccuacggcuggcuccagcucuccugguuccagcagaucuacgcccgccaguacuacaugcaguaccucgccgccaccgccgccuccggcgccuucguccccccccccuccgcccaggagauccccgucgucuccgcccccgcccccgcccccauccacaaccaguuccccgccgagaaccagcccgccaaccagaacgccgccccccaggucgucgucaaccccggcgccaaccagaaccuccgcaugaacgcccagggcggccccaucgucgaggaggacgacgagaucaaccgcgacuggcucgacuggaccuacuccgccgccaccuucuccgucuuccucuccauccucuacuucuacuccucccucucccgcuuccucauggucaugggcgccaccgucgucauguaccuccaccacgucggcugguuccccuuccgcccccgccccguccagaacuuccccaacgacggccccccccccgacgucgucaaccaggaccccaacaacaaccuccaggagggcaccgaccccgagaccgaggaccccaaccaccucccccccgaccgcgacguccucgacggcgagcagaccucccccuccuucauguccaccgccuggcucgucuucaagaccuucuucgccucccuccuccccgagggcccccccgccaucgccaacuga

SEQ ID NO: 44117 - RNA, 843 nt, Artificial Sequence
  derived and/or modified sequence opt2 from HES1__Homo_sapiens__NP_005515
augcccgccgacaucauggagaagaacuccuccucccccgucgccgccacccccgccuccgucaacaccacccccgacaagcccaagaccgccuccgagcaccgcaaguccuccaagcccaucauggagaagcgccgccgcgcccgcaucaacgagucccucucccagcucaagacccucauccucgacgcccucaagaaggacuccucccgccacuccaagcucgagaaggccgacauccucgagaugaccgucaagcaccuccgcaaccuccagcgcgcccagaugaccgccgcccucuccaccgaccccuccguccucggcaaguaccgcgccggcuucuccgagugcaugaacgaggucacccgcuuccucuccaccugcgagggcgucaacaccgagguccgcacccgccuccucggccaccucgccaacugcaugacccagaucaacgccaugaccuaccccggccagccccaccccgcccuccaggccccccccccccccccccccggccccggcggcccccagcacgcccccuucgcccccccccccccccucguccccauccccggcggcgccgcccccccccccggcggcgcccccugcaagcucggcucccaggccggcgaggccgccaaggucuucggcggcuuccaggucguccccgcccccgacggccaguucgccuuccucauccccaacggcgccuucgcccacuccggccccgucauccccgucuacaccuccaacuccggcaccuccgucggccccaacgccgucucccccuccuccggccccucccucaccgccgacuccauguggcgccccuggcgcaacuga

SEQ ID NO: 44118 - RNA, 522 nt, Artificial Sequence
  derived and/or modified sequence opt2 from HES2__Homo_sapiens__XP_011539915
augggccucccccgccgcgccggcgacgccgccgagcuccgcaagucccucaagccccuccucgagaagcgccgccgcgcccgcaucaaccagucccucucccagcucaagggccucauccucccccuccucggccgcgagaacuccaacugcuccaagcucgagaaggccgacguccucgagaugaccguccgcuuccuccaggagcuccccgccuccuccuggcccaccgccgccccccuccccugcgacuccuaccgcgagggcuacuccgccugcgucgcccgccucgcccgcguccuccccgccugccgcguccucgagcccgccgucuccgcccgccuccucgagcaccucuggcgccgcgccgccuccgccacccucgacggcggccgcgccggcgacuccuccggccccuccgcccccgcccccgcccccgccuccgcccccgagcccgccuccgcccccguccccuccccccccuccccccccugcggccccggccucuggcgccccugguga

SEQ ID NO: 44119 - RNA, 669 nt, Artificial Sequence
  derived and/or modified sequence opt2 from HES6__Homo_sapiens__NP_001136325
auggccccccccgccgcccccggccgcgaccgcgucggccgcgaggacgaggacggcugggagacccgcggcgaccgcaaggcccgcaagccccucgucgagaagaagcgccgcgcccgcaucaacgagucccuccaggagcuccgccuccuccucgccggcgccgaggccaagcucgagaacgccgagguccucgagcucaccguccgccgcguccagggcguccuccgcggccgcgcccgcgagcgcgagcagcuccaggccgaggccuccgagcgcuucgccgccggcuacauccagugcaugcacgagguccacaccuucgucuccaccugccaggccaucgacgccaccgucgccgccgagcuccucaaccaccuccucgaguccaugccccuccgcgagggcuccuccuuccaggaccuccucggcgacgcccucgccggccccccccgcgcccccggccgcuccggcuggcccgccggcggcgcccccggcucccccauccccuccccccccggccccggcgacgaccucugcuccgaccucgaggaggcccccgaggccgagcucucccaggcccccgccgagggccccgaccucguccccgccgcccucggcucccucaccaccgcccagaucgcccgcuccgucuggcgccccugguga

SEQ ID NO: 44120 - RNA, 693 nt, Artificial Sequence
  derived and/or modified sequence opt2 from HES7__Homo_sapiens__NP_001159439
auggucacccgcgaccgcgccgagaaccgcgacggccccaagaugcucaagccccucgucgagaagcgccgccgcgaccgcaucaaccgcucccucgaggagcuccgccuccuccuccucgagcgcacccgcgaccagaaccuccgcaaccccaagcucgagaaggccgagauccucgaguucgccgucggcuaccuccgcgagcgcucccgcgucgagccccccgccgccgccgcccccggcgucccccgcucccccguccaggacgccgaggcccucgccuccugcuaccucuccggcuuccgcgagugccuccuccgccucgccgccuucgcccacgacgccucccccgccgcccgcgcccagcucuucuccgcccuccacggcuaccuccgccccaagcccccccgccccaagcccgucgacccccgcccccccgccccccgccccucccucgaccccgccgcccccgcccucggccccgcccuccaccagcgcccccccguccaccagggccaccccuccccccgcugcgccuggucccccucccucugcuccccccgcgccggcgacuccggcgcccccgccccccucaccggccuccuccccccccccccccccccccaccgccaggacggcgcccccaaggccccccucccccccccccccgccuucuggcgccccuggcccuga

SEQ ID NO: 44121 - RNA, 558 nt, Artificial Sequence
  derived and/or modified sequence opt2 from HESX1__Homo_sapiens__NP_003856
augucccccucccuccaggagggcgcccagcucggcgagaacaagcccuccaccugcuccuucuccaucgagcgcauccucggccucgaccagaagaaggacugcgucccccucaugaagccccaccgccccugggccgacaccugcuccuccuccggcaaggacggcaaccucugccuccacguccccaacccccccuccggcaucuccuuccccuccgucgucgaccaccccaugcccgaggagcgcgccuccaaguacgagaacuacuucuccgccuccgagcgccucucccucaagcgcgagcucuccugguaccgcggccgccgcccccgcaccgccuucacccagaaccagaucgagguccucgagaacgucuuccgcgucaacugcuaccccggcaucgacauccgcgaggaccucgcccagaagcucaaccucgaggaggaccgcauccagaucugguuccagaaccgccgcgccaagcucaagcgcucccaccgcgagucccaguuccucauggccaagaagaacuucaacaccaaccuccucgaguga

SEQ ID NO: 44122 - RNA, 1590 nt, Artificial Sequence
  derived and/or modified sequence opt2 from HEXA__Homo_sapiens__NP_000511
augaccuccucccgccucugguucucccuccuccucgccgccgccuucgccggccgcgccaccgcccucuggcccuggccccagaacuuccagaccuccgaccagcgcuacguccucuaccccaacaacuuccaguuccaguacgacgucuccuccgccgcccagcccggcugcuccguccucgacgaggccuuccagcgcuaccgcgaccuccucuucggcuccggcuccuggccccgccccuaccucaccggcaagcgccacacccucgagaagaacguccucgucgucuccgucgucacccccggcugcaaccagcuccccacccucgaguccgucgagaacuacacccucaccaucaacgacgaccagugccuccuccucuccgagaccgucuggggcgcccuccgcggccucgagaccuucucccagcucgucuggaaguccgccgagggcaccuucuucaucaacaagaccgagaucgaggacuucccccgcuucccccaccgcggccuccuccucgacaccucccgccacuaccucccccucuccuccauccucgacacccucgacgucauggccuacaacaagcucaacgucuuccacuggcaccucgucgacgaccccuccuuccccuacgaguccuucaccuuccccgagcucaugcgcaagggcuccuacaaccccgucacccacaucuacaccgcccaggacgucaaggaggucaucgaguacgcccgccuccgcggcauccgcguccucgccgaguucgacacccccggccacacccucuccuggggccccggcauccccggccuccucacccccugcuacuccggcuccgagcccuccggcaccuucggccccgucaaccccucccucaacaacaccuacgaguucauguccaccuucuuccucgaggucuccuccgucuuccccgacuucuaccuccaccucggcggcgacgaggucgacuucaccugcuggaaguccaaccccgagauccaggacuucaugcgcaagaagggcuucggcgaggacuucaagcagcucgaguccuucuacauccagacccuccucgacaucgucuccuccuacggcaagggcuacgucgucuggcaggaggucuucgacaacaaggucaagauccagcccgacaccaucauccaggucuggcgcgaggacauccccgucaacuacaugaaggagcucgagcucgucaccaaggccggcuuccgcgcccuccucuccgcccccugguaccucaaccgcaucuccuacggccccgacuggaaggacuucuacaucgucgagccccucgccuucgagggcacccccgagcagaaggcccucgucaucggcggcgaggccugcauguggggcgaguacgucgacaacaccaaccucgucccccgccucuggccccgcgccggcgccgucgccgagcgccucugguccaacaagcucaccuccgaccucaccuucgccuacgagcgccucucccacuuccgcugcgagcuccuccgccgcggcguccaggcccagccccucaacgucggcuucugcgagcaggaguucgagcagaccuga

SEQ ID NO: 44123 - RNA, 1671 nt, Artificial Sequence
  derived and/or modified sequence opt2 from HEXB__Homo_sapiens__NP_000512
auggagcucugcggccucggccucccccgcccccccaugcuccucgcccuccuccucgccacccuccucgccgccaugcucgcccuccucacccaggucgcccucgucguccaggucgccgaggccgcccgcgcccccuccgucuccgccaagcccggccccgcccucuggccccucccccucuccgucaagaugacccccaaccuccuccaccucgcccccgagaacuucuacaucucccacucccccaacuccaccgccggccccuccugcacccuccucgaggaggccuuccgccgcuaccacggcuacaucuucggcuucuacaaguggcaccacgagcccgccgaguuccaggccaagacccagguccagcagcuccucgucuccaucacccuccaguccgagugcgacgccuuccccaacaucuccuccgacgaguccuacacccuccucgucaaggagcccgucgccguccucaaggccaaccgcgucuggggcgcccuccgcggccucgagaccuucucccagcucgucuaccaggacuccuacggcaccuucaccaucaacgaguccaccaucaucgacuccccccgcuucucccaccgcggcauccucaucgacaccucccgccacuaccuccccgucaagaucauccucaagacccucgacgccauggccuucaacaaguucaacguccuccacuggcacaucgucgacgaccaguccuuccccuaccaguccaucaccuuccccgagcucuccaacaagggcuccuacucccucucccacgucuacacccccaacgacguccgcauggucaucgaguacgcccgccuccgcggcauccgcguccuccccgaguucgacacccccggccacacccucuccuggggcaagggccagaaggaccuccucacccccugcuacucccgccagaacaagcucgacuccuucggccccaucaaccccacccucaacaccaccuacuccuuccucaccaccuucuucaaggagaucuccgaggucuuccccgaccaguucauccaccucggcggcgacgaggucgaguucaagugcugggaguccaaccccaagauccaggacuucaugcgccagaagggcuucggcaccgacuucaagaagcucgaguccuucuacauccagaagguccucgacaucaucgccaccaucaacaagggcuccaucgucuggcaggaggucuucgacgacaaggccaagcucgcccccggcaccaucgucgaggucuggaaggacuccgccuaccccgaggagcucucccgcgucaccgccuccggcuuccccgucauccucuccgcccccugguaccucgaccucaucuccuacggccaggacuggcgcaaguacuacaaggucgagccccucgacuucggcggcacccagaagcagaagcagcucuucaucggcggcgaggccugccucuggggcgaguacgucgacgccaccaaccucaccccccgccucuggccccgcgccuccgccgucggcgagcgccucugguccuccaaggacguccgcgacauggacgacgccuacgaccgccucacccgccaccgcugccgcauggucgagcgcggcaucgccgcccagccccucuacgccggcuacugcaaccacgagaacauguga

SEQ ID NO: 44124 - RNA, 1758 nt, Artificial Sequence
  derived and/or modified sequence opt2 from HEXDC__Homo_sapiens__NP_775891
auguccggcuccacccccuuccagaugcgccucguccaccucgaccucaagggcgccccccccaaggucuccuaccucuccgagaucuucccccucuuccgcgcccucggcgccaacggccuccucaucgaguacgaggacauguuccccuacgagggcccccuccgccuccuccgcgccaaguacgccuacucccccuccgagaucaaggagauccuccaccucgccggccucaacgagcucgaggucaucccccucguccagaccuucggccacauggaguucguccucaagcacaccgccuucgcccaccuccgcgaggucggcuccuuccccugcacccucaacccccacgaggccgagucccucgcccucgucggcgccaugaucgaccagguccucgagcuccaccccggcgcccagcgccuccacaucggcugcgacgaggucuacuaccucggcgagggcgaggccucccgccgcuggcuccagcaggagcagaacuccaccggcaagcucugccucucccacaugcgcgccgucgccuccggcgucaaggcccgccgccccuccgucaccccccucgucugggacgacaugcuccgcgaccuccccgaggaccagcucgccgccuccggcgucccccagcucgucgagcccguccucugggacuacaccgccgaccucgacguccacggcaagguccuccucaugcagaaguaccgccgcugcggcuucccccagcucugggccgccuccgccuucaagggcgccaccggccccucccaggccgucccccccgucgagcaccaccuccgcaaccacguccaguggcuccaggucgccggcuccggccccaccgacucccuccagggcaucauccucaccggcuggcagcgcuacgaccacuacuccguccucugcgagcuccuccccgccggcguccccucccucgccgccugccuccagcuccuccuccgcggcggcuucgacgaggacgucaaggccaaggucgagaaccuccucggcaucuccucccucgagaagaccgaccccguccgccaggcccccugcuccccccccugcccccuccucccccuccccuucccccgccccuggcgccagcucuucuccgccggccucuccgccggccgcggccccgcccccucccucgccgccaccucccucccccucucccacaaguccgccuccaucugcgccgcccucuggaugcgcugcuggcgcgccaccggcaugucccucgccggcuccgcccccaccaccgccuccggcuccuccuccacccgcuccugguucuccaccuccuccccccagcgcuccgccuccuggcacuccggcgcccccuccugccgcuccuggcgccuccccugcuccuggcucuccacccgcaugcccuggcgcuccggcuggcgcaagaccugcacccccgccugcuccggcugcaagcucugcugccgcaccuccgcccgcugccuccccccccgcugccacccccccgcccucgccggcacccuccuccgcacccccgagggccgcgcccacgcccgcggccuccuccucgaggccggcggcgcccuccacugccagauggccugggccauccgcgcccacgucggcgucguccccuccggccccgccgucuccugcccccacuccguccccgagggccccggccagccccucggcgagcgccucgagaacaccgagggcuccuccaccggccgccccgcccucuga

SEQ ID NO: 44125 - RNA, 1080 nt, Artificial Sequence
  derived and/or modified sequence opt2 from HEXIM1__Homo_sapiens__NP_006451
auggccgagcccuuccucuccgaguaccagcaccagccccagaccuccaacugcaccggcgccgccgccguccaggaggagcucaaccccgagcgcccccccggcgccgaggagcgcguccccgaggaggacucccgcuggcagucccgcgccuucccccagcucggcggccgccccggccccgagggcgagggcucccucgagucccagccccccccccuccagacccaggccugccccgaguccuccugccuccgcgagggcgagaagggccagaacggcgacgacuccuccgccggcggcgacuuccccccccccgccgaggucgagcccacccccgaggccgagcuccucgcccagcccugccacgacuccgaggccuccaagcucggcgcccccgccgccggcggcgaggaggaguggggccagcagcagcgccagcucggcaagaagaagcaccgccgccgccccuccaagaagaagcgccacuggaagcccuacuacaagcucaccugggaggagaagaagaaguucgacgagaagcagucccuccgcgccucccgcauccgcgccgagauguucgccaagggccagcccgucgcccccuacaacaccacccaguuccucauggacgaccacgaccaggaggagcccgaccucaagaccggccucuacuccaagcgcgccgccgccaaguccgacgacaccuccgacgacgacuucauggaggagggcggcgaggaggacggcggcuccgacggcaugggcggcgacggcuccgaguuccuccagcgcgacuucuccgagaccuacgagcgcuaccacaccgagucccuccagaacauguccaagcaggagcucaucaaggaguaccucgagcucgagaagugccucucccgcauggaggacgagaacaaccgccuccgccucgaguccaagcgccucggcggcgacgacgcccgcguccgcgagcucgagcucgagcucgaccgccuccgcgccgagaaccuccagcuccucaccgagaacgagcuccaccgccagcaggagcgcgccccccucuccaaguucggcgacuga

SEQ ID NO: 44126 - RNA, 927 nt, Artificial Sequence
  derived and/or modified sequence opt2 from HEY1__Homo_sapiens__NP_001035798
augaagcgcgcccaccccgaguacuccuccuccgacuccgagcucgacgagaccaucgaggucgagaaggaguccgccgacgagaacggcaaccucuccuccgcccucggcuccaugucccccaccaccuccucccagauccucgcccgcaagcgccgccgcggcaucaucgagaagcgccgccgcgaccgcaucaacaacucccucuccgagcuccgccgccucguccccuccgccuucgagaagcaggucauggagcagggcuccgccaagcucgagaaggccgagauccuccagaugaccgucgaccaccucaagaugcuccacaccgccggcggcaagggcuacuucgacgcccacgcccucgccauggacuaccgcucccucggcuuccgcgagugccucgccgaggucgcccgcuaccucuccaucaucgagggccucgacgccuccgacccccuccgcguccgccucgucucccaccucaacaacuacgccucccagcgcgaggccgccuccggcgcccacgccggccucggccacauccccuggggcaccgucuucggccaccacccccacaucgcccacccccuccuccucccccagaacggccacggcaacgccggcaccaccgccucccccaccgagccccaccaccagggccgccucggcuccgcccaccccgaggcccccgcccuccgcgccccccccuccggcucccucggccccguccuccccgucgucaccuccgccuccaagcucucccccccccuccucuccuccgucgccucccucuccgccuuccccuucuccuucggcuccuuccaccuccucucccccaacgcccucucccccuccgcccccacccaggccgccaaccucggcaagcccuaccgccccuggggcaccgagaucggcgccuucuga

SEQ ID NO: 44127 - RNA, 1014 nt, Artificial Sequence
  derived and/or modified sequence opt2 from HEY2__Homo_sapiens__NP_036391
augaagcgccccugcgaggagaccaccuccgaguccgacauggacgagaccaucgacgucggcuccgagaacaacuacuccggccaguccaccuccuccgucauccgccucaacucccccaccaccaccucccagaucauggcccgcaagaagcgccgcggcaucaucgagaagcgccgccgcgaccgcaucaacaacucccucuccgagcuccgccgccucguccccaccgccuucgagaagcagggcuccgccaagcucgagaaggccgagauccuccagaugaccgucgaccaccucaagaugcuccaggccaccggcggcaagggcuacuucgacgcccacgcccucgccauggacuucauguccaucggcuuccgcgagugccucaccgaggucgcccgcuaccucuccuccgucgagggccucgacuccuccgacccccuccgcguccgccucgucucccaccucuccaccugcgccacccagcgcgaggccgccgccaugaccuccuccauggcccaccaccaccacccccuccacccccaccacugggccgccgccuuccaccaccuccccgccgcccuccuccagcccaacggccuccacgccuccgaguccacccccugccgccucuccaccaccuccgaggucccccccgcccacggcuccgcccuccucaccgccaccuucgcccacgccgacuccgcccuccgcaugcccuccaccggcuccgucgcccccugcguccccccccucuccaccucccuccucucccucuccgccaccguccacgccgccgccgccgccgccaccgccgccgcccacuccuucccccucuccuucgccggcgccuuccccaugcucccccccaacgccgccgccgccgucgccgccgccaccgccaucucccccccccucuccgucuccgccaccuccuccccccagcagaccuccuccggcaccaacaacaagcccuaccgccccuggggcaccgaggucggcgccuucuga

SEQ ID NO: 44128 - RNA, 1047 nt, Artificial Sequence
  derived and/or modified sequence opt2 from HFE__Homo_sapiens__NP_000401
augggcccccgcgcccgccccgcccuccuccuccucaugcuccuccagaccgccguccuccagggccgccuccuccgcucccacucccuccacuaccucuucaugggcgccuccgagcaggaccucggccucucccucuucgaggcccucggcuacgucgacgaccagcucuucgucuucuacgaccacgagucccgccgcgucgagccccgcacccccugggucuccucccgcaucuccucccagauguggcuccagcucucccagucccucaagggcugggaccacauguucaccgucgacuucuggaccaucauggagaaccacaaccacuccaaggagucccacacccuccaggucauccucggcugcgagaugcaggaggacaacuccaccgagggcuacuggaaguacggcuacgacggccaggaccaccucgaguucugccccgacacccucgacuggcgcgccgccgagccccgcgccuggcccaccaagcucgagugggagcgccacaagauccgcgcccgccagaaccgcgccuaccucgagcgcgacugccccgcccagcuccagcagcuccucgagcucggccgcggcguccucgaccagcagguccccccccucgucaaggucacccaccacgucaccuccuccgucaccacccuccgcugccgcgcccucaacuacuacccccagaacaucaccaugaaguggcucaaggacaagcagcccauggacgccaaggaguucgagcccaaggacguccuccccaacggcgacggcaccuaccagggcuggaucacccucgccgucccccccggcgaggagcagcgcuacaccugccaggucgagcaccccggccucgaccagccccucaucgucaucugggagcccucccccuccggcacccucgucaucggcgucaucuccggcaucgccgucuucgucgucauccucuucaucggcauccucuucaucauccuccgcaagcgccagggcucccgcggcgccaugggccacuacguccucgccgagcgcgaguga

SEQ ID NO: 44129 - RNA, 4308 nt, Artificial Sequence
  derived and/or modified sequence opt2 from HFM1__Homo_sapiens__XP_011539154
augcucaaguccaacgacugccucuucucccucgagaaccucuucuucgagaagcccgacgaggucgagaaccaccccgacaacgagaagucccucgacugguuccucccccccgccccccucaucuccgagauccccgacacccaggagcucgaggaggagcucgagucccacaagcuccucggccaggagaagcgccccaagaugcucaccuccaaccucaagaucaccaacgaggacaccaacuacaucucccucacccagaaguuccaguucgccuuccccuccgacaaguacgagcaggacgaccucaaccucgagggcgucggcaacaacgaccucucccacaucgccggcaagcucaccuacgccucccagaaguacaagaaccacaucggcaccgagaucgcccccgagaaguccguccccgacgacaccaagcucgucaacuucgccgaggacaagggcgaguccaccuccgucuuccgcaagcgccucuucaagaucuccgacaacauccacggcuccgccuacuccaacgacaacgagcucgacucccacaucggcuccgucaagaucguccagaccgagaugaacaagggcaagucccgcaacuacuccaacuccaagcagaaguuccaguacuccgccaacgucuucaccgccaacaacgccuucuccgccuccgagaucggcgagggcauguucaaggcccccuccuucuccgucgccuuccagccccacgacauccaggaggucaccgagaacggccucggcucccucaaggccgucaccgagauccccgccaaguuccgcuccaucuucaaggaguuccccuacuucaacuacauccaguccaaggccuucgacgaccuccucuacaccgaccgcaacuucgucaucugcgcccccaccggcuccggcaagaccgucgucuucgagcucgccaucacccgccuccucauggaggucccccuccccuggcucaacaucaagaucgucuacauggcccccaucaaggcccucugcucccagcgcuucgacgacuggaaggagaaguucggccccaucggccucaacugcaaggagcucaccggcgacaccgucauggacgaccucuucgagauccagcacgcccacaucaucaugaccacccccgagaagugggacuccaugacccgcaaguggcgcgacaacucccucguccagcucguccgccucuuccucaucgacgagguccacaucgucaaggacgagaaccgcggccccacccucgaggucgucgucucccgcaugaagaccguccaguccgucucccagacccucaagaacaccuccaccgccauccccaugcgcuucgucgccgucuccgccaccauccccaacgccgaggacaucgccgaguggcucuccgacggcgagcgccccgccgucugccucaagauggacgagucccaccgccccgucaagcuccagaaggucguccucggcuuccccugcuccuccaaccagaccgaguucaaguucgaccucacccucaacuacaagaucgccuccgucauccagauguacuccgaccagaagcccacccucgucuucugcgccacccgcaagggcguccagcaggccgccuccguccucgucaaggacgccaaguucaucaugaccgucgagcagaagcagcgccuccagaaguacgccuacuccguccgcgacuccaagcuccgcgacauccucaaggacggcgccgccuaccaccacgccggcauggagcucuccgaccgcaaggucgucgagggcgccuucaccgucggcgaccuccccguccucuucaccaccuccacccucgccaugggcgucaaccuccccgcccaccucgucgucaucaaguccaccaugcacuacgccggcggccucuucgaggaguacuccgagaccgacauccuccagaugaucggccgcgccggccgcccccaguucgacaccaccgccaccgccgucaucaugacccgccucuccacccgcgacaaguacauccagaugcucgccugccgcgacaccgucgaguccucccuccaccgccaccucaucgagcaccucaacgccgagaucguccuccacaccaucaccgacgucaacaucgccgucgaguggauccgcuccacccuccucuacauccgcgcccucaagaaccccucccacuacggcuucgccuccggccucaacaaggacggcaucgaggccaagcuccaggagcucugccucaagaaccucaacgaccucuccucccucgaccucaucaagauggacgagggcgucaacuucaagcccaccgaggccggccgccucauggccugguacuacaucaccuucgagaccgucaagaaguucuacaccaucuccggcaaggagacccucuccgaccucgucacccucaucgccggcugcaaggaguuccucgacauccagcuccgcaucaacgagaagaagacccucaacacccucaacaaggaccccaaccgcaucaccauccgcuuccccauggagggccgcaucaagacccgcgagaugaaggucaacugccucauccaggcccagcucggcugcauccccauccaggacuucgcccucacccaggacaccgccaagaucuuccgccacggcucccgcaucacccgcuggcucuccgacuucgucgccgcccaggagaagaaguucgccguccuccucaacucccucauccucgccaagugcuuccgcugcaagcucugggagaacucccuccacgucuccaagcagcucgagaagaucggcaucacccucuccaacgccaucgucaacgccggccucaccuccuucaagaagaucgaggagaccgacgcccgcgagcucgagcucauccucaaccgccacccccccuucggcacccagaucaaggagaccgucauguaccuccccaaguacgagcucaaggucgagcagaucacccgcuacuccgacaccaccgccgagauccucgucaccgucauccuccgcaacuucgagcagcuccagaccaagcgcaccgccuccgacucccacuacgucacccucaucaucggcgacgccgacaaccaggucgucuaccuccacaagaucaccgacuccguccuccucaaggccggcuccugggccaagaagaucgccgucaagcgcgcccucaaguccgaggaccucuccaucaaccucaucuccuccgaguucgucggccucgacauccagcagaagcucaccgucuucuaccucgagcccaagcgcuucggcaaccagaucaccaugcagcgcaaguccgagacccagaucucccacuccaagcacuccgacaucuccaccaucgccggccccaacaagggcaccaccgccuccaagaagcccggcaaccgcgagugcaaccaccucugcaaguccaagcacaccugcggccacgacugcugcaagaucggcgucgcccagaaguccgagaucaaggaguccaccaucuccuccuaccucuccgaccuccgcaaccgcaacgccgucuccuccgucccccccgucaagcgccucaagauccagaugaacaagucccaguccgucgaccucaaggaguucggcuucacccccaagcccucccuccccuccaucucccgcuccgaguaccucaacaucuccgagcuccccaucauggagcagugggaccagcccgagaucuacggcaagguccgccaggagcccuccgaguaccaggacaaggagguccucaacgucaacuucgagcucggcaacgaggucugggacgacuucgacgacgagaaccucgaggucaccuccuucuccaccgacaccgagaagaccaagaucuccggcuucggcaacacccucuccuccuccacccgcggcuccaagcucccccuccaggaguccaaguccaaguuccagcgcgagauguccaacuccuucgucuccucccacgagauguccgacaucucccucuccaacuccgccaugcccaaguucuccgccuccuccaugaccaagcucccccagcaggccggcaacgccgucaucguccacuuccaggagcgcaagccccagaaccucucccccgagaucgagaagcagugcuucaccuucuccgagaagaaccccaacuccuccaacuacaagaaggucgacuucuucauccgcaacuccgagugcaagaaggaggucgacuucuccauguaccaccccgacgacgaggccgacgagaugaagucccuccucggcaucuucgacggcaucuucuga

SEQ ID NO: 44130 - RNA, 1338 nt, Artificial Sequence
  derived and/or modified sequence opt2 from HGD__Homo_sapiens__NP_000178
auggccgagcucaaguacaucuccggcuucggcaacgagugcuccuccgaggacccccgcugccccggcucccuccccgagggccagaacaacccccaggucugccccuacaaccucuacgccgagcagcucuccggcuccgccuucaccugcccccgcuccaccaacaagcgcuccuggcucuaccgcauccuccccuccgucucccacaagcccuucgaguccaucgacgagggccaggucacccacaacugggacgaggucgaccccgaccccaaccagcuccgcuggaagcccuucgagauccccaaggccucccagaagaaggucgacuucgucuccggccuccacacccucugcggcgccggcgacaucaaguccaacaacggccucgccauccacaucuuccucugcaacaccuccauggagaaccgcugcuucuacaacuccgacggcgacuuccucaucgucccccagaagggcaaccuccucaucuacaccgaguucggcaagaugcucguccagcccaacgagaucugcgucauccagcgcggcaugcgcuucuccaucgacgucuucgaggagacccgcggcuacauccucgaggucuacggcguccacuucgagcuccccgaccucggccccaucggcgccaacggccucgccaacccccgcgacuuccucauccccaucgccugguacgaggaccgccagguccccggcggcuacaccgucaucaacaaguaccagggcaagcucuucgccgccaagcaggacgucucccccuucaacgucgucgccuggcacggcaacuacacccccuacaaguacaaccucaagaacuucauggucaucaacuccgucgccuucgaccacgccgaccccuccaucuucaccguccucaccgccaaguccguccgccccggcgucgccaucgccgacuucgucaucuuccccccccgcuggggcgucgccgacaagaccuuccgcccccccuacuaccaccgcaacugcauguccgaguucaugggccucauccgcggccacuacgaggccaagcagggcggcuuccuccccggcggcggcucccuccacuccaccaugaccccccacggccccgacgccgacugcuucgagaaggccuccaaggucaagcucgcccccgagcgcaucgccgacggcaccauggccuucauguucgaguccucccucucccucgccgucaccaaguggggccucaaggccucccgcugccucgacgagaacuaccacaagugcugggagccccucaagucccacuucacccccaacucccgcaaccccgccgagcccaacuga

SEQ ID NO: 44131 - RNA, 1968 nt, Artificial Sequence
  derived and/or modified sequence opt2 from HGFAC__Homo_sapiens__NP_001519
augggccgcugggccuggguccccucccccuggcccccccccggccucggccccuuccuccuccuccuccuccuccuccuccuccucccccgcggcuuccagccccagcccggcggcaaccgcaccgagucccccgagcccaacgccaccgccacccccgccauccccaccauccucgucaccuccgucaccuccgagacccccgccaccuccgcccccgaggccgagggcccccaguccggcggccuccccccccccccccgcgccguccccuccuccuccuccccccaggcccaggcccucaccgaggacggccgccccugccgcuuccccuuccgcuacggcggccgcaugcuccacgccugcaccuccgagggcuccgcccaccgcaaguggugcgccaccacccacaacuacgaccgcgaccgcgccuggggcuacugcgucgaggccacccccccccccggcggccccgccgcccucgaccccugcgccuccggccccugccucaacggcggcuccugcuccaacacccaggacccccaguccuaccacugcuccugcccccgcgccuucaccggcaaggacugcggcaccgagaagugcuucgacgagacccgcuacgaguaccucgagggcggcgaccgcugggcccgcguccgccagggccacgucgagcagugcgagugcuucggcggccgcaccuggugcgagggcacccgccacaccgccugccucuccucccccugccucaacggcggcaccugccaccucaucgucgccaccggcaccaccgucugcgccugcccccccggcuucgccggccgccucugcaacaucgagcccgacgagcgcugcuuccucggcaacggcaccggcuaccgcggcgucgccuccaccuccgccuccggccucuccugccucgccuggaacuccgaccuccucuaccaggagcuccacgucgacuccgucggcgccgccgcccuccucggccucggcccccacgccuacugccgcaaccccgacaacgacgagcgccccuggugcuacgucgucaaggacuccgcccucuccugggaguacugccgccucgaggccugcgagucccucacccgcguccagcucucccccgaccuccucgccacccuccccgagcccgccucccccggccgccaggccugcggccgccgccacaagaagcgcaccuuccuccgcccccgcaucaucggcggcuccuccucccuccccggcucccaccccuggcucgccgccaucuacaucggcgacuccuucugcgccggcucccucguccacaccugcugggucgucuccgccgcccacugcuucucccacucccccccccgcgacuccgucuccgucguccucggccagcacuucuucaaccgcaccaccgacgucacccagaccuucggcaucgagaaguacauccccuacacccucuacuccgucuucaaccccuccgaccacgaccucguccucauccgccucaagaagaagggcgaccgcugcgccacccgcucccaguucguccagcccaucugccuccccgagcccggcuccaccuuccccgccggccacaagugccagaucgccggcuggggccaccucgacgagaacgucuccggcuacuccuccucccuccgcgaggcccucgucccccucgucgccgaccacaagugcuccucccccgaggucuacggcgccgacaucucccccaacaugcucugcgccggcuacuucgacugcaaguccgacgccugccagggcgacuccggcggcccccucgccugcgagaagaacggcgucgccuaccucuacggcaucaucuccuggggcgacggcugcggccgccuccacaagcccggcgucuacacccgcgucgccaacuacgucgacuggaucaacgaccgcauccgccccccccgccgccucgucgcccccuccuga

SEQ ID NO: 44132 - RNA, 2187 nt, Artificial Sequence
  derived and/or modified sequence opt2 from HGF__Homo_sapiens__NP_000592
augugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccuga

SEQ ID NO: 44133 - RNA, 1173 nt, Artificial Sequence
  derived and/or modified sequence opt2 from HGH1__Homo_sapiens__NP_057542
augggcgaggccggcgccggcgccggcgccuccggcggccccgaggccucccccgaggccgaggucgucaagcuccuccccuuccucgcccccggcgcccgcgccgaccuccaggccgccgccguccgccacguccucgcccucaccggcugcggccccggccgcgcccuccucgccggccaggccgcccuccuccaggcccucauggagcucgcccccgccuccgcccccgcccgcgacgccgcccgcgcccucgucaaccucgccgccgaccccggccuccacgagacccuccucgccgccgaccccggccuccccgcccgccucaugggccgcgcccucgacccccaguggcccugggccgaggaggccgccgccgcccucgccaaccucucccgcgagcccgcccccugcgccgcccucauggccgcccucgccgccgccgagcccgccgacuccggccucgagcgccucguccgcgcccucugcacccccggcuacaacgcccgcgccccccuccacuaccucgccccccuccucuccaaccucucccagcgccccgccgcccgcgccuuccuccucgaccccgaccgcugcgucguccagcgccuccucccccucacccaguaccccgacuccuccguccgccgcggcggcgucgucggcacccuccgcaacugcugcuucgagcaccgccaccacgaguggcuccucggccccgaggucgacauccuccccuuccuccuccucccccucgccggccccgaggacuucuccgaggaggagauggagcgccuccccgucgaccuccaguaccucccccccgacaagcagcgcgagcccgacgccgacauccgcaagaugcucgucgaggccaucaugcuccucaccgccaccgcccccggccgccagcagguccgcgaccagggcgccuaccucauccuccgcgagcuccacuccugggagcccgagcccgacguccgcaccgccugcgagaagcucauccagguccucaucggcgacgagcccgagcgcggcauggagaaccuccucgagguccagguccccgaggacgucgagcagcagcuccagcagcucgacugccgcgagcaggagcagcucgagcgcgagcucgcccccgagcccugggucgagcgcgccacccccaccuga

SEQ ID NO: 44134 - RNA, 2334 nt, Artificial Sequence
  derived and/or modified sequence opt2 from HGS__Homo_sapiens__NP_004703
augggccgcggcuccggcaccuucgagcgccuccucgacaaggccaccucccagcuccuccucgagaccgacugggaguccauccuccagaucugcgaccucauccgccagggcgacacccaggccaaguacgccgucaacuccaucaagaagaaggucaacgacaagaacccccacgucgcccucuacgcccucgaggucauggaguccgucgucaagaacugcggccagaccguccacgacgaggucgccaacaagcagaccauggaggagcucaaggaccuccucaagcgccaggucgaggucaacguccgcaacaagauccucuaccucauccaggccugggcccacgccuuccgcaacgagcccaaguacaaggucguccaggacaccuaccagaucaugaaggucgagggccacgucuuccccgaguucaaggaguccgacgccauguucgccgccgagcgcgcccccgacugggucgacgccgaggagugccaccgcugccgcguccaguucggcgucaugacccgcaagcaccacugccgcgccugcggccagaucuucugcggcaagugcuccuccaaguacuccaccauccccaaguucggcaucgagaaggagguccgcgucugcgagcccugcuacgagcagcucaaccgcaaggccgagggcaaggccaccuccaccaccgagcucccccccgaguaccucaccuccccccucucccagcagucccagcucccccccaagcgcgacgagaccgcccuccaggaggaggaggagcuccagcucgcccucgcccucucccaguccgaggccgaggagaaggagcgccuccgccagaaguccaccuacaccuccuaccccaaggccgagcccaugcccuccgccuccuccgccccccccgccuccucccucuacuccucccccgucaacuccuccgccccccucgccgaggacaucgaccccgagcucgcccgcuaccucaaccgcaacuacugggagaagaagcaggaggaggcccgcaagucccccacccccuccgcccccgucccccucaccgagcccgccgcccagcccggcgagggccacgccgcccccaccaacgucgucgagaacccccuccccgagaccgacucccagcccaucccccccuccggcggccccuucuccgagccccaguuccacaacggcgaguccgaggagucccacgagcaguuccucaaggcccuccagaacgccgucaccaccuucgucaaccgcaugaaguccaaccacaugcgcggccgcuccaucaccaacgacuccgccguccucucccucuuccaguccaucaacggcaugcacccccagcuccucgagcuccucaaccagcucgacgagcgccgccucuacuacgagggccuccaggacaagcucgcccagauccgcgacgcccgcggcgcccucuccgcccuccgcgaggagcaccgcgagaagcuccgccgcgccgccgaggaggccgagcgccagcgccagauccagcucgcccagaagcucgagaucaugcgccagaagaagcaggaguaccucgagguccagcgccagcucgccauccagcgccuccaggagcaggagaaggagcgccagaugcgccucgagcagcagaagcagaccguccagaugcgcgcccagaugcccgccuucccccuccccuacgcccagcuccaggccaugcccgccgccggcggcguccucuaccagcccuccggccccgccuccuuccccuccaccuucucccccgccggcuccgucgagggcucccccaugcacggcgucuacaugucccagcccgcccccgccgccggccccuaccccuccaugcccuccaccgccgccgaccccuccauggucuccgccuacauguaccccgccggcgccaccggcgcccaggccgccccccaggcccaggccggccccaccgccucccccgccuacuccuccuaccagcccacccccaccgccggcuaccagaacgucgccucccaggccccccagucccuccccgccaucucccagcccccccaguccuccaccaugggcuacaugggcucccaguccgucuccaugggcuaccagcccuacaacaugcagaaccucaugaccacccuccccucccaggacgccucccuccccccccagcagcccuacaucgccggccagcagcccauguaccagcagauggcccccuccggcggccccccccagcagcagccccccgucgcccagcagccccaggcccagggcccccccgcccagggcuccgaggcccagcucaucuccuucgacuga

SEQ ID NO: 44135 - RNA, 1908 nt, Artificial Sequence
  derived and/or modified sequence opt2 from HGSNAT__Homo_sapiens__NP_689632
auguccggcgccggccgcgcccucgccgcccuccuccucgccgccuccguccucuccgccgcccuccucgcccccggcggcuccuccggccgcgacgcccaggccgcccccccccgcgaccucgacaagaagcgccacgccgagcucaagauggaccaggcccuccuccucauccacaacgagcuccucuggaccaaccucaccgucuacuggaaguccgagugcugcuaccacugccucuuccagguccucgucaacgucccccagucccccaaggccggcaagcccuccgccgccgccgccuccgucuccacccagcacggcuccauccuccagcucaacgacacccucgaggagaaggaggucugccgccucgaguaccgcuucggcgaguucggcaacuacucccuccucgucaagaacauccacaacggcgucuccgagaucgccugcgaccucgccgucaacgaggaccccgucgacuccaaccuccccgucuccaucgccuuccucaucggccucgccgucaucaucgucaucuccuuccuccgccuccuccucucccucgacgacuucaacaacuggaucuccaaggccaucuccucccgcgagaccgaccgccucaucaacuccgagcucggcucccccucccgcaccgacccccucgacggcgacguccagcccgccaccuggcgccucuccgcccuccccccccgccuccgcuccgucgacaccuuccgcggcaucgcccucauccucauggucuucgucaacuacggcggcggcaaguacugguacuucaagcacgccuccuggaacggccucaccgucgccgaccucgucuuccccugguucgucuucaucaugggcuccuccaucuuccucuccaugaccuccauccuccagcgcggcugcuccaaguuccgccuccucggcaagaucgccuggcgcuccuuccuccucaucugcaucggcaucaucaucgucaaccccaacuacugccucggcccccucuccugggacaagguccgcauccccggcguccuccagcgccucggcgucaccuacuucgucgucgccguccucgagcuccucuucgccaagcccguccccgagcacugcgccuccgagcgcuccugccucucccuccgcgacaucaccuccuccuggccccaguggcuccucauccucguccucgagggccucuggcucggccucaccuuccuccuccccguccccggcugccccaccggcuaccucggccccggcggcaucggcgacuucggcaaguaccccaacugcaccggcggcgccgccggcuacaucgaccgccuccuccucggcgacgaccaccucuaccagcaccccuccuccgccguccucuaccacaccgaggucgccuacgaccccgagggcauccucggcaccaucaacuccaucgucauggccuuccucggcguccaggccggcaagauccuccucuacuacaaggcccgcaccaaggacauccucauccgcuucaccgccuggugcugcauccucggccucaucuccgucgcccucaccaaggucuccgagaacgagggcuucauccccgucaacaagaaccucuggucccucuccuacgucaccacccucuccuccuucgccuucuucauccuccucguccucuaccccgucgucgacgucaagggccucuggaccggcacccccuucuucuaccccggcaugaacuccauccucgucuacgucggccacgaggucuucgagaacuacuuccccuuccaguggaagcucaaggacaaccagucccacaaggagcaccucacccagaacaucgucgccaccgcccucuggguccucaucgccuacauccucuaccgcaagaagaucuucuggaagaucuga

SEQ ID NO: 44136 - RNA, 1071 nt, Artificial Sequence
  derived and/or modified sequence opt2 from HHAT__Homo_sapiens__NP_001164035
augcucccccgcugggagcucgcccucuaccuccucgccucccucggcuuccacuucuacuccuucuacgaggucuacaaggucucccgcgagcacgaggaggagcucgaccaggaguucgagcucgagaccgacacccucuucggcggccucaagaaggacgccaccgacuucgagugguccuucuggauggaguggggcaagcaguggcucgucuggcuccuccucggccacauggucgucucccagauggccacccuccucgcccgcaagaugcagcagcaggagcacgacucccucaaggccucccucugcguccucgcccucggccucggccgccuccucugcuggugguggcucgccgagcucauggcccaccucauguacaugcacgccaucuacuccuccaucccccuccucgagaccgucuccugcuggacccucggcggccucgcccucgcccagguccucuucuucuacgucaaguaccucguccucuucggcguccccgcccuccucaugcgccucgacggccucaccccccccgcccucccccgcugcgucuccaccauguucuccuucaccggcauguggcgcuacuucgacgucggccuccacaacuuccucauccgcuacgucuacauccccgucggcggcucccagcacggccuccucggcacccucuucuccaccgccaugaccuucgccuucgucuccuacuggcacggcggcuacgacuaccucuggugcugggccgcccucaacuggcucggcgucaccgucgagaacggcguccgccgccucgucgagacccccugcauccaggacucccucgcccgcuacuucuccccccaggcccgccgccgcuuccacgccgcccucgccuccugcuccaccuccaugcucauccucuccaaccucgucuuccucggcggcaacgaggucggcaagaccuacuggaaccgcaucuucauccagggcuggcccugggucacccucuccguccucggcuuccucuacugcuacucccacgucggcaucgccugggcccagaccuacgccaccgacuga

SEQ ID NO: 44137 - RNA, 1515 nt, Artificial Sequence
  derived and/or modified sequence opt2 from HHATL__Homo_sapiens__NP_065758
augggcaucaagaccgcccuccccgccgccgagcucggccucuacucccucguccucuccggcgcccucgccuacgccggccgcggccuccucgaggccucccaggacggcgcccaccgcaaggccuuccgcgaguccguccgccccggcugggaguacaucggccgcaagauggacgucgccgacuucgagugggucaugugguucaccuccuuccgcaacgucaucaucuucgcccucuccggccacguccucuucgccaagcucugcaccauggucgcccccaagcuccgcuccuggauguacgccgucuacggcgcccucgccgucaugggcaccaugggccccugguaccuccuccuccuccucggccacugcgucggccucuacgucgccucccuccucggccagcccuggcucugccucggccucggccucgccucccucgccuccuucaagauggacccccucaucuccuggcaguccggcuucgucaccggcaccuucgaccuccaggagguccucuuccacggcggcuccuccuucaccguccuccgcugcaccuccuucgcccucgaguccugcgcccaccccgaccgccacuacucccucgccgaccuccucaaguacaacuucuaccuccccuucuucuucuucggccccaucaugaccuucgaccgcuuccacgcccaggucucccaggucgagcccguccgccgcgagggcgagcucuggcacauccgcgcccaggccggccucuccgucgucgccaucauggccgucgacaucuucuuccacuucuucuacauccucaccauccccuccgaccucaaguucgccaaccgccuccccgacuccgcccucgccggccucgccuacuccaaccucgucuacgacugggucaaggccgccguccucuucggcgucgucaacaccgucgccugccucgaccaccucgaccccccccagccccccaagugcaucaccgcccucuacgucuucgccgagacccacuucgaccgcggcaucaacgacuggcucugcaaguacgucuacaaccacaucggcggcgagcacuccgccgucauccccgagcucgccgccaccgucgccaccuucgccaucaccacccucuggcucggccccugcgacaucgucuaccucugguccuuccucaacugcuucggccucaacuucgagcucuggaugcagaagcucgccgaguggggcccccucgcccgcaucgaggccucccucuccguccagaugucccgccgcguccgcgcccucuucggcgccaugaacuucugggccaucaucauguacaaccucgucucccucaacucccucaaguucaccgagcucgucgcccgccgccuccuccucaccggcuucccccagaccacccucuccauccucuucgucaccuacugcggcguccagcucgucaaggagcgcgagcgcacccucgcccucgaggaggagcagaagcaggacaaggagaagcccgaguga

SEQ ID NO: 44138 - RNA, 813 nt, Artificial Sequence
  derived and/or modified sequence opt2 from HHEX__Homo_sapiens__NP_002720
augcaguacccccaccccggccccgccgccggcgccgucggcgucccccucuacgcccccaccccccuccuccagcccgcccaccccacccccuucuacaucgaggacauccucggccgcggccccgccgcccccacccccgcccccacccuccccucccccaacuccuccuucaccucccucgucucccccuaccgcacccccgucuacgagcccacccccauccaccccgccuucucccaccacuccgccgccgcccucgccgccgccuacggccccggcggcuucggcggcccccucuaccccuucccccgcaccgucaacgacuacacccacgcccuccuccgccacgacccccucggcaagccccuccucuggucccccuuccuccagcgcccccuccacaagcgcaagggcggccagguccgcuucuccaacgaccagaccaucgagcucgagaagaaguucgagacccagaaguaccucuccccccccgagcgcaagcgccucgccaagaugcuccagcucuccgagcgccaggucaagaccugguuccagaaccgccgcgccaaguggcgccgccucaagcaggagaacccccaguccaacaagaaggaggagcucgagucccucgacuccuccugcgaccagcgccaggaccuccccuccgagcagaacaagggcgccucccucgacuccucccagugcucccccucccccgccucccaggaggaccucgaguccgagaucuccgaggacuccgaccaggaggucgacaucgagggcgacaaguccuacuucaacgccggcuga

SEQ ID NO: 44139 - RNA, 2103 nt, Artificial Sequence
  derived and/or modified sequence opt2 from HHIP__Homo_sapiens__NP_071920
augcucaagaugcucuccuucaagcuccuccuccucgccgucgcccucggcuucuucgagggcgacgccaaguucggcgagcgcaacgagggcuccggcgcccgccgccgccgcugccucaacggcaacccccccaagcgccucaagcgccgcgaccgccgcaugaugucccagcucgagcuccucuccggcggcgagaugcucugcggcggcuucuacccccgccucuccugcugccuccgcuccgacucccccggccucggccgccucgagaacaagaucuucuccgucaccaacaacaccgagugcggcaagcuccucgaggagaucaagugcgcccucugcuccccccacucccagucccucuuccacucccccgagcgcgagguccucgagcgcgaccucguccucccccuccucugcaaggacuacugcaaggaguucuucuacaccugccgcggccacauccccggcuuccuccagaccaccgccgacgaguucugcuucuacuacgcccgcaaggacggcggccucugcuuccccgacuucccccgcaagcagguccgcggccccgccuccaacuaccucgaccagauggaggaguacgacaaggucgaggagaucucccgcaagcacaagcacaacugcuucugcauccaggaggucgucuccggccuccgccagcccgucggcgcccuccacuccggcgacggcucccagcgccucuucauccucgagaaggagggcuacgucaagauccucacccccgagggcgagaucuucaaggagcccuaccucgacauccacaagcucguccaguccggcaucaagggcggcgacgagcgcggccuccucucccucgccuuccaccccaacuacaagaagaacggcaagcucuacgucuccuacaccaccaaccaggagcgcugggccaucggcccccacgaccacauccuccgcgucgucgaguacaccgucucccgcaagaacccccaccaggucgaccuccgcaccgcccgcgucuuccucgaggucgccgagcuccaccgcaagcaccucggcggccagcuccucuucggccccgacggcuuccucuacaucauccucggcgacggcaugaucacccucgacgacauggaggagauggacggccucuccgacuucaccggcuccguccuccgccucgacgucgacaccgacaugugcaacguccccuacuccaucccccgcuccaacccccacuucaacuccaccaaccagccccccgaggucuucgcccacggccuccacgaccccggccgcugcgccgucgaccgccaccccaccgacaucaacaucaaccucaccauccucugcuccgacuccaacggcaagaaccgcuccuccgcccgcauccuccagaucaucaagggcaaggacuacgaguccgagcccucccuccucgaguucaagcccuucuccaacggcccccucgucggcggcuucgucuaccgcggcugccaguccgagcgccucuacggcuccuacgucuucggcgaccgcaacggcaacuuccucacccuccagcagucccccgucaccaagcaguggcaggagaagccccucugccucggcaccuccggcuccugccgcggcuacuucuccggccacauccucggcuucggcgaggacgagcucggcgaggucuacauccucuccuccuccaaguccaugacccagacccacaacggcaagcucuacaagaucgucgaccccaagcgcccccucaugcccgaggagugccgcgccaccguccagcccgcccagacccucaccuccgagugcucccgccucugccgcaacggcuacugcacccccaccggcaagugcugcugcucccccggcugggagggcgacuucugccgcaccgccaagugcgagcccgccugccgccacggcggcgucugcguccgccccaacaagugccucugcaagaagggcuaccucggcccccagugcgagcaggucgaccgcaacauccgccgcgucacccgcgccggcauccucgaccagaucaucgacaugaccuccuaccuccucgaccucaccuccuacaucgucuga

SEQ ID NO: 44140 - RNA, 2349 nt, Artificial Sequence
  derived and/or modified sequence opt2 from HHIPL1__Homo_sapiens__NP_001120730
auggcccgcgcccgcgccggcgcccuccucgcccucuggguccucggcgccgccgcccacccccagugccucgacuuccgcccccccuuccgccccacccagccccuccgccucugcgcccaguacuccgacuucggcugcugcgacgagggccgcgacgccgagcucacccgccgcuucugggcccucgccucccgcgucgacgccgccgagugggccgccugcgccggcuacgcccgcgaccuccucugccaggagugcucccccuacgccgcccaccucuacgacgccgaggaccccuucaccccccuccgcaccguccccggccucugccaggacuacugccucgacauguggcacaagugccgcggccucuuccgccaccucuccaccgaccaggagcucugggcccucgagggcaaccucgcccgcuucugccgcuaccucucccucgacgacaccgacuacugcuuccccuaccuccucgucaacaagaaccucaacuccaaccucggccacgucgucgccgacgccaagggcugccuccagcucugccucgaggaggucgccaacggccuccgcaaccccgucgccaugguccacgcccgcgacggcacccaccgcuucuucgucgccgagcaggucggccucgucugggccuaccuccccgaccgcucccgccucggcaagcccuuccucaacaucucccgcgucguccucaccucccccugggagggcgacgagcgcggcuuccucggcaucgccuuccaccccuccuuccagcacaaccgccgccucuacgucuacuacuccgucggcauccgcuccuccgaguggauccgcaucuccgaguuccgcgucuccgaggacgacgagaacgccgucgaccacuccuccgagcgcaucauccucgaggucaaggagcccgccuccaaccacaacggcggccagcuccucuucggcgacgacggcuaccucuacaucuucaccggcgacggcggcauggccggcgaccccuucggcaccuucggcaacgcccagaacaaguccgcccuccucggcaagguccuccgcaucgacgucgaccgcaaggagcgcggccuccccuacggcaucccccccgacaaccccuucgucggcgaccccgccgcccagcccgaggucuacgcccucggcguccgcaacauguggcgcugcuccuucgaccgcggcgaccccuccuccggcaccggccgcggccgccucuucugcggcgacgucggccagaacaaguucgaggaggucgacgucgucgagcgcggcggcaacuacggcuggcgcgcccgcgagggcuucgagugcuacgaccgcucccucugcgccaacaccucccucaacgaccuccuccccaucuucgccuacccccacaccgucggcaaguccgucaccggcggcuacgucuaccgcggcugcgaguaccccaaccucaacggccucuacaucuucggcgacuucauguccggccgccucaugucccuccaggagaaccccggcaccggccaguggcaguacuccgagaucugcaugggccacggccagaccugcgaguuccccggccucaucaacaacuacuaccccuacaucaucuccuucggcgaggacgaggccggcgagcucuacuucauguccaccggcgagcccuccgccaccgccccccgcggcgucgucuacaagaucaucgacgccucccgccgcgccccccccggcaagugccagauccagcccgcccaggucaagauccgcucccgccucauccccuucguccccaaggagaaguucauccccaagacccgcuccaccccccgccccaccgcccgcgcccccacccgcgccccccgccgcggccgccccaccgccgccccccccgcccccaccccccgccccgcccgccccacccagcagcccggcucccgccgcggcggcggccgccgccgcggccgccucaacuccgccucccgcgccuuccgcgacggcgagguccgccucguccgccccgccggccucuccuccggcuccggccgcgucgaggucuucgucggcggccgcuggggcaccgucugcgacgacuccuggaacaucuccggcgccgccgucgucugccgccagcucggcuucgccuacgccguccgcgccgucaagcgcgccgaguucggccagggcggcucccuccccauccuccucgacgacguccgcugcgccggcugggagcgcaaccuccucgagugccagcacaacggcgucggcacccacaacugcgagcacgacgaggacgccggcgucgucugcucccaccagaaccccgaccucuga

SEQ ID NO: 44141 - RNA, 1596 nt, Artificial Sequence
  derived and/or modified sequence opt2 from HHLA1__Homo_sapiens__NP_001138567
augcucggcuuccucucccgcggccccuccaugaagcucugcaugggccucgccugcguccucucccucuggaacaccgucuccggcaucaagggcgaggccaagaaggagaagggcaugaccuuccuccccaccaccgucuccggccuccgcgaggaggagcgcaaggagaagggcgucgccuuccucgccaccaccgagcuccccgcccgcuccaucgaccucuccgcccucaaccucaccgagcucgucaacggcaugcucucccgcgcccucaaggacuccaagaaguucuucucccuccucuccgucaccuccuacuccuccuucgccuuccacaaguucuccgucgccgucuacaacaucuccaaccucaagaccgucgaccccgccaaguuccccacccgcuacugcuacugccucaacaaccgcaccaacgaccucuccgacuucaccgcccuccucgucgacaucaucggcaacuccaccuccuaccucaccgagaucuucaaguccaccuccauccucuccgucaaccaguccaacgaguccgacugcaucuucaucugcgucaugaccggcaaguccggccgcaaccucuccgacuucugggagaucgaggagaaguaccccaucaucaacuacaccuucaccuccggccucuccggcguccucggcgccgccacccgcggcaccgcccgcaccuccaagcccaccaccaagucccagaagacccuccccuccaccucccccggccacuggacccaguccacccccugggccuccgcccuccgcuccucccccuggaccgagaccgccgcccccuccgagaccgaggagacccucaacaccggccgcccccccgagcuccccgcccgcgccaccgccaccugguucuccgccucccacacccuccccgcccucgccacccgccgcgucgcccgcacccaguggcucaccgccgaccgccagaccugggccuccaucuccuccguccccugggcccagaccaucuccgagaagaagcccggcggcucccucugggagacccgcuccuccccccccaccaccgccggcaccgaggaggccaugaacaccaccucccuccucgcccccgccgccgagaucauggccacccccggcucccccucccaggccucccccacccucggcgccuucacccacggcacccagacccccucccccaccaaggccaccgccccccgcuacccccagaccggcgaccucuccgccgaguggcccuucaccgccggcgaggagcccguccucgucccccgcccccaccaggucucccgcugcccccagccccucuucaaggucggcgccauggccgccgccccccucacccucgccauccagcgccucaaccccugccucauggagcucugccaguucuuccagcagugccucugcaugucccagcgcuccccccgcaccgaggacaugcgcuacugccucgaguacuacuccugguuccucaagaacgccaccuacaucugccagcgcgucaagcgcgucucccacucccacacccucaagcagaagugccucgagaacaucugcaaguccgucuga

SEQ ID NO: 44142 - RNA, 1194 nt, Artificial Sequence
  derived and/or modified sequence opt2 from HHLA2__Homo_sapiens__NP_001269487
augaaggcccagaccgcccucuccuucuuccucauccucaucaccucccucuccggcucccagggcaucuucccccucgccuucuucaucuacguccccaugaacgagcagaucgucaucggccgccucgacgaggacaucauccuccccuccuccuucgagcgcggcuccgaggucgucauccacuggaaguaccaggacuccuacaagguccacuccuacuacaagggcuccgaccaccucgagucccaggacccccgcuacgccaaccgcaccucccucuucuacaacgagauccagaacggcaacgccucccucuucuuccgccgcgucucccuccucgacgagggcaucuacaccugcuacgucggcaccgccauccaggucaucaccaacaaggucguccucaaggucggcgucuuccucacccccgucaugaaguacgagaagcgcaacaccaacuccuuccucaucugcuccguccucuccgucuacccccgccccaucaucaccuggaagauggacaacacccccaucuccgagaacaacauggaggagaccggcucccucgacuccuucuccaucaacuccccccucaacaucaccggcuccaacuccuccuacgagugcaccaucgagaacucccuccucaagcagaccuggaccggccgcuggaccaugaaggacggccuccacaagaugcaguccgagcacgucucccucuccugccagcccgucaacgacuacuucucccccaaccaggacuucaaggucaccuggucccgcaugaaguccggcaccuucuccguccucgccuacuaccucuccuccucccagaacaccaucaucaacgagucccgcuucuccuggaacaaggagcucaucaaccaguccgacuucuccaugaaccucauggaccucaaccucuccgacuccggcgaguaccucugcaacaucuccuccgacgaguacacccuccucaccauccacaccguccacgucgagcccucccaggagaccgccucccacaacaagggccucuggauccucguccccuccgccauccucgccgccuuccuccucaucugguccgucaagugcugccgcgagcgcugcugcgucccccccggcgagcgcugccccuccgcccccgacaacggcgaggagaacgucccccucuccggcaaggucuga

SEQ ID NO: 44143 - RNA, 1359 nt, Artificial Sequence
  derived and/or modified sequence opt2 from HIAT1__Homo_sapiens__XP_011540259
augacccagggcaagaagaagaagcgcgccgccaaccgcuccaucaugcucgccaagaagaucaucaucaaggacggcggcaccccccagggcaucggcucccccuccgucuaccacgccgucaucgucaucuuccucgaguucuucgccuggggccuccucaccgcccccacccucgucguccuccacgagaccuuccccaagcacaccuuccucaugaacggccucauccagggcgucaagggccuccucuccuuccucuccgccccccucaucggcgcccucuccgacgucuggggccgcaaguccuuccuccuccucaccgucuucuucaccugcgcccccaucccccucaugaagaucucccccuggugguacuucgccgucaucuccgucuccggcgucuucgccgucaccuucuccgucgucuucgccuacgucgccgacaucacccaggagcacgagcgcuccauggccuacggccucgucuccgccaccuucgccgccucccucgucaccucccccgccaucggcgccuaccucggccgcgucuacggcgacucccucgucgucguccucgccaccgccaucgcccuccucgacaucugcuucauccucgucgccguccccgagucccuccccgagaagaugcgccccgccuccuggggcgcccccaucuccugggagcaggccgaccccuucgccaucaugaaguucucccccgaguccgucgccgccuucaucgccguccucggcauccucuccaucaucgcccagaccaucguccucucccuccucaugcgcuccaucggcaacaagaacaccauccuccucggccucggcuuccagauccuccagcucgccugguacggcuucggcuccgagcccuggaugaugugggccgccggcgccgucgccgccauguccuccaucaccuuccccgccgucuccgcccucgucucccgcaccgccgacgccgaccagcagggcgucguccagggcaugaucaccggcauccgcggccucugcaacggccucggccccgcccucuacggcuucaucuucuacaucuuccacgucgagcucaaggagcuccccaucaccggcaccgaccucggcaccaacaccuccccccagcaccacuucgagcagaacuccaucauccccggcccccccuuccucuucggcgccugcuccguccuccucgcccuccucgucgcccucuucauccccgagcacaccaaccucucccuccgcuccuccuccuggcgcaagcacugcggcucccacucccacccccacaacacccaggcccccggcgaggccaaggagccccuccuccaggacaccaacgucuga

SEQ ID NO: 44144 - RNA, 1011 nt, Artificial Sequence
  derived and/or modified sequence opt2 from HIBADH__Homo_sapiens__NP_689953
auggccgccucccuccgccuccucggcgccgccuccggccuccgcuacuggucccgccgccuccgccccgccgccggcuccuucgccgccgucugcucccgcuccgucgccuccaagacccccgucggcuucaucggccucggcaacaugggcaaccccauggccaagaaccucaugaagcacggcuacccccucaucaucuacgacgucuuccccgacgccugcaaggaguuccaggacgccggcgagcaggucgucuccucccccgccgacgucgccgagaaggccgaccgcaucaucaccaugcuccccaccuccaucaacgccaucgaggccuacuccggcgccaacggcauccucaagaaggucaagaagggcucccuccucaucgacuccuccaccaucgaccccgccgucuccaaggagcucgccaaggaggucgagaagaugggcgccgucuucauggacgcccccgucuccggcggcgucggcgccgcccgcuccggcaaccucaccuucauggucggcggcgucgaggacgaguucgccgccgcccaggagcuccucggcugcaugggcuccaacgucgucuacugcggcgccgucggcaccggccaggccgccaagaucugcaacaacaugcuccucgccaucuccaugaucggcaccgccgaggccaugaaccucggcauccgccucggccucgaccccaagcuccucgccaagauccucaacauguccuccggccgcugcugguccuccgacaccuacaaccccguccccggcgucauggacggcguccccuccgccaacaacuaccagggcggcuucggcaccacccucauggccaaggaccucggccucgcccaggacuccgccaccuccaccaagucccccauccuccucggcucccucgcccaccagaucuaccgcaugaugugcgccaagggcuacuccaagaaggacuucuccuccgucuuccaguuccuccgcgaggaggagaccuucuga

SEQ ID NO: 44145 - RNA, 1161 nt, Artificial Sequence
  derived and/or modified sequence opt2 from HIBCH__Homo_sapiens__NP_055177
augggccagcgcgagauguggcgccucaugucccgcuucaacgccuucaagcgcaccaacaccauccuccaccaccuccgcauguccaagcacaccgacgccgccgaggagguccuccucgagaagaagggcugcaccggcgucaucacccucaaccgccccaaguuccucaacgcccucacccucaacaugauccgccagaucuacccccagcucaagaagugggagcaggaccccgagaccuuccucaucaucaucaagggcgccggcggcaaggccuucugcgccggcggcgacauccgcgucaucuccgaggccgagaaggccaagcagaagaucgcccccgucuucuuccgcgaggaguacaugcucaacaacgccgucggcuccugccagaagcccuacgucgcccucauccacggcaucaccaugggcggcggcgucggccucuccguccacggccaguuccgcgucgccaccgagaagugccucuucgccaugcccgagaccgccaucggccucuuccccgacgucggcggcggcuacuuccucccccgccuccagggcaagcucggcuacuuccucgcccucaccggcuuccgccucaagggccgcgacgucuaccgcgccggcaucgccacccacuucgucgacuccgagaagcucgccaugcucgaggaggaccuccucgcccucaagucccccuccaaggagaacaucgccuccguccucgagaacuaccacaccgaguccaagaucgaccgcgacaaguccuucauccucgaggagcacauggacaagaucaacuccugcuucuccgccaacaccgucgaggagaucaucgagaaccuccagcaggacggcuccuccuucgcccucgagcagcucaaggucaucaacaagaugucccccaccucccucaagaucacccuccgccagcucauggagggcuccuccaagacccuccaggagguccucaccauggaguaccgccucucccaggccugcaugcgcggccacgacuuccacgagggcguccgcgccguccucaucgacaaggaccagucccccaaguggaagcccgccgaccucaaggaggucaccgaggaggaccucaacaaccacuucaagucccucggcuccuccgaccucaaguucuga

SEQ ID NO: 44146 - RNA, 2202 nt, Artificial Sequence
  derived and/or modified sequence opt2 from HIC1__Homo_sapiens__NP_001091672
augaccuuccccgaggccgacauccuccucaaguccggcgagugcgccggccagaccaugcucgacaccauggaggcccccggccacucccgccagcuccuccuccagcucaacaaccagcgcaccaagggcuuccucugcgacgucaucaucgucguccagaacgcccucuuccgcgcccacaagaacguccucgccgccuccuccgccuaccucaagucccucgucguccacgacaaccuccucaaccucgaccacgacauggucucccccgccgucuuccgccucguccucgacuucaucuacaccggccgccucgccgacggcgccgaggccgccgccgccgccgccgucgcccccggcgccgagcccucccucggcgccguccucgccgccgccuccuaccuccagauccccgaccucgucgcccucugcaagaagcgccucaagcgccacggcaaguacugccaccuccgcggcggcggcggcggcggcggcggcuacgcccccuacggccgccccggccgcggccuccgcgccgccacccccgucauccaggccugcuaccccucccccgucggccccccccccccccccgccgccgagccccccuccggccccgaggccgccgucaacacccacugcgccgagcucuacgccuccggccccggccccgccgccgcccucugcgccuccgagcgccgcugcuccccccucugcggccucgaccucuccaagaaguccccccccggcuccgccgcccccgagcgcccccucgccgagcgcgagcuccccccccgccccgacuccccccccuccgccggccccgccgccuacaaggagcccccccucgcccuccccucccuccccccccuccccuuccagaagcucgaggaggccgccccccccuccgaccccuuccgcggcggcuccggcucccccggccccgagccccccggccgccccgacggccccucccuccucuaccgcuggaugaagcacgagcccggccucggcuccuacggcgacgagcucggccgcgagcgcggcucccccuccgagcgcugcgaggagcgcggcggcgacgccgccgucucccccggcggccccccccucggccucgccccccccccccgcuaccccggcucccucgacggccccggcgccggcggcgacggcgacgacuacaaguccuccuccgaggagaccggcuccuccgaggaccccuccccccccggcggccaccucgagggcuaccccugcccccaccucgccuacggcgagcccgaguccuucggcgacaaccucuacgucugcauccccugcggcaagggcuuccccuccuccgagcagcucaacgcccacgucgaggcccacgucgaggaggaggaggcccucuacggccgcgccgaggccgccgaggucgccgccggcgccgccggccucggcccccccuucggcggcggcggcgacaaggucgccggcgcccccggcggccucggcgagcuccuccgccccuaccgcugcgccuccugcgacaaguccuacaaggaccccgccacccuccgccagcacgagaagacccacuggcucacccgccccuaccccugcaccaucugcggcaagaaguucacccagcgcggcaccaugacccgccacaugcgcucccaccucggccucaagcccuucgccugcgacgccugcggcaugcgcuucacccgccaguaccgccucaccgagcacaugcgcauccacuccggcgagaagcccuacgagugccaggucugcggcggcaaguucgcccagcagcgcaaccucaucucccacaugaagaugcacgccgucggcggcgccgccggcgccgccggcgcccucgccggccucggcggccuccccggcguccccggccccgacggcaagggcaagcucgacuuccccgagggcgucuucgccgucgcccgccucaccgccgagcagcucucccucaagcagcaggacaaggccgccgccgccgagcuccucgcccagaccacccacuuccuccacgaccccaaggucgcccucgagucccucuacccccucgccaaguucaccgccgagcucggccucucccccgacaaggccgccgagguccucucccagggcgcccaccucgccgccggccccgacggccgcaccaucgaccgcuucucccccaccuga

SEQ ID NO: 44147 - RNA, 1848 nt, Artificial Sequence
  derived and/or modified sequence opt2 from HIC2__Homo_sapiens__NP_055909
auggucuccggcccccucgcccuccgcuggugcgccugggccggccgcggcgacaugggccccgacauggagcuccccucccacuccaagcagcuccuccuccagcucaaccagcagcgcaccaagggcuuccucugcgacgucaucaucauggucgagaacuccaucuuccgcgcccacaagaacguccucgccgccuccuccaucuacuucaagucccucguccuccacgacaaccucaucaaccucgacaccgacauggucuccuccaccgucuuccagcagauccucgacuucaucuacaccggcaagcuccuccccuccgaccagcccgccgagcccaacuucuccacccuccucaccgccgccuccuaccuccagcuccccgagcucgccgcccucugccgccgcaagcucaagcgcgccggcaagcccuucggcuccggccgcgccggcuccaccggcaugggccgccccccccgcucccagcgccucuccaccgccuccgucauccaggcccgcuaccagggccucgucgacggccgcaagggcgcccacgccccccaggagcucccccaggccaagggcuccgacgacgagcucuuccucggcggcuccaaccaggacuccguccagggccucggccgcgccgucugccccgccggcggcgaggccggccucggcggcugcuccuccuccaccaacggcuccuccggcggcugcgagcaggagcucggccucgaccucuccaagaagucccccccccucccccccgccacccccggcccccaccucacccccgacgacgccgcccagcucuccgacucccagcacggcuccccccccgccgccuccgccccccccgucgccaacuccgccuccuacuccgagcucggcggcacccccgacgagcccauggaccucgagggcgccgaggacaaccaccucucccuccucgaggcccccggcggccagccccgcaagucccuccgccacuccacccgcaagaaggaguggggcaagaaggagcccgucgccggcucccccuucgagcgccgcgaggccggccccaagggccccugccccggcgaggagggcgagggcgucggcgaccgcguccccaacggcauccucgccuccggcgccggccccuccggccccuacggcgagccccccuaccccugcaaggaggaggaggagaacggcaaggacgccuccgaggacuccgcccaguccggcuccgagggcggcuccggccacgccuccgcccacuacauguaccgccaggagggcuacgagaccgucuccuacggcgacaaccucuacgucugcauccccugcgccaagggcuuccccuccuccgagcagcucaacgcccacgucgagacccacaccgaggaggagcucuucaucaaggaggagggcgccuacgagaccggcuccggcggcgccgaggaggaggccgaggaccucuccgcccccuccgccgccuacaccgccgagccccgccccuucaagugcuccgucugcgagaagaccuacaaggaccccgccacccuccgccagcacgagaagacccacuggcucacccgccccuuccccugcaacaucugcggcaagauguucacccagcgcggcaccaugacccgccacaugcgcucccaccucggccucaagcccuucgccugcgacgagugcggcaugcgcuucacccgccaguaccgccucaccgagcacaugcgcguccacuccggcgagaagcccuacgagugccagcucugcggcggcaaguucacccagcagcgcaaccucaucucccaccuccgcaugcacaccucccccuccuga

SEQ ID NO: 44148 - RNA, 2367 nt, Artificial Sequence
  derived and/or modified sequence opt2 from HID1__Homo_sapiens__NP_085133
augggcuccaccgacuccaagcucaacuuccgcaaggccgucauccagcucaccaccaagacccagcccgucgaggccaccgacgacgccuucugggaccaguucugggccgacaccgccaccuccguccaggacgucuucgcccucguccccgccgccgagauccgcgccguccgcgaggagucccccuccaaccucgccacccucugcuacaaggccgucgagaagcucguccagggcgccgaguccggcugccacuccgagaaggagaagcagaucguccucaacugcucccgccuccucacccgcguccuccccuacaucuucgaggaccccgacuggcgcggcuucuucugguccaccguccccggcgccggccgcggcggccagggcgaggaggacgacgagcacgcccgcccccucgccgagucccuccuccucgccaucgccgaccuccucuucugccccgacuucaccguccagucccaccgccgcuccaccgucgacuccgccgaggacguccacucccucgacuccugcgaguacaucugggaggccggcgucggcuucgcccacuccccccagcccaacuacauccacgacaugaaccgcauggagcuccucaagcuccuccucaccugcuucuccgaggccauguaccucccccccgcccccgaguccggcuccaccaaccccuggguccaguucuucugcuccaccgagaaccgccacgcccucccccucuucaccucccuccucaacaccgucugcgccuacgaccccgucggcuacggcauccccuacaaccaccuccucuucuccgacuaccgcgagccccucgucgaggaggccgcccagguccucaucgucacccucgaccacgacuccgccuccuccgccucccccaccgucgacggcaccaccaccggcaccgccauggacgacgccgacccccccggccccgagaaccucuucgucaacuaccucucccgcauccaccgcgaggaggacuuccaguucauccucaagggcaucgcccgccuccucuccaacccccuccuccagaccuaccuccccaacuccaccaagaagauccaguuccaccaggagcuccucguccucuucuggaagcucugcgacuucaacaagaaguuccucuucuucguccucaaguccuccgacguccucgacauccucguccccauccucuucuuccucaacgacgcccgcgccgaccagucccgcgucggccucaugcacaucggcgucuucauccuccuccuccucuccggcgagcgcaacuucggcguccgccucaacaagcccuacuccauccgcguccccauggacauccccgucuucaccggcacccacgccgaccuccucaucgucgucuuccacaagaucaucaccuccggccaccagcgccuccagccccucuucgacugccuccucaccaucgucgucaacgucucccccuaccucaagucccucuccauggucaccgccaacaagcuccuccaccuccucgaggccuucuccaccaccugguuccucuucuccgccgcccagaaccaccaccucgucuucuuccuccucgaggucuucaacaacaucauccaguaccaguucgacggcaacuccaaccucgucuacgccaucauccgcaagcgcuccaucuuccaccagcucgccaaccuccccaccgacccccccaccauccacaaggcccuccagcgccgccgccgcacccccgagccccucucccgcaccggcucccaggagggcaccuccauggagggcucccgccccgccgcccccgccgagcccggcacccucaagaccucccucgucgccacccccggcaucgacaagcucaccgagaagucccaggucuccgaggacggcacccuccgcucccucgagcccgagccccagcagucccucgaggacggcucccccgccaagggcgagcccucccaggccuggcgcgagcagcgccgccccuccaccuccuccgccuccggccaguggucccccacccccgaguggguccucuccuggaaguccaagcucccccuccagaccaucaugcgccuccuccagguccucgucccccaggucgagaagaucugcaucgacaagggccucaccgacgaguccgagauccuccgcuuccuccagcacggcacccucgucggccuccuccccgucccccaccccauccucauccgcaaguaccaggccaacuccggcaccgccaugugguuccgcaccuacauguggggcgucaucuaccuccgcaacgucgacccccccgucugguacgacaccgacgucaagcucuucgagauccagcgcgucuga

SEQ ID NO: 44149 - RNA, 2553 nt, Artificial Sequence
  derived and/or modified sequence opt2 from HIF1A__Homo_sapiens__NP_001230013
auguccucccagugccgcucccucgagaacaaguucgucuuccucaaggagggccucggcaacuccaagcccgaggagcucgaggagauccgcaucgagaacggccgcaucuccuccgagcgccgcaaggagaagucccgcgacgccgcccgcucccgccgcuccaaggaguccgaggucuucuacgagcucgcccaccagcucccccucccccacaacgucuccucccaccucgacaaggccuccgucaugcgccucaccaucuccuaccuccgcguccgcaagcuccucgacgccggcgaccucgacaucgaggacgacaugaaggcccagaugaacugcuucuaccucaaggcccucgacggcuucgucaugguccucaccgacgacggcgacaugaucuacaucuccgacaacgucaacaaguacaugggccucacccaguucgagcucaccggccacuccgucuucgacuucacccaccccugcgaccacgaggagaugcgcgagaugcucacccaccgcaacggccucgucaagaagggcaaggagcagaacacccagcgcuccuucuuccuccgcaugaagugcacccucaccucccgcggccgcaccaugaacaucaaguccgccaccuggaagguccuccacugcaccggccacauccacgucuacgacaccaacuccaaccagccccagugcggcuacaagaagccccccaugaccugccucguccucaucugcgagcccaucccccaccccuccaacaucgagaucccccucgacuccaagaccuuccucucccgccacucccucgacaugaaguucuccuacugcgacgagcgcaucaccgagcucaugggcuacgagcccgaggagcuccucggccgcuccaucuacgaguacuaccacgcccucgacuccgaccaccucaccaagacccaccacgacauguucaccaagggccaggucaccaccggccaguaccgcaugcucgccaagcgcggcggcuacgucugggucgagacccaggccaccgucaucuacaacaccaagaacucccagccccagugcaucgucugcgucaacuacgucgucuccggcaucauccagcacgaccucaucuucucccuccagcagaccgagugcguccucaagcccgucgaguccuccgacaugaagaugacccagcucuucaccaaggucgaguccgaggacaccuccucccucuucgacaagcucaagaaggagcccgacgcccucacccuccucgcccccgccgccggcgacaccaucaucucccucgacuucggcuccaacgacaccgagaccgacgaccagcagcucgaggaggucccccucuacaacgacgucaugcuccccucccccaacgagaagcuccagaacaucaaccucgccauguccccccuccccaccgccgagacccccaagccccuccgcuccuccgccgaccccgcccucaaccaggaggucgcccucaagcucgagcccaaccccgagucccucgagcucuccuucaccaugccccagauccaggaccagacccccucccccuccgacggcuccacccgccaguccucccccgagcccaacucccccuccgaguacugcuucuacgucgacuccgacauggucaacgaguucaagcucgagcucgucgagaagcucuucgccgaggacaccgaggccaagaaccccuucuccacccaggacaccgaccucgaccucgagaugcucgcccccuacauccccauggacgacgacuuccagcuccgcuccuucgaccagcucuccccccucgaguccuccuccgccucccccgaguccgccuccccccaguccaccgucaccgucuuccagcagacccagauccaggagcccaccgccaacgccaccaccaccaccgccaccaccgacgagcucaagaccgucaccaaggaccgcauggaggacaucaagauccucaucgccucccccucccccacccacauccacaaggagaccaccuccgccaccuccucccccuaccgcgacacccagucccgcaccgccucccccaaccgcgccggcaagggcgucaucgagcagaccgagaagucccacccccgcucccccaacguccucuccgucgcccucucccagcgcaccaccguccccgaggaggagcucaaccccaagauccucgcccuccagaacgcccagcgcaagcgcaagauggagcacgacggcucccucuuccaggccgucggcaucggcacccuccuccagcagcccgacgaccacgccgccaccaccucccucuccuggaagcgcgucaagggcugcaaguccuccgagcagaacggcauggagcagaagaccaucauccucauccccuccgaccucgccugccgccuccucggccaguccauggacgaguccggccucccccagcucaccuccuacgacugcgaggucaacgcccccauccagggcucccgcaaccuccuccagggcgaggagcuccuccgcgcccucgaccaggucaacuga

SEQ ID NO: 44150 - RNA, 1050 nt, Artificial Sequence
  derived and/or modified sequence opt2 from HIF1AN__Homo_sapiens__NP_060372
auggccgccaccgccgccgaggccgucgccuccggcuccggcgagccccgcgaggaggccggcgcccucggccccgccugggacgagucccagcuccgcuccuacuccuuccccacccgccccaucccccgccucucccaguccgacccccgcgccgaggagcucaucgagaacgaggagcccgucguccucaccgacaccaaccucgucuaccccgcccucaagugggaccucgaguaccuccaggagaacaucggcaacggcgacuucuccgucuacuccgccuccacccacaaguuccucuacuacgacgagaagaagauggccaacuuccagaacuucaagccccgcuccaaccgcgaggagaugaaguuccacgaguucgucgagaagcuccaggacauccagcagcgcggcggcgaggagcgccucuaccuccagcagacccucaacgacaccgucggccgcaagaucgucauggacuuccucggcuucaacuggaacuggaucaacaagcagcagggcaagcgcggcuggggccagcucaccuccaaccuccuccucaucggcauggagggcaacgucacccccgcccacuacgacgagcagcagaacuucuucgcccagaucaagggcuacaagcgcugcauccucuucccccccgaccaguucgagugccucuaccccuaccccguccaccaccccugcgaccgccagucccaggucgacuucgacaaccccgacuacgagcgcuuccccaacuuccagaacgucgucggcuacgagaccgucgucggccccggcgacguccucuacauccccauguacugguggcaccacaucgagucccuccucaacggcggcaucaccaucaccgucaacuucugguacaagggcgcccccacccccaagcgcaucgaguacccccucaaggcccaccagaaggucgccaucaugcgcaacaucgagaagaugcucggcgaggcccucggcaacccccaggaggucggcccccuccucaacaccaugaucaagggccgcuacaacuga

SEQ ID NO: 44151 - RNA, 2004 nt, Artificial Sequence
  derived and/or modified sequence opt2 from HIF3A__Homo_sapiens__NP_690007
auggacuggcaggaccaccgcuccaccaccgagcuccgcaaggagaagucccgcgacgccgcccgcucccgccgcucccaggagaccgagguccucuaccagcucgcccacacccuccccuucgcccgcggcgucuccgcccaccucgacaaggccuccaucaugcgccucaccaucuccuaccuccgcaugcaccgccucugcgccgccggcgaguggaaccaggucggcgccggcggcgagccccucgacgccugcuaccucaaggcccucgagggcuucgucaugguccucaccgccgagggcgacauggccuaccucuccgagaacgucuccaagcaccucggccucucccagcucgagcucaucggccacuccaucuucgacuucauccaccccugcgaccaggaggagcuccaggacgcccucaccccccagcagacccucucccgccgcaaggucgaggcccccaccgagcgcugcuucucccuccgcaugaaguccacccucaccucccgcggccgcacccucaaccucaaggccgccaccuggaagguccucaacugcuccggccacaugcgcgccuacaagccccccgcccagaccucccccgccggcucccccgacuccgagcccccccuccagugccucguccucaucugcgaggccaucccccaccccggcucccucgagcccccccucggccgcggcgccuuccucucccgccacucccucgacaugaaguucaccuacugcgacgaccgcaucgccgaggucgccggcuacucccccgacgaccucaucggcugcuccgccuacgaguacauccacgcccucgacuccgacgccgucuccaaguccauccacacccuccucuccaagggccaggccgucaccggccaguaccgcuuccucgcccgcuccggcggcuaccucuggacccagacccaggccaccgucgucuccggcggccgcggcccccaguccgaguccaucgucugcguccacuuccucaucucccaggucgaggagaccggcgucguccucucccucgagcagaccgagcagcacucccgccgccccauccagcgcggcgcccccucccagaaggacacccccaaccccggcgacucccucgacacccccggcccccgcauccucgccuuccuccacccccccucccucuccgaggccgcccucgccgccgacccccgccgcuucugcucccccgaccuccgccgccuccucggccccauccucgacggcgccuccgucgccgccacccccuccaccccccucgccacccgccacccccaguccccccucuccgccgaccuccccgacgagcuccccgucggcaccgagaacguccaccgccucuucaccuccggcaaggacaccgaggccgucgagaccgaccucgacaucgcccaggacgccgacgcccucgaccucgagaugcucgcccccuacaucuccauggacgacgacuuccagcucaacgccuccgagcagcucccccgcgccuaccaccgcccccucggcgccgucccccgcccccgcgcccgcuccuuccacggccucuccccccccgcccucgagcccucccuccucccccgcuggggcuccgacccccgccucuccugcuccucccccucccgcggcgaccccuccgccuccucccccauggccggcgcccgcaagcgcacccucgcccaguccuccgaggacgaggacgagggcgucgagcuccucggcguccgcccccccaagcgcucccccucccccgagcacgagaacuuccuccucuucccccucucccucuccuuccuccucaccggcggccccgcccccggcucccuccaggaccccuccaccccccuccucaaccucaacgagccccucggccucggccccucccuccucucccccuacuccgacgaggacaccacccagcccggcggccccuuccagccccgcgccggcuccgcccaggccgacuga

SEQ ID NO: 44152 - RNA, 324 nt, Artificial Sequence
  derived and/or modified sequence opt2 from HIGD1A__Homo_sapiens__NP_001093138
auggagcagaagcucgucgaggagauccuccaggccaucaccauguccaccgacaccggcgucucccuccccuccuacgaggaggaccagggcuccaagcucauccgcaaggccaaggaggcccccuucguccccgucggcaucgccggcuucgccgccaucgucgccuacggccucuacaagcucaagucccgcggcaacaccaagauguccauccaccucauccacaugcgcgucgccgcccagggcuucgucgucggcgccaugaccgucggcaugggcuacuccauguaccgcgaguucugggccaagcccaagcccuga

SEQ ID NO: 44153 - RNA, 294 nt, Artificial Sequence
  derived and/or modified sequence opt2 from HIGD1C__Homo_sapiens__NP_001103089
auguccuccgacaaccagugguccgccgacgaggacgagggccagcucucccgccucauccgcaagucccgcgacucccccuucguccccaucggcaucgccggcuucgucaccgucgucuccugcggccucuacaagcucaaguaccgccgcgaccagaagauguccauccaccucauccacaugcgcgucgccgcccagggcuucgucgucggcgccgucacccucggcguccucuacuccauguacaaggacuacauccgcccccgcuucuucuccgaguccaagaaguga

SEQ ID NO: 44154 - RNA, 321 nt, Artificial Sequence
  derived and/or modified sequence opt2 from HIGD2A__Homo_sapiens__NP_620175
auggccacccccggccccgucauccccgagguccccuucgagcccuccaagccccccgucaucgagggccucucccccaccgucuaccgcaaccccgaguccuucaaggagaaguucguccgcaagacccgcgagaaccccgucguccccaucggcugccucgccaccgccgccgcccucaccuacggccucuacuccuuccaccgcggcaacucccagcgcucccagcucaugaugcgcacccgcaucgccgcccagggcuucaccgucgccgccauccuccucggccucgccgucaccgccaugaagucccgccccuga

SEQ ID NO: 44155 - RNA, 192 nt, Artificial Sequence
  derived and/or modified sequence opt2 from HILPDA__Homo_sapiens__NP_001092256
augaagcacguccucaaccucuaccuccucggcgucguccucacccuccucuccaucuucguccgcgucauggagucccucgagggccuccucgagucccccucccccggcaccuccuggaccacccgcucccagcucgccaacaccgagcccaccaagggccuccccgaccaccccucccgcuccauguga

SEQ ID NO: 44156 - RNA, 1260 nt, Artificial Sequence
  derived and/or modified sequence opt2 from HINFP__Homo_sapiens__NP_001230188
augcccccccccggcaaggucccccgcaaggagaaccucuggcuccagugcgaguggggcuccugcuccuucgucugcuccaccauggagaaguucuucgagcacgucacccagcaccuccagcagcaccuccacggcuccggcgaggaggaggaggaggaggaggaggacgacccccucgaggaggaguucuccugccucuggcaggagugcggcuucugcucccucgacuccuccgccgaccucauccgccacgucuacuuccacugcuaccacaccaagcucaagcaguggggccuccaggcccuccagucccaggccgaccucggccccugcauccucgacuuccagucccgcaacgucauccccgacauccccgaccacuuccucugccucugggagcacugcgagaacuccuucgacaaccccgagugguucuaccgccacgucgaggcccacucccucugcugcgaguacgaggccgucggcaaggacaaccccgucguccucugcggcuggaagggcugcaccugcaccuucaaggaccgcuccaagcuccgcgagcaccuccgcucccacacccaggagaaggucgucgccugccccaccugcggcggcauguucgccaacaacaccaaguuccucgaccacauccgccgccagaccucccucgaccagcagcacuuccagugcucccacugcuccaagcgcuucgccaccgagcgccuccuccgcgaccacaugcgcaaccacgucaaccacuacaagugcccccucugcgacaugaccugcccccuccccuccucccuccgcaaccacaugcgcuuccgccacuccgaggaccgccccuucaagugcgacugcugcgacuacuccugcaagaaccucaucgaccuccagaagcaccucgacacccacuccgaggagcccgccuaccgcugcgacuucgagaacugcaccuucuccgcccgcucccucugcuccaucaagucccacuaccgcaagguccacgagggcgacuccgagccccgcuacaagugccacgucugcgacaagugcuucacccgcggcaacaaccucaccguccaccuccgcaagaagcaccaguucaaguggcccuccggccacccccgcuuccgccucggccacuucugcaucccccuccccggcuucgccgcccucuacgcccccaccucccccggcacccgcaacaugaagauggccaucugcggcugcuccugguucgccacccgcgucuga

SEQ ID NO: 44157 - RNA, 381 nt, Artificial Sequence
  derived and/or modified sequence opt2 from HINT1__Homo_sapiens__NP_005331
auggccgacgagaucgccaaggcccaggucgcccgccccggcggcgacaccaucuucggcaagaucauccgcaaggagauccccgccaagaucaucuucgaggacgaccgcugccucgccuuccacgacaucuccccccaggcccccacccacuuccucgucauccccaagaagcacaucucccagaucuccgucgccgaggacgacgacgagucccuccucggccaccucaugaucgucggcaagaagugcgccgccgaccucggccucaacaagggcuaccgcauggucgucaacgagggcuccgacggcggccaguccgucuaccacguccaccuccacguccucggcggccgccagaugcacuggccccccggcuga

SEQ ID NO: 44158 - RNA, 492 nt, Artificial Sequence
  derived and/or modified sequence opt2 from HINT2__Homo_sapiens__NP_115982
auggccgccgccgucguccucgccgccggccuccgcgccgcccgccgcgccgucgccgccaccggcguccgcggcggccagguccgcggcgccgccggcgucaccgacggcaacgaggucgccaaggcccagcaggccacccccggcggcgccgcccccaccaucuucucccgcauccucgacaagucccuccccgccgacauccucuacgaggaccagcagugccucgucuuccgcgacgucgccccccaggcccccguccacuuccucgucauccccaagaagcccaucccccgcaucucccaggccgaggaggaggaccagcagcuccucggccaccuccuccucgucgccaagcagaccgccaaggccgagggccucggcgacggcuaccgccucgucaucaacgacggcaagcucggcgcccaguccgucuaccaccuccacauccacguccucggcggccgccagcuccaguggccccccggcuga

SEQ ID NO: 44159 - RNA, 2961 nt, Artificial Sequence
  derived and/or modified sequence opt2 from HIP1__Homo_sapiens__NP_001230127
auggaccgcauggccuccuccaugaagcagguccccaacccccuccccaagguccucucccgccgcggcgucggcgccggccucgaggccgccgagcgcgaguccuucgagcgcacccagaccgucuccaucaacaaggccaucaacacccaggaggucgccgucaaggagaagcacgcccgcaccugcauccucggcacccaccacgagaagggcgcccagaccuucugguccgucgucaaccgccucccccucuccuccaacgccguccucugcuggaaguucugccacgucuuccacaagcuccuccgcgacggccaccccaacguccucaaggacucccuccgcuaccgcaacgagcucuccgacaugucccgcauguggggccaccucuccgagggcuacggccagcucugcuccaucuaccucaagcuccuccgcaccaagauggaguaccacaccaagaacccccgcuuccccggcaaccuccagauguccgaccgccagcucgacgaggccggcgaguccgacgucaacaacuucuuccagcucaccgucgagauguucgacuaccucgagugcgagcucaaccucuuccagaccgucuucaacucccucgacaugucccgcuccgucuccgucaccgccgccggccagugccgccucgccccccucauccaggucauccucgacugcucccaccucuacgacuacaccgucaagcuccucuucaagcuccacuccugccuccccgccgacacccuccagggccaccgcgaccgcuucauggagcaguucaccaagcucaaggaccucuucuaccgcuccuccaaccuccaguacuucaagcgccucauccagaucccccagcuccccgagaacccccccaacuuccuccgcgccuccgcccucuccgagcacaucucccccgucgucgucauccccgccgaggccuccucccccgacuccgagcccguccucgagaaggacgaccucauggacauggacgccucccagcagaaccucuucgacaacaaguucgacgacaucuucggcuccuccuucuccuccgaccccuucaacuucaacucccagaacggcgucaacaaggacgagaaggaccaccucaucgagcgccucuaccgcgagaucuccggccucaaggcccagcucgagaacaugaagaccgagucccagcgcgucguccuccagcucaagggccacgucuccgagcucgaggccgaccucgccgagcagcagcaccuccgccagcaggccgccgacgacugcgaguuccuccgcgccgagcucgacgagcuccgccgccagcgcgaggacaccgagaaggcccagcgcucccucuccgagaucgagcgcaaggcccaggccaacgagcagcgcuacuccaagcucaaggagaaguacuccgagcucguccagaaccacgccgaccuccuccgcaagaacgccgaggucaccaagcaggucuccauggcccgccaggcccaggucgaccucgagcgcgagaagaaggagcucgaggacucccucgagcgcaucuccgaccagggccagcgcaagacccaggagcagcucgagguccucgagucccucaagcaggagcucgccaccucccagcgcgagcuccagguccuccagggcucccucgagaccuccgcccaguccgaggccaacugggccgccgaguucgccgagcucgagaaggagcgcgacucccucgucuccggcgccgcccaccgcgaggaggagcucuccgcccuccgcaaggagcuccaggacacccagcucaagcucgccuccaccgaggaguccaugugccagcucgccaaggaccagcgcaagaugcuccucgucggcucccgcaaggccgccgagcaggucauccaggacgcccucaaccagcucgaggagcccccccucaucuccugcgccggcuccgccgaccaccuccucuccaccgucaccuccaucuccuccugcaucgagcagcucgagaaguccuggucccaguaccucgccugccccgaggacaucuccggccuccuccacuccaucacccuccucgcccaccucaccuccgacgccaucgcccacggcgccaccaccugccuccgcgccccccccgagcccgccgacucccucaccgaggccugcaagcaguacggccgcgagacccucgccuaccucgccucccucgaggaggagggcucccucgagaacgccgacuccaccgccaugcgcaacugccucuccaagaucaaggccaucggcgaggagcuccucccccgcggccucgacaucaagcaggaggagcucggcgaccucgucgacaaggagauggccgccaccuccgccgccaucgagaccgccaccgcccgcaucgagggcaccgccucccccaaggaguucuacgccaagaacucccgcuggaccgagggccucaucuccgccuccaaggccgucggcuggggcgccaccgucauggucgacgccgccgaccucgucguccagggccgcggcaaguucgaggagcucauggucugcucccacgagaucgccgccuccaccgcccagcucgucgccgccuccaaggucaaggccgacaaggacucccccaaccucgcccagcuccagcaggccucccgcggcgucaaccaggccaccgccggcgucgucgccuccaccaucuccggcaagucccagaucgaggagaccgacaacauggacuucuccuccaugacccucacccagaucaagcgccaggagauggacucccagguccgcguccucgagcucgagaacgagcuccagaaggagcgccagaagcucggcgagcuccgcaagaagcacuacgagcucgccggcgucgccgagggcugggaggagggcaccgaggccuccccccccacccuccaggaggucgucaccgagaaggaguga

SEQ ID NO: 44160 - RNA, 3207 nt, Artificial Sequence
  derived and/or modified sequence opt2 from HIP1R__Homo_sapiens__NP_003950
augaacuccaucaagaacguccccgcccgcguccucucccgccgccccggccacucccucgaggccgagcgcgagcaguucgacaagacccaggccaucuccaucuccaaggccaucaacacccaggaggcccccgucaaggagaagcacgcccgccgcaucauccucggcacccaccacgagaagggcgccuucaccuucugguccuacgccaucggccucccccuccccuccuccuccauccucuccuggaaguucugccacguccuccacaagguccuccgcgacggccaccccaacguccuccacgacugccagcgcuaccgcuccaacauccgcgagaucggcgaccucuggggccaccuccacgaccgcuacggccagcucgucaacgucuacaccaagcuccuccucaccaagaucuccuuccaccucaagcacccccaguuccccgccggccucgaggucaccgacgagguccucgagaaggccgccggcaccgacgucaacaacaucuuccagcucaccgucgagauguucgacuacauggacugcgagcucaagcucuccgaguccgucuuccgccagcucaacaccgccaucgccgucucccagauguccuccggccagugccgccucgccccccucauccaggucauccaggacugcucccaccucuaccacuacaccgucaagcuccucuucaagcuccacuccugccuccccgccgacacccuccagggccaccgcgaccgcuuccacgagcaguuccacucccuccgcaacuucuuccgccgcgccuccgacaugcucuacuucaagcgccucauccagaucccccgccuccccgagggcccccccaacuuccuccgcgccuccgcccucgccgagcacaucaagcccgucgucgucauccccgaggaggcccccgaggacgaggagcccgagaaccucaucgagaucuccaccggcccccccgccggcgagcccgucgucgucgccgaccucuucgaccagaccuucggcccccccaacggcuccgucaaggacgaccgcgaccuccagaucgagucccucaagcgcgaggucgagaugcuccgcuccgagcucgagaagaucaagcucgaggcccagcgcuacaucgcccagcucaagucccaggucaacgcccucgagggcgagcucgaggagcagcgcaagcagaagcagaaggcccucgucgacaacgagcagcuccgccacgagcucgcccagcuccgcgccgcccagcucgagggcgagcgcucccagggccuccgcgaggaggccgagcgcaaggccuccgccaccgaggcccgcuacaacaagcucaaggagaagcacuccgagcucguccacguccacgccgagcuccuccgcaagaacgccgacaccgccaagcagcucaccgucacccagcagucccaggaggaggucgcccgcgucaaggagcagcucgccuuccaggucgagcaggucaagcgcgaguccgagcucaagcucgaggagaaguccgaccagcucgagaagcucaagcgcgagcucgaggccaaggccggcgagcucgcccgcgcccaggaggcccucucccacaccgagcaguccaaguccgagcucuccucccgccucgacacccucuccgccgagaaggacgcccucuccggcgccguccgccagcgcgaggccgaccuccucgccgcccagucccucguccgcgagaccgaggccgcccucucccgcgagcagcagcgcuccucccaggagcagggcgagcuccagggccgccucgccgagcgcgagucccaggagcagggccuccgccagcgccuccucgacgagcaguucgccguccuccgcggcgccgccgccgaggccgccggcauccuccaggacgccgucuccaagcucgacgacccccuccaccuccgcugcaccuccucccccgacuaccucgucucccgcgcccaggaggcccucgacgccgucuccacccucgaggagggccacgcccaguaccucaccucccucgccgacgccuccgcccucgucgccgcccucacccgcuucucccaccucgccgccgacaccaucaucaacggcggcgccaccucccaccucgcccccaccgaccccgccgaccgccucaucgacaccugccgcgagugcggcgcccgcgcccucgagcucaugggccagcuccaggaccagcaggcccuccgccacaugcaggccucccucguccgcaccccccuccagggcauccuccagcucggccaggagcucaagcccaagucccucgacguccgccaggaggagcucggcgccgucgucgacaaggagauggccgccaccuccgccgccaucgaggacgccguccgccgcaucgaggacaugaugaaccaggcccgccacgccuccuccggcgucaagcucgaggucaacgagcgcauccucaacuccugcaccgaccucaugaaggccauccgccuccucgucaccaccuccaccucccuccagaaggagaucgucgaguccggccgcggcgccgccacccagcaggaguucuacgccaagaacucccgcuggaccgagggccucaucuccgccuccaaggccgucggcuggggcgccacccagcucgucgaggccgccgacaaggucguccuccacaccggcaaguacgaggagcucaucgucugcucccacgagaucgccgccuccaccgcccagcucgucgccgccuccaaggucaaggccaacaagcacuccccccaccucucccgccuccaggagugcucccgcaccgucaacgagcgcgccgccaacgucgucgccuccaccaaguccggccaggagcagaucgaggaccgcgacaccauggacuucuccggccucucccucaucaagcucaagaagcaggagauggagacccagguccgcguccucgagcucgagaagacccucgaggccgagcgcaugcgccucggcgagcuccgcaagcagcacuacguccucgccggcgccuccggcucccccggcgaggaggucgccauccgccccuccaccgccccccgcuccgucaccaccaagaagcccccccucgcccagaagcccuccgucgccccccgccaggaccaccagcucgacaagaaggacggcaucuaccccgcccagcucgucaacuacuga

SEQ ID NO: 44161 - RNA, 2349 nt, Artificial Sequence
  derived and/or modified sequence opt2 from HIPK1__Homo_sapiens__XP_011539282
augaccuucuacuccuggauccccuaccaccgccaggccccccucaaccaccgccgcgucugcuccgccgagggcgccggcucccccggccccgcccucgacccccgcuggcuccccaccgaggcccaccuccucgaggcccaccgccuccuccuccaguccguccucugcgaccgcccccgcgaguccauccagcuccacuuccgccucuccauggccucccagcuccaggucuucuccccccccuccgucuccuccuccgccuucugcuccgccaagaagcucaagaucgagcccuccggcugggacgucuccggccaguccuccaacgacaaguacuacacccacuccaagacccuccccgccacccagggccaggccaacuccucccaccaggucgccaacuucaacauccccgccuacgaccagggccuccuccuccccgcccccgccgucgagcacaucgucgucaccgccgccgacuccuccggcuccgccgccaccuccaccuuccaguccucccagacccucacccaccgcuccaacgucucccuccucgagcccuaccagaagugcggccucaagcgcaaguccgaggaggucgacuccaacggcuccguccagaucaucgaggagcaccccccccucaugcuccagaaccgcaccgucgucggcgccgccgccaccaccaccaccgucaccaccaaguccuccuccuccuccggcgagggcgacuaccagcucguccagcacgagauccucugcuccaugaccaacuccuacgagguccucgaguuccucggccgcggcaccuucggccaggucgccaagugcuggaagcgcuccaccaaggagaucgucgccaucaagauccucaagaaccaccccuccuacgcccgccagggccagaucgaggucuccauccucucccgccucuccuccgagaacgccgacgaguacaacuucguccgcuccuacgagugcuuccagcacaagaaccacaccugccucgucuucgagaugcucgagcagaaccucuacgacuuccucaagcagaacaaguucuccccccucccccucaaguacauccgccccauccuccagcaggucgccaccgcccucaugaagcucaagucccucggccucauccacgccgaccucaagcccgagaacaucaugcucgucgaccccguccgccagcccuaccgcgucaaggucaucgacuucggcuccgccucccacgucuccaaggccgucugcuccaccuaccuccagucccgcuacuaccgcgcccccgagaucauccucggccuccccuucugcgaggccaucgacauguggucccucggcugcgucaucgccgagcucuuccucggcuggccccucuaccccggcgccuccgaguacgaccagauccgcuacaucucccagacccagggccuccccgccgaguaccuccucuccgccggcaccaagaccacccgcuucuucaaccgcgaccccaaccucggcuacccccucuggcgccucaagacccccgaggagcacgagcucgagaccggcaucaaguccaaggaggcccgcaaguacaucuucaacugccucgacgacauggcccaggucaacauguccaccgaccucgagggcaccgacaugcucgccgagaaggccgaccgccgcgaguacaucgaccuccucaagaagaugcucaccaucgacgccgacaagcgcaucaccccccucaagacccucaaccaccaguucgucaccaugacccaccuccucgacuucccccacuccaaccacgucaaguccugcuuccagaacauggagaucugcaagcgccgcguccacauguacgacaccgucucccagaucaagucccccuucaccacccacgucgcccccaacaccuccaccaaccucaccauguccuucuccaaccagcucaacaccguccacaaccaggccuccguccucgccuccuccuccaccgccgccgccgccacccucucccucgccaacuccgacgucucccuccucaacuaccaguccgcccucuaccccuccuccgccgcccccguccccggcgucgcccagcagggcgucucccuccagcccggcaccacccagaucugcacccagaccgaccccuuccagcagaccuucaucgucugcccccccgccuuccagaccggccuccaggccaccaccaagcacuccggcuuccccguccgcauggacaacgccguccccaucgucccccaggcccccgccgcccagccccuccagauccaguccggcguccucacccagaccugccgcgagaagaucucccgccacuccuga

SEQ ID NO: 44162 - RNA, 3516 nt, Artificial Sequence
  derived and/or modified sequence opt2 from HIPK2__Homo_sapiens__NP_001106710
auggcccccgucuacgagggcauggccucccacguccaggucuucuccccccacacccuccaguccuccgccuucugcuccgucaagaagcucaagaucgagcccuccuccaacugggacaugaccggcuacggcucccacuccaaggucuacucccaguccaagaacaucccccucucccagcccgccaccaccaccgucuccaccucccuccccguccccaaccccucccuccccuacgagcagaccaucgucuuccccggcuccaccggccacaucgucgucaccuccgccuccuccaccuccgucaccggccagguccucggcggcccccacaaccucaugcgccgcuccaccgucucccuccucgacaccuaccagaagugcggccucaagcgcaaguccgaggagaucgagaacaccuccuccguccagaucaucgaggagcacccccccaugauccagaacaacgccuccggcgccaccgucgccaccgccaccaccuccaccgccaccuccaagaacuccggcuccaacuccgagggcgacuaccagcucguccagcacgagguccucugcuccaugaccaacaccuacgagguccucgaguuccucggccgcggcaccuucggccaggucgucaagugcuggaagcgcggcaccaacgagaucgucgccaucaagauccucaagaaccaccccuccuacgcccgccagggccagaucgaggucuccauccucgcccgccucuccaccgaguccgccgacgacuacaacuucguccgcgccuacgagugcuuccagcacaagaaccacaccugccucgucuucgagaugcucgagcagaaccucuacgacuuccucaagcagaacaaguucuccccccucccccucaaguacauccgccccguccuccagcaggucgccaccgcccucaugaagcucaagucccucggccucauccacgccgaccucaagcccgagaacaucaugcucgucgaccccucccgccagcccuaccgcgucaaggucaucgacuucggcuccgccucccacgucuccaaggccgucugcuccaccuaccuccagucccgcuacuaccgcgcccccgagaucauccucggccuccccuucugcgaggccaucgacauguggucccucggcugcgucaucgccgagcucuuccucggcuggccccucuaccccggcgccuccgaguacgaccagauccgcuacaucucccagacccagggccuccccgccgaguaccuccucuccgccggcaccaagaccacccgcuucuucaaccgcgacaccgacucccccuacccccucuggcgccucaagacccccgacgaccacgaggccgagaccggcaucaaguccaaggaggcccgcaaguacaucuucaacugccucgacgacauggcccaggucaacaugaccaccgaccucgagggcuccgacaugcucgucgagaaggccgaccgccgcgaguucaucgaccuccucaagaagaugcucaccaucgacgccgacaagcgcaucacccccaucgagacccucaaccaccccuucgucaccaugacccaccuccucgacuucccccacuccacccacgucaaguccugcuuccagaacauggagaucugcaagcgccgcgucaacauguacgacaccgucaaccaguccaagacccccuucaucacccacgucgcccccuccaccuccaccaaccucaccaugaccuucaacaaccagcucaccaccguccacaaccagcccuccgccgccuccauggccgccgucgcccagcgcuccaugccccuccagaccggcaccgcccagaucugcgcccgccccgaccccuuccagcaggcccucaucgucugcccccccggcuuccagggccuccaggccucccccuccaagcacgccggcuacuccguccgcauggagaacgccguccccaucgucacccaggcccccggcgcccagccccuccagauccagcccggccuccucgcccagcaggccuggcccuccggcacccagcagauccuccucccccccgccuggcagcagcucaccggcgucgccacccacaccuccguccagcacgccaccgucauccccgagaccauggccggcacccagcagcucgccgacuggcgcaacacccacgcccacggcucccacuacaaccccaucaugcagcagcccgcccuccucaccggccacgucacccuccccgccgcccagccccucaacgucggcgucgcccacgucaugcgccagcagcccaccuccaccaccuccucccgcaaguccaagcagcaccaguccuccguccgcaacgucuccaccugcgaggucuccuccucccaggccaucuccuccccccagcgcuccaagcgcgucaaggagaacacccccccccgcugcgccaugguccacuccucccccgccugcuccaccuccgucaccugcggcuggggcgacgucgccuccuccaccacccgcgagcgccagcgccagaccaucgucauccccgacacccccucccccaccgucuccgucaucaccaucuccuccgacaccgacgaggaggaggagcagaagcacgcccccaccuccaccgucuccaagcagcgcaagaacgucaucuccugcgucaccguccacgacucccccuacuccgacuccuccuccaacaccucccccuacuccguccagcagcgcgccggccacaacaacgccaacgccuucgacaccaagggcucccucgagaaccacugcaccggcaacccccgcaccaucaucguccccccccucaagacccaggccuccgagguccucgucgagugcgacucccucguccccgucaacaccucccaccacuccuccuccuacaaguccaaguccuccuccaacgucaccuccaccuccggccacuccuccggcuccuccuccggcgccaucaccuaccgccagcagcgccccggcccccacuuccagcagcagcagccccucaaccucucccaggcccagcagcacaucaccaccgaccgcaccggcucccaccgccgccagcaggccuacaucacccccaccauggcccaggcccccuacuccuucccccacaacucccccucccacggcaccguccacccccaccucgccgccgccgccgccgccgcccaccuccccacccagccccaccucuacaccuacaccgcccccgccgcccucggcuccaccggcaccgucgcccaccucgucgccucccagggcuccgcccgccacaccguccagcacaccgccuaccccgccuccaucguccaccagguccccgucuccaugggcccccgcguccuccccucccccaccauccaccccucccaguaccccgcccaguucgcccaccagaccuacaucuccgccucccccgccuccaccgucuacaccggcuacccccucucccccgccaaggucaaccaguaccccuacaucuga

SEQ ID NO: 44163 - RNA, 3585 nt, Artificial Sequence
  derived and/or modified sequence opt2 from HIPK3__Homo_sapiens__NP_001265092
auggccucccagguccucgucuacccccccuacgucuaccagacccaguccuccgccuucugcuccgucaagaagcucaaggucgagcccuccuccugcgucuuccaggagcgcaacuacccccgcaccuacgucaacggccgcaacuucggcaacucccacccccccaccaagggcuccgccuuccagaccaagauccccuucaaccgcccccgcggccacaacuucucccuccagaccuccgccgucguccucaagaacaccgccggcgccaccaaggucaucgccgcccaggcccagcaggcccacguccaggccccccagaucggcgccuggcgcaaccgccuccacuuccucgagggcccccagcgcugcggccucaagcgcaaguccgaggagcucgacaaccacuccuccgccaugcagaucgucgacgagcucuccauccuccccgccaugcuccagaccaacaugggcaaccccgucaccgucgucaccgccaccaccggcuccaagcagaacugcaccaccggcgagggcgacuaccagcucguccagcacgagguccucugcuccaugaagaacaccuacgagguccucgacuuccucggccgcggcaccuucggccaggucgucaagugcuggaagcgcggcaccaacgagaucgucgccaucaagauccucaagaaccaccccuccuacgcccgccagggccagaucgaggucuccauccucgcccgccucuccaccgagaacgccgacgaguacaacuucguccgcgccuacgagugcuuccagcaccgcaaccacaccugccucgucuucgagaugcucgagcagaaccucuacgacuuccucaagcagaacaaguucuccccccucccccucaaggucauccgccccauccuccagcaggucgccaccgcccucaagaagcucaagucccucggccucauccacgccgaccucaagcccgagaacaucaugcucgucgaccccguccgccagcccuaccgcgucaaggucaucgacuucggcuccgccucccacgucuccaagaccgucugcuccaccuaccuccagucccgcuacuaccgcgcccccgagaucauccucggccuccccuucugcgaggccaucgacauguggucccucggcugcgucaucgccgagcucuuccucggcuggccccucuaccccggcgcccucgaguacgaccagauccgcuacaucucccagacccagggccuccccggcgagcagcuccucaacgucggcaccaaguccacccgcuucuucugcaaggagaccgacaugucccacuccggcuggcgccucaagacccucgaggagcacgaggccgagaccggcaugaaguccaaggaggcccgcaaguacaucuucaacucccucgacgacgucgcccacgucaacaccgucauggaccucgagggcuccgaccuccucgccgagaaggccgaccgccgcgaguucgucucccuccucaagaagaugcuccucaucgacgccgaccuccgcaucacccccgccgagacccucaaccaccccuucgucaacaugaagcaccuccucgacuucccccacuccaaccacgucaaguccugcuuccacaucauggacaucugcaagucccaccucaacuccugcgacaccaacaaccacaacaagaccucccuccuccgccccgucgccuccuccuccaccgccacccucaccgccaacuucaccaagaucggcacccuccgcucccaggcccucaccaccuccgcccacuccgucguccaccacggcaucccccuccaggccggcaccgcccaguucggcugcggcgacgccuuccagcagacccucaucaucugcccccccgccauccagggcauccccgccacccacggcaagcccaccuccuacuccauccgcgucgacaacaccgucccccucgucacccaggcccccgccguccagccccuccagauccgccccggcguccucucccagaccugguccggccgcacccagcagaugcucguccccgccuggcagcaggucaccccccucgcccccgccaccaccacccucaccuccgaguccgucgccggcucccaccgccucggcgacuggggcaagaugaucuccugcuccaaccacuacaacuccgucaugccccagccccuccucaccaaccagaucacccucuccgccccccagcccgucuccgucggcaucgcccacgucgucuggccccagcccgccaccaccaagaagaacaagcagugccagaaccgcuccaacucccuccagaacaccaacaucccccacuccgccuucaucucccccaagaucaucaacggcaaggacgucgaggaggucuccugcaucgagacccaggacaaccagaacuccgagggcgaggcccgcaacugcugcgagaccuccauccgccaggacuccgacuccuccgucuccgacaagcagcgccagaccaucaucaucgccgacucccccucccccgccgucuccgucaucaccaucuccuccgacaccgacgaggaggagaccucccagcgccacucccuccgcgagugcaagggcucccucgacugcgaggccugccaguccacccucaacaucgaccgcaugugcucccucuccucccccgacuccacccucuccaccuccuccuccggccaguccucccccucccccugcaagcgccccaacuccauguccgacgaggagcaggaguccuccugcgacaccgucgacggcucccccaccuccgacuccuccggccacgacucccccuucgccgaguccaccuucgucgaggacacccacgagaacaccgagcucgucuccuccgccgacaccgagaccaagcccgccgucugcuccgucgucgucccccccgucgagcucgagaacggccucaacgccgacgagcacauggccaacaccgacuccaucugccagccccucaucaagggccgcuccgcccccggccgccucaaccagcccuccgccgucggcacccgccagcagaagcucaccuccgccuuccagcagcagcaccucaacuucucccagguccagcacuucggcuccggccaccaggaguggaacggcaacuucggccaccgccgccagcaggccuacauccccaccuccgucaccuccaaccccuucacccucucccacggcucccccaaccacaccgccguccacgcccaccucgccggcaacacccaccucggcggccagcccacccuccuccccuaccccuccuccgccacccucuccuccgccgcccccgucgcccaccuccucgccucccccugcaccucccgccccaugcuccagcaccccaccuacaacaucucccaccccuccggcaucguccaccagguccccgucggccucaacccccgccuccuccccucccccaccauccaccagacccaguacaagcccaucuuccccccccacuccuacaucgccgccucccccgccuacaccggcuucccccucucccccaccaagcucucccaguaccccuacauguga

SEQ ID NO: 44164 - RNA, 3054 nt, Artificial Sequence
  derived and/or modified sequence opt2 from HIRA__Homo_sapiens__NP_003316
augaagcuccucaagcccaccugggucaaccacaacggcaagcccaucuucuccgucgacauccaccccgacggcaccaaguucgccaccggcggccagggccaggacuccggcaaggucgucaucuggaacaugucccccguccuccaggaggacgacgagaaggacgagaacauccccaagaugcucugccagauggacaaccaccucgccugcgucaacugcguccgcugguccaacuccggcauguaccucgccuccggcggcgacgacaagcucaucauggucuggaagcgcgccaccuacaucggccccuccaccgucuucggcuccuccggcaagcucgccaacgucgagcaguggcgcugcgucuccauccuccgcaaccacuccggcgacgucauggacgucgccugguccccccacgacgccuggcucgccuccugcuccgucgacaacaccgucgucaucuggaacgccgucaaguuccccgagauccucgccacccuccgcggccacuccggccucgucaagggccucaccugggaccccgucggcaaguacaucgccucccaggccgacgaccgcucccucaaggucuggcgcacccucgacuggcagcucgagaccuccaucaccaagcccuucgacgagugcggcggcaccacccacguccuccgccucuccuggucccccgacggccacuaccucgucuccgcccacgccaugaacaacuccggccccaccgcccagaucaucgagcgcgagggcuggaagaccaacauggacuucgucggccaccgcaaggccgucaccgucgucaaguucaaccccaagaucuucaagaagaagcagaagaacggcuccuccgccaagcccuccugccccuacugcugcugcgccgucggcuccaaggaccgcucccucuccgucuggcucaccugccucaagcgcccccucgucgucauccacgagcucuucgacaaguccaucauggacaucuccuggacccucaacggccucggcauccucgucugcuccauggacggcuccgucgccuuccucgacuucucccaggacgagcucggcgacccccucuccgaggaggagaagucccgcauccaccaguccaccuacggcaagucccucgccaucaugaccgaggcccagcucuccaccgccgucaucgagaaccccgagaugcucaaguaccagcgccgccagcagcagcagcagcucgaccagaaguccgccgccacccgcgagaugggcuccgccaccuccgucgccggcgucgucaacggcgagucccucgaggacauccgcaagaaccuccucaagaagcaggucgagacccgcaccgccgacggccgccgccgcaucaccccccucugcaucgcccagcucgacaccggcgacuucuccaccgccuucuucaacuccaucccccucuccggcucccucgccggcaccaugcucuccucccacuccuccccccagcuccucccccucgacuccuccacccccaacuccuucggcgccuccaagcccugcaccgagcccgucgucgccgccuccgcccgccccgccggcgacuccgucaacaaggacuccaugaacgccaccuccacccccgccgcccucucccccuccguccucaccacccccuccaagaucgagcccaugaaggccuucgacucccgcuucaccgagcgcuccaaggccacccccggcgcccccgcccucaccuccaugacccccaccgccgucgagcgccucaaggagcagaaccucgucaaggagcuccgcccccgcgaccuccucgaguccuccuccgacuccgacgagaaggucccccucgccaaggccuccucccucuccaagcgcaagcucgagcucgaggucgagaccgucgagaagaagaagaagggccgcccccgcaaggacucccgccucaugcccgucucccucuccguccagucccccgccgcccucaccgccgagaaggaggccaugugccucuccgcccccgcccucgcccucaagcuccccauccccuccccccagcgcgccuucacccuccaggucuccuccgaccccuccauguacaucgaggucgagaacgaggucaccgucgucggcggcgucaagcucucccgccucaagugcaaccgcgagggcaaggagugggagaccguccucaccucccgcauccucaccgccgccggcuccugcgacgucgucugcgucgccugcgagaagcgcaugcucuccgucuucuccaccugcggccgccgccuccucucccccauccuccuccccucccccaucuccacccuccacugcaccggcuccuacgucauggcccucaccgccgccgccacccucuccgucugggacguccaccgccaggucgucgucgucaaggaggagucccuccacuccauccucgccggcuccgacaugaccgucucccagauccuccucacccagcacggcauccccgucaugaaccucuccgacggcaaggccuacugcuucaaccccucccucuccaccuggaaccucgucuccgacaagcaggacucccucgcccagugcgccgacuuccgcuccucccuccccucccaggacgccaugcucugcuccggcccccucgccaucauccagggccgcaccuccaacuccggccgccaggccgcccgccucuucuccgucccccacgucguccagcaggagaccacccucgccuaccucgagaaccaggucgccgccgcccucacccuccaguccucccacgaguaccgccacuggcuccucgucuacgcccgcuaccucgucaacgagggcuucgaguaccgccuccgcgagaucugcaaggaccuccucggccccguccacuacuccaccggcucccagugggaguccaccgucgucggccuccgcaagcgcgagcuccucaaggagcuccuccccgucaucggccagaaccuccgcuuccagcgccucuucaccgagugccaggagcagcucgacauccuccgcgacaaguga

SEQ ID NO: 44165 - RNA, 1671 nt, Artificial Sequence
  derived and/or modified sequence opt2 from HIRIP3__Homo_sapiens__NP_003600
auggcccgcgagaaggagaugcaggaguucacccgcuccuucuuccgcggccgccccgaccucuccacccucacccacuccaucguccgccgccgcuaccucgcccacuccggccgcucccaccucgagcccgaggagaagcaggcccucaagcgccucgucgaggaggagcuccucaagaugcaggucgacgaggccgccucccgcgaggacaagcucgaccucaccaagaagggcaagcgcccccccacccccugcuccgaccccgagcgcaagcgcuuccgcuucaacuccgaguccgaguccggcuccgaggccuccucccccgacuacuucggcccccccgccaagaacggcgucgccgccgaggucucccccgccaaggaggagaacccccgccgcgccuccaaggccgucgaggaguccuccgacgaggagcgccagcgcgaccuccccgcccagcgcggcgaggaguccuccgaggaggaggagaagggcuacaagggcaagacccgcaagaagcccgucgucaagaagcaggcccccggcaaggccuccgucucccgcaagcaggcccgcgaggaguccgaggaguccgaggccgagcccguccagcgcaccgccaagaaggucgagggcaacaagggcaccaagucccucaaggaguccgagcaggaguccgaggaggagauccucgcccagaagaaggagcagcgcgaggaggaggucgaggaggaggagaaggaggaggacgaggagaagggcgacuggaagccccgcacccgcuccaacggccgccgcaaguccgcccgcgaggagcgcuccugcaagcagaagucccaggccaagcgccuccucggcgacuccgacuccgaggaggagcagaaggaggccgccuccuccggcgacgacuccggccgcgaccgcgagccccccguccagcgcaaguccgaggaccgcacccagcucaagggcggcaagcgccucuccggcuccuccgaggacgaggaggacuccggcaagggcgagcccaccgccaagggcucccgcaagauggcccgccucggcuccaccuccggcgaggaguccgaccucgagcgcgaggucuccgacuccgaggccggcggcggcccccagggcgagcgcaagaaccgcuccuccaagaaguccucccgcaagggccgcacccgcuccuccuccuccuccuccgacggcucccccgaggccaagggcggcaaggccggcuccggccgccgcggcgaggaccaccccgccgucaugcgccucaagcgcuacauccgcgccugcggcgcccaccgcaacuacaagaagcuccucggcuccugcugcucccacaaggagcgccucuccauccuccgcgccgagcucgaggcccucggcaugaagggcacccccucccucggcaagugccgcgcccucaaggagcagcgcgaggaggccgccgaggucgccucccucgacgucgccaacaucaucuccggcuccggccgcccccgccgccgcaccgccuggaacccccucggcgaggccgccccccccggcgagcucuaccgccgcacccucgacuccgacgaggagcgcccccgccccgccccccccgacuggucccacaugcgcggcaucaucuccuccgacggcgaguccaacuga

SEQ ID NO: 44166 - RNA, 648 nt, Artificial Sequence
  derived and/or modified sequence opt2 from HIST1H1A__Homo_sapiens__NP_005316
auguccgagaccgucccccccgcccccgccgccuccgccgcccccgagaagccccucgccggcaagaaggccaagaagcccgccaaggccgccgccgccuccaagaagaagcccgccggccccuccgucuccgagcucaucguccaggccgccuccuccuccaaggagcgcggcggcgucucccucgccgcccucaagaaggcccucgccgccgccggcuacgacgucgagaagaacaacucccgcaucaagcucggcaucaagucccucgucuccaagggcacccucguccagaccaagggcaccggcgccuccggcuccuucaagcucaacaagaaggccuccuccgucgagaccaagcccggcgccuccaaggucgccaccaagaccaaggccaccggcgccuccaagaagcucaagaaggccaccggcgccuccaagaaguccgucaagacccccaagaaggccaagaagcccgccgccacccgcaaguccuccaagaaccccaagaagcccaagaccgucaagcccaagaaggucgccaagucccccgccaaggccaaggccgucaagcccaaggccgccaaggcccgcgucaccaagcccaagaccgccaagcccaagaaggccgcccccaagaagaaguga

SEQ ID NO: 44167 - RNA, 681 nt, Artificial Sequence
  derived and/or modified sequence opt2 from HIST1H1B__Homo_sapiens__NP_005313
auguccgagaccgcccccgccgagaccgccacccccgcccccgucgagaagucccccgccaagaagaaggccaccaagaaggccgccggcgccggcgccgccaagcgcaaggccaccggcccccccgucuccgagcucaucaccaaggccgucgccgccuccaaggagcgcaacggccucucccucgccgcccucaagaaggcccucgccgccggcggcuacgacgucgagaagaacaacucccgcaucaagcucggccucaagucccucgucuccaagggcacccucguccagaccaagggcaccggcgccuccggcuccuucaagcucaacaagaaggccgccuccggcgaggccaagcccaaggccaagaaggccggcgccgccaaggccaagaagcccgccggcgccacccccaagaaggccaagaaggccgccggcgccaagaaggccgucaagaagacccccaagaaggccaagaagcccgccgccgccggcgucaagaaggucgccaagucccccaagaaggccaaggccgccgccaagcccaagaaggccaccaagucccccgccaagcccaaggccgucaagcccaaggccgccaagcccaaggccgccaagcccaaggccgccaagcccaaggccgccaaggccaagaaggccgccgccaagaagaaguga

SEQ ID NO: 44168 - RNA, 642 nt, Artificial Sequence
  derived and/or modified sequence opt2 from HIST1H1C__Homo_sapiens__NP_005310
auguccgagaccgcccccgccgcccccgccgccgccccccccgccgagaaggcccccgucaagaagaaggccgccaagaaggccggcggcaccccccgcaaggccuccggcccccccgucuccgagcucaucaccaaggccgucgccgccuccaaggagcgcuccggcgucucccucgccgcccucaagaaggcccucgccgccgccggcuacgacgucgagaagaacaacucccgcaucaagcucggccucaagucccucgucuccaagggcacccucguccagaccaagggcaccggcgccuccggcuccuucaagcucaacaagaaggccgccuccggcgaggccaagcccaaggucaagaaggccggcggcaccaagcccaagaagcccgucggcgccgccaagaagcccaagaaggccgccggcggcgccacccccaagaaguccgccaagaagacccccaagaaggccaagaagcccgccgccgccaccgucaccaagaaggucgccaagucccccaagaaggccaaggucgccaagcccaagaaggccgccaaguccgccgccaaggccgucaagcccaaggccgccaagcccaaggucgucaagcccaagaaggccgcccccaagaagaaguga

SEQ ID NO: 44169 - RNA, 666 nt, Artificial Sequence
  derived and/or modified sequence opt2 from HIST1H1D__Homo_sapiens__NP_005311
auguccgagaccgccccccucgcccccaccauccccgcccccgccgagaagacccccgucaagaagaaggccaagaaggccggcgccaccgccggcaagcgcaaggccuccggcccccccgucuccgagcucaucaccaaggccgucgccgccuccaaggagcgcuccggcgucucccucgccgcccucaagaaggcccucgccgccgccggcuacgacgucgagaagaacaacucccgcaucaagcucggccucaagucccucgucuccaagggcacccucguccagaccaagggcaccggcgccuccggcuccuucaagcucaacaagaaggccgccuccggcgagggcaagcccaaggccaagaaggccggcgccgccaagccccgcaagcccgccggcgccgccaagaagcccaagaaggucgccggcgccgccacccccaagaaguccaucaagaagacccccaagaaggucaagaagcccgccaccgccgccggcaccaagaaggucgccaaguccgccaagaaggucaagaccccccagcccaagaaggccgccaagucccccgccaaggccaaggcccccaagcccaaggccgccaagcccaaguccggcaagcccaaggucaccaaggccaagaaggccgcccccaagaagaaguga

SEQ ID NO: 44170 - RNA, 660 nt, Artificial Sequence
  derived and/or modified sequence opt2 from HIST1H1E__Homo_sapiens__NP_005312
auguccgagaccgcccccgccgcccccgccgcccccgcccccgccgagaagacccccgucaagaagaaggcccgcaaguccgccggcgccgccaagcgcaaggccuccggcccccccgucuccgagcucaucaccaaggccgucgccgccuccaaggagcgcuccggcgucucccucgccgcccucaagaaggcccucgccgccgccggcuacgacgucgagaagaacaacucccgcaucaagcucggccucaagucccucgucuccaagggcacccucguccagaccaagggcaccggcgccuccggcuccuucaagcucaacaagaaggccgccuccggcgaggccaagcccaaggccaagaaggccggcgccgccaaggccaagaagcccgccggcgccgccaagaagcccaagaaggccaccggcgccgccacccccaagaaguccgccaagaagacccccaagaaggccaagaagcccgccgccgccgccggcgccaagaaggccaagucccccaagaaggccaaggccgccaagcccaagaaggcccccaagucccccgccaaggccaaggccgucaagcccaaggccgccaagcccaagaccgccaagcccaaggccgccaagcccaagaaggccgccgccaagaagaaguga

SEQ ID NO: 44171 - RNA, 624 nt, Artificial Sequence
  derived and/or modified sequence opt2 from HIST1H1T__Homo_sapiens__NP_005314
auguccgagaccguccccgccgccuccgccuccgccggcgucgccgccauggagaagcuccccaccaagaagcgcggccgcaagcccgccggccucaucuccgccucccgcaagguccccaaccucuccgucuccaagcucaucaccgaggcccucuccgucucccaggagcgcgucggcaugucccucgucgcccucaagaaggcccucgccgccgccggcuacgacgucgagaagaacaacucccgcaucaagcucucccucaagucccucgucaacaagggcauccucguccagacccgcggcaccggcgccuccggcuccuucaagcucuccaagaaggucauccccaaguccacccgcuccaaggccaagaaguccgucuccgccaagaccaagaagcucguccucucccgcgacuccaagucccccaagaccgccaagaccaacaagcgcgccaagaagccccgcgccaccacccccaagaccguccgcuccggccgcaaggccaagggcgccaagggcaagcagcagcagaagucccccgucaaggcccgcgccuccaaguccaagcucacccagcaccacgaggucaacguccgcaaggccaccuccaagaaguga

SEQ ID NO: 44172 - RNA, 393 nt, Artificial Sequence
  derived and/or modified sequence opt2 from HIST1H2AE__Homo_sapiens__NP_066390
auguccggccgcggcaagcagggcggcaaggcccgcgccaaggccaagacccgcuccucccgcgccggccuccaguuccccgucggccgcguccaccgccuccuccgcaagggcaacuacuccgagcgcgucggcgccggcgcccccgucuaccucgccgccguccucgaguaccucaccgccgagauccucgagcucgccggcaacgccgcccgcgacaacaagaagacccgcaucaucccccgccaccuccagcucgccauccgcaacgacgaggagcucaacaagcuccucggccgcgucaccaucgcccagggcggcguccuccccaacauccaggccguccuccuccccaagaagaccgagucccaccacaaggccaagggcaaguga

SEQ ID NO: 44173 - RNA, 387 nt, Artificial Sequence
  derived and/or modified sequence opt2 from HIST1H2AH__Homo_sapiens__NP_542163
auguccggccgcggcaagcagggcggcaaggcccgcgccaaggccaagacccgcuccucccgcgccggccuccaguuccccgucggccgcguccaccgccuccuccgcaagggcaacuacgccgagcgcgucggcgccggcgcccccgucuaccucgccgccguccucgaguaccucaccgccgagauccucgagcucgccggcaacgccgcccgcgacaacaagaagacccgcaucaucccccgccaccuccagcucgccauccgcaacgacgaggagcucaacaagcuccucggcaaggucaccaucgcccagggcggcguccuccccaacauccaggccguccuccuccccaagaagaccgagucccaccacaaggccaaguga

SEQ ID NO: 44174 - RNA, 381 nt, Artificial Sequence
  derived and/or modified sequence opt2 from HIST1H2BG__Homo_sapiens__NP_003509
augcccgagcccgccaaguccgcccccgcccccaagaagggcuccaagaaggccgucaccaaggcccagaagaaggacggcaagaagcgcaagcgcucccgcaaggaguccuacuccgucuacgucuacaagguccucaagcagguccaccccgacaccggcaucuccuccaaggccaugggcaucaugaacuccuucgucaacgacaucuucgagcgcaucgccggcgaggccucccgccucgcccacuacaacaagcgcuccaccaucaccucccgcgagauccagaccgccguccgccuccuccuccccggcgagcucgccaagcacgccgucuccgagggcaccaaggccgucaccaaguacaccuccuccaaguga

SEQ ID NO: 44175 - RNA, 381 nt, Artificial Sequence
  derived and/or modified sequence opt2 from HIST1H2BH__Homo_sapiens__NP_003515
augcccgaccccgccaaguccgcccccgcccccaagaagggcuccaagaaggccgucaccaaggcccagaagaaggacggcaagaagcgcaagcgcucccgcaaggaguccuacuccgucuacgucuacaagguccucaagcagguccaccccgacaccggcaucuccuccaaggccaugggcaucaugaacuccuucgucaacgacaucuucgagcgcaucgccggcgaggccucccgccucgcccacuacaacaagcgcuccaccaucaccucccgcgagauccagaccgccguccgccuccuccuccccggcgagcucgccaagcacgccgucuccgagggcaccaaggccgucaccaaguacaccuccuccaaguga

SEQ ID NO: 44176 - RNA, 381 nt, Artificial Sequence
  derived and/or modified sequence opt2 from HIST1H2BM__Homo_sapiens__NP_003512
augcccgagcccgucaaguccgcccccguccccaagaagggcuccaagaaggccaucaacaaggcccagaagaaggacggcaagaagcgcaagcgcucccgcaaggaguccuacuccgucuacgucuacaagguccucaagcagguccaccccgacaccggcaucuccuccaaggccaugggcaucaugaacuccuucgucaacgacaucuucgagcgcaucgccggcgaggccucccgccucgcccacuacaacaagcgcuccaccaucaccucccgcgagauccagaccgccguccgccuccuccuccccggcgagcucgccaagcacgccgucuccgagggcaccaaggccgucaccaaguacaccuccuccaaguga

SEQ ID NO: 44177 - RNA, 411 nt, Artificial Sequence
  derived and/or modified sequence opt2 from HIST1H3G__Homo_sapiens__NP_003525
auggcccgcaccaagcagaccgcccgcaaguccaccggcggcaaggccccccgcaagcagcucgccaccaaggccgcccgcaaguccgcccccgccaccggcggcgucaagaagccccaccgcuaccgccccggcaccgucgcccuccgcgagauccgccgcuaccagaaguccaccgagcuccucauccgcaagcuccccuuccagcgccucguccgcgagaucgcccaggacuucaagaccgaccuccgcuuccaguccuccgccgucauggcccuccaggaggccugcgaggccuaccucgucggccucuucgaggacaccaaccucugcgccauccacgccaagcgcgucaccaucaugcccaaggacauccagcucgcccgccgcauccgcggcgagcgcgccuga

SEQ ID NO: 44178 - RNA, 312 nt, Artificial Sequence
  derived and/or modified sequence opt2 from HIST1H4D__Homo_sapiens__NP_003530
auguccggccgcggcaagggcggcaagggccucggcaagggcggcgccaagcgccaccgcaagguccuccgcgacaacauccagggcaucaccaagcccgccauccgccgccucgcccgccgcggcggcgucaagcgcaucuccggccucaucuacgaggagacccgcggcguccucaaggucuuccucgagaacgucauccgcgacgccgucaccuacaccgagcacgccaagcgcaagaccgucaccgccauggacgucgucuacgcccucaagcgccagggccgcacccucuacggcuucggcggcuga

SEQ ID NO: 44179 - RNA, 411 nt, Artificial Sequence
  derived and/or modified sequence opt2 from HIST3H3__Homo_sapiens__NP_003484
auggcccgcaccaagcagaccgcccgcaaguccaccggcggcaaggccccccgcaagcagcucgccaccaaggucgcccgcaaguccgcccccgccaccggcggcgucaagaagccccaccgcuaccgccccggcaccgucgcccuccgcgagauccgccgcuaccagaaguccaccgagcuccucauccgcaagcuccccuuccagcgccucaugcgcgagaucgcccaggacuucaagaccgaccuccgcuuccaguccuccgccgucauggcccuccaggaggccugcgaguccuaccucgucggccucuucgaggacaccaaccucugcgucauccacgccaagcgcgucaccaucaugcccaaggacauccagcucgcccgccgcauccgcggcgagcgcgccuga

SEQ ID NO: 44180 - RNA, 8157 nt, Artificial Sequence
  derived and/or modified sequence opt2 from HIVEP1__Homo_sapiens__XP_011512855
augccccgcaccaagcagauccacccccgcaaccuccgcgacaagaucgaggaggcccagaaggagcucaacggcgccgaggucuccaagaaggagauccuccaggccggcgucaagggcaccuccgagucccucaagggcgucaagcgcaagaagaucgucgccgagaaccaccucaagaagauccccaaguccccccuccgcaacccccuccaggccaagcacaagcagaacaccgaggaguccuccuucgccguccuccacuccgccuccgagucccacaagaagcagaacuacauccccgucaagaacggcaagcaguucaccaagcagaacggcgagacccccggcaucaucgccgaggccuccaaguccgaggaguccgucucccccaagaagccccucuuccuccagcagcccuccgagcuccgccgcuggcgcuccgagggcgccgaccccgccaaguucuccgaccucgacgagcagugcgacuccuccucccucuccuccaagacccgcaccgacaacuccgagugcaucuccucccacugcggcaccaccucccccuccuacaccaacaccgccuucgacguccuccucaaggccauggagcccgagcucuccacccucucccagaagggcucccccugcgccaucaagaccgagaagcuccgccccaacaagaccgcccgcuccccccccaagcucaagaacuccuccauggacgcccccaaccagaccucccaggagcucgucgccgagucccaguccuccugcaccuccuacaccguccacauguccgccgcccagaagaacgagcagggcgccaugcaguccgccucccaccucuaccaccagcacgagcacuucguccccaaguccaaccagcacaaccagcagcuccccggcugcuccggcuucaccggcucccucaccaaccuccagaaccaggagaacgccaagcucgagcaggucuacaacaucgccgucaccuccuccgucggccucaccucccccuccucccgcucccaggucaccccccagaaccagcagauggacuccgccuccccccucuccaucucccccgccaacuccacccaguccccccccaugcccaucuacaacuccacccacgucgccuccgucgucaaccaguccgucgagcagaugugcaaccuccuccucaaggaccagaagcccaagaagcagggcaaguacaucugcgaguacugcaaccgcgccugcgccaagcccuccguccuccucaagcacauccgcucccacaccggcgagcgccccuaccccugcgucaccugcggcuucuccuucaagaccaaguccaaccucuacaagcacaagaagucccacgcccacaccaucaagcucggccucguccuccagcccgacgccggcggccucuuccucucccacgagucccccaaggcccucuccauccacuccgacgucgaggacuccggcgaguccgaggaggagggcgccaccgacgagcgccagcacgaccucggcgccauggagcuccagcccguccacaucaucaagcgcauguccaacgccgagacccuccucaaguccuccuucacccccuccucccccgagaacgucaucggcgacuuccuccuccaggaccgcuccgccgagucccaggccgucaccgagcuccccaaggucgucguccaccacgucaccgucuccccccuccgcaccgacucccccaaggccauggaccccaagcccgagcucuccuccgcccagaagcagaaggaccuccaggucaccaacguccagccccucuccgccaacaugucccagggcggcgucucccgccucgagaccaacgagaacucccaccagaagggcgacaugaacccccucgagggcaagcaggacucccacgucggcaccguccacgcccagcuccagcgccagcaggccaccgacuacucccaggagcagcagggcaagcuccucuccccccgcucccucggcuccaccgacuccggcuacuucucccgcuccgaguccgccgaccagaccgucuccccccccacccccuucgcccgccgccuccccuccaccgagcaggacuccggccgcuccaacggccccuccgccgcccucgucaccaccuccacccccuccgcccuccccaccggcgagaaggcccuccuccuccccggccagaugcgccccccccucgccaccaagacccucgaggagcgcaucuccaagcucaucuccgacaacgaggcccucgucgacgacaagcagcucgacuccgucaagccccgccgcaccucccucucccgccgcggcuccaucgacucccccaaguccuacaucuucaaggacuccuuccaguucgaccucaagcccgucggccgccgcaccuccuccuccuccgacauccccaagucccccuucacccccaccgagaaguccaagcaggucuuccuccucuccguccccucccucgacugccuccccaucacccgcuccaacuccaugcccaccaccggcuacuccgccguccccgccaacaucaucccccccccccacccccuccgcggcucccaguccuucgacgacaagaucggcgccuucuacgacgacgucuucgucuccggccccaacgcccccgucccccaguccggccacccccgcacccucguccgccaggccgccaucgaggacuccuccgccaacgagucccacguccucggcaccggccagucccucgacgagucccaccagggcugccacgccgccggcgaggccauguccguccgcuccaaggcccucgcccagggcccccacaucgagaagaagaagucccaccagggccgcggcaccauguucgagugcgagaccugccgcaaccgcuaccgcaagcucgagaacuucgagaaccacaagaaguucuacugcuccgagcuccacggccccaagaccaaggucgccaugcgcgagcccgagcacucccccguccccggcggccuccagccccagauccuccacuaccgcgucgccggcuccuccggcaucugggagcagaccccccagauccgcaagcgccgcaagaugaaguccgucggcgacgacgaggagcuccagcagaacgaguccggcaccucccccaaguccuccgagggccuccaguuccagaacgcccucggcugcaaccccucccuccccaagcacaacgucaccauccgcuccgaccagcagcacaagaacauccagcuccagaacucccacauccaccucgucgcccgcggccccgagcagaccauggaccccaagcucuccaccaucauggagcagcagaucuccuccgccgcccaggacaagaucgagcuccagcgccacggcaccggcaucuccgucauccagcacaccaacucccucucccgccccaacuccuucgacaagcccgagcccuucgagcgcgccucccccgucuccuuccaggagcucaaccgcaccggcaaguccggcucccucaaggucaucggcaucucccaggaggagucccaccccucccgcgacggcucccacccccaccagcucgcccucuccgacgcccuccgcggcgagcuccaggaguccucccgcaagucccccuccgagcgccacguccucggccagcccucccgccucguccgccagcacaacauccagguccccgagauccucgucaccgaggagcccgaccgcgaccucgaggcccagugccacgaccaggagaaguccgagaaguucuccuggccccagcgcuccgagacccucuccaagcuccccaccgagaagcucccccccaagaagaagcgccuccgccucgccgagaucgagcacuccuccaccgaguccuccuucgacuccacccucucccgcucccucucccgcgaguccucccucucccacaccuccuccuucuccgccucccucgacaucgaggacgucuccaagaccgaggccucccccaagaucgacuuccucaacaaggccgaguuccucaugauccccgccggccucaacacccucaacguccccggcugccaccgcgagaugcgccgcaccgccuccgagcagaucaacugcacccagaccuccauggaggucuccgaccuccgcuccaaguccuucgacugcggcuccaucacccccccccagaccaccccccucaccgagcuccagccccccuccucccccucccgcgucggcgucaccggccacgucccccuccucgagcgccgccgcggcccccucguccgccagaucucccucaacaucgcccccgacucccaccucucccccguccaccccaccuccuuccagaacaccgcccuccccuccgucaacgccguccccuaccagggcccccagcucaccuccaccucccucgccgaguucuccgccaacacccuccacucccagacccaggucaaggaccuccaggccgagaccuccaacuccuccuccaccaacgucuuccccguccagcagcucugcgacaucaaccuccucaaccagauccacgccccccccucccaccaguccacccagcucucccuccaggucuccacccagggcuccaagcccgacaagaacuccguccucuccggcuccuccaaguccgaggacugcuucgcccccaaguaccagcuccacugccaggucuucaccuccggccccuccugcuccuccaaccccguccacucccuccccaaccaggucaucuccgaccccgucggcaccgaccacugcgucaccuccgccacccuccccaccaagcucaucgacuccauguccaacucccacccccuccucccccccgagcuccgcccccucggcucccagguccagaagguccccuccuccuucaugcuccccauccgccuccaguccuccguccccgccuacugcuucgccacccucaccucccucccccagauccucgucacccaggaccuccccaaccagcccaucugccagaccaaccacuccgucguccccaucuccgaggagcagaacuccguccccacccuccagaagggccaccagaacgcccuccccaaccccgagaaggaguuccucugcgagaacgucuucuccgagaugucccagaacuccucccucuccgagucccuccccaucacccagaagaucuccgucggccgccucuccccccagcaggaguccuccgccuccuccaagcgcaugcucucccccgccaacucccucgacaucgccauggagaagcaccagaagcgcgccaaggacgagaacggcgccgucugcgccaccgacguccgcccccucgaggcccucuccucccgcgucaacgaggccuccaagcagaagaagcccauccucguccgccaggucugcaccaccgagccccucgacggcgucaugcucgagaaggacgucuucucccagcccgagaucuccaacgaggccgucaaccucaccaacguccuccccgccgacaacuccuccaccggcugcuccaaguucgucgucaucgagcccaucuccgagcuccaggaguucgagaacaucaaguccuccaccucccucacccucaccguccgcuccucccccgcccccuccgagaacacccacaucuccccccucaagugcaccgacaacaaccaggagcgcaagucccccggcgucaagaaccagggcgacaaggucaacauccaggagcagucccagcagcccgucaccucccucucccucuucaacaucaaggacacccagcagcucgccuuccccucccucaagaccaccaccaacuucaccuggugcuaccuccuccgccagaagucccuccaccucccccagaaggaccagaagaccuccgccuacaccgacuggaccgucuccgccuccaaccccaacccccucggccuccccaccaaggucgcccucgcccuccucaacuccaagcagaacaccggcaagucccucuacugccaggccaucaccacccacuccaaguccgaccuccucgucuacuccuccaaguggaaguccucccucuccaagcgcgcccucggcaaccagaaguccaccgucgucgaguucuccaacaaggacgccuccgagaucaacuccgagcaggacaaggagaacucccucaucaaguccgagccccgccgcaucaagaucuucgacggcggcuacaaguccaacgaggaguacgucuacguccgcggccgcggccgcggcaaguacaucugcgaggagugcggcauccgcugcaagaagcccuccaugcucaagaagcacauccgcacccacaccgacguccgccccuaccacugcaccuacugcaacuucuccuucaagaccaagggcaaccucaccaagcacaugaaguccaaggcccacuccaagaagugcgucgaccucggcgucuccgucggccucaucgacgagcaggacaccgaggaguccgacgagaagcagcgcuucuccuacgagcgcuccggcuacgaccucgaggaguccgacggccccgacgaggacgacaacgagaacgaggacgacgacgaggacucccaggccgaguccguccucuccgccacccccuccgucaccgccuccccccagcaccuccccucccgcuccucccuccaggaccccgucuccaccgacgaggacguccgcaucaccgacugcuucuccggcguccacaccgaccccauggacguccucccccgcgcccuccucacccgcaugaccguccucuccaccgcccaguccgacuacaaccgcaagacccucucccccggcaaggcccgccagcgcgccgcccgcgacgagaacgacaccauccccuccgucgacaccucccgcucccccugccaccagauguccgucgacuaccccgaguccgaggagauccuccgcuccuccauggccggcaaggccgucgccaucacccagucccccuccuccguccgccucccccccgccgccgccgagcacuccccccagaccgccgccggcaugcccuccgucgccuccccccaccccgacccccaggagcagaagcagcagaucacccuccagcccacccccggccuccccuccccccacacccaccucuucucccaccucccccuccacucccagcagcagucccgcacccccuacaacaugguccccgucggcggcauccacgucguccccgccggccucaccuacuccaccuucgucccccuccaggccggccccguccagcucaccauccccgccgucuccgucguccaccgcacccucggcacccaccgcaacaccgucaccgaggucuccggcaccaccaaccccgccggcgucgccgagcucuccuccgucguccccugcauccccaucggccagauccgcguccccggccuccagaaccucuccacccccggccuccagucccuccccucccucuccauggagaccgucaacaucgucggccucgccaacaccaacauggccccccagguccacccccccggccucgcccucaacgccgucggccuccagguccucaccgccaaccccuccucccaguccucccccgccccccaggcccacauccccggccuccagauccucaacaucgcccuccccacccucauccccuccgucucccaggucgccgucgacgcccagggcgcccccgagaugcccgccucccaguccaaggccugcgagacccagcccaagcagaccuccgucgccuccgccaaccaggucucccgcaccgaguccccccagggccuccccaccguccagcgcgagaacgccaagaagguccucaacccccccgcccccgccggcgaccacgcccgccucgacggccucuccaagauggacaccgagaaggccgccuccgccaaccacgucaagcccaagcccgagcucaccuccauccagggccagcccgccuccaccucccagccccuccucaaggcccacuccgaggucuucaccaagcccuccggccagcagacccucucccccgaccgccaggucccccgccccaccgcccucccccgccgccagcccaccguccacuucuccgacgucuccuccgacgacgacgaggaccgccucgucaucgccaccuga

SEQ ID NO: 44181 - RNA, 7341 nt, Artificial Sequence
  derived and/or modified sequence opt2 from HIVEP2__Homo_sapiens__NP_006725
auggacaccggcgacaccgcccucggccagaaggccaccucccgcuccggcgagaccgacaaggccuccggccgcuggcgccaggagcaguccgccgucaucaagauguccaccuucggcucccacgagggccagcgccagccccagaucgagcccgagcagaucggcaacaccgccuccgcccagcucuucggcuccggcaagcucgccucccccuccgaggucguccagcaggucgccgagaagcaguaccccccccaccgccccucccccuacuccugccagcacucccucuccuucccccagcacucccucccccagggcgucaugcacuccaccaagccccaccagucccucgagggcccccccuggcucuuccccggcccccuccccuccgucgccuccgaggaccucuuccccuuccccauccacggccacuccggcggcuacccccgcaagaagaucuccucccucaaccccgccuacucccaguacucccagaaguccaucgagcaggccgaggaggcccacaagaaggagcacaagcccaagaagcccggcaaguacaucugccccuacugcucccgcgccugcgccaagcccuccguccucaagaagcacauccgcucccacaccggcgagcgccccuaccccugcauccccugcggcuucuccuucaagaccaaguccaaccucuacaagcaccgcaagucccacgcccacgccaucaaggccggccucguccccuucaccgaguccgccgucuccaagcucgaccucgaggccggcuucaucgacgucgaggccgagauccacuccgacggcgagcaguccaccgacaccgacgaggaguccucccucuucgccgaggccuccgacaagaugucccccggcccccccaucccccucgacaucgccucccgcggcggcuaccacggcucccucgaggagucccucggcggccccaugaagguccccauccucaucauccccaaguccggcaucccccuccccaacgaguccucccaguacaucggccccgacaugcuccccaaccccucccucaacaccaaggccgacgacucccacaccgucaagcagaagcucgcccuccgccucuccgagaagaagggccaggacuccgagcccucccucaaccuccucuccccccacuccaagggcuccaccgacuccggcuacuucucccgcuccgaguccgccgagcagcagaucuccccccccaacaccaacgccaaguccuacgaggagaucaucuucggcaaguacugccgccucuccccccgcaacgcccucuccgucaccaccaccucccaggagcgcgccgccaugggccgcaagggcaucauggagccccucccccacgucaacacccgccucgacgucaagauguucgaggaccccgucucccagcucauccccuccaagggcgacgucgaccccucccagaccuccaugcucaaguccaccaaguucaacuccgagucccgccagccccagaucauccccuccuccauccgcaacgagggcaagcucuaccccgccaacuuccagggcuccaaccccguccuccucgaggcccccgucgacuccuccccccucauccgcuccaacuccguccccaccuccuccgccaccaaccucaccaucccccccucccuccgcggcucccacuccuucgacgagcgcaugaccggcuccgacgacgucuucuaccccggcaccgucggcauccccccccagcgcaugcuccgccgccaggccgccuucgagcuccccuccguccaggagggccacgucgaggucgagcaccacggccgcaugcucaagggcaucuccuccuccucccucaaggagaagaagcucucccccggcgaccgcgucggcuacgacuacgacgucugccgcaagcccuacaagaagugggaggacuccgagacccccaagcagaacuaccgcgacaucuccugccucuccucccucaagcacggcggcgaguacuucauggaccccgucgucccccuccagggcguccccuccauguucggcaccaccugcgagaaccgcaagcgccgcaaggagaaguccgucggcgacgaggaggacacccccaugaucugcuccuccaucgucuccacccccgucggcaucauggccuccgacuacgaccccaagcuccagaugcaggagggcguccgcuccggcuucgccauggccggccacgagaaccucucccacggccacaccgagcgcuucgaccccugccgcccccagcuccagcccggcucccccucccucgucuccgaggagucccccuccgccaucgacuccgacaagauguccgaccucggcggccgcaagccccccggcaacgucaucuccgucauccagcacaccaacucccucucccgccccaacuccuucgagcgcuccgaguccgccgagcucgucgccugcacccaggacaaggcccccucccccuccgagaccugcgacuccgagaucuccgaggcccccgucucccccgagugggccccccccggcgacggcgccgaguccggcggcaagcccucccccucccagcagguccagcagcaguccuaccacacccagccccgccucguccgccagcacaacauccagguccccgagauccgcgucaccgaggagcccgacaagcccgagaaggagaaggaggcccaguccaaggagcccgagaagcccgucgaggaguuccaguggccccagcgcuccgagacccucucccagcuccccgccgagaagcucccccccaagaagaagcgccuccgccucgccgacauggagcacuccuccggcgaguccuccuucgaguccaccggcaccggccucucccgcucccccucccaggaguccaaccucucccacuccuccuccuucuccauguccuucgagcgcgaggagaccuccaagcucuccgcccuccccaagcaggacgaguucggcaagcacuccgaguuccucaccguccccgccggcuccuacucccucuccguccccggccaccaccaccagaaggagaugcgccgcugcuccuccgagcagaugcccugcccccaccccgccgagguccccgagguccgcuccaaguccuucgacuacggcaaccucucccacgcccccgucuccggcgccgccgccuccaccgucucccccucccgcgagcgcaagaagugcuuccucguccgccaggccuccuucuccggcucccccgagaucucccagggcgaggucggcauggaccaguccgucaagcaggagcagcucgagcaccuccacgccggccuccgcuccggcuggcaccacggcccccccgccguccuccccccccuccagcaggaggaccccggcaagcaggucgccggccccugccccccccucuccuccggcccccuccaccucgcccagccccagaucaugcacauggacucccaggagucccuccgcaacccccucauccagcccaccuccuacaugaccuccaagcaccuccccgagcagccccaccucuucccccaccaggagaccauccccuucucccccauccagaacgcccucuuccaguuccaguaccccaccgucugcaugguccaccuccccgcccagcagccccccugguggcaggcccacuucccccaccccuucgcccagcacccccagaaguccuacggcaagcccuccuuccagaccgagauccacuccuccuacccccucgagcacgucgccgagcacaccggcaagaagcccgccgaguacgcccacaccaaggagcagaccuaccccugcuacuccggcgccuccggccuccaccccaagaaccuccuccccaaguuccccuccgaccaguccuccaaguccaccgagacccccuccgagcagguccuccaggaggacuucgccuccgccaacgccggcucccuccagucccuccccggcaccgucguccccguccgcauccagacccacguccccuccuacggcuccgucauguacaccuccaucucccagauccucggccagaacucccccgccaucgucaucugcaaggucgacgagaacaugacccagcgcacccucgucaccaacgccgccaugcagggcaucggcuucaacaucgcccagguccucggccagcacgccggccucgagaaguaccccaucuggaaggccccccagacccucccccucggccucgaguccuccaucccccucugccuccccuccaccuccgacuccgucgccacccucggcggcuccaagcgcaugcucucccccgccuccucccucgagcucuucauggagaccaagcagcagaagcgcgucaaggaggagaagauguacggccagaucgucgaggagcucuccgccgucgagcucaccaacuccgacaucaagaaggaccucucccgcccccagaagccccagcucguccgccagggcugcgccuccgagcccaaggacggccuccaguccggcuccuccuccuucuccucccucucccccuccuccucccaggacuaccccuccgucucccccuccucccgcgagcccuuccuccccuccaaggagaugcucuccggcucccgcgccccccuccccggccagaaguccuccggccccuccgaguccaaggaguccuccgacgagcucgacaucgacgagaccgccuccgacauguccauguccccccaguccuccucccuccccgccggcgacggccagcucgaggaggagggcaagggccacaagcgccccgucggcaugcucguccgcauggccuccgcccccuccggcaacgucgccgacuccacccuccuccucaccgacauggccgacuuccagcagauccuccaguuccccucccuccgcaccaccaccaccgucuccuggugcuuccucaacuacaccaagcccaacuacguccagcaggccaccuucaaguccuccgucuacgccuccuggugcaucuccuccugcaaccccaaccccuccggccucaacaccaagaccacccucgcccuccuccgcuccaagcagaagaucaccgccgagaucuacacccucgccgccaugcaccgccccggcaccggcaagcucaccuccuccuccgccuggaagcaguucacccagaugaagcccgacgccuccuuccucuucggcuccaagcucgagcgcaagcucgucggcaacauccucaaggagcgcggcaagggcgacauccacggcgacaaggacaucggcuccaagcagaccgagcccauccgcaucaagaucuucgagggcggcuacaaguccaacgaggacuacgucuacguccgcggccgcggccgcggcaaguacaucugcgaggagugcggcauccgcugcaagaagcccuccaugcucaagaagcacauccgcacccacaccgacguccgccccuacgucugcaagcucugcaacuucgccuucaagaccaagggcaaccucaccaagcacaugaaguccaaggcccacaugaagaagugccucgagcucggcgucuccaugaccuccgucgacgacaccgagaccgaggaggccgagaaccucgaggaccuccacaaggccgccgagaagcacuccauguccuccaucuccaccgaccaccaguucuccgacgccgaggaguccgacggcgaggacggcgacgacaacgacgacgacgacgaggacgaggacgacuucgacgaccagggcgaccucacccccaagacccgcucccgcuccaccuccccccagcccccccgcuucuccucccuccccgucaacgucggcgccgucccccacggcguccccuccgacuccucccucggccacuccucccucaucuccuaccucgucacccuccccuccauccgcgucacccagcucaugacccccuccgacuccugcgaggacacccagaugaccgaguaccagcgccucuuccaguccaaguccaccgacuccgagcccgacaaggaccgccucgacauccccuccugcauggacgaggagugcaugcuccccuccgagcccuccuccuccccccgcgacuucucccccuccucccaccacuccucccccggcuacgacuccucccccugccgcgacaacucccccaagcgcuaccucauccccaagggcgaccucuccccccgccgccaccucuccccccgccgcgaccucucccccaugcgccaccucuccccccgcaaggaggccgcccuccgccgcgagaugucccagcgcgacgucuccccccgccgccaccucuccccccgccgccccgucucccccggcaaggacaucaccgcccgccgcgaccucuccccccgccgcgagcgccgcuacaugaccaccauccgcgcccccuccccccgccgcgcccucuaccacaaccccccccucuccaugggccaguaccuccaggccgagcccaucguccucggcccccccaaccuccgccgcggccucccccagguccccuacuucucccucuacggcgaccaggagggcgccuacgagcaccccggcuccucccucuuccccgagggccccaacgacuacgucuucucccaccucccccuccacucccagcagcagguccgcgcccccauccccaugguccccgucggcggcauccagaugguccacuccaugccccccgcccucuccucccuccaccccucccccacccucccccuccccauggagggcuucgaggagaagaagggcgccuccggcgaguccuucuccaaggaccccuacguccucuccaagcagcacgagaagcgcggcccccacgcccuccaguccuccggcccccccuccacccccuccuccccccgccuccucaugaagcaguccaccuccgaggacucccucaacgccaccgagcgcgagcaggaggagaacauccagaccugcaccaaggccaucgccucccuccgcaucgccaccgaggaggccgcccuccucggccccgaccagcccgcccgcguccaggagccccaccagaacccccucggcuccgcccacgucuccauccgccacuucucccgccccgagcccggccagcccugcaccuccgccacccaccccgaccuccacgacggcgagaaggacaacuucggcaccucccagaccccccucgcccacuccaccuucuacuccaaguccugcgucgacgacaagcagcucgacuuccacuccuccaaggagcucuccuccuccaccgaggaguccaaggaccccuccuccgagaagucccagcuccacuga

SEQ ID NO: 44182 - RNA, 2085 nt, Artificial Sequence
  derived and/or modified sequence opt2 from HJURP__Homo_sapiens__NP_001269891
augcucggcacccuccgcgccauggagggcgaggacgucgaggacgaccagcuccuccagaagcuccgcgccucccgccgccgcuuccagcgccgcaugcagcgccucaucgagaaguacaaccagcccuucgaggacacccccgucguccagauggccacccucaccuacgagaccccccagggccuccgcaucuggggcggccgccucaucaaggagcgcaacgagggcgagauccagcccgccgucccccaguccccccucaagaacgagcuccgccgcaaguaccucacccaggucgacauccuccuccagggcgccgaguacuucgagugcgccggcaaccgcgccggccgcgacguccgcgucaccccccuccccucccucgccucccccgccguccccgcccccggcuacugcucccgcaucucccgcaagucccccggcgaccccgccaagcccgccuccuccccccgcgagugggacccccuccaccccuccuccaccgacauggcccucgucccccgcaacgacucccucucccuccaggagaccuccuccuccuccuuccucuccucccagcccuucgaggacgacgacaucugcaacgucaccaucuccgaccucuacgccggcaugcuccacuccaugucccgccuccucuccaccaagcccuccuccaucaucuccaccaagaccuucaucaugcagaacuggaacucccgccgccgccaccgcuacaagucccgcaugaacaagaccuacugcaagggcgcccgccgcucccagcgcuccuccaaggagaacuucauccccugcuccgagcccgucaagggcaccggcgcccuccgcgacugcaagaacguccucgacgucuccugccgcaagaccggccucaagcucgagaaggccuuccucgaggucaaccgcccccagauccacaagcucgaccccuccuggaaggagcgcaaggucacccccuccaaguacuccucccucaucuacuucgacuccuccgccaccuacaaccucgacgaggagaaccgcuuccgcacccucaaguggcucaucucccccgucaagaucgucucccgccccaccauccgccagggccacggcgagaaccgccagcgcgagaucgagauccgcuucgaccagcuccaccgcgaguacugccucuccccccgcaaccagccccgccgcaugugccuccccgacuccugggccaugaacauguaccgcggcggccccgccucccccggcggccuccagggccucgagacccgccgccucucccuccccuccuccaaggccaaggccaagucccucuccgaggccuucgagaaccucggcaagcgcucccucgaggccggccgcugccuccccaaguccgacuccuccuccucccuccccaagaccaaccccacccacuccgccacccgcccccagcagaccuccgaccuccacguccagggcaacuccuccggcaucuuccgcaaguccgucucccccuccaagacccucuccguccccgacaaggagguccccggccacggccgcaaccgcuacgacgagaucaaggaggaguucgacaagcuccaccagaaguacugccucaagucccccggccagaugaccgucccccucugcaucggcgucuccaccgacaaggccuccauggagguccgcuaccagaccgagggcuuccucggcaagcucaaccccgacccccacuuccagggcuuccagaagcuccccuccuccccccucggcugccgcaagucccuccucggcuccaccgccaucgaggcccccuccuccaccugcgucgcccgcgccaucacccgcgacggcacccgcgaccaccaguuccccgccaagcgcccccgccucuccgagccccagggcuccggccgccagggcaacucccucggcgccuccgacggcgucgacaacaccguccgccccggcgaccagggcuccuccucccagcccaacuccgaggagcgcggcgagaacaccuccuaccgcauggaggagaaguccgacuucaugcucgagaagcucgagaccaaguccgucuga

SEQ ID NO: 44183 - RNA, 2754 nt, Artificial Sequence
  derived and/or modified sequence opt2 from HK1__Homo_sapiens__NP_000179
augaucgccgcccagcuccucgccuacuacuucaccgagcucaaggacgaccaggucaagaagaucgacaaguaccucuacgccaugcgccucuccgacgagacccucaucgacaucaugacccgcuuccgcaaggagaugaagaacggccucucccgcgacuucaaccccaccgccaccgucaagaugcuccccaccuucguccgcuccauccccgacggcuccgagaagggcgacuucaucgcccucgaccucggcggcuccuccuuccgcauccuccgcguccaggucaaccacgagaagaaccagaacguccacauggaguccgaggucuacgacacccccgagaacaucguccacggcuccggcucccagcucuucgaccacgucgccgagugccucggcgacuucauggagaagcgcaagaucaaggacaagaagcuccccgucggcuucaccuucuccuuccccugccagcaguccaagaucgacgaggccauccucaucaccuggaccaagcgcuucaaggccuccggcgucgagggcgccgacgucgucaagcuccucaacaaggccaucaagaagcgcggcgacuacgacgccaacaucgucgccgucgucaacgacaccgucggcaccaugaugaccugcggcuacgacgaccagcacugcgaggucggccucaucaucggcaccggcaccaacgccugcuacauggaggagcuccgccacaucgaccucgucgagggcgacgagggccgcaugugcaucaacaccgaguggggcgccuucggcgacgacggcucccucgaggacauccgcaccgaguucgaccgcgagaucgaccgcggcucccucaaccccggcaagcagcucuucgagaagauggucuccggcauguaccucggcgagcucguccgccucauccucgucaagauggccaaggagggccuccucuucgagggccgcaucacccccgagcuccucacccgcggcaaguucaacaccuccgacgucuccgccaucgagaagaacaaggagggccuccacaacgccaaggagauccucacccgccucggcgucgagcccuccgacgacgacugcgucuccguccagcacgucugcaccaucgucuccuuccgcuccgccaaccucgucgccgccacccucggcgccauccucaaccgccuccgcgacaacaagggcaccccccgccuccgcaccaccgucggcgucgacggcucccucuacaagacccacccccaguacucccgccgcuuccacaagacccuccgccgccucguccccgacuccgacguccgcuuccuccucuccgaguccggcuccggcaagggcgccgccauggucaccgccgucgccuaccgccucgccgagcagcaccgccagaucgaggagacccucgcccacuuccaccucaccaaggacaugcuccucgaggucaagaagcgcaugcgcgccgagauggagcucggccuccgcaagcagacccacaacaacgccgucgucaagaugcuccccuccuucguccgccgcacccccgacggcaccgagaacggcgacuuccucgcccucgaccucggcggcaccaacuuccgcguccuccucgucaagauccgcuccggcaagaagcgcaccgucgagaugcacaacaagaucuacgccauccccaucgagaucaugcagggcaccggcgaggagcucuucgaccacaucgucuccugcaucuccgacuuccucgacuacaugggcaucaagggcccccgcaugccccucggcuucaccuucuccuuccccugccagcagaccucccucgacgccggcauccucaucaccuggaccaagggcuucaaggccaccgacugcgucggccacgacgucgucacccuccuccgcgacgccaucaagcgccgcgaggaguucgaccucgacgucgucgccgucgucaacgacaccgucggcaccaugaugaccugcgccuacgaggagcccaccugcgaggucggccucaucgucggcaccggcuccaacgccugcuacauggaggagaugaagaacgucgagauggucgagggcgaccagggccagaugugcaucaacauggaguggggcgccuucggcgacaacggcugccucgacgacauccgcacccacuacgaccgccucgucgacgaguacucccucaacgccggcaagcagcgcuacgagaagaugaucuccggcauguaccucggcgagaucguccgcaacauccucaucgacuucaccaagaagggcuuccucuuccgcggccagaucuccgagacccucaagacccgcggcaucuucgagaccaaguuccucucccagaucgaguccgaccgccucgcccuccuccagguccgcgccauccuccagcagcucggccucaacuccaccugcgacgacuccauccucgucaagaccgucugcggcgucgucucccgccgcgccgcccagcucugcggcgccggcauggccgccgucgucgacaagauccgcgagaaccgcggccucgaccgccucaacgucaccgucggcgucgacggcacccucuacaagcuccacccccacuucucccgcaucaugcaccagaccgucaaggagcucucccccaagugcaacgucuccuuccuccucuccgaggacggcuccggcaagggcgccgcccucaucaccgccgucggcguccgccuccgcaccgaggccuccuccuga

SEQ ID NO: 44184 - RNA, 2754 nt, Artificial Sequence
  derived and/or modified sequence opt2 from HK2__Homo_sapiens__NP_000180
augaucgccucccaccuccucgccuacuucuucaccgagcucaaccacgaccagguccagaaggucgaccaguaccucuaccacaugcgccucuccgacgagacccuccucgagaucuccaagcgcuuccgcaaggagauggagaagggccucggcgccaccacccaccccaccgccgccgucaagaugcuccccaccuucguccgcuccacccccgacggcaccgagcacggcgaguuccucgcccucgaccucggcggcaccaacuuccgcguccucugggucaaggucaccgacaacggccuccagaaggucgagauggagaaccagaucuacgccauccccgaggacaucaugcgcggcuccggcacccagcucuucgaccacaucgccgagugccucgccaacuucauggacaagcuccagaucaaggacaagaagcucccccucggcuucaccuucuccuuccccugccaccagaccaagcucgacgaguccuuccucgucuccuggaccaagggcuucaaguccuccggcgucgagggccgcgacgucgucgcccucauccgcaaggccauccagcgccgcggcgacuucgacaucgacaucgucgccgucgucaacgacaccgucggcaccaugaugaccugcggcuacgacgaccacaacugcgagaucggccucaucgucggcaccggcuccaacgccugcuacauggaggagaugcgccacaucgacauggucgagggcgacgagggccgcaugugcaucaacauggaguggggcgccuucggcgacgacggcucccucaacgacauccgcaccgaguucgaccaggagaucgacaugggcucccucaaccccggcaagcagcucuucgagaagaugaucuccggcauguacaugggcgagcucguccgccucauccucgucaagauggccaaggaggagcuccucuucggcggcaagcucucccccgagcuccucaacaccggccgcuucgagaccaaggacaucuccgacaucgagggcgagaaggacggcauccgcaaggcccgcgagguccucaugcgccucggccucgaccccacccaggaggacugcgucgccacccaccgcaucugccagaucgucuccacccgcuccgccucccucugcgccgccacccucgccgccguccuccagcgcaucaaggagaacaagggcgaggagcgccuccgcuccaccaucggcgucgacggcuccgucuacaagaagcacccccacuucgccaagcgccuccacaagaccguccgccgccucguccccggcugcgacguccgcuuccuccgcuccgaggacggcuccggcaagggcgccgccauggucaccgccgucgccuaccgccucgccgaccagcaccgcgcccgccagaagacccucgagcaccuccagcucucccacgaccagcuccucgaggucaagcgccgcaugaaggucgagauggagcgcggccucuccaaggagacccacgccuccgcccccgucaagaugcuccccaccuacgucugcgccacccccgacggcaccgagaagggcgacuuccucgcccucgaccucggcggcaccaacuuccgcguccuccucguccgcguccgcaacggcaaguggggcggcgucgagaugcacaacaagaucuacgccaucccccaggaggucaugcacggcaccggcgacgagcucuucgaccacaucguccagugcaucgccgacuuccucgaguacaugggcaugaagggcgucucccucccccucggcuucaccuucuccuuccccugccagcagaacucccucgacgaguccauccuccucaaguggaccaagggcuucaaggccuccggcugcgagggcgaggacgucgucacccuccucaaggaggccauccaccgccgcgaggaguucgaccucgacgucgucgccgucgucaacgacaccgucggcaccaugaugaccugcggcuucgaggacccccacugcgaggucggccucaucgucggcaccggcuccaacgccugcuacauggaggagaugcgcaacgucgagcucgucgagggcgaggagggccgcaugugcgucaacauggaguggggcgccuucggcgacaacggcugccucgacgacuuccgcaccgaguucgacgucgccgucgacgagcucucccucaaccccggcaagcagcgcuucgagaagaugaucuccggcauguaccucggcgagaucguccgcaacauccucaucgacuucaccaagcgcggccuccucuuccgcggccgcaucuccgagcgccucaagacccgcggcaucuucgagaccaaguuccucucccagaucgaguccgacugccucgcccuccuccagguccgcgccauccuccagcaccucggccucgaguccaccugcgacgacuccaucaucgucaaggaggucugcaccgucgucgcccgccgcgccgcccagcucugcggcgccggcauggccgccgucgucgaccgcauccgcgagaaccgcggccucgacgcccucaaggucaccgucggcgucgacggcacccucuacaagcuccacccccacuucgccaaggucaugcacgagaccgucaaggaccucgcccccaagugcgacgucuccuuccuccaguccgaggacggcuccggcaagggcgccgcccucaucaccgccgucgccugccgcauccgcgaggccggccagcgcuga

SEQ ID NO: 44185 - RNA, 2772 nt, Artificial Sequence
  derived and/or modified sequence opt2 from HK3__Homo_sapiens__NP_002106
auggacuccaucggcuccuccggccuccgccagggcgaggagacccucuccugcuccgaggagggccuccccggccccuccgacuccuccgagcucguccaggagugccuccagcaguucaaggucacccgcgcccagcuccagcagauccaggccucccuccucggcuccauggagcaggcccuccgcggccaggccucccccgcccccgccguccgcaugcuccccaccuacgucggcuccaccccccacggcaccgagcagggcgacuucgucguccucgagcucggcgccaccggcgccucccuccgcguccucugggucacccucaccggcaucgagggccaccgcgucgagccccgcucccaggaguucgucaucccccaggaggucaugcucggcgccggccagcagcucuucgacuucgccgcccacugccucuccgaguuccucgacgcccagcccgucaacaagcagggccuccagcucggcuucuccuucuccuuccccugccaccagaccggccucgaccgcuccacccucaucuccuggaccaagggcuuccgcugcuccggcgucgagggccaggacgucguccagcuccuccgcgacgccauccgccgccagggcgccuacaacaucgacgucgucgccgucgucaacgacaccgucggcaccaugaugggcugcgagcccggcguccgccccugcgaggucggccucgucgucgacaccggcaccaacgccugcuacauggaggaggcccgccacgucgccguccucgacgaggaccgcggccgcgucugcgucuccgucgaguggggcuccuucuccgacgacggcgcccucggccccguccucaccaccuucgaccacacccucgaccacgagucccucaaccccggcgcccagcgcuucgagaagaugaucggcggccucuaccucggcgagcucguccgccucguccucgcccaccucgcccgcugcggcguccucuucggcggcugcaccucccccgcccuccucucccagggcuccauccuccucgagcacgucgccgagauggaggaccccuccaccggcgccgcccgcguccacgccauccuccaggaccucggccucucccccggcgccuccgacgucgagcucguccagcacgucugcgccgccgucugcacccgcgccgcccagcucugcgccgccgcccucgccgccguccucuccugccuccagcacucccgcgagcagcagacccuccaggucgccgucgccaccggcggccgcgucugcgagcgccacccccgcuucugcuccguccuccagggcaccgucaugcuccucgcccccgagugcgacgucucccucauccccuccgucgacggcggcggccgcggcgucgccauggucaccgccgucgccgcccgccucgccgcccaccgccgccuccucgaggagacccucgcccccuuccgccucaaccacgaccagcucgccgccguccaggcccagaugcgcaaggccauggccaagggccuccgcggcgaggccuccucccuccgcaugcuccccaccuucguccgcgccacccccgacggcuccgagcgcggcgacuuccucgcccucgaccucggcggcaccaacuuccgcguccuccucguccgcgucaccaccggcguccagaucaccuccgagaucuacuccauccccgagaccgucgcccagggcuccggccagcagcucuucgaccacaucgucgacugcaucgucgacuuccagcagaagcagggccucuccggccagucccucccccucggcuucaccuucuccuuccccugccgccagcucggccucgaccagggcauccuccucaacuggaccaagggcuucaaggccuccgacugcgagggccaggacgucgucucccuccuccgcgaggccaucacccgccgccaggccgucgagcucaacgucgucgccaucgucaacgacaccgucggcaccaugauguccugcggcuacgaggacccccgcugcgagaucggccucaucgucggcaccggcaccaacgccugcuacauggaggagcuccgcaacgucgccggcguccccggcgacuccggccgcaugugcaucaacauggaguggggcgccuucggcgacgacggcucccucgccaugcucuccacccgcuucgacgccuccgucgaccaggccuccaucaaccccggcaagcagcgcuucgagaagaugaucuccggcauguaccucggcgagaucguccgccacauccuccuccaccucaccucccucggcguccucuuccgcggccagcagauccagcgccuccagacccgcgacaucuucaagaccaaguuccucuccgagaucgaguccgacucccucgcccuccgccagguccgcgccauccucgaggaccucggccucccccucaccuccgacgacgcccucaugguccucgaggucugccaggccgucucccagcgcgccgcccagcucugcggcgccggcgucgccgccgucgucgagaagauccgcgagaaccgcggccucgaggagcucgccgucuccgucggcgucgacggcacccucuacaagcuccacccccgcuucuccucccucgucgccgccaccguccgcgagcucgccccccgcugcgucgucaccuuccuccaguccgaggacggcuccggcaagggcgccgcccucgucaccgccgucgccugccgccucgcccagcucacccgcgucuga

SEQ ID NO: 44186 - RNA, 2754 nt, Artificial Sequence
  derived and/or modified sequence opt2 from HKDC1__Homo_sapiens__NP_079406
auguucgccguccaccucauggccuucuacuucuccaagcucaaggaggaccagaucaagaaggucgaccgcuuccucuaccacaugcgccucuccgacgacacccuccucgacaucaugcgccgcuuccgcgccgagauggagaagggccucgccaaggacaccaaccccaccgccgccgucaagaugcuccccaccuucguccgcgccauccccgacggcuccgagaacggcgaguuccucucccucgaccucggcggcuccaaguuccgcguccucaagguccaggucgccgaggagggcaagcgccacguccagauggagucccaguucuaccccacccccaacgagaucauccgcggcaacggcaccgagcucuucgaguacgucgccgacugccucgccgacuucaugaagaccaaggaccucaagcacaagaagcucccccucggccucaccuucuccuuccccugccgccagaccaagcucgaggagggcguccuccucuccuggaccaagaaguucaaggcccgcggcguccaggacaccgacgucgucucccgccucaccaaggccaugcgccgccacaaggacauggacgucgacauccucgcccucgucaacgacaccgucggcaccaugaugaccugcgccuacgacgaccccuacugcgaggucggcgucaucaucggcaccggcaccaacgccugcuacauggaggacauguccaacaucgaccucgucgagggcgacgagggccgcaugugcaucaacaccgaguggggcgccuucggcgacgacggcgcccucgaggacauccgcaccgaguucgaccgcgagcucgaccucggcucccucaaccccggcaagcagcucuucgagaagaugaucuccggccucuaccucggcgagcucguccgccucauccuccucaagauggccaaggccggccuccucuucggcggcgagaaguccuccgcccuccacaccaagggcaagaucgagacccgccacgucgccgccauggagaaguacaaggagggccucgccaacacccgcgagauccucgucgaccucggccucgagcccuccgaggccgacugcaucgccguccagcacgucugcaccaucgucuccuuccgcuccgccaaccucugcgccgccgcccucgccgccauccucacccgccuccgcgagaacaagaaggucgagcgccuccgcaccaccgucggcauggacggcacccucuacaagauccacccccaguaccccaagcgccuccacaaggucguccgcaagcucguccccuccugcgacguccgcuuccuccucuccgaguccggcuccaccaagggcgccgccauggucaccgccgucgccucccgcguccaggcccagcgcaagcagaucgaccgcguccucgcccucuuccagcucacccgcgagcagcucgucgacguccaggccaagaugcgcgccgagcucgaguacggccucaagaagaagucccacggccucgccaccguccgcaugcuccccaccuacgucugcggccuccccgacggcaccgagaagggcaaguuccucgcccucgaccucggcggcaccaacuuccgcguccuccucgucaagauccgcuccggccgccgcuccguccgcauguacaacaagaucuucgccaucccccucgagaucaugcagggcaccggcgaggagcucuucgaccacaucguccagugcaucgccgacuuccucgacuacaugggccucaagggcgccucccucccccucggcuucaccuucuccuuccccugccgccagauguccaucgacaagggcacccucaucggcuggaccaagggcuucaaggccaccgacugcgagggcgaggacgucgucgacaugcuccgcgaggccaucaagcgccgcaacgaguucgaccucgacaucgucgccgucgucaacgacaccgucggcaccaugaugaccugcggcuacgaggaccccaacugcgagaucggccucaucgccggcaccggcuccaacaugugcuacauggaggacaugcgcaacaucgagauggucgagggcggcgagggcaagaugugcaucaacaccgaguggggcggcuucggcgacaacggcugcaucgacgacauccgcacccgcuacgacaccgaggucgacgagggcucccucaaccccggcaagcagcgcuacgagaagaugaccuccggcauguaccucggcgagaucguccgccagauccucaucgaccucaccaagcagggccuccucuuccgcggccagaucuccgagcgccuccgcacccgcggcaucuucgagaccaaguuccucucccagaucgaguccgaccgccucgcccuccuccagguccgccgcauccuccagcagcucggccucgacuccaccugcgaggacuccaucgucgucaaggaggucugcggcgccgucucccgccgcgccgcccagcucugcggcgccggccucgccgccaucgucgagaagcgccgcgaggaccagggccucgagcaccuccgcaucaccgucggcgucgacggcacccucuacaagcuccacccccacuucucccgcauccuccaggagaccgucaaggagcucgccccccgcugcgacgucaccuucaugcucuccgaggacggcuccggcaagggcgccgcccucaucaccgccgucgccaagcgccuccagcaggcccagaaggagaacuga

SEQ ID NO: 44187 - RNA, 1098 nt, Artificial Sequence
  derived and/or modified sequence opt2 from HLA-A__Homo_sapiens__NP_001229687
auggccgucauggccccccgcacccuccuccuccuccucuccggcgcccucgcccucacccagaccugggccggcucccacuccaugcgcuacuucuucaccuccgucucccgccccggccgcggcgagccccgcuucaucgccgucggcuacgucgacgacacccaguucguccgcuucgacuccgacgccgccucccagaagauggagccccgcgcccccuggaucgagcaggagggccccgaguacugggaccaggagacccgcaacaugaaggcccacucccagaccgaccgcgccaaccucggcacccuccgcggcuacuacaaccaguccgaggacggcucccacaccauccagaucauguacggcugcgacgucggccccgacggccgcuuccuccgcggcuaccgccaggacgccuacgacggcaaggacuacaucgcccucaacgaggaccuccgcuccuggaccgccgccgacauggccgcccagaucaccaagcgcaagugggaggccguccacgccgccgagcagcgccgcgucuaccucgagggccgcugcgucgacggccuccgccgcuaccucgagaacggcaaggagacccuccagcgcaccgacccccccaagacccacaugacccaccaccccaucuccgaccacgaggccacccuccgcugcugggcccucggcuucuaccccgccgagaucacccucaccuggcagcgcgacggcgaggaccagacccaggacaccgagcucgucgagacccgccccgccggcgacggcaccuuccagaagugggccgccgucgucguccccuccggcgaggagcagcgcuacaccugccacguccagcacgagggccuccccaagccccucacccuccgcugggagcucuccucccagcccaccauccccaucgucggcaucaucgccggccucguccuccucggcgccgucaucaccggcgccgucgucgccgccgucauguggcgccgcaaguccuccgaccgcaagggcggcuccuacacccaggccgccuccuccgacuccgcccagggcuccgacgucucccucaccgccugcaaggucuga

SEQ ID NO: 44188 - RNA, 1089 nt, Artificial Sequence
  derived and/or modified sequence opt2 from HLA-B__Homo_sapiens__NP_005505
augcucgucauggccccccgcaccguccuccuccuccucuccgccgcccucgcccucaccgagaccugggccggcucccacuccaugcgcuacuucuacaccuccgucucccgccccggccgcggcgagccccgcuucaucuccgucggcuacgucgacgacacccaguucguccgcuucgacuccgacgccgccuccccccgcgaggagccccgcgcccccuggaucgagcaggagggccccgaguacugggaccgcaacacccagaucuacaaggcccaggcccagaccgaccgcgagucccuccgcaaccuccgcggcuacuacaaccaguccgaggccggcucccacacccuccaguccauguacggcugcgacgucggccccgacggccgccuccuccgcggccacgaccaguacgccuacgacggcaaggacuacaucgcccucaacgaggaccuccgcuccuggaccgccgccgacaccgccgcccagaucacccagcgcaagugggaggccgcccgcgaggccgagcagcgccgcgccuaccucgagggcgagugcgucgaguggcuccgccgcuaccucgagaacggcaaggacaagcucgagcgcgccgacccccccaagacccacgucacccaccaccccaucuccgaccacgaggccacccuccgcugcugggcccucggcuucuaccccgccgagaucacccucaccuggcagcgcgacggcgaggaccagacccaggacaccgagcucgucgagacccgccccgccggcgaccgcaccuuccagaagugggccgccgucgucguccccuccggcgaggagcagcgcuacaccugccacguccagcacgagggccuccccaagccccucacccuccgcugggagcccuccucccaguccaccguccccaucgucggcaucgucgccggccucgccguccucgccgucgucgucaucggcgccgucgucgccgccgucaugugccgccgcaaguccuccggcggcaagggcggcuccuacucccaggccgccugcuccgacuccgcccagggcuccgacgucucccucaccgccuga

SEQ ID NO: 44189 - RNA, 1101 nt, Artificial Sequence
  derived and/or modified sequence opt2 from HLA-C__Homo_sapiens__NP_001229971
augcgcgucauggccccccgcgcccuccuccuccuccucuccggcggccucgcccucaccgagaccugggccugcucccacuccaugcgcuacuucgacaccgccgucucccgccccggccgcggcgagccccgcuucaucuccgucggcuacgucgacgacacccaguucguccgcuucgacuccgacgccgccuccccccgcggcgagccccgcgcccccugggucgagcaggagggccccgaguacugggaccgcgagacccagaacuacaagcgccaggcccaggccgaccgcgucucccuccgcaaccuccgcggcuacuacaaccaguccgaggacggcucccacacccuccagcgcauguacggcugcgaccucggccccgacggccgccuccuccgcggcuacgaccaguccgccuacgacggcaaggacuacaucgcccucaacgaggaccuccgcuccuggaccgccgccgacaccgccgcccagaucacccagcgcaagcucgaggccgcccgcgccgccgagcagcuccgcgccuaccucgagggcaccugcgucgaguggcuccgccgcuaccucgagaacggcaaggagacccuccagcgcgccgagccccccaagacccacgucacccaccacccccucuccgaccacgaggccacccuccgcugcugggcccucggcuucuaccccgccgagaucacccucaccuggcagcgcgacggcgaggaccagacccaggacaccgagcucgucgagacccgccccgccggcgacggcaccuuccagaagugggccgccgucgucguccccuccggccaggagcagcgcuacaccugccacaugcagcacgagggccuccaggagccccucacccucuccugggagcccuccucccagcccaccauccccaucaugggcaucgucgccggccucgccguccucgucguccucgccguccucggcgccgucgucaccgccaugaugugccgccgcaaguccuccggcggcaagggcggcuccugcucccaggccgccugcuccaacuccgcccagggcuccgacgagucccucaucaccugcaaggccuga

SEQ ID NO: 44190 - RNA, 786 nt, Artificial Sequence
  derived and/or modified sequence opt2 from HLA-DMA__Homo_sapiens__NP_006111
augggccacgagcagaaccagggcgccgcccuccuccagaugcucccccuccucuggcuccucccccacuccugggccguccccgaggcccccacccccauguggcccgacgaccuccagaaccacaccuuccuccacaccgucuacugccaggacggcucccccuccgucggccucuccgaggccuacgacgaggaccagcucuucuucuucgacuucucccagaacacccgcgucccccgccuccccgaguucgccgacugggcccaggagcagggcgacgcccccgccauccucuucgacaaggaguucugcgaguggaugauccagcagaucggccccaagcucgacggcaagauccccgucucccgcggcuuccccaucgccgaggucuucacccucaagccccucgaguucggcaagcccaacacccucgucugcuucgucuccaaccucuucccccccaugcucaccgucaacuggcagcaccacuccguccccgucgagggcuucggccccaccuucgucuccgccgucgacggccucuccuuccaggccuucuccuaccucaacuucacccccgagcccuccgacaucuucuccugcaucgucacccacgagaucgaccgcuacaccgccaucgccuacugggucccccgcaacgcccuccccuccgaccuccucgagaacguccucugcggcgucgccuucggccucggcguccucggcaucaucgucggcaucguccucaucaucuacuuccgcaagcccugcuccggcgacuga

SEQ ID NO: 44191 - RNA, 792 nt, Artificial Sequence
  derived and/or modified sequence opt2 from HLA-DMB__Homo_sapiens__NP_002109
augaucaccuuccucccccuccuccucggccucucccucggcugcaccggcgccggcggcuucgucgcccacgucgaguccaccugccuccucgacgacgccggcacccccaaggacuucaccuacugcaucuccuucaacaaggaccuccucaccugcugggaccccgaggagaacaagauggcccccugcgaguucggcguccucaacucccucgccaacguccucucccagcaccucaaccagaaggacacccucaugcagcgccuccgcaacggccuccagaacugcgccacccacacccagcccuucuggggcucccucaccaaccgcacccgcccccccuccguccaggucgccaagaccacccccuucaacacccgcgagcccgucaugcucgccugcuacgucuggggcuucuaccccgccgaggucaccaucaccuggcgcaagaacggcaagcucgucaugccccacuccuccgcccacaagaccgcccagcccaacggcgacuggaccuaccagacccucucccaccucgcccucacccccuccuacggcgacaccuacaccugcgucgucgagcacaccggcgcccccgagcccauccuccgcgacuggacccccggccucucccccaugcagacccucaaggucuccgucuccgccgucacccucggccucggccucaucaucuucucccucggcgucaucuccuggcgccgcgccggccacuccuccuacaccccccuccccggcuccaacuacuccgagggcuggcacaucuccuga

SEQ ID NO: 44192 - RNA, 753 nt, Artificial Sequence
  derived and/or modified sequence opt2 from HLA-DOA__Homo_sapiens__NP_002110
auggcccuccgcgccggccucguccucggcuuccacacccucaugacccuccucuccccccaggaggccggcgccaccaaggccgaccacaugggcuccuacggccccgccuucuaccaguccuacggcgccuccggccaguucacccacgaguucgacgaggagcagcucuucuccgucgaccucaagaaguccgaggccgucuggcgccuccccgaguucggcgacuucgcccgcuucgacccccagggcggccucgccggcaucgccgccaucaaggcccaccucgacauccucgucgagcgcuccaaccgcucccgcgccaucaacguccccccccgcgucaccguccuccccaagucccgcgucgagcucggccagcccaacauccucaucugcaucgucgacaacaucuucccccccgucaucaacaucaccuggcuccgcaacggccagaccgucaccgagggcgucgcccagaccuccuucuacucccagcccgaccaccucuuccgcaaguuccacuaccuccccuucguccccuccgccgaggacgucuacgacugccaggucgagcacuggggccucgacgccccccuccuccgccacugggagcuccagguccccauccccccccccgacgccauggagacccucgucugcgcccucggccucgccaucggccucgucggcuuccucgucggcaccguccucaucaucaugggcaccuacgucuccuccgucccccgcuga

SEQ ID NO: 44193 - RNA, 822 nt, Artificial Sequence
  derived and/or modified sequence opt2 from HLA-DOB__Homo_sapiens__NP_002111
augggcuccggcuggguccccugggucgucgcccuccucgucaaccucacccgccucgacuccuccaugacccagggcaccgacucccccgaggacuucgucauccaggccaaggccgacugcuacuucaccaacggcaccgagaagguccaguucgucguccgcuucaucuucaaccucgaggaguacguccgcuucgacuccgacgucggcauguucgucgcccucaccaagcucggccagcccgacgccgagcaguggaacucccgccucgaccuccucgagcgcucccgccaggccgucgacggcgucugccgccacaacuaccgccucggcgcccccuucaccgucggccgcaagguccagcccgaggucaccgucuaccccgagcgcaccccccuccuccaccagcacaaccuccuccacugcuccgucaccggcuucuaccccggcgacaucaagaucaagugguuccucaacggccaggaggagcgcgccggcgucauguccaccggccccauccgcaacggcgacuggaccuuccagaccgucgucaugcucgagaugacccccgagcucggccacgucuacaccugccucgucgaccacuccucccuccucucccccgucuccgucgaguggcgcgcccaguccgaguacuccuggcgcaagaugcucuccggcaucgccgccuuccuccucggccucaucuuccuccucgucggcaucgucauccagcuccgcgcccagaagggcuacguccgcacccagauguccggcaacgaggucucccgcgccguccuccucccccaguccugcuga

SEQ ID NO: 44194 - RNA, 783 nt, Artificial Sequence
  derived and/or modified sequence opt2 from HLA-DPA1__Homo_sapiens__NP_001229454
augcgccccgaggaccgcauguuccacauccgcgccgucauccuccgcgcccucucccucgccuuccuccucucccuccgcggcgccggcgccaucaaggccgaccacgucuccaccuacgccgccuucguccagacccaccgccccaccggcgaguucauguucgaguucgacgaggacgagauguucuacgucgaccucgacaagaaggagaccgucuggcaccucgaggaguucggccaggccuucuccuucgaggcccagggcggccucgccaacaucgccauccucaacaacaaccucaacacccucauccagcgcuccaaccacacccaggccaccaacgacccccccgaggucaccgucuuccccaaggagcccgucgagcucggccagcccaacacccucaucugccacaucgacaaguucuucccccccguccucaacgucaccuggcucugcaacggcgagcucgucaccgagggcgucgccgagucccucuuccucccccgcaccgacuacuccuuccacaaguuccacuaccucaccuucguccccuccgccgaggacuucuacgacugccgcgucgagcacuggggccucgaccagccccuccucaagcacugggaggcccaggagcccauccagaugcccgagaccaccgagaccguccucugcgcccucggccucguccucggccucgucggcaucaucgucggcaccguccucaucaucaagucccuccgcuccggccacgacccccgcgcccagggcacccucuga

SEQ ID NO: 44195 - RNA, 777 nt, Artificial Sequence
  derived and/or modified sequence opt2 from HLA-DPB1__Homo_sapiens__NP_002112
augaugguccuccaggucuccgccgccccccgcaccgucgcccucaccgcccuccucaugguccuccucaccuccgucguccagggccgcgccacccccgagaacuaccucuuccagggccgccaggagugcuacgccuucaacggcacccagcgcuuccucgagcgcuacaucuacaaccgcgaggaguucgcccgcuucgacuccgacgucggcgaguuccgcgccgucaccgagcucggccgccccgccgccgaguacuggaacucccagaaggacauccucgaggagaagcgcgccguccccgaccgcaugugccgccacaacuacgagcucggcggccccaugacccuccagcgccgcguccagccccgcgucaacgucucccccuccaagaagggcccccuccagcaccacaaccuccucgucugccacgucaccgacuucuaccccggcuccauccagguccgcugguuccucaacggccaggaggagaccgccggcgucgucuccaccaaccucauccgcaacggcgacuggaccuuccagauccucgucaugcucgagaugaccccccagcagggcgacgucuacaccugccaggucgagcacaccucccucgacucccccgucaccgucgaguggaaggcccaguccgacuccgcccgcuccaagacccucaccggcgccggcggcuucguccucggccucaucaucugcggcgucggcaucuucaugcaccgccgcuccaagaagguccagcgcggcuccgccuga

SEQ ID NO: 44196 - RNA, 768 nt, Artificial Sequence
  derived and/or modified sequence opt2 from HLA-DQA1__Homo_sapiens__NP_002113
augauccucaacaaggcccuccuccucggcgcccucgcccucaccaccgucaugucccccugcggcggcgaggacaucgucgccgaccacgucgccuccugcggcgucaaccucuaccaguucuacggccccuccggccaguacacccacgaguucgacggcgacgagcaguucuacgucgaccucgagcgcaaggagaccgccuggcgcuggcccgaguucuccaaguucggcggcuucgacccccagggcgcccuccgcaacauggccgucgccaagcacaaccucaacaucaugaucaagcgcuacaacuccaccgccgccaccaacgagguccccgaggucaccgucuucuccaagucccccgucacccucggccagcccaacacccucaucugccucgucgacaacaucuucccccccgucgucaacaucaccuggcucuccaacggccaguccgucaccgagggcgucuccgagaccuccuuccucuccaaguccgaccacuccuucuucaagaucuccuaccucaccuuccuccccuccgccgacgagaucuacgacugcaaggucgagcacuggggccucgaccagccccuccucaagcacugggagcccgagauccccgcccccauguccgagcucaccgagaccgucgucugcgcccucggccucuccgucggccucaugggcaucgucgucggcaccgucuucaucauccagggccuccgcuccgucggcgccucccgccaccagggcccccucuga

SEQ ID NO: 44197 - RNA, 768 nt, Artificial Sequence
  derived and/or modified sequence opt2 from HLA-DQA2__Homo_sapiens__NP_064440
augauccucaacaaggcccuccuccucggcgcccucgcccucaccgccgucaugucccccugcggcggcgaggacaucgucgccgaccacgucgccuccuacggcgucaacuucuaccagucccacggccccuccggccaguacacccacgaguucgacggcgacgaggaguucuacgucgaccucgagaccaaggagaccgucuggcagcuccccauguucuccaaguucaucuccuucgacccccaguccgcccuccgcaacauggccgucggcaagcacacccucgaguucaugaugcgccaguccaacuccaccgccgccaccaacgagguccccgaggucaccgucuucuccaaguuccccgucacccucggccagcccaacacccucaucugccucgucgacaacaucuucccccccgucgucaacaucaccuggcucuccaacggccacuccgucaccgagggcgucuccgagaccuccuuccucuccaaguccgaccacuccuucuucaagaucuccuaccucaccuuccuccccuccgccgacgagaucuacgacugcaaggucgagcacuggggccucgacgagccccuccucaagcacugggagcccgagauccccgcccccauguccgagcucaccgagacccucgucugcgcccucggccucuccgucggccucaugggcaucgucgucggcaccgucuucaucauccagggccuccgcuccgucggcgccucccgccaccagggccuccucuga

SEQ ID NO: 44198 - RNA, 810 nt, Artificial Sequence
  derived and/or modified sequence opt2 from HLA-DQB1__Homo_sapiens__NP_001230890
auguccuggaagaaggcccuccgcauccccggcgaccuccgcgucgccaccgucacccucaugcucgccaugcucuccucccuccucgccgagggccgcgacucccccgaggacuucgucuuccaguucaagggcaugugcuacuucaccaacggcaccgagcgcguccgccucgucacccgcuacaucuacaaccgcgaggaguacgcccgcuucgacuccgacgucggcgucuaccgcgccgucaccccccagggccgccccgacgccgaguacuggaacucccagaaggagguccucgagggcacccgcgccgagcucgacaccgucugccgccacaacuacgaggucgccuuccgcggcauccuccagcgccgcgucgagcccaccgucaccaucucccccucccgcaccgaggcccucaaccaccacaaccuccucgucugcuccgucaccgacuucuaccccggccagaucaagguccgcugguuccgcaacgaccaggaggagaccgccggcgucgucuccaccccccucauccgcaacggcgacuggaccuuccagauccucgucaugcucgagaugaccccccagcgcggcgacgucuacaccugccacgucgagcaccccucccuccagucccccaucaccgucgaguggcgcgcccaguccgaguccgcccaguccaagaugcucuccggcgucggcggcuucguccucggccucaucuuccucggccucggccucaucauccgccagcgcucccagaagggcccccagggccccccccccgccggccuccuccacuga

SEQ ID NO: 44199 - RNA, 684 nt, Artificial Sequence
  derived and/or modified sequence opt2 from HLA-DQB2__Homo_sapiens__NP_001185787
auggcccuccagauccccggcggcuucugggccgccgccgucaccgucaugcucgucaugcucuccacccccgucgccgaggcccgcgacuuccccaaggacuuccucguccaguucaagggcaugugcuacuucaccaacggcaccgagcgcguccgcggcgucgcccgcuacaucuacaaccgcgaggaguacggccgcuucgacuccgacgucggcgaguuccaggccgucaccgagcucggccgcuccaucgaggacuggaacaacuacaaggacuuccucgagcaggagcgcgccgccgucgacaaggucugccgccacaacuacgaggccgagcuccgcaccacccuccagcgccaggucgagcccaccgucaccaucucccccucccgcaccgaggcccucaaccaccacaaccuccucgucugcuccgucaccgacuucuaccccgcccagaucaagguccgcugguuccgcaacgaccaggaggagaccgccggcgucgucuccaccucccucauccgcaacggcgacuggaccuuccagauccucgucaugcucgagaucaccccccagcgcggcgacaucuacaccugccaggucgagcaccccucccuccagucccccaucaccgucgaguggcgcccccgcggccccccccccgccggccuccuccacuga

SEQ ID NO: 44200 - RNA, 765 nt, Artificial Sequence
  derived and/or modified sequence opt2 from HLA-DRA__Homo_sapiens__NP_061984
auggccaucuccggcguccccguccucggcuucuucaucaucgccguccucauguccgcccaggaguccugggccaucaaggaggagcacgucaucauccaggccgaguucuaccucaaccccgaccaguccggcgaguucauguucgacuucgacggcgacgagaucuuccacgucgacauggccaagaaggagaccgucuggcgccucgaggaguucggccgcuucgccuccuucgaggcccagggcgcccucgccaacaucgccgucgacaaggccaaccucgagaucaugaccaagcgcuccaacuacacccccaucaccaacgucccccccgaggucaccguccucaccaacucccccgucgagcuccgcgagcccaacguccucaucugcuucaucgacaaguucaccccccccgucgucaacgucaccuggcuccgcaacggcaagcccgucaccaccggcgucuccgagaccgucuuccucccccgcgaggaccaccucuuccgcaaguuccacuaccuccccuuccuccccuccaccgaggacgucuacgacugccgcgucgagcacuggggccucgacgagccccuccucaagcacugggaguucgacgcccccuccccccuccccgagaccaccgagaacgucgucugcgcccucggccucaccgucggccucgucggcaucaucaucggcaccaucuucaucaucaagggccuccgcaaguccaacgccgccgagcgccgcggcccccucuga

SEQ ID NO: 44201 - RNA, 801 nt, Artificial Sequence
  derived and/or modified sequence opt2 from HLA-DRB1__Homo_sapiens__NP_001230894
auggucugccuccgccuccccggcggcuccugcauggccguccucaccgucacccucaugguccucuccuccccccucgcccucgccggcgacacccgcccccgcuuccucgaguacuccaccuccgagugccacuucuucaacggcaccgagcgcguccgcuaccucgaccgcuacuuccacaaccaggaggagaacguccgcuucgacuccgacgucggcgaguuccgcgccgucaccgagcucggccgccccgacgccgaguacuggaacucccagaaggaccuccucgagcagaagcgcggccgcgucgacaacuacugccgccacaacuacggcgucgucgaguccuucaccguccagcgccgcguccaccccaaggucaccgucuaccccuccaagacccagccccuccagcaccacaaccuccucgucugcuccgucuccggcuucuaccccggcuccaucgagguccgcugguuccgcaacggccaggaggagaagaccggcgucgucuccaccggccucauccacaacggcgacuggaccuuccagacccucgucaugcucgagaccgucccccgcuccggcgaggucuacaccugccaggucgagcaccccuccgucaccuccccccucaccgucgaguggcgcgcccgcuccgaguccgcccaguccaagaugcucuccggcgucggcggcuucguccucggccuccucuuccucggcgccggccucuucaucuacuuccgcaaccagaagggccacuccggccuccagccccgcggcuuccucuccuga

SEQ ID NO: 44202 - RNA, 801 nt, Artificial Sequence
  derived and/or modified sequence opt2 from HLA-DRB3__Homo_sapiens__NP_072049
auggucugccucaagcuccccggcggcuccucccucgccgcccucaccgucacccucaugguccucuccucccgccucgccuucgccggcgacacccgcccccgcuuccucgagcuccgcaaguccgagugccacuucuucaacggcaccgagcgcguccgcuaccucgaccgcuacuuccacaaccaggaggaguuccuccgcuucgacuccgacgucggcgaguaccgcgccgucaccgagcucggccgccccgucgccgaguccuggaacucccagaaggaccuccucgagcagaagcgcggccgcgucgacaacuacugccgccacaacuacggcgucggcgaguccuucaccguccagcgccgcguccacccccaggucaccgucuaccccgccaagacccagccccuccagcaccacaaccuccucgucugcuccgucuccggcuucuaccccggcuccaucgagguccgcugguuccgcaacggccaggaggagaaggccggcgucgucuccaccggccucauccagaacggcgacuggaccuuccagacccucgucaugcucgagaccgucccccgcuccggcgaggucuacaccugccaggucgagcaccccuccgucaccuccgcccucaccgucgaguggcgcgcccgcuccgaguccgcccaguccaagaugcucuccggcgucggcggcuucguccucggccuccucuuccucggcgccggccucuucaucuacuuccgcaaccagaagggccacuccggccuccagcccaccggcuuccucuccuga

SEQ ID NO: 44203 - RNA, 801 nt, Artificial Sequence
  derived and/or modified sequence opt2 from HLA-DRB4__Homo_sapiens__NP_068818
auggucugccucaagcuccccggcggcuccugcauggccgcccucaccgucacccucaccguccucuccuccccccucgcccucgccggcgacacccagccccgcuuccucgagcaggccaagugcgagugccacuuccucaacggcaccgagcgcgucuggaaccucauccgcuacaucuacaaccaggaggaguacgcccgcuacaacuccgaccucggcgaguaccaggccgucaccgagcucggccgccccgacgccgaguacuggaacucccagaaggaccuccucgagcgccgccgcgccgaggucgacaccuacugccgcuacaacuacggcgucgucgaguccuucaccguccagcgccgcguccagcccaaggucaccgucuaccccuccaagacccagccccuccagcaccacaaccuccucgucugcuccgucaacggcuucuaccccggcuccaucgagguccgcugguuccgcaacggccaggaggagaaggccggcgucgucuccaccggccucauccagaacggcgacuggaccuuccagacccucgucaugcucgagaccgucccccgcuccggcgaggucuacaccugccaggucgagcaccccuccaugauguccccccucaccguccagugguccgcccgcuccgaguccgcccaguccaagaugcucuccggcgucggcggcuucguccucggccuccucuuccucggcaccggccucuucaucuacuuccgcaaccagaagggccacuccggccuccagcccaccggccuccucuccuga

SEQ ID NO: 44204 - RNA, 801 nt, Artificial Sequence
  derived and/or modified sequence opt2 from HLA-DRB5__Homo_sapiens__NP_002116
auggucugccucaagcuccccggcggcuccuacauggccaagcucaccgucacccucaugguccucuccuccccccucgcccucgccggcgacacccgcccccgcuuccuccagcaggacaaguacgagugccacuucuucaacggcaccgagcgcguccgcuuccuccaccgcgacaucuacaaccaggaggaggaccuccgcuucgacuccgacgucggcgaguaccgcgccgucaccgagcucggccgccccgacgccgaguacuggaacucccagaaggacuuccucgaggaccgccgcgccgccgucgacaccuacugccgccacaacuacggcgucggcgaguccuucaccguccagcgccgcgucgagcccaaggucaccgucuaccccgcccgcacccagacccuccagcaccacaaccuccucgucugcuccgucaacggcuucuaccccggcuccaucgagguccgcugguuccgcaacucccaggaggagaaggccggcgucgucuccaccggccucauccagaacggcgacuggaccuuccagacccucgucaugcucgagaccgucccccgcuccggcgaggucuacaccugccaggucgagcaccccuccgucaccuccccccucaccgucgaguggcgcgcccaguccgaguccgcccaguccaagaugcucuccggcgucggcggcuucguccucggccuccucuuccucggcgccggccucuucaucuacuucaagaaccagaagggccacuccggccuccaccccaccggccucgucuccuga

SEQ ID NO: 44205 - RNA, 1077 nt, Artificial Sequence
  derived and/or modified sequence opt2 from HLA-E__Homo_sapiens__NP_005507
auggucgacggcacccuccuccuccuccucuccgaggcccucgcccucacccagaccugggccggcucccacucccucaaguacuuccacaccuccgucucccgccccggccgcggcgagccccgcuucaucuccgucggcuacgucgacgacacccaguucguccgcuucgacaacgacgccgccuccccccgcauggucccccgcgcccccuggauggagcaggagggcuccgaguacugggaccgcgagacccgcuccgcccgcgacaccgcccagaucuuccgcgucaaccuccgcacccuccgcggcuacuacaaccaguccgaggccggcucccacacccuccaguggaugcacggcugcgagcucggccccgacggccgcuuccuccgcggcuacgagcaguucgccuacgacggcaaggacuaccucacccucaacgaggaccuccgcuccuggaccgccgucgacaccgccgcccagaucuccgagcagaaguccaacgacgccuccgaggccgagcaccagcgcgccuaccucgaggacaccugcgucgaguggcuccacaaguaccucgagaagggcaaggagacccuccuccaccucgagccccccaagacccacgucacccaccaccccaucuccgaccacgaggccacccuccgcugcugggcccucggcuucuaccccgccgagaucacccucaccuggcagcaggacggcgagggccacacccaggacaccgagcucgucgagacccgccccgccggcgacggcaccuuccagaagugggccgccgucgucguccccuccggcgaggagcagcgcuacaccugccacguccagcacgagggccuccccgagcccgucacccuccgcuggaagcccgccucccagcccaccauccccaucgucggcaucaucgccggccucguccuccucggcuccgucgucuccggcgccgucgucgccgccgucaucuggcgcaagaaguccuccggcggcaagggcggcuccuacuccaaggccgagugguccgacuccgcccagggcuccgagucccacucccucuga

SEQ ID NO: 44206 - RNA, 765 nt, Artificial Sequence
  derived and/or modified sequence opt2 from HLA-F__Homo_sapiens__NP_001091948
auggccccccgcucccuccuccuccuccucuccggcgcccucgcccucaccgacaccugggccggcucccacucccuccgcuacuucuccaccgccgucucccgccccggccgcggcgagccccgcuacaucgccgucgaguacgucgacgacacccaguuccuccgcuucgacuccgacgccgccaucccccgcauggagccccgcgagcccugggucgagcaggagggcccccaguacugggaguggaccaccggcuacgccaaggccaacgcccagaccgaccgcgucgcccuccgcaaccuccuccgccgcuacaaccaguccgaggccggcucccacacccuccagggcaugaacggcugcgacaugggccccgacggccgccuccuccgcggcuaccaccagcacgccuacgacggcaaggacuacaucucccucaacgaggaccuccgcuccuggaccgccgccgacaccgucgcccagaucacccagcgcuucuacgaggccgaggaguacgccgaggaguuccgcaccuaccucgagggcgagugccucgagcuccuccgccgcuaccucgagaacggcaaggagacccuccagcgcgccgagcaguccccccagcccaccauccccaucgucggcaucgucgccggccucgucguccucggcgccgucgucaccggcgccgucgucgccgccgucauguggcgcaagaaguccuccgaccgcaaccgcggcuccuacucccaggccgccgucuga

SEQ ID NO: 44207 - RNA, 1017 nt, Artificial Sequence
  derived and/or modified sequence opt2 from HLA-G__Homo_sapiens__NP_002118
auggucgucauggccccccgcacccucuuccuccuccucuccggcgcccucacccucaccgagaccugggccggcucccacuccaugcgcuacuucuccgccgccgucucccgccccggccgcggcgagccccgcuucaucgccaugggcuacgucgacgacacccaguucguccgcuucgacuccgacuccgccugcccccgcauggagccccgcgcccccugggucgagcaggagggccccgaguacugggaggaggagacccgcaacaccaaggcccacgcccagaccgaccgcaugaaccuccagacccuccgcggcuacuacaaccaguccgaggccuccucccacacccuccaguggaugaucggcugcgaccucggcuccgacggccgccuccuccgcggcuacgagcaguacgccuacgacggcaaggacuaccucgcccucaacgaggaccuccgcuccuggaccgccgccgacaccgccgcccagaucuccaagcgcaagugcgaggccgccaacgucgccgagcagcgccgcgccuaccucgagggcaccugcgucgaguggcuccaccgcuaccucgagaacggcaaggagaugcuccagcgcgccgacccccccaagacccacgucacccaccaccccgucuucgacuacgaggccacccuccgcugcugggcccucggcuucuaccccgccgagaucauccucaccuggcagcgcgacggcgaggaccagacccaggacgucgagcucgucgagacccgccccgccggcgacggcaccuuccagaagugggccgccgucgucguccccuccggcgaggagcagcgcuacaccugccacguccagcacgagggccuccccgagccccucaugcuccgcuggaagcaguccucccuccccaccauccccaucaugggcaucgucgccggccucgucguccucgccgccgucgucaccggcgccgccgucgccgccguccucuggcgcaagaaguccuccgacuga

SEQ ID NO: 44208 - RNA, 2622 nt, Artificial Sequence
  derived and/or modified sequence opt2 from HLCS__Homo_sapiens__XP_005261010
augcucaucacccucugcuaccucuaccucugggcccgcuggggccgccgccccgccgagcucguccgcgccaccguccgccgccuccgcgccucccgcugcuccuucaccuucugcggcgccgccgcccagccccccggcgcccgcgucugccucucccgcggcggccgcgucuucugcgucuccgacucccaguccaucgaggaccucaacaagugggcccucuuccucgucucccccuucauccucgaggccgagcacaucgccuucgucaccgaguccaucuggguccaguccgagaaccuccagcgcuccuccuccuccgagaccaucgucaagugguccgacugcugccucccccucgccugccgccccggcgaccccuaccgccucaucgccgaggccuccgucgacaacuucuccaagcucggcgucgccuucauggaggaccgccuccacauggacaacggccucgucccccagaagaucgucuccguccaccuccaggacuccacccucaaggaggucaaggaccaggucuccaacaagcaggcccagauccucgagcccaagcccgagcccucccucgagaucaagcccgagcaggacggcauggagcacgucggccgcgacgaccccaaggcccucggcgaggagcccaagcagcgccgcggcuccgccuccggcuccgagcccgccggcgacuccgaccgcggcggcggccccgucgagcacuaccaccuccaccucuccuccugccacgagugccucgagcucgagaacuccaccaucgaguccgucaaguucgccuccgccgagaacauccccgaccuccccuacgacuacuccuccucccucgaguccgucgccgacgagaccucccccgagcgcgagggccgccgcgucaaccucaccggcaaggcccccaacauccuccucuacgucggcuccgacucccaggaggcccucggccgcuuccacgagguccgcuccguccucgccgacugcgucgacaucgacuccuacauccucuaccaccuccucgaggacuccgcccuccgcgaccccuggaccgacaacugccuccuccucgucaucgccacccgcgaguccauccccgaggaccucuaccagaaguucauggccuaccucucccagggcggcaagguccucggccucuccuccuccuucaccuucggcggcuuccaggucaccuccaagggcgcccuccacaagaccguccagaaccucgucuucuccaaggccgaccaguccgaggucaagcucuccguccucuccuccggcugccgcuaccaggagggccccguccgccucucccccggccgccuccagggccaccucgagaacgaggacaaggaccgcaugaucguccacguccccuucggcacccgcggcggcgaggccguccucugccagguccaccucgagcucccccccuccuccaacaucguccagacccccgaggacuucaaccuccucaaguccuccaacuuccgccgcuacgagguccuccgcgagauccucaccacccucggccucuccugcgacaugaagcagguccccgcccucaccccccucuaccuccucuccgccgccgaggagauccgcgacccccucaugcaguggcucggcaagcacgucgacuccgagggcgagaucaaguccggccagcucucccuccgcuucgucuccuccuacgucuccgaggucgagaucacccccuccugcauccccgucgucaccaacauggaggccuucuccuccgagcacuucaaccucgagaucuaccgccagaaccuccagaccaagcagcucggcaaggucauccucuucgccgaggucacccccaccaccaugcgccuccucgacggccucauguuccagaccccccaggagaugggccucaucgucaucgccgcccgccagaccgagggcaagggccgcggcggcaacgucuggcucucccccgucggcugcgcccucuccacccuccucaucuccaucccccuccgcucccagcucggccagcgcauccccuucguccagcaccucauguccgucgccgucgucgaggccguccgcuccauccccgaguaccaggacaucaaccuccgcgucaaguggcccaacgacaucuacuacuccgaccucaugaagaucggcggcguccucgucaacuccacccucaugggcgagaccuucuacauccucaucggcugcggcuucaacgucaccaacuccaaccccaccaucugcaucaacgaccucaucaccgaguacaacaagcagcacaaggccgagcucaagccccuccgcgccgacuaccucaucgcccgcgucgucaccguccucgagaagcucaucaaggaguuccaggacaagggccccaacuccguccucccccucuacuaccgcuacuggguccacuccggccagcagguccaccucggcuccgccgagggccccaaggucuccaucgucggccucgacgacuccggcuuccuccagguccaccaggagggcggcgaggucgucaccguccaccccgacggcaacuccuucgacaugcuccgcaaccucauccuccccaagcgccgcuga

SEQ ID NO: 44209 - RNA, 888 nt, Artificial Sequence
  derived and/or modified sequence opt2 from HLF__Homo_sapiens__NP_002117
auggagaagaugucccgcccccucccccucaaccccaccuucauccccccccccuacggcguccuccgcucccuccucgagaacccccucaagcucccccuccaccacgaggacgccuucuccaaggacaaggacaaggagaagaagcucgacgacgaguccaacucccccaccgucccccaguccgccuuccucggccccacccucugggacaagacccuccccuacgacggcgacaccuuccagcucgaguacauggaccucgaggaguuccucuccgagaacggcaucccccccucccccucccagcacgaccacuccccccacccccccggccuccagcccgccuccuccgccgcccccuccgucauggaccucuccucccgcgccuccgccccccuccaccccggcauccccucccccaacugcaugcagucccccauccgccccggccagcuccuccccgccaaccgcaacacccccucccccaucgaccccgacaccauccagguccccgucggcuacgagcccgaccccgccgaccucgcccucuccuccauccccggccaggagauguucgacccccgcaagcgcaaguucuccgaggaggagcucaagccccagcccaugaucaagaaggcccgcaaggucuucauccccgacgaccucaaggacgacaaguacugggcccgccgccgcaagaacaacauggccgccaagcgcucccgcgacgcccgccgccucaaggagaaccagaucgccauccgcgccuccuuccucgagaaggagaacuccgcccuccgccaggaggucgccgaccuccgcaaggagcucggcaagugcaagaacauccucgccaaguacgaggcccgccacggcccccucuga

SEQ ID NO: 44210 - RNA, 3030 nt, Artificial Sequence
  derived and/or modified sequence opt2 from HLTF__Homo_sapiens__NP_003062
auguccuggauguucaagcgcgaccccgucuggaaguaccuccagaccguccaguacggcguccacggcaacuucccccgccucuccuaccccaccuucuucccccgcuucgaguuccaggacgucaucccccccgacgacuuccucaccuccgacgaggaggucgacuccguccucuucggcucccuccgcggccacgucgucggccuccgcuacuacaccggcgucgucaacaacaacgagauggucgcccuccagcgcgaccccaacaaccccuacgacaagaacgccaucaaggucaacaacgucaacggcaaccaggucggccaccucaagaaggagcucgccggcgcccucgccuacaucauggacaacaagcucgcccagaucgagggcgucguccccuucggcgccaacaacgccuucaccaugccccuccacaugaccuucuggggcaaggaggagaaccgcaaggccgucuccgaccagcucaagaagcacggcuucaagcucggccccgcccccaagacccucggcuucaaccucgaguccggcuggggcuccggccgcgccggccccuccuacuccaugcccguccacgccgccguccagaugaccaccgagcagcucaagaccgaguucgacaagcucuucgaggaccucaaggaggacgacaagacccacgagauggagcccgccgaggccaucgagaccccccuccucccccaccagaagcaggcccucgccuggauggucucccgcgagaacuccaaggagcucccccccuucugggagcagcgcaacgaccucuacuacaacaccaucaccaacuucuccgagaaggaccgccccgagaacguccacggcggcauccucgccgacgacaugggccucggcaagacccucaccgccaucgccgucauccucaccaacuuccacgacggccgcccccuccccaucgagcgcgucaagaagaaccuccucaagaaggaguacaacgucaacgacgacuccaugaagcucggcggcaacaacaccuccgagaaggccgacggccucuccaaggacgccucccgcugcuccgagcagcccuccaucuccgacaucaaggagaaguccaaguuccgcauguccgagcucuccuccucccgccccaagcgccgcaagaccgccguccaguacaucgaguccuccgacuccgaggagaucgagaccuccgagcucccccagaagaugaagggcaagcucaagaacguccaguccgagaccaagggccgcgccaaggccggcuccuccaaggucaucgaggacgucgccuucgccugcgcccucaccuccuccguccccaccaccaagaagaagaugcucaagaagggcgccugcgccgucgagggcuccaagaagaccgacgucgaggagcgcccccgcaccacccucaucaucugcccccucuccguccucuccaacuggaucgaccaguucggccagcacaucaaguccgacguccaccucaacuucuacgucuacuacggccccgaccgcauccgcgagcccgcccuccucuccaagcaggacaucguccucaccaccuacaacauccucacccacgacuacggcaccaagggcgacuccccccuccacuccauccgcuggcuccgcgucauccucgacgagggccacgccauccgcaaccccaacgcccagcagaccaaggccguccucgaccucgaguccgagcgccgcuggguccucaccggcacccccauccagaacucccucaaggaccucuggucccuccucuccuuccucaagcucaagcccuucaucgaccgcgagugguggcaccgcaccauccagcgccccgucaccaugggcgacgagggcggccuccgccgccuccagucccucaucaagaacaucacccuccgccgcaccaagaccuccaagaucaagggcaagcccguccucgagcuccccgagcgcaaggucuucauccagcacaucacccucuccgacgaggagcgcaagaucuaccaguccgucaagaacgagggccgcgccaccaucggccgcuacuucaacgagggcaccguccucgcccacuacgccgacguccucggccuccuccuccgccuccgccagaucugcugccacaccuaccuccucaccaacgccgucuccuccaacggccccuccggcaacgacacccccgaggagcuccgcaagaagcucauccgcaagaugaagcucauccucuccuccggcuccgacgaggagugcgccaucugccucgacucccucaccguccccgucaucacccacugcgcccacgucuucugcaagcccugcaucugccaggucauccagaacgagcagccccacgccaagugcccccucugccgcaacgacauccacgaggacaaccuccucgagugcccccccgaggagcucgcccgcgacuccgagaagaaguccgacauggaguggaccuccuccuccaagaucaacgcccucaugcacgcccucaccgaccuccgcaagaagaaccccaacaucaagucccucgucgucucccaguucaccaccuuccucucccucaucgagaucccccucaaggccuccggcuucgucuucacccgccucgacggcuccauggcccagaagaagcgcgucgaguccauccagugcuuccagaacaccgaggccggcucccccaccaucaugcuccucucccucaaggccggcggcgucggccucaaccucuccgccgccucccgcgucuuccucauggaccccgccuggaaccccgccgccgaggaccagugcuucgaccgcugccaccgccucggccagaagcaggaggucaucaucaccaaguucaucgucaaggacuccgucgaggagaacaugcucaagauccagaacaagaagcgcgagcucgccgccggcgccuucggcaccaagaagcccaacgccgacgagaugaagcaggccaagaucaacgagauccgcacccucaucgaccucuga

SEQ ID NO: 44211 - RNA, 1467 nt, Artificial Sequence
  derived and/or modified sequence opt2 from HLX__Homo_sapiens__NP_068777
auguucgccgccggccucgcccccuucuacgccuccaacuucucccucugguccgccgccuacugcuccuccgccggccccggcggcugcuccuucccccucgaccccgccgccgucaagaagcccuccuucugcaucgccgacauccuccacgccggcgucggcgaccucggcgccgcccccgagggccucgccggcgccuccgccgccgcccucaccgcccaccucggcuccguccacccccacgccuccuuccaggccgccgcccgcuccccccuccgccccacccccgucgucgcccccuccgagguccccgccggcuucccccagcgccucuccccccucuccgccgccuaccaccaccaccacccccagcagcagcagcagcagcagcagccccagcagcagcagccccccccccccccccgcgccggcgcccuccagccccccgccuccggcacccgcgucguccccaacccccaccacuccggcuccgcccccgcccccuccuccaaggaccucaaguucggcaucgaccgcauccucuccgccgaguucgaccccaaggucaaggagggcaacacccuccgcgaccucaccucccuccucaccggcggccgccccgccggcguccaccucuccggccuccagcccuccgccggccaguucuucgccucccucgaccccaucaacgaggccuccgccauccucuccccccucaacuccaacccccgcaacuccguccagcaccaguuccaggacaccuuccccggccccuacgccguccucaccaaggacaccaugccccagaccuacaagcgcaagcgcuccuggucccgcgccgucuucuccaaccuccagcgcaagggccucgagaagcgcuucgagauccagaaguacgucaccaagcccgaccgcaagcagcucgccgccaugcucggccucaccgacgcccaggucaaggucugguuccagaaccgccgcaugaaguggcgccacuccaaggaggcccaggcccagaaggacaaggacaaggaggccggcgagaagcccuccggcggcgcccccgccgccgacggcgagcaggacgagcgcucccccucccgcuccgagggcgaggccgaguccgaguccuccgacuccgagucccucgacauggcccccuccgacaccgagcgcaccgagggcuccgagcgcucccuccaccagaccaccgucaucaaggcccccgucaccggcgcccucaucaccgccuccuccgccggcuccggcggcuccuccggcggcggcggcaacuccuucuccuucuccuccgccuccucccucuccuccuccuccaccuccgccggcugcgccuccucccucggcggcggcggcgccuccgagcuccuccccgccacccagcccaccgccuccuccgcccccaagucccccgagcccgcccagggcgcccucggcugccucuga

SEQ ID NO: 44212 - RNA, 1134 nt, Artificial Sequence
  derived and/or modified sequence opt2 from HM13__Homo_sapiens__NP_110416
auggacuccgcccucuccgacccccacaacggcuccgccgaggccggcggccccaccaacuccaccacccgcccccccuccacccccgagggcaucgcccucgccuacggcucccuccuccucauggcccuccuccccaucuucuucggcgcccuccgcuccguccgcugcgcccgcggcaagaacgccuccgacaugcccgagaccaucaccucccgcgacgccgcccgcuuccccaucaucgccuccugcacccuccucggccucuaccucuucuucaagaucuucucccaggaguacaucaaccuccuccucuccauguacuucuucguccucggcauccucgcccucucccacaccaucucccccuucaugaacaaguucuuccccgccuccuuccccaaccgccaguaccagcuccucuucacccagggcuccggcgagaacaaggaggagaucaucaacuacgaguucgacaccaaggaccucgucugccucggccucuccuccaucgucggcgucugguaccuccuccgcaagcacuggaucgccaacaaccucuucggccucgccuucucccucaacggcgucgagcuccuccaccucaacaacgucuccaccggcugcauccuccucggcggccucuucaucuacgacgucuucugggucuucggcaccaacgucauggucaccgucgccaaguccuucgaggcccccaucaagcucgucuucccccaggaccuccucgagaagggccucgaggccaacaacuucgccaugcucggccucggcgacgucgucauccccggcaucuucaucgcccuccuccuccgcuucgacaucucccucaagaagaacacccacaccuacuucuacaccuccuucgccgccuacaucuucggccucggccucaccaucuucaucaugcacaucuucaagcacgcccagcccgcccuccucuaccucguccccgccugcaucggcuuccccguccucgucgcccucgccaagggcgaggucaccgagauguucuccuacgaggaguccaaccccaaggaccccgccgccgucaccgaguccaaggagggcaccgaggccuccgccuccaagggccucgagaagaaggagaaguga

SEQ ID NO: 44213 - RNA, 1263 nt, Artificial Sequence
  derived and/or modified sequence opt2 from HMBOX1__Homo_sapiens__NP_001129198
augcucuccuccuuccccgucguccuccucgagaccaugucccacuacaccgacgagccccgcuucaccaucgagcagaucgaccuccuccagcgccuccgccgcaccggcaugaccaagcacgagauccuccacgcccucgagacccucgaccgccucgaccaggagcacuccgacaaguucggccgccgcuccuccuacggcggcuccuccuacggcaacuccaccaacaacguccccgccuccuccuccaccgccaccgccuccacccagacccagcacuccggcaugucccccucccccuccaacuccuacgacaccuccccccagcccugcaccaccaaccagaacggccgcgagaacaacgagcgccucuccaccuccaacggcaagaugucccccacccgcuaccacgccaacuccaugggccagcgcuccuacuccuucgaggccuccgaggaggaccucgacgucgacgacaaggucgaggagcucaugcgccgcgacuccuccgucaucaaggaggagaucaaggccuuccucgccaaccgccgcaucucccaggccgucgucgcccaggucaccggcaucucccagucccgcaucucccacuggcuccuccagcagggcuccgaccucuccgagcagaagaagcgcgccuucuaccgcugguaccagcucgagaagaccaaccccggcgccacccucuccaugcgccccgcccccauccccaucgaggaccccgaguggcgccagacccccccccccgucuccgccaccuccggcaccuuccgccuccgccgcggcucccgcuucaccuggcgcaaggagugccucgccgucauggaguccuacuucaacgagaaccaguaccccgacgaggccaagcgcgaggagaucgccaacgccugcaacgccgucauccagaagcccggcaagaagcucuccgaccucgagcgcgucaccucccucaaggucuacaacugguucgccaaccgccgcaaggagaucaagcgccgcgccaacaucgaggccgccauccucgagucccacggcaucgacguccagucccccggcggccacuccaacuccgacgacgucgacggcaacgacuacuccgagcaggacgacuccaccucccacuccgaccaccaggaccccaucucccucgccgucgagauggccgccgucaaccacaccauccucgcccucgcccgccagggcgccaacgagaucaagaccgaggcccucgacgacgacuga

SEQ ID NO: 44214 - RNA, 1086 nt, Artificial Sequence
  derived and/or modified sequence opt2 from HMBS__Homo_sapiens__NP_000181
auguccggcaacggcaacgccgccgccaccgccgaggagaacucccccaagaugcgcgucauccgcgucggcacccgcaagucccagcucgcccgcauccagaccgacuccgucgucgccacccucaaggccuccuaccccggccuccaguucgagaucaucgccauguccaccaccggcgacaagauccucgacaccgcccucuccaagaucggcgagaagucccucuucaccaaggagcucgagcacgcccucgagaagaacgaggucgaccucgucguccacucccucaaggaccuccccaccguccucccccccggcuucaccaucggcgccaucugcaagcgcgagaacccccacgacgccgucgucuuccaccccaaguucgucggcaagacccucgagacccuccccgagaaguccgucgucggcaccuccucccuccgccgcgccgcccagcuccagcgcaaguucccccaccucgaguuccgcuccauccgcggcaaccucaacacccgccuccgcaagcucgacgagcagcaggaguucuccgccaucauccucgccaccgccggccuccagcgcaugggcuggcacaaccgcgucggccagauccuccaccccgaggagugcauguacgccgucggccagggcgcccucggcgucgagguccgcgccaaggaccaggacauccucgaccucgucggcguccuccacgaccccgagacccuccuccgcugcaucgccgagcgcgccuuccuccgccaccucgagggcggcugcuccguccccgucgccguccacaccgccaugaaggacggccagcucuaccucaccggcggcgucuggucccucgacggcuccgacuccauccaggagaccaugcaggccaccauccacguccccgcccagcacgaggacggccccgaggacgacccccagcucgucggcaucaccgcccgcaacaucccccgcggcccccagcucgccgcccagaaccucggcaucucccucgccaaccuccuccucuccaagggcgccaagaacauccucgacgucgcccgccagcucaacgacgcccacuga

SEQ ID NO: 44215 - RNA, 16908 nt, Artificial Sequence
  derived and/or modified sequence opt2 from HMCN1__Homo_sapiens__NP_114141
augaucuccugggaggucguccacaccgucuuccucuucgcccuccucuacuccucccucgcccaggacgccuccccccaguccgagauccgcgccgaggagauccccgagggcgccuccacccucgccuucgucuucgacgucaccggcuccauguacgacgaccucguccaggucaucgagggcgccuccaagauccucgagaccucccucaagcgccccaagcgcccccucuucaacuucgcccucguccccuuccacgaccccgagaucggccccgucaccaucaccaccgaccccaagaaguuccaguacgagcuccgcgagcucuacguccagggcggcggcgacugccccgagauguccaucggcgccaucaagaucgcccucgagaucucccuccccggcuccuucaucuacgucuucaccgacgcccgcuccaaggacuaccgccucacccacgagguccuccagcucauccagcagaagcagucccaggucgucuucguccucaccggcgacugcgacgaccgcacccacaucggcuacaaggucuacgaggagaucgccuccaccuccuccggccaggucuuccaccucgacaagaagcaggucaacgagguccucaagugggucgaggaggccguccaggccuccaagguccaccuccucuccaccgaccaccucgagcaggccgucaacaccuggcgcauccccuucgaccccucccucaaggaggucaccgucucccucuccggccccucccccaugaucgagauccgcaacccccucggcaagcucaucaagaagggcuucggccuccacgagcuccucaacauccacaacuccgccaaggucgucaacgucaaggagcccgaggccggcauguggaccgucaagaccuccuccuccggccgccacuccguccgcaucaccggccucuccaccaucgacuuccgcgccggcuucucccgcaagcccacccucgacuucaagaagaccgucucccgccccguccagggcauccccaccuacguccuccucaacaccuccggcaucuccacccccgcccgcaucgaccuccucgagcuccucuccaucuccggcuccucccucaagaccauccccgucaaguacuacccccaccgcaagcccuacggcaucuggaacaucuccgacuucgucccccccaacgaggccuucuuccucaaggucaccggcuacgacaaggacgacuaccucuuccagcgcgucuccuccgucuccuucuccuccaucguccccgacgcccccaaggucaccaugcccgagaagacccccggcuacuaccuccagcccggccagauccccugcuccgucgacucccuccuccccuucacccucuccuucguccgcaacggcgucacccucggcgucgaccaguaccucaaggaguccgccuccgucaaccucgacaucgccaaggucacccucuccgacgagggcuucuacgagugcaucgccgucuccuccgccggcaccggccgcgcccagaccuucuucgacgucuccgagcccccccccgucauccagguccccaacaacgucaccgucacccccggcgagcgcgccguccucaccugccucaucaucuccgccgucgacuacaaccucaccuggcagcgcaacgaccgcgacguccgccucgccgagcccgcccgcauccgcacccucgccaaccucucccucgagcucaaguccgucaaguucaacgacgccggcgaguaccacugcauggucuccuccgagggcggcuccuccgccgccuccgucuuccucaccguccaggagccccccaaggucaccgucaugcccaagaaccaguccuucaccggcggcuccgaggucuccaucaugugcuccgccaccggcuaccccaagcccaagaucgccuggaccgucaacgacauguucaucgucggcucccaccgcuaccgcaugaccuccgacggcacccucuucaucaagaacgccgcccccaaggacgccggcaucuacggcugccucgccuccaacuccgccggcaccgacaagcagaacuccacccuccgcuacaucgaggcccccaagcucauggucguccaguccgagcuccucgucgcccucggcgacaucaccgucauggagugcaagaccuccggcaucccccccccccaggucaagugguucaagggcgaccucgagcuccgccccuccaccuuccucaucaucgacccccuccucggccuccucaagauccaggagacccaggaccucgacgccggcgacuacaccugcgucgccaucaacgaggccggccgcgccaccggcaagaucacccucgacgucggcuccccccccgucuucauccaggagcccgccgacgucuccauggagaucggcuccaacgucacccuccccugcuacguccagggcuaccccgagcccaccaucaaguggcgccgccucgacaacaugcccaucuucucccgccccuucuccgucuccuccaucucccagcuccgcaccggcgcccucuucauccucaaccucugggccuccgacaagggcaccuacaucugcgaggccgagaaccaguucggcaagauccaguccgagaccaccgucaccgucaccggccucgucgccccccucaucggcaucucccccuccgucgccaacgucaucgagggccagcagcucacccuccccugcacccuccucgccggcaaccccauccccgagcgccgcuggaucaagaacuccgccaugcuccuccagaaccccuacaucaccguccgcuccgacggcucccuccacaucgagcgcguccagcuccaggacggcggcgaguacaccugcgucgccuccaacgucgccggcaccaacaacaagaccaccuccgucgucguccacguccuccccaccauccagcacggccagcagauccucuccaccaucgagggcauccccgucacccuccccugcaaggccuccggcaaccccaagcccuccgucaucugguccaagaagggcgagcucaucuccaccuccuccgccaaguucuccgccggcgccgacggcucccucuacgucgucucccccggcggcgaggaguccggcgaguacgucugcaccgccaccaacaccgccggcuacgccaagcgcaagguccagcucaccgucuacguccgcccccgcgucuucggcgaccagcgcggccucucccaggacaagcccgucgagaucuccguccucgccggcgaggaggucacccuccccugcgaggucaagucccuccccccccccaucaucaccugggccaaggagacccagcucaucucccccuucuccccccgccacaccuuccuccccuccggcuccaugaagaucaccgagacccgcaccuccgacuccggcauguaccucugcgucgccaccaacaucgccggcaacgucacccaggccgucaagcucaacguccacgucccccccaagauccagcgcggccccaagcaccucaagguccaggucggccagcgcgucgacauccccugcaacgcccagggcaccccccuccccgucaucaccugguccaagggcggcuccaccaugcucgucgacggcgagcaccacgucuccaaccccgacggcacccucuccaucgaccaggccacccccuccgacgccggcaucuacaccugcgucgccaccaacaucgccggcaccgacgagaccgagaucacccuccacguccaggagccccccaccgucgaggaccucgagccccccuacaacaccaccuuccaggagcgcgucgccaaccagcgcaucgaguuccccugccccgccaagggcacccccaagcccaccaucaaguggcuccacaacggccgcgagcucaccggccgcgagcccggcaucuccauccucgaggacggcacccuccucgucaucgccuccgucacccccuacgacaacggcgaguacaucugcgucgccgucaacgaggccggcaccaccgagcgcaaguacaaccucaagguccacgucccccccgucaucaaggacaaggagcaggucaccaacgucuccguccuccucaaccagcucaccaaccucuucugcgaggucgagggcacccccucccccaucaucaugugguacaaggacaacguccaggucaccgaguccuccaccauccagaccgucaacaacggcaagauccucaagcucuuccgcgccacccccgaggacgccggccgcuacuccugcaaggccaucaacaucgccggcaccucccagaaguacuucaacaucgacguccucgucccccccaccaucaucggcaccaacuuccccaacgaggucuccgucguccucaaccgcgacgucgcccucgagugccaggucaagggcacccccuuccccgacauccacugguucaaggacggcaagccccucuuccucggcgaccccaacgucgagcuccucgaccgcggccagguccuccaccucaagaacgcccgccgcaacgacaagggccgcuaccagugcaccgucuccaacgccgccggcaagcaggccaaggacaucaagcucaccaucuacaucccccccuccaucaagggcggcaacgucaccaccgacaucuccguccucaucaacucccucaucaagcucgagugcgagacccgcggccuccccaugcccgccaucaccugguacaaggacggccagcccaucauguccuccucccaggcccucuacaucgacaagggccaguaccuccacaucccccgcgcccaggucuccgacuccgccaccuacaccugccacgucgccaacgucgccggcaccgccgagaaguccuuccacgucgacgucuacgucccccccaugaucgagggcaaccucgccaccccccucaacaagcaggucgucaucgcccacucccucacccucgagugcaaggccgccggcaaccccucccccauccucaccuggcucaaggacggcguccccgucaaggccaacgacaacauccgcaucgaggccggcggcaagaagcucgagaucauguccgcccaggagaucgaccgcggccaguacaucugcgucgccaccuccgucgccggcgagaaggagaucaaguacgaggucgacguccucgucccccccgccaucgagggcggcgacgagaccuccuacuucaucgucauggucaacaaccuccucgagcucgacugccacgucaccggcucccccccccccaccaucauguggcucaaggacggccagcucaucgacgagcgcgacggcuucaagauccuccucaacggccgcaagcucgucaucgcccaggcccaggucuccaacaccggccucuaccgcugcauggccgccaacaccgccggcgaccacaagaaggaguucgaggucaccguccacgucccccccaccaucaaguccuccggccucuccgagcgcgucgucgucaaguacaagcccgucgcccuccagugcaucgccaacggcauccccaaccccuccaucaccuggcucaaggacgaccagcccgucaacaccgcccagggcaaccucaagauccaguccuccggccgcguccuccagaucgccaagacccuccucgaggacgccggccgcuacaccugcgucgccaccaacgccgccggcgagacccagcagcacauccagcuccacguccacgagccccccucccucgaggacgccggcaagaugcucaacgagaccguccucgucuccaaccccguccagcucgagugcaaggccgccggcaaccccguccccgucaucaccugguacaaggacaaccgccuccucuccggcuccaccuccaugaccuuccucaaccgcggccagaucaucgacaucgaguccgcccagaucuccgacgccggcaucuacaagugcgucgccaucaacuccgccggcgccaccgagcucuucuacucccuccagguccacgucgcccccuccaucuccggcuccaacaacauggucgccgucgucgucaacaaccccguccgccucgagugcgaggcccgcggcauccccgcccccucccucaccuggcucaaggacggcucccccgucuccuccuucuccaacggccuccagguccucuccggcggccgcauccucgcccucaccuccgcccagaucuccgacaccggccgcuacaccugcgucgccgucaacgccgccggcgagaagcagcgcgacaucgaccuccgcgucuacgucccccccaacaucaugggcgaggagcagaacgucuccguccucaucucccaggccgucgagcuccucugccaguccgacgccauccccccccccacccucaccuggcucaaggacggccacccccuccucaagaagcccggccucuccaucuccgagaaccgcuccguccucaagaucgaggacgcccagguccaggacaccggccgcuacaccugcgaggccaccaacgucgccggcaagaccgagaagaacuacaacgucaacaucugggucccccccaacaucggcggcuccgacgagcucacccagcucaccgucaucgagggcaaccucaucucccuccucugcgaguccuccggcauccccccccccaaccucaucuggaagaagaagggcucccccguccucaccgacuccaugggccgcguccgcauccucuccggcggccgccagcuccagaucuccaucgccgagaaguccgacgccgcccucuacuccugcgucgccuccaacgucgccggcaccgccaagaaggaguacaaccuccaggucuacauccgccccaccaucaccaacuccggcucccaccccaccgagaucaucgucacccgcggcaaguccaucucccucgagugcgagguccagggcauccccccccccaccgucaccuggaugaaggacggccacccccucaucaaggccaagggcgucgagauccucgacgagggccacauccuccagcucaagaacauccacgucuccgacaccggccgcuacgucugcgucgccgucaacgucgccggcaugaccgacaagaaguacgaccucuccguccacgccccccccuccaucaucggcaaccaccgcucccccgagaacaucuccgucgucgagaagaacuccgucucccucaccugcgaggccuccggcaucccccuccccuccaucaccugguucaaggacggcuggcccgucucccucuccaacuccguccgcauccucuccggcggccgcaugcuccgccucaugcagaccaccauggaggacgccggccaguacaccugcgucguccgcaacgccgccggcgaggagcgcaagaucuucggccucuccguccucguccccccccacaucgucggcgagaacacccucgaggacgucaaggucaaggagaagcaguccgucacccucaccugcgaggucaccggcaaccccguccccgagaucaccuggcacaaggacggccagccccuccaggaggacgaggcccaccacaucaucuccggcggccgcuuccuccagaucaccaacguccaggucccccacaccggccgcuacaccugccucgccuccucccccgccggccacaagucccgcuccuucucccucaacgucuucgucucccccaccaucgccggcgucggcuccgacggcaaccccgaggacgucaccgucauccucaacucccccaccucccucgucugcgaggccuacuccuacccccccgccaccaucaccugguucaaggacggcaccccccucgaguccaaccgcaacauccgcauccuccccggcggccgcacccuccagauccucaacgcccaggaggacaacgccggccgcuacuccugcgucgccaccaacgaggccggcgagaugaucaagcacuacgaggucaaggucuacaucccccccaucaucaacaagggcgaccucuggggccccggccucucccccaaggaggucaagaucaaggucaacaacacccucacccucgagugcgaggccuacgccauccccuccgccucccucuccugguacaaggacggccagccccucaaguccgacgaccacgucaacaucgccgccaacggccacacccuccagaucaaggaggcccagaucuccgacaccggccgcuacaccugcgucgccuccaacaucgccggcgaggacgagcucgacuucgacgucaacauccaggucccccccuccuuccagaagcucugggagaucggcaacaugcucgacaccggccgcaacggcgaggccaaggacgucaucaucaacaaccccaucucccucuacugcgagaccaacgccgcccccccccccacccucaccugguacaaggacggccacccccucaccuccuccgacaagguccucauccuccccggcggccgcguccuccagaucccccgcgccaaggucgaggacgccggccgcuacaccugcgucgccgucaacgaggccggcgaggacucccuccaguacgacguccgcguccucgucccccccaucaucaagggcgccaacuccgaccuccccgaggaggucaccguccucgucaacaaguccgcccucaucgagugccucuccuccggcucccccgccccccgcaacuccuggcagaaggacggccagccccuccucgaggacgaccaccacaaguuccucuccaacggccgcauccuccagauccucaacacccagaucaccgacaucggccgcuacgucugcgucgccgagaacaccgccggcuccgccaagaaguacuucaaccucaacguccacgucccccccuccgucaucggccccaaguccgagaaccucaccgucgucgucaacaacuucaucucccucaccugcgaggucuccggcuuccccccccccgaccucuccuggcucaagaacgagcagcccaucaagcucaacaccaacacccucaucguccccggcggccgcacccuccagaucauccgcgccaaggucuccgacggcggcgaguacaccugcaucgccaucaaccaggccggcgaguccaagaagaaguucucccucaccgucuacgucccccccuccaucaaggaccacgacuccgagucccucuccgucgucaacguccgcgagggcaccuccgucucccucgagugcgaguccaacgccguccccccccccgucaucaccugguacaagaacggccgcaugaucaccgaguccacccacgucgagauccucgccgacggccagaugcuccacaucaagaaggccgaggucuccgacaccggccaguacgucugccgcgccaucaacgucgccggccgcgacgacaagaacuuccaccucaacgucuacgucccccccuccaucgagggccccgagcgcgaggucaucgucgagaccaucuccaaccccgucacccucaccugcgacgccaccggcauccccccccccaccaucgccuggcucaagaaccacaagcgcaucgagaacuccgacucccucgagguccgcauccucuccggcggcuccaagcuccagaucgcccgcucccagcacuccgacuccggcaacuacaccugcaucgccuccaacauggagggcaaggcccagaaguacuacuuccucuccauccaggucccccccuccgucgccggcgccgagauccccuccgacgucuccguccuccucggcgagaacgucgagcucgucugcaacgccaacggcauccccaccccccucauccaguggcucaaggacggcaagcccaucgccuccggcgagaccgagcgcauccgcgucuccgccaacggcuccacccucaacaucuacggcgcccucaccuccgacaccggcaaguacaccugcgucgccaccaaccccgccggcgaggaggaccgcaucuucaaccucaacgucuacgucacccccaccauccgcggcaacaaggacgaggccgagaagcucaugacccucgucgacaccuccaucaacaucgagugccgcgccaccggcaccccccccccccagaucaacuggcucaagaacggccucccccucccccucuccucccacauccgccuccucgccgccggccaggucauccgcaucguccgcgcccaggucuccgacgucgccgucuacaccugcgucgccuccaaccgcgccggcgucgacaacaagcacuacaaccuccaggucuucgccccccccaacauggacaacuccaugggcaccgaggagaucaccguccucaagggcuccuccaccuccauggccugcaucaccgacggcacccccgcccccuccauggccuggcuccgcgacggccagccccucggccucgacgcccaccucaccgucuccacccacggcaugguccuccagcuccucaaggccgagaccgaggacuccggcaaguacaccugcaucgccuccaacgaggccggcgaggucuccaagcacuucauccucaagguccucgagcccccccacaucaacggcuccgaggagcacgaggagaucuccgucaucgucaacaacccccucgagcucaccugcaucgccuccggcauccccgcccccaagaugaccuggaugaaggacggccgcccccucccccagaccgaccagguccagacccucggcggcggcgagguccuccgcaucuccaccgcccaggucgaggacaccggccgcuacaccugccucgccuccucccccgccggcgacgacgacaaggaguaccucguccgcguccacgucccccccaacaucgccggcaccgacgagccccgcgacaucaccguccuccgcaaccgccaggucacccucgagugcaaguccgacgccguccccccccccgucaucaccuggcuccgcaacggcgagcgccuccaggccaccccccgcguccgcauccucuccggcggccgcuaccuccagaucaacaacgccgaccucggcgacaccgccaacuacaccugcgucgccuccaacaucgccggcaagaccacccgcgaguucauccucaccgucaacgucccccccaacaucaagggcggcccccagucccucgucauccuccucaacaaguccaccguccucgagugcaucgccgagggcguccccaccccccgcaucaccuggcgcaaggacggcgccguccucgccggcaaccacgcccgcuacuccauccucgagaacggcuuccuccacauccaguccgcccacgucaccgacaccggccgcuaccucugcauggccaccaacgccgccggcaccgaccgccgccgcaucgaccuccagguccacgucccccccuccaucgcccccggccccaccaacaugaccgucaucgucaacguccagaccacccucgccugcgaggccaccggcauccccaagcccuccaucaacuggcgcaagaacggccaccuccucaacgucgaccagaaccagaacuccuaccgccuccucuccuccggcucccucgucaucaucucccccuccgucgacgacaccgccaccuacgagugcaccgucaccaacggcgccggcgacgacaagcgcaccgucgaccucaccguccaggucccccccuccaucgccgacgagcccaccgacuuccucgucaccaagcacgcccccgccgucaucaccugcaccgccuccggcguccccuuccccuccauccacuggaccaagaacggcauccgccuccucccccgcggcgacggcuaccgcauccucuccuccggcgccaucgagauccucgccacccagcucaaccacgccggccgcuacaccugcgucgcccgcaacgccgccggcuccgcccaccgccacgucacccuccacguccacgagccccccgucauccagccccagcccuccgagcuccacgucauccucaacaaccccauccuccuccccugcgaggccaccggcacccccucccccuucaucaccuggcagaaggagggcaucaacgucaacaccuccggccgcaaccacgccguccuccccuccggcggccuccagaucucccgcgccguccgcgaggacgccggcaccuacaugugcgucgcccagaaccccgccggcaccgcccucggcaagaucaagcucaacguccaggucccccccgucaucuccccccaccucaaggaguacgucaucgccgucgacaagcccaucacccucuccugcgaggccgacggccuccccccccccgacaucaccuggcacaaggacggccgcgccaucgucgaguccauccgccagcgcguccucuccuccggcucccuccagaucgccuucguccagcccggcgacgccggccacuacaccugcauggccgccaacgucgccggcuccuccuccaccuccaccaagcucaccguccacguccccccccgcauccgcuccaccgagggccacuacaccgucaacgagaacucccaggccauccuccccugcgucgccgacggcauccccacccccgccaucaacuggaagaaggacaacguccuccucgccaaccuccucggcaaguacaccgccgagcccuacggcgagcucauccucgagaacgucguccucgaggacuccggcuucuacaccugcgucgccaacaacgccgccggcgaggacacccacaccgucucccucaccguccacguccuccccaccuucaccgagcuccccggcgacgucucccucaacaagggcgagcagcuccgccucuccugcaaggccaccggcaucccccuccccaagcucaccuggaccuucaacaacaacaucauccccgcccacuucgacuccgucaacggccacuccgagcucgucaucgagcgcgucuccaaggaggacuccggcaccuacgucugcaccgccgagaacuccgucggcuucgucaaggccaucggcuucgucuacgucaaggagccccccgucuucaagggcgacuaccccuccaacuggaucgagccccucggcggcaacgccauccucaacugcgaggucaagggcgaccccacccccaccauccaguggaaccgcaagggcgucgacaucgagaucucccaccgcauccgccagcucggcaacggcucccucgccaucuacggcaccgucaacgaggacgccggcgacuacaccugcgucgccaccaacgaggccggcgucgucgagcgcuccaugucccucacccuccaguccccccccaucaucacccucgagcccgucgagaccgucaucaacgccggcggcaagaucauccucaacugccaggccaccggcgagccccagcccaccaucaccuggucccgccagggccacuccaucuccugggacgaccgcgucaacguccucuccaacaacucccucuacaucgccgacgcccagaaggaggacaccuccgaguucgagugcgucgcccgcaaccucaugggcuccguccucguccgcguccccgucaucguccagguccacggcggcuucucccagugguccgccuggcgcgccugcuccgucaccugcggcaagggcauccagaagcgcucccgccucugcaaccagccccuccccgccaacggcggcaagcccugccagggcuccgaccucgagaugcgcaacugccagaacaagcccugccccgucgacggcuccugguccgaguggucccucugggaggagugcacccgcuccugcggccgcggcaaccagacccgcacccgcaccugcaacaaccccuccguccagcacggcggccgccccugcgagggcaacgccgucgagaucaucaugugcaacauccgccccugccccguccacggcgccugguccgccuggcagcccuggggcaccugcuccgaguccugcggcaagggcacccagacccgcgcccgccucugcaacaaccccccccccgccuucggcggcuccuacugcgacggcgccgagacccagaugcaggucugcaacgagcgcaacugccccauccacggcaagugggccaccugggccuccugguccgccugcuccgucuccugcggcggcggcgcccgccagcgcacccgcggcugcuccgaccccgucccccaguacggcggccgcaagugcgagggcuccgacguccaguccgacuucugcaacuccgaccccugccccacccacggcaacuggucccccugguccggcuggggcaccugcucccgcaccugcaacggcggccagaugcgccgcuaccgcaccugcgacaaccccccccccuccaacggcggccgcgccugcggcggccccgacucccagauccagcgcugcaacaccgacaugugccccgucgacggcuccuggggcuccuggcacuccuggucccagugcuccgccuccugcggcggcggcgagaagacccgcaagcgccucugcgaccaccccguccccgucaagggcggccgccccugccccggcgacaccacccaggucacccgcugcaacguccaggccugccccggcggcccccagcgcgcccgcggcuccgucaucggcaacaucaacgacgucgaguucggcaucgccuuccucaacgccaccaucaccgacucccccaacuccgacacccgcaucauccgcgccaagaucaccaacgucccccgcucccucggcuccgccaugcgcaagaucgucuccauccucaaccccaucuacuggaccaccgccaaggagaucggcgaggccgucaacggcuucacccucaccaacgccgucuucaagcgcgagacccaggucgaguucgccaccggcgagauccuccagaugucccacaucgcccgcggccucgacuccgacggcucccuccuccucgacaucgucgucuccggcuacguccuccagcuccagucccccgccgaggucaccgucaaggacuacaccgaggacuacauccagaccggccccggccagcucuacgccuacuccacccgccucuucaccaucgacggcaucuccauccccuacaccuggaaccacaccgucuucuacgaccaggcccagggccgcaugcccuuccucgucgagacccuccacgccuccuccgucgaguccgacuacaaccagaucgaggagacccucggcuucaagauccacgccuccaucuccaagggcgaccgcuccaaccagugccccuccggcuucacccucgacuccgucggccccuucugcgccgacgaggacgagugcgccgccggcaaccccugcucccacuccugccacaacgccaugggcaccuacuacugcuccugccccaagggccucaccaucgccgccgacggccgcaccugccaggacaucgacgagugcgcccucggccgccacaccugccacgccggccaggacugcgacaacaccaucggcuccuaccgcugcgucguccgcugcggcuccggcuuccgccgcaccuccgacggccucuccugccaggacaucaacgagugccaggaguccucccccugccaccagcgcugcuucaacgccaucggcuccuuccacugcggcugcgagcccggcuaccagcucaagggccgcaagugcauggacgucaacgagugccgccagaacgucugccgccccgaccagcacugcaagaacacccgcggcggcuacaagugcaucgaccucugccccaacggcaugaccaaggccgagaacggcaccugcaucgacaucgacgagugcaaggacggcacccaccagugccgcuacaaccagaucugcgagaacacccgcggcuccuaccgcugcgucugcccccgcggcuaccgcucccagggcgucggccgccccugcauggacaucaacgagugcgagcagguccccaagcccugcgcccaccagugcuccaacacccccggcuccuucaagugcaucugcccccccggccagcaccuccucggcgacggcaaguccugcgccggccucgagcgccuccccaacuacggcacccaguacuccuccuacaaccucgcccgcuucucccccguccgcaacaacuaccagccccagcagcacuaccgccaguacucccaccucuacuccuccuacuccgaguaccgcaacucccgcaccucccucucccgcacccgccgcaccauccgcaagaccugccccgagggcuccgaggccucccacgacaccugcgucgacaucgacgagugcgagaacaccgacgccugccagcacgagugcaagaacaccuucggcuccuaccagugcaucugcccccccggcuaccagcucacccacaacggcaagaccugccaggacaucgacgagugccucgagcagaacguccacugcggccccaaccgcaugugcuucaacaugcgcggcuccuaccagugcaucgacacccccugcccccccaacuaccagcgcgaccccgucuccggcuucugccucaagaacugcccccccaacgaccucgagugcgcccucucccccuacgcccucgaguacaagcucgucucccuccccuucggcaucgccaccaaccaggaccucauccgccucgucgccuacacccaggacggcgucaugcacccccgcaccaccuuccucauggucgacgaggagcagaccguccccuucgcccuccgcgacgagaaccucaagggcgucgucuacaccacccgcccccuccgcgaggccgagaccuaccgcaugcgcguccgcgccuccuccuacuccgccaacggcaccaucgaguaccagaccaccuucaucgucuacaucgccgucuccgccuaccccuacuga

SEQ ID NO: 44216 - RNA, 1044 nt, Artificial Sequence
  derived and/or modified sequence opt2 from HMG20A__Homo_sapiens__NP_001291433
auggagaaccucaugaccuccuccacccuccccccccucuucgccgacgaggacggcuccaaggaguccaacgaccucgccaccaccggccucaaccaccccgagguccccuacuccuccggcgccaccuccuccaccaacaaccccgaguucgucgaggaccucucccagggccagcuccuccaguccgaguccuccaacgccgccgagggcaacgagcagcgccacgaggacgagcagcgcuccaagcgcggcggcugguccaagggccgcaagcgcaagaagccccuccgcgacuccaacgcccccaaguccccccucaccggcuacguccgcuucaugaacgagcgccgcgagcagcuccgcgccaagcgccccgagguccccuuccccgagaucacccgcaugcucggcaacgagugguccaagcucccccccgaggagaagcagcgcuaccucgacgaggccgaccgcgacaaggagcgcuacaugaaggagcucgagcaguaccagaagaccgaggccuacaaggucuucucccgcaagacccaggaccgccagaagggcaagucccaccgccaggacgccgcccgccaggccacccacgaccacgagaaggagaccgaggucaaggagcgcuccgucuucgacauccccaucuucaccgaggaguuccucaaccacuccaaggcccgcgaggccgagcuccgccagcuccgcaaguccaacauggaguucgaggagcgcaacgccgcccuccagaagcacgucgaguccaugcgcaccgccgucgagaagcucgaggucgacgucauccaggagcgcucccgcaacaccguccuccagcagcaccucgagacccuccgccagguccucaccuccuccuucgccuccaugccccuccccggcuccggcgagacccccaccgucgacaccaucgacuccuacaugaaccgccuccacuccaucauccucgccaacccccaggacaacgagaacuucaucgccaccguccgcgaggucgucaaccgccucgaccgcuga

SEQ ID NO: 44217 - RNA, 954 nt, Artificial Sequence
  derived and/or modified sequence opt2 from HMG20B__Homo_sapiens__NP_006330
augucccacggccccaagcagcccggcgccgccgccgcccccgccggcggcaaggcccccggccagcacggcggcuucgucgucaccgucaagcaggagcgcggcgagggcccccgcgccggcgagaagggcucccacgaggaggagcccgucaagaagcgcggcuggcccaagggcaagaagcgcaagaagauccuccccaacggccccaaggcccccgucaccggcuacguccgcuuccucaacgagcgccgcgagcagauccgcacccgccaccccgaccuccccuuccccgagaucaccaagaugcucggcgccgagugguccaagcuccagcccaccgagaagcagcgcuaccucgacgaggccgagcgcgagaagcagcaguacaugaaggagcuccgcgccuaccagcaguccgaggccuacaagaugugcaccgagaagauccaggagaagaagaucaagaaggaggacuccuccuccggccucaugaacacccuccucaacggccacaagggcggcgacugcgacggcuucuccaccuucgacguccccaucuucaccgaggaguuccucgaccagaacaaggcccgcgaggccgagcuccgccgccuccgcaagaugaacgucgccuucgaggagcagaacgccguccuccagcgccacacccaguccauguccuccgcccgcgagcgccucgagcaggagcucgcccucgaggagcgccgcacccucgcccuccagcagcagcuccaggccguccgccaggcccucaccgccuccuucgccucccuccccguccccggcaccggcgagacccccacccucggcacccucgacuucuacauggcccgccuccacggcgccaucgagcgcgaccccgcccagcacgagaagcucaucguccgcaucaaggagauccucgcccaggucgccuccgagcaccucuga

SEQ ID NO: 44218 - RNA, 291 nt, Artificial Sequence
  derived and/or modified sequence opt2 from HMGA1__Homo_sapiens__NP_665912
auguccgaguccuccuccaaguccucccagccccucgccuccaagcaggagaaggacggcaccgagaagcgcggccgcggccgcccccgcaagcagccccccaaggagcccuccgagguccccacccccaagcgcccccgcggccgccccaagggcuccaagaacaagggcgccgccaagacccgcaagaccaccaccacccccggccgcaagccccgcggccgccccaagaagcucgagaaggaggaggaggagggcaucucccaggaguccuccgaggaggagcaguga

SEQ ID NO: 44219 - RNA, 357 nt, Artificial Sequence
  derived and/or modified sequence opt2 from HMGA2__Homo_sapiens__NP_001287847
auguccgcccgcggcgagggcgccggccagcccuccaccuccgcccagggccagcccgccgcccccgccccccagaagcgcggccgcggccgcccccgcaagcagcagcaggagcccaccggcgagcccucccccaagcgcccccgcggccgccccaagggcuccaagaacaagucccccuccaaggccgcccagaagaaggccgaggccaccggcgagaagcgcccccgcggccgcccccgcaaguggccccagcaggucguccagaagaagcccgcccaggucaacgucgcccuccccggcaaggaccaccccggcaaccucaucuaccuccucuucuccaagaacgccaccuga

SEQ ID NO: 44220 - RNA, 477 nt, Artificial Sequence
  derived and/or modified sequence opt2 from HMGB1__Homo_sapiens__XP_005266425
augggcaagggcgaccccaagaagccccgcggcaagauguccuccuacgccuucuucguccagaccugccgcgaggagcacaagaagaagcaccccgacgccuccgucaacuucuccgaguucuccaagaagugcuccgagcgcuggaagaccauguccgccaaggagaagggcaaguucgaggacauggccaaggccgacaaggcccgcuacgagcgcgagaugaagaccuacaucccccccaagggcgagaccaagaagaaguucaaggaccccaacgcccccaagcgcccccccuccgccuucuuccucuucugcuccgaguaccgccccaagaucaagggcgagcaccccggccucuccaucggcgacgucgccaagaagcucggcgagauguggaacaacaccgccgccgacgacaagcagcccuacgagaagaaggccgccaagcucaaggagaaguacgagaaguucuga

SEQ ID NO: 44221 - RNA, 630 nt, Artificial Sequence
  derived and/or modified sequence opt2 from HMGB2__Homo_sapiens__NP_001124161
augggcaagggcgaccccaacaagccccgcggcaagauguccuccuacgccuucuucguccagaccugccgcgaggagcacaagaagaagcaccccgacuccuccgucaacuucgccgaguucuccaagaagugcuccgagcgcuggaagaccauguccgccaaggagaaguccaaguucgaggacauggccaaguccgacaaggcccgcuacgaccgcgagaugaagaacuacgucccccccaagggcgacaagaagggcaagaagaaggaccccaacgcccccaagcgcccccccuccgccuucuuccucuucugcuccgagcaccgccccaagaucaaguccgagcaccccggccucuccaucggcgacaccgccaagaagcucggcgagaugugguccgagcaguccgccaaggacaagcagcccuacgagcagaaggccgccaagcucaaggagaaguacgagaaggacaucgccgccuaccgcgccaagggcaaguccgaggccggcaagaagggccccggccgccccaccggcuccaagaagaagaacgagcccgaggacgaggaggaggaggaggaggaggaggacgaggacgaggaggaggaggacgaggacgaggaguga

SEQ ID NO: 44222 - RNA, 603 nt, Artificial Sequence
  derived and/or modified sequence opt2 from HMGB3__Homo_sapiens__NP_001288157
auggccaagggcgaccccaagaagcccaagggcaagauguccgccuacgccuucuucguccagaccugccgcgaggagcacaagaagaagaaccccgagguccccgucaacuucgccgaguucuccaagaagugcuccgagcgcuggaagaccauguccggcaaggagaaguccaaguucgacgagauggccaaggccgacaagguccgcuacgaccgcgagaugaaggacuacggccccgccaagggcggcaagaagaagaaggaccccaacgcccccaagcgcccccccuccggcuucuuccucuucugcuccgaguuccgccccaagaucaaguccaccaaccccggcaucuccaucggcgacgucgccaagaagcucggcgagauguggaacaaccucaacgacuccgagaagcagcccuacaucaccaaggccgccaagcucaaggagaaguacgagaaggacgucgccgacuacaaguccaagggcaaguucgacggcgccaagggccccgccaaggucgcccgcaagaaggucgaggaggaggacgaggaggaggaggaggaggaggaggaggaggaggaggaggaggacgaguga

SEQ ID NO: 44223 - RNA, 2667 nt, Artificial Sequence
  derived and/or modified sequence opt2 from HMGCR__Homo_sapiens__NP_000850
augcucucccgccucuuccgcaugcacggccucuucgucgccucccaccccugggaggucaucgucggcaccgucacccucaccaucugcaugauguccaugaacauguucaccggcaacaacaagaucugcggcuggaacuacgagugccccaaguucgaggaggacguccucuccuccgacaucaucauccucaccaucacccgcugcaucgccauccucuacaucuacuuccaguuccagaaccuccgccagcucggcuccaaguacauccucggcaucgccggccucuucaccaucuucuccuccuucgucuucuccaccgucgucauccacuuccucgacaaggagcucaccggccucaacgaggcccuccccuucuuccuccuccucaucgaccucucccgcgccuccacccucgccaaguucgcccucuccuccaacucccaggacgagguccgcgagaacaucgcccgcggcauggccauccucggccccaccuucacccucgacgcccucgucgagugccucgucaucggcgucggcaccauguccggcguccgccagcucgagaucaugugcugcuucggcugcauguccguccucgccaacuacuucgucuucaugaccuucuuccccgccugcgucucccucguccucgagcucucccgcgagucccgcgagggccgccccaucuggcagcucucccacuucgcccgcguccucgaggaggaggagaacaagcccaaccccgucacccagcgcgucaagaugaucaugucccucggccucguccucguccacgcccacucccgcuggaucgccgaccccuccccccagaacuccaccgccgacaccuccaaggucucccucggccucgacgagaacgucuccaagcgcaucgagcccuccgucucccucuggcaguucuaccucuccaagaugaucuccauggacaucgagcaggucaucacccucucccucgcccuccuccucgccgucaaguacaucuucuucgagcagaccgagaccgaguccacccucucccucaagaaccccaucaccucccccgucgucacccagaagaagguccccgacaacugcugccgccgcgagcccaugcucguccgcaacaaccagaagugcgacuccgucgaggaggagaccggcaucaaccgcgagcgcaaggucgaggucaucaagccccucgucgccgagaccgacacccccaaccgcgccaccuucgucgucggcaacuccucccuccucgacaccuccuccguccucgucacccaggagcccgagaucgagcucccccgcgagccccgccccaacgaggagugccuccagauccucggcaacgccgagaagggcgccaaguuccucuccgacgccgagaucauccagcucgucaacgccaagcacauccccgccuacaagcucgagacccucauggagacccacgagcgcggcgucuccauccgccgccagcuccucuccaagaagcucuccgagcccuccucccuccaguaccuccccuaccgcgacuacaacuacucccucgucaugggcgccugcugcgagaacgucaucggcuacaugcccauccccgucggcgucgccggcccccucugccucgacgagaaggaguuccagguccccauggccaccaccgagggcugccucgucgccuccaccaaccgcggcugccgcgccaucggccucggcggcggcgccuccucccgcguccucgccgacggcaugacccgcggccccgucguccgccucccccgcgccugcgacuccgccgaggucaaggccuggcucgagaccuccgagggcuucgccgucaucaaggaggccuucgacuccaccucccgcuucgcccgccuccagaagcuccacaccuccaucgccggccgcaaccucuacauccgcuuccagucccgcuccggcgacgccaugggcaugaacaugaucuccaagggcaccgagaaggcccucuccaagcuccacgaguacuuccccgagaugcagauccucgccgucuccggcaacuacugcaccgacaagaagcccgccgccaucaacuggaucgagggccgcggcaaguccgucgucugcgaggccgucauccccgccaaggucguccgcgagguccucaagaccaccaccgaggccaugaucgaggucaacaucaacaagaaccucgucggcuccgccauggccggcuccaucggcggcuacaacgcccacgccgccaacaucgucaccgccaucuacaucgccugcggccaggacgccgcccagaacgucggcuccuccaacugcaucacccucauggaggccuccggccccaccaacgaggaccucuacaucuccugcaccaugcccuccaucgagaucggcaccgucggcggcggcaccaaccuccucccccagcaggccugccuccagaugcucggcguccagggcgccugcaaggacaaccccggcgagaacgcccgccagcucgcccgcaucgucugcggcaccgucauggccggcgagcucucccucauggccgcccucgccgccggccaccucgucaagucccacaugauccacaaccgcuccaagaucaaccuccaggaccuccagggcgccugcaccaagaagaccgccuga

SEQ ID NO: 44224 - RNA, 1563 nt, Artificial Sequence
  derived and/or modified sequence opt2 from HMGCS1__Homo_sapiens__NP_002121
augcccggcucccucccccucaacgccgaggccugcuggcccaaggacgucggcaucgucgcccucgagaucuacuuccccucccaguacgucgaccaggccgagcucgagaaguacgacggcgucgacgccggcaaguacaccaucggccucggccaggccaagaugggcuucugcaccgaccgcgaggacaucaacucccucugcaugaccgucguccagaaccucauggagcgcaacaaccucuccuacgacugcaucggccgccucgaggucggcaccgagaccaucaucgacaaguccaaguccgucaagaccaaccucaugcagcucuucgaggaguccggcaacaccgacaucgagggcaucgacaccaccaacgccugcuacggcggcaccgccgccgucuucaacgccgucaacuggaucgaguccuccuccugggacggccgcuacgcccucgucgucgccggcgacaucgccgucuacgccaccggcaacgcccgccccaccggcggcgucggcgccgucgcccuccucaucggccccaacgccccccucaucuucgagcgcggccuccgcggcacccacaugcagcacgccuacgacuucuacaagcccgacaugcucuccgaguaccccaucgucgacggcaagcucuccauccagugcuaccucuccgcccucgaccgcugcuacuccgucuacugcaagaagauccacgcccaguggcagaaggagggcaacgacaaggacuucacccucaacgacuucggcuucaugaucuuccacucccccuacugcaagcucguccagaagucccucgcccgcaugcuccucaacgacuuccucaacgaccagaaccgcgacaagaacuccaucuacuccggccucgaggccuucggcgacgucaagcucgaggacaccuacuucgaccgcgacgucgagaaggccuucaugaaggccuccuccgagcucuucucccagaagaccaaggccucccuccucgucuccaaccagaacggcaacauguacaccuccuccgucuacggcucccucgccuccguccucgcccaguacuccccccagcagcucgccggcaagcgcaucggcgucuucuccuacggcuccggccucgccgccacccucuacucccucaaggucacccaggacgccacccccggcuccgcccucgacaagaucaccgccucccucugcgaccucaagucccgccucgacucccgcaccggcgucgcccccgacgucuucgccgagaacaugaagcuccgcgaggacacccaccaccucgucaacuacaucccccagggcuccaucgacucccucuucgagggcaccugguaccucguccgcgucgacgagaagcaccgccgcaccuacgcccgccgccccacccccaacgacgacacccucgacgagggcgucggccucguccacuccaacaucgccaccgagcacauccccucccccgccaagaaggucccccgccuccccgccaccgccgccgagcccgaggccgccgucaucuccaacggcgagcacuga

SEQ ID NO: 44225 - RNA, 303 nt, Artificial Sequence
  derived and/or modified sequence opt2 from HMGN1__Homo_sapiens__NP_004956
augcccaagcgcaaggucuccuccgccgagggcgccgccaaggaggagcccaagcgccgcuccgcccgccucuccgccaagccccccgccaaggucgaggccaagcccaagaaggccgccgccaaggacaaguccuccgacaagaagguccagaccaagggcaagcgcggcgccaagggcaagcaggccgaggucgccaaccaggagaccaaggaggaccuccccgccgagaacggcgagaccaagaccgaggagucccccgccuccgacgaggccggcgagaaggaggccaaguccgacuga

SEQ ID NO: 44226 - RNA, 273 nt, Artificial Sequence
  derived and/or modified sequence opt2 from HMGN4__Homo_sapiens__NP_006344
augcccaagcgcaaggccaagggcgacgccaagggcgacaaggccaaggucaaggacgagccccagcgccgcuccgcccgccucuccgccaagcccgccccccccaagcccgagccccgccccaagaaggccuccgccaagaagggcgagaagcuccccaagggccgcaagggcaaggccgacgccggcaaggacggcaacaaccccgccaagaaccgcgacgccuccacccuccagucccagaaggccgagggcaccggcgacgccaaguga

SEQ ID NO: 44227 - RNA, 849 nt, Artificial Sequence
  derived and/or modified sequence opt2 from HMGN5__Homo_sapiens__NP_110390
augcccaagcgcaaggccgccggccagggcgacaugcgccaggagcccaagcgccgcuccgcccgccucuccgccaugcucguccccgucacccccgaggucaagcccaagcgcaccuccuccucccgcaagaugaagaccaaguccgacaugauggaggagaacaucgacaccuccgcccaggccgucgccgagaccaagcaggaggccgucgucgaggaggacuacaacgagaacgccaagaacggcgaggccaagaucaccgaggcccccgccuccgagaaggagaucgucgaggucaaggaggagaacaucgaggacgccaccgagaagggcggcgagaagaaggaggccgucgccgccgaggucaagaacgaggaggaggaccagaaggaggacgaggaggaccagaacgaggagaagggcgaggccggcaaggaggacaaggacgagaagggcgaggaggacggcaaggaggacaagaacggcaacgagaagggcgaggacgccaaggagaaggaggacggcaagaagggcgaggacggcaagggcaacggcgaggacggcaaggagaagggcgaggacgagaaggaggaggaggaccgcaaggagaccggcgacggcaaggagaacgaggacggcaaggagaagggcgacaagaaggagggcaaggacgucaaggucaaggaggacgagaaggagcgcgaggacggcaaggaggacgagggcggcaacgaggaggaggccggcaaggagaaggaggaccucaaggaggaggaggagggcaaggaggaggacgagaucaaggaggacgacggcaagaaggaggagccccaguccaucgucuga

SEQ ID NO: 44228 - RNA, 3879 nt, Artificial Sequence
  derived and/or modified sequence opt2 from HMGXB3__Homo_sapiens__NP_055798
auggacgccuccuacgacggcaccgaggucaccgucgucauggaggagaucgaggaggccuacugcuacaccucccccggcccccccaagaagaagaagaaguacaagauccacggcgagaagaccaagaagccccgcuccgccuaccuccucuacuacuacgacaucuaccucaagguccagcaggagcucccccaccucccccaguccgagaucaacaagaagaucuccgaguccuggcgccuccucuccgucgccgagcgcuccuacuaccucgagaaggccaagcucgagaaggagggccucgaccccaacuccaagcucuccgcccucaccgccgucguccccgacauccccggcuuccgcaagauccucccccgcuccgacuacaucaucauccccaaguccucccuccaggaggaccgcuccugcccccagcucgagcucugcgucgcccagaaccagaugucccccaagggccccccccucgucuccaacaccgcccccgagaccguccccucccacgccggcauggccgagcagugccucgccgucgaggcccucgccgaggaggucggcgcccucacccaguccggcgccguccaggagaucgccaccuccgagauccucucccaggacguccuccucgaggacgccucccucgaggucggcgagucccaccagcccuaccagaccucccucgucaucgaggagacccucgucaacggcucccccgaccuccccaccggcucccucgccgucccccacccccaggucggcgaguccgucuccgucgucaccgucaugcgcgacuccuccgaguccuccuccuccgcccccgccacccaguucaucaugcucccccuccccgccuacuccgucgucgagaaccccaccuccaucaagcucaccaccaccuacacccgccgcggccacggcaccugcaccucccccggcugcuccuucaccuacgucacccgccacaagccccccaagugccccaccugcggcaacuuccucggcggcaaguggauccccaaggagaagcccgccaaggucaaggucgagcucgccuccggcgucuccuccaagggcuccgucgucaagcgcaaccagcagcccgucaccaccgagcagaacuccuccaaggagaacgccuccaagcucacccucgagaacuccgaggccgucucccagcuccucaacgucgcccccccccgcgaggucggcgaggaguccgagugggaggaggucaucaucuccgacgcccacguccucgucaaggaggcccccggcaacugcggcaccgccgucaccaagacccccgucgucaaguccggcguccagcccgaggucacccucggcaccaccgacaacgacucccccggcgccgacguccccacccccuccgagggcaccuccaccuccuccccccuccccgcccccaagaagcccaccggcgucgaccuccucacccccggcucccgcgcccccgagcucaagggccgcgcccgcggcaagcccucccuccucgccgccgcccgccccaugcgcgccauccuccccgcccccgucaacgucggccgcggcuccuccaugggccucccccgcgcccgccaggccuucucccucuccgacaagacccccuccguccgcaccugcggccucaagcccuccacccucaagcagcucggccagcccauccagcagcccuccggccccggcgaggucaagcuccccuccggccccuccaaccgcaccucccaggucaaggucgucgaggucaagcccgacauguucccccccuacaaguacuccugcaccgucacccucgaccucggccucgccaccucccgcggccgcggcaagugcaagaaccccuccugcuccuacgucuacaccaaccgccacaagccccgcaucugccccuccugcggcgucaaccucgccaaggaccgcaccgagaagaccaccaaggccaucgaggucuccuccccccuccccgacguccucaacgccaccgagccccucuccaccgcccagcgcgagauccagcgccaguccacccuccagcuccuccgcaagguccuccagauccccgagaacgaguccgagcucgccgaggucuucgcccucauccacgagcucaacuccucccgccucauccucuccaacgucuccgaggagaccgucaccaucgagcagaccuccugguccaacuacuacgagucccccuccacccagugccuccucugcuccuccccccucuucaagggcggccagaacucccucgccggcccccaggagugcuggcuccucaccgccucccgccuccagaccgucaccgcccaggucaagaugugccucaacccccacugccucgcccuccacuccuucaucgacaucuacaccggccucuucaacgucggcaacaagcuccucgucucccucgaccuccucuucgccauccgcaaccagaucaagcucggcgaggacccccgcgucuccaucaacgucguccucaaguccguccaggagcagaccgagaagacccucaccuccgaggagcucucccagcuccaggagcuccucugcaacggcuacugggccuucgagugccucaccguccgcgacuacaacgacaugaucugcggcaucugcggcgucgcccccaaggucgagauggcccagcgcuccgaggagaacguccucgcccucaaguccgucgaguucaccuggcccgaguuccucggcuccaacgaggucaacgucgaggacuucugggccaccauggagaccgaggucaucgagcaggucgccuuccccgccuccauccccaucaccaaguucgacgccuccgucaucgcccccuucuuccccccccucaugcgcggcgccgucgucgucaacaccgagaaggacaagaaccucgacguccagcccguccccggcuccggcuccgcccucguccgccuccuccaggagggcaccugcaagcucgacgagaucggcuccuacuccgaggagaagcuccagcaccuccuccgccagugcggcauccccuucggcgccgaggacuccaaggaccagcucugcuucucccuccucgcccucuacgaguccguccagaacggcgcccgcgccauccgccccccccgccacuucaccggcggcaagaucuacaaggucugcccccaccaggucgucugcggcuccaaguaccucguccgcggcgaguccgcccgcgaccacgucgaccuccucgccuccucccgccacuggccccccgucuacgucgucgacauggccaccuccgucgcccucugcgccgaccucugcuaccccgagcucaccaaccagauguggggccgcaaccagggcugcuucuccucccccaccgagccccccgucuccgucuccugccccgagcuccucgaccagcacuacaccgucgacaugaccgagaccgagcacuccauccagcaccccgucaccaagaccgccacccgccgcaucguccacgccggccuccagcccaaccccggcgaccccuccgccggccaccacucccucgcccucugccccgagcucgcccccuacgccaccauccucgccuccaucgucgacuccaagcccaacggcguccgccagcgccccaucgccuucgacaacgccacccacuacuaccucuacaaccgccucauggacuuccucaccucccgcgagaucgucaaccgccagauccacgacaucguccaguccugccagcccggcgaggucgucauccgcgacacccucuaccgccucggcgucgcccagaucaagaccgagaccgaggaggagggcgaggaggaggaggucgccgccgucgccgaguga

SEQ ID NO: 44229 - RNA, 1806 nt, Artificial Sequence
  derived and/or modified sequence opt2 from HMGXB4__Homo_sapiens__NP_001003681
auggccuacgacgacuccgucaagaaggaggacugcuucgacggcgaccacaccuucgaggacaucggccucgccgccggccgcucccagcgcgagaagaagcgcuccuacaaggacuuccuccgcgaggaggaggagaucgccgcccagguccgcaacuccuccaagaagaagcucaaggacuccgagcucuacuuccucggcaccgacacccacaagaagaagcgcaagcacuccuccgacgacuacuacuacggcgacaucuccucccucgaguccucccagaagaagaagaagaaguccuccccccaguccaccgacaccgccauggaccuccucaaggccaucaccuccccccucgccgccggcuccaagcccuccaagaagaccggcgagaaguccuccggcuccuccucccacuccgaguccaagaaggagcaccaccgcaagaaggucuccggcuccuccggcgagcucccccucgaggacggcggcucccacaaguccaagaagaugaagccccucuacgucaacaccgagacccucacccuccgcgagcccgacggccucaagaugaagcucauccucucccccaaggagaagggcuccuccuccgucgacgaggaguccuuccaguaccccucccagcaggccaccgucaagaaguccuccaagaaguccgcccgcgacgagcagggcgcccuccuccucggccacgagcuccaguccuuccucaagaccgcccgcaagaagcacaaguccuccuccgacgcccacuccucccccggccccgagggcugcggcuccgacgccucccaguucgccgagucccacuccgccaaccucgaccucuccggccucgagcccauccucgucgaguccgacuccuccuccggcggcgagcucgaggccggcgagcucgucaucgacgacuccuaccgcgagaucaagaagaagaagaaguccaagaaguccaagaagaagaaggacaaggagaagcacaaggagaagcgccacuccaaguccaagcgcucccucggccucuccgccguccccgucggcgaggucaccgucaccuccggccccccccccuccauccccuacgccggcgccgccgcccccccccucccccuccccggccuccacaccgacggccacuccgagaagaagaagaagaaggaggagaaggacaaggagcgcgagcgcggcgagaagcccaagaagaagaacauguccgccuaccaggucuucugcaaggaguaccgcgucaccaucgucgccgaccaccccggcaucgacuucggcgagcucuccaagaagcucgccgaggucuggaagcagcuccccgagaaggacaagcucaucuggaagcagaaggcccaguaccuccagcacaagcagaacaaggccgaggccaccaccgucaagcgcaaggccuccuccuccgagggcuccaugaaggucaaggccuccuccgucggcguccucuccccccagaagaaguccccccccaccaccaugcuccuccccgccucccccgccaaggcccccgagaccgagcccaucgacgucgccgcccaccuccagcuccucggcgagucccucucccucaucggccaccgccuccaggagaccgagggcauggucgccgucuccggcucccucuccguccuccucgacuccaucaucugcgcccucggcccccucgccugccucaccacccagcuccccgagcucaacggcugccccaagcagguccucuccaacacccucgacaacaucgccuacaucaugcccggccucuga

SEQ ID NO: 44230 - RNA, 3459 nt, Artificial Sequence
  derived and/or modified sequence opt2 from HMHA1__Homo_sapiens__NP_001245257
augucccgcggccagcgcguccucaagggccuccucggcugggucugcaccuggaccugggccuggcgcgcccgccucggcgcccgcggcugcggccuccacguccucugcccccgcgaccucccccucccccccgaggagcucccccgcaaggacggcgccgacgccgucuuccccggccccucccucgagccccccgccggcuccuccggcgucaaggccaccggcacccucaagcgccccaccucccucucccgccacgccuccgccgccggcuucccccucuccggcgccgccuccuggacccucggccgcucccaccgcuccccccucaccgccgccucccccggcgagcuccccaccgagggcgccggccccgacgucgucgaggacaucucccaccuccucgccgacgucgcccgcuucgccgagggccucgagaagcucaaggagugcguccuccgcgacgaccuccucgaggcccgccgcccccgcgcccacgagugccucggcgaggcccuccgcgucaugcaccagaucaucuccaaguacccccuccucaacaccgucgagacccucaccgccgccggcacccucaucgccaaggucaaggccuuccacuacgaguccaacaacgaccucgagaagcaggaguucgagaaggcccucgagaccaucgccgucgccuucuccuccaccgucuccgaguuccucaugggcgaggucgacuccuccacccuccucgccgucccccccggcgacuccucccaguccauggagucccucuacggccccggcuccgagggcaccccccccucccucgaggacugcgacgccggcugccuccccgccgaggaggucgacguccuccuccagcgcugcgagggcggcgucgacgccgcccuccucuacgccaagaacauggccaaguacaugaaggaccucaucuccuaccucgagaagcgcaccacccucgagauggaguucgccaagggccuccagaagaucgcccacaacugccgccaguccgucaugcaggagccccacaugccccuccucuccaucuacucccucgcccucgagcaggaccucgaguucggccacuccaugguccaggccgucggcacccuccagacccagaccuucaugcagccccucacccuccgccgccucgagcacgagaagcgccgcaaggagaucaaggaggccuggcaccgcgcccagcgcaagcuccaggaggccgaguccaaccuccgcaaggccaagcagggcuacguccagcgcugcgaggaccacgacaaggcccgcuuccucgucgccaaggccgaggaggagcaggccggcuccgcccccggcgccggcuccaccgccaccaagacccucgacaagcgccgccgccucgaggaggaggccaagaacaaggccgaggaggccauggccaccuaccgcaccugcgucgccgacgccaagacccagaagcaggagcucgaggacaccaaggucaccgcccuccgccagauccaggaggucauccgccaguccgaccagaccaucaaguccgccaccaucuccuacuaccagaugaugcacaugcagaccgccccccuccccguccacuuccagaugcucugcgaguccuccaagcucuacgaccccggccagcaguacgccucccacguccgccagcuccagcgcgaccaggagcccgacguccacuacgacuucgagccccacgucuccgccaacgccuggucccccgucaugcgcgcccgcaaguccuccuucaacgucuccgacgucgcccgccccgaggccgccggcuccccccccgaggagggcggcugcaccgagggcacccccgccaaggaccaccgcgccggccgcggccaccagguccacaaguccuggccccucuccaucuccgacuccgacuccggccucgaccccggccccggcgccggcgacuucaagaaguucgagcgcaccuccuccuccggcaccauguccuccaccgaggagcucgucgaccccgacggcggcgccggcgccuccgccuucgagcaggccgaccucaacggcaugacccccgagcuccccgucgccguccccuccggccccuuccgccacgagggccucuccaaggccgcccgcacccaccgccuccgcaagcuccgcacccccgccaagugccgcgagugcaacuccuacgucuacuuccagggcgccgagugcgaggagugcugccucgccugccacaagaagugccucgagacccucgccauccagugcggccacaagaagcuccagggccgccuccagcucuucggccaggacuucucccacgccgcccgcuccgcccccgacggcguccccuucaucgucaagaagugcgucugcgagaucgagcgccgcgcccuccgcaccaagggcaucuaccgcgucaacggcgucaagacccgcgucgagaagcucugccaggccuucgagaacggcaaggagcucgucgagcucucccaggccuccccccacgacaucuccaacguccucaagcucuaccuccgccagcuccccgagccccucaucuccuuccgccucuaccacgagcucgucggccucgccaaggacucccucaaggccgaggccgaggccaaggccgccucccgcggccgccaggacggcuccgaguccgaggccgucgccgucgcccucgccggccgccuccgcgagcuccuccgcgaccucccccccgagaaccgcgccucccuccaguaccuccuccgccaccuccgccgcaucgucgaggucgagcaggacaacaagaugacccccggcaaccucggcaucgucuucggccccacccuccuccgcccccgccccaccgaggccaccgucucccucuccucccucgucgacuacccccaccaggcccgcgucaucgagacccucaucguccacuacggccucgucuucgaggaggagcccgaggagacccccggcggccaggacgaguccuccaaccagcgcgccgaggucgucguccagguccccuaccucgaggccggcgaggccgucgucuacccccuccaggaggccgccgccgacggcugccgcgagucccgcgucgucuccaacgacuccgacuccgaccucgaggaggccuccgagcuccucuccuccuccgaggccuccgcccucggccaccucuccuuccucgagcagcagcaguccgaggccucccucgaggucgccuccggcucccacuccggcuccgaggagcagcucgaggccaccgcccgcgaggacggcgacggcgacgaggacggccccgcccagcagcucuccggcuucaacaccaaccaguccaacaacguccuccaggccccccucccccccaugcgccuccgcggcggccgcaugacccucggcuccugccgcgagcgccagcccgaguucgucuga

SEQ ID NO: 44231 - RNA, 2178 nt, Artificial Sequence
  derived and/or modified sequence opt2 from HMMR__Homo_sapiens__NP_001136028
auguccuuccccaaggccccccucaagcgcuucaacgaccccuccggcugcgcccccucccccggcgccuacgacgucaagacccucgagguccucaagggccccgucuccuuccagaagucccagcgcuucaagcagcagaaggaguccaagcagaaccucaacgucgacaaggacaccacccuccccgccuccgcccgcaaggucaaguccuccgaguccaagaaggagucccagaagaacgacaaggaccucaagauccucgagaaggagauccgcguccuccuccaggagcgcggcgcccaggaccgccgcauccaggaccucgagaccgagcucgagaagauggaggcccgccucaacgccgcccuccgcgagaagaccucccucuccgccaacaacgccacccucgagaagcagcucaucgagcucacccgcaccaacgagcuccucaaguccaaguucuccgagaacggcaaccagaagaaccuccgcauccucucccucgagcucaugaagcuccgcaacaagcgcgagaccaagaugcgcggcaugauggccaagcaggagggcauggagaugaagcuccaggucacccagcgcucccucgaggagucccagggcaagaucgcccagcucgagggcaagcucgucuccaucgagaaggagaagaucgacgagaaguccgagaccgagaagcuccucgaguacaucgaggagaucuccugcgccuccgaccaggucgagaaguacaagcucgacaucgcccagcucgaggagaaccucaaggagaagaacgacgagauccucucccucaagcagucccucgaggagaacaucgucauccucuccaagcaggucgaggaccucaacgucaagugccagcuccucgagaaggagaaggaggaccacgucaaccgcaaccgcgagcacaacgagaaccucaacgccgagaugcagaaccucaagcagaaguucauccucgagcagcaggagcgcgagaagcuccagcagaaggagcuccagaucgacucccuccuccagcaggagaaggagcucuccuccucccuccaccagaagcucugcuccuuccaggaggagauggucaaggagaagaaccucuucgaggaggagcucaagcagacccucgacgagcucgacaagcuccagcagaaggaggagcaggccgagcgccucgucaagcagcucgaggaggaggccaagucccgcgccgaggagcucaagcuccucgaggagaagcucaagggcaaggaggccgagcucgagaaguccuccgccgcccacacccaggccacccuccuccuccaggagaaguacgacuccaugguccagucccucgaggacgucaccgcccaguucgaguccuacaaggcccucaccgccuccgagaucgaggaccucaagcucgagaacuccucccuccaggagaaggccgccaaggccggcaagaacgccgaggacguccagcaccagauccucgccaccgaguccuccaaccaggaguacguccgcaugcuccucgaccuccagaccaaguccgcccucaaggagaccgagaucaaggagaucaccgucuccuuccuccagaagaucaccgaccuccagaaccagcucaagcagcaggaggaggacuuccgcaagcagcucgaggacgaggagggccgcaaggccgagaaggagaacaccaccgccgagcucaccgaggagaucaacaaguggcgccuccucuacgaggagcucuacaacaagaccaagcccuuccagcuccagcucgacgccuucgaggucgagaagcaggcccuccucaacgagcacggcgccgcccaggagcagcucaacaagauccgcgacuccuacgccaagcuccucggccaccagaaccucaagcagaagaucaagcacgucgucaagcucaaggacgagaacucccagcucaaguccgaggucuccaagcuccgcugccagcucgccaagaagaagcaguccgagaccaagcuccaggaggagcucaacaagguccucggcaucaagcacuucgaccccuccaaggccuuccaccacgaguccaaggagaacuucgcccucaagaccccccucaaggagggcaacaccaacugcuaccgcgcccccauggagugccaggaguccuggaaguga

SEQ ID NO: 44232 - RNA, 867 nt, Artificial Sequence
  derived and/or modified sequence opt2 from HMOX1__Homo_sapiens__NP_002124
auggagcgcccccagcccgacuccaugccccaggaccucuccgaggcccucaaggaggccaccaaggagguccacacccaggccgagaacgccgaguucaugcgcaacuuccagaagggccaggucacccgcgacggcuucaagcucgucauggccucccucuaccacaucuacgucgcccucgaggaggagaucgagcgcaacaaggagucccccgucuucgcccccgucuacuuccccgaggagcuccaccgcaaggccgcccucgagcaggaccucgccuucugguacggcccccgcuggcaggaggucauccccuacacccccgccaugcagcgcuacgucaagcgccuccacgaggucggccgcaccgagcccgagcuccucgucgcccacgccuacacccgcuaccucggcgaccucuccggcggccagguccucaagaagaucgcccagaaggcccucgaccuccccuccuccggcgagggccucgccuucuucaccuuccccaacaucgccuccgccaccaaguucaagcagcucuaccgcucccgcaugaacucccucgagaugacccccgccguccgccagcgcgucaucgaggaggccaagaccgccuuccuccucaacauccagcucuucgaggagcuccaggagcuccucacccacgacaccaaggaccagucccccucccgcgcccccggccuccgccagcgcgccuccaacaagguccaggacuccgcccccgucgagaccccccgcggcaagcccccccucaacacccgcucccaggccccccuccuccgcuggguccucacccucuccuuccucgucgccaccgucgccgucggccucuacgccauguga

SEQ ID NO: 44233 - RNA, 951 nt, Artificial Sequence
  derived and/or modified sequence opt2 from HMOX2__Homo_sapiens__NP_001120676
auguccgccgaggucgagaccuccgagggcgucgacgaguccgagaagaagaacuccggcgcccucgagaaggagaaccagaugcgcauggccgaccucuccgagcuccucaaggagggcaccaaggaggcccacgaccgcgccgagaacacccaguucgucaaggacuuccucaagggcaacaucaagaaggagcucuucaagcucgccaccaccgcccucuacuucaccuacuccgcccucgaggaggagauggagcgcaacaaggaccaccccgccuucgccccccucuacuuccccauggagcuccaccgcaaggaggcccucaccaaggacauggaguacuucuucggcgagaacugggaggagcagguccagugccccaaggccgcccagaaguacgucgagcgcauccacuacaucggccagaacgagcccgagcuccucgucgcccacgccuacacccgcuacaugggcgaccucuccggcggccagguccucaagaaggucgcccagcgcgcccucaagcuccccuccaccggcgagggcacccaguucuaccucuucgagaacgucgacaacgcccagcaguucaagcagcucuaccgcgcccgcaugaacgcccucgaccucaacaugaagaccaaggagcgcaucgucgaggaggccaacaaggccuucgaguacaacaugcagaucuucaacgagcucgaccaggccggcuccacccucgcccgcgagacccucgaggacggcuuccccguccacgacggcaagggcgacaugcgcaagugccccuucuacgccgccgagcaggacaagggcgcccucgagggcuccuccugccccuuccgcaccgccauggccguccuccgcaagcccucccuccaguucauccucgccgccggcgucgcccucgccgccggccuccucgccugguacuacauguga

SEQ ID NO: 44234 - RNA, 516 nt, Artificial Sequence
  derived and/or modified sequence opt2 from HMP19__Homo_sapiens__NP_057064
auggucaagcucaacuccaaccccuccgagaagggcaccaagccccccuccgucgaggacggcuuccagaccgucccccucaucaccccccucgaggucaaccaccuccagcuccccgcccccgagaaggucaucgucaagacccgcaccgaguaccagcccgagcagaagaacaagggcaaguuccgcguccccaagaucgccgaguucaccgucaccauccucgucucccucgcccucgccuuccucgccugcaucgucuuccucgucgucuacaaggccuucaccuacgaccacuccugccccgagggcuucgucuacaagcacaagcgcugcauccccgccucccucgacgccuacuacuccucccaggaccccaacucccgcucccgcuucuacaccgucaucucccacuacuccgucgccaagcaguccaccgcccgcgccaucggccccuggcucuccgccgccgccgucauccacgagcccaagccccccaagacccagggccacuga

SEQ ID NO: 44235 - RNA, 420 nt, Artificial Sequence
  derived and/or modified sequence opt2 from HMSD__Homo_sapiens__NP_001116838
auguccaucuccuccgcccucgccauggucuucaugggcgccaagggcaacaccgccgcccagaugucccaggcccucugcuucuccaagaucggcggcgaggacggcgacauccaccgcggcuuccagucccuccucgucgccaucaaccgcaccgacaccgaguacguccuccgcaccgccaacggccucuucggcgagaaguccuacgacuuccucaccggcuucaccgacuccugcggcaaguucuaccaggccaccaucaagcagcucgacuucgucaacgacaccgagaaguccaccacccgcgucaacuccugggucgccgacaagaccaagggcgagaacauccuccucuucuacuucgacaacauccucaacuccuucaucgucuccucccuccagaacugccagaucuga

SEQ ID NO: 44236 - RNA, 1047 nt, Artificial Sequence
  derived and/or modified sequence opt2 from HMX1__Homo_sapiens__NP_061815
augcccgacgagcucaccgagcccggccgcgccacccccgcccgcgccuccuccuuccucaucgagaaccuccucgccgccgaggccaagggcgccggccgcgccacccagggcgacggcucccgcgaggacgaggaggaggacgacgacgaccccgaggacgaggacgccgagcaggcccgccgccgccgccuccagcgccgccgccagcuccucgccggcaccggccccggcggcgaggcccgcgcccgcgcccuccucggccccggcgcccucggccucggcccccgccccccccccggccccggcccccccuucgcccucggcugcggcggcgccgcccgcugguacccccgcgcccacggcggcuacggcggcggccucucccccgacaccuccgaccgcgacucccccgagaccggcgaggagaugggccgcgccgagggcgccuggccccgcggccccggccccggcgccguccagcgcgaggccgccgagcucgccgcccgcggccccgccgccggcaccgaggaggccuccgagcucgccgagguccccgccgccgccggcgagacccgcggcggcgucggcgucggcggcggccgcaagaagaagacccgcaccgucuucucccgcucccaggucuuccagcucgaguccaccuucgaccucaagcgcuaccucuccuccgccgagcgcgccggccucgccgccucccuccagcucaccgagacccaggucaagaucugguuccagaaccgccgcaacaaguggaagcgccagcucgccgccgagcucgaggccgccucccucuccccccccggcgcccagcgccucguccgcguccccguccucuaccacgaguccccccccgccgccgccgccgccggcccccccgccacccuccccuucccccucgcccccgccgcccccgcccccccccccccccuccucggcuucuccggcgcccucgccuacccccucgccgccuuccccgccgccgccuccguccccuuccuccgcgcccagaugcccggccucgucuga

SEQ ID NO: 44237 - RNA, 546 nt, Artificial Sequence
  derived and/or modified sequence opt2 from HN1__Homo_sapiens__NP_001002032
augaccaccaccaccaccuucaagggcgucgaccccaacucccgcaacuccucccgcguccuccgcccccccggcggcggcuccaacuucucccucggcuucgacgagcccaccgagcagcccguccgcaagaacaagauggccuccaacaucuucggcacccccgaggagaaccaggccuccugggccaaguccgccggcgccaaguccuccggcggccgcgaggaccucgaguccuccggccuccagcgccgcaacuccuccgaggccuccuccggcgacuuccucgaccucaagaagauguggacccagaccugccaggccgccuggggccgcgucaagcgcucccccugccuccuccgccucugccccgcccgcuggccccgcccccagugccaccccgaggagaucccccucgccgccucccccgccuccuccugggucuccuccgacugccccgagcgcugccgcuccgucugcuuccuccacgccugcgagcuccacaaccucucccucaccguccaccuccucgaccucuuccacuga

SEQ ID NO: 44238 - RNA, 573 nt, Artificial Sequence
  derived and/or modified sequence opt2 from HN1L__Homo_sapiens__NP_653171
auguuccagguccccgacuccgagggcggccgcgccggcucccgcgccaugaagccccccggcggcgaguccuccaaccucuucggcucccccgaggaggccacccccuccucccgccccaaccgcauggccuccaacaucuucggccccaccgaggagccccagaacauccccaagcgcaccaacccccccggcggcaagggcuccggcaucuucgacgaguccacccccguccagacccgccagcaccucaacccccccggcggcaagaccuccgacaucuucggcucccccgucaccgccaccucccgccucgcccaccccaacaagcccaaggaccacgucuuccucugcgagggcgaggagcccaaguccgaccucaaggccgcccgcuccauccccgccggcgccgagcccggcgagaagggcuccgcccgcaaggccggccccgccaaggagcaggagcccaugcccaccgucgacucccacgagccccgccucggcccccgcccccgcucccacaacaagguccucaacccccccggcggcaaguccuccaucuccuucuacuga

SEQ ID NO: 44239 - RNA, 1896 nt, Artificial Sequence
  derived and/or modified sequence opt2 from HNF1A__Homo_sapiens__NP_000536
auggucuccaagcucucccagcuccagaccgagcuccucgccgcccuccucgaguccggccucuccaaggaggcccucauccaggcccucggcgagcccggccccuaccuccucgccggcgagggcccccucgacaagggcgaguccugcggcggcggccgcggcgagcucgccgagcuccccaacggccucggcgagacccgcggcuccgaggacgagaccgacgacgacggcgaggacuucaccccccccauccucaaggagcucgagaaccucucccccgaggaggccgcccaccagaaggccgucgucgagacccuccuccaggaggaccccuggcgcgucgccaagauggucaaguccuaccuccagcagcacaacaucccccagcgcgaggucgucgacaccaccggccucaaccagucccaccucucccagcaccucaacaagggcacccccaugaagacccagaagcgcgccgcccucuacaccugguacguccgcaagcagcgcgaggucgcccagcaguucacccacgccggccagggcggccucaucgaggagcccaccggcgacgagcuccccaccaagaagggccgccgcaaccgcuucaaguggggccccgccucccagcagauccucuuccaggccuacgagcgccagaagaaccccuccaaggaggagcgcgagacccucgucgaggagugcaaccgcgccgagugcauccagcgcggcgucucccccucccaggcccagggccucggcuccaaccucgucaccgagguccgcgucuacaacugguucgccaaccgccgcaaggaggaggccuuccgccacaagcucgccauggacaccuacuccggccccccccccggccccggccccggccccgcccuccccgcccacuccucccccggccuccccccccccgcccucucccccuccaagguccacggcguccgcuacggccagcccgccaccuccgagaccgccgagguccccuccuccuccggcggcccccucgucaccgucuccaccccccuccaccaggucucccccaccggccucgagcccucccacucccuccucuccaccgaggccaagcucgucuccgccgccggcggcccccucccccccgucuccacccucaccgcccuccacucccucgagcagaccucccccggccucaaccagcagccccagaaccucaucauggccucccuccccggcgucaugaccaucggccccggcgagcccgccucccucggccccaccuucaccaacaccggcgccuccacccucgucaucggccucgccuccacccaggcccaguccguccccgucaucaacuccaugggcuccucccucaccacccuccagcccguccaguucucccagccccuccaccccuccuaccagcagccccucaugccccccguccagucccacgucacccagucccccuucauggccaccauggcccagcuccaguccccccacgcccucuacucccacaagcccgaggucgcccaguacacccacaccggccuccucccccagaccaugcucaucaccgacaccaccaaccucuccgcccucgccucccucacccccaccaagcaggucuucaccuccgacaccgaggccuccuccgaguccggccuccacacccccgccucccaggccaccacccuccacguccccucccaggaccccgccggcauccagcaccuccagcccgcccaccgccucuccgccucccccaccgucuccuccuccucccucguccucuaccaguccuccgacuccuccaacggccagucccaccuccuccccuccaaccacuccgucaucgagaccuucaucuccacccagauggccuccuccucccaguga

SEQ ID NO: 44240 - RNA, 1674 nt, Artificial Sequence
  derived and/or modified sequence opt2 from HNF1B__Homo_sapiens__NP_000449
auggucuccaagcucaccucccuccagcaggagcuccucuccgcccuccucuccuccggcgucaccaaggagguccucguccaggcccucgaggagcuccuccccucccccaacuucggcgucaagcucgagacccucccccucucccccggcuccggcgccgagcccgacaccaagcccgucuuccacacccucaccaacggccacgccaagggccgccucuccggcgacgagggcuccgaggacggcgacgacuacgacaccccccccauccucaaggagcuccaggcccucaacaccgaggaggccgccgagcagcgcgccgaggucgaccgcaugcucuccgaggaccccuggcgcgccgccaagaugaucaagggcuacaugcagcagcacaacaucccccagcgcgaggucgucgacgucaccggccucaaccagucccaccucucccagcaccucaacaagggcacccccaugaagacccagaagcgcgccgcccucuacaccugguacguccgcaagcagcgcgagauccuccgccaguucaaccagaccguccaguccuccggcaacaugaccgacaaguccucccaggaccagcuccucuuccucuuccccgaguucucccagcagucccacggccccggccaguccgacgacgccugcuccgagcccaccaacaagaagaugcgccgcaaccgcuucaaguggggccccgccucccagcagauccucuaccaggccuacgaccgccagaagaaccccuccaaggaggagcgcgaggcccucgucgaggagugcaaccgcgccgagugccuccagcgcggcgucucccccuccaaggcccacggccucggcuccaaccucgucaccgagguccgcgucuacaacugguucgccaaccgccgcaaggaggaggccuuccgccagaagcucgccauggacgccuacuccuccaaccagacccacucccucaacccccuccucucccacggcuccccccaccaccagcccuccuccuccccccccaacaagcucuccggcguccgcuacucccagcagggcaacaacgagaucaccuccuccuccaccaucucccaccacggcaacuccgccauggucaccucccaguccguccuccagcaggucucccccgccucccucgaccccggccacaaccuccucucccccgacggcaagaugaucuccgucuccggcggcggccucccccccgucuccacccucaccaacauccacucccucucccaccacaacccccagcagucccagaaccucaucaugaccccccucuccggcgucauggccaucgcccagucccucaacaccucccaggcccaguccguccccgucaucaacuccgucgccggcucccucgccgcccuccagcccguccaguucucccagcagcuccacuccccccaccagcagccccucaugcagcagucccccggcucccacauggcccagcagcccuucauggccgccgucacccagcuccagaacucccacauguacgcccacaagcaggagcccccccaguacucccacaccucccgcuuccccuccgccauggucgucaccgacaccuccuccaucuccacccucaccaacauguccuccuccaagcagugcccccuccaggccugguga

SEQ ID NO: 44241 - RNA, 1425 nt, Artificial Sequence
  derived and/or modified sequence opt2 from HNF4A__Homo_sapiens__NP_000448
augcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucuga

SEQ ID NO: 44242 - RNA, 1338 nt, Artificial Sequence
  derived and/or modified sequence opt2 from HNF4G__Homo_sapiens__NP_004124
auggacauggccaacuacuccgagguccucgaccccaccuacaccacccucgaguucgagaccaugcagauccucuacaacuccuccgacuccuccgcccccgagaccuccaugaacaccaccgacaacggcgucaacugccucugcgccaucugcggcgaccgcgccaccggcaagcacuacggcgccuccuccugcgacggcugcaagggcuucuuccgccgcuccauccgcaagucccacgucuacuccugccgcuucucccgccagugcgucgucgacaaggacaagcgcaaccagugccgcuacugccgccuccgcaagugcuuccgcgccggcaugaagaaggaggccguccagaacgagcgcgaccgcaucuccacccgccgcuccaccuucgacggcuccaacauccccuccaucaacacccucgcccaggccgagguccgcucccgccagaucuccgucuccucccccggcuccuccaccgacaucaacgucaagaagaucgccuccaucggcgacgucugcgaguccaugaagcagcagcuccucguccucgucgagugggccaaguacauccccgccuucugcgagcucccccucgacgaccaggucgcccuccuccgcgcccacgccggcgagcaccuccuccucggcgccaccaagcgcuccaugauguacaaggacauccuccuccucggcaacaacuacgucauccaccgcaacuccugcgaggucgagaucucccgcgucgccaaccgcguccucgacgagcucguccgccccuuccaggagauccagaucgacgacaacgaguacgccugccucaaggccaucgucuucuucgaccccgacgccaagggccucuccgaccccgucaagaucaagaacaugcgcuuccagguccagaucggccucgaggacuacaucaacgaccgccaguacgacucccgcggccgcuucggcgagcuccuccuccuccuccccacccuccaguccaucaccuggcagaugaucgagcagauccaguucgucaagcucuucggcauggucaagaucgacaaccuccuccaggagaugcuccucggcggcgccuccaacgacggcucccaccuccaccaccccaugcacccccaccucucccaggacccccucaccggccagaccauccuccucggccccauguccacccucguccacgccgaccagaucuccacccccgagaccccccuccccucccccccccagggcuccggccaggagcaguacaagaucgccgccaaccaggccuccgucaucucccaccagcaccucuccaagcagaagcagcucuga

SEQ ID NO: 44243 - RNA, 156 nt, Artificial Sequence
  derived and/or modified sequence opt2 from HNMT__Homo_sapiens__NP_001019245
auggccuccuccaugcgcucccucuucuccgaccacggcaaguacgucgaguccuuccgccgcuuccucaaccacuccaccgagcaccagugcaugcaggaguucauggacaagaagcuccccggcaucaucggccgcuaccagaacugcugcuga

SEQ ID NO: 44244 - RNA, 918 nt, Artificial Sequence
  derived and/or modified sequence opt2 from HNRNPA0__Homo_sapiens__NP_006796
auggagaacucccagcucugcaagcucuucaucggcggccucaacguccagaccuccgaguccggccuccgcggccacuucgaggccuucggcacccucaccgacugcgucgucgucgucaacccccagaccaagcgcucccgcugcuucggcuucgucaccuacuccaacgucgaggaggccgacgccgccauggccgccuccccccacgccgucgacggcaacaccgucgagcucaagcgcgccgucucccgcgaggacuccgcccgccccggcgcccacgccaaggucaagaagcucuucgucggcggccucaagggcgacgucgccgagggcgaccucaucgagcacuucucccaguucggcaccgucgagaaggccgagaucaucgccgacaagcaguccggcaagaagcgcggcuucggcuucgucuacuuccagaaccacgacgccgccgacaaggccgccgucgucaaguuccaccccauccagggccaccgcgucgaggucaagaaggccguccccaaggaggacaucuacuccggcggcggcggcggcggcucccgcuccucccgcggcggccgcggcggccgcggccgcggcggcggccgcgaccagaacggccucuccaagggcggcggcggcggcuacaacuccuacggcggcuacggcggcggcggcggcggcggcuacaacgccuacggcggcggcggcggcggcuccuccuacggcggcuccgacuacggcaacggcuucggcggcuucggcuccuacucccagcaccaguccuccuacggccccaugaaguccggcggcggcggcggcggcggcggcuccuccuggggcggccgcuccaacuccggccccuaccgcggcggcuacggcggcggcggcggcuacggcggcuccuccuucuga

SEQ ID NO: 44245 - RNA, 963 nt, Artificial Sequence
  derived and/or modified sequence opt2 from HNRNPA1__Homo_sapiens__NP_002127
auguccaaguccgagucccccaaggagcccgagcagcuccgcaagcucuucaucggcggccucuccuucgagaccaccgacgagucccuccgcucccacuucgagcaguggggcacccucaccgacugcgucgucaugcgcgaccccaacaccaagcgcucccgcggcuucggcuucgucaccuacgccaccgucgaggaggucgacgccgccaugaacgcccgcccccacaaggucgacggccgcgucgucgagcccaagcgcgccgucucccgcgaggacucccagcgccccggcgcccaccucaccgucaagaagaucuucgucggcggcaucaaggaggacaccgaggagcaccaccuccgcgacuacuucgagcaguacggcaagaucgaggucaucgagaucaugaccgaccgcggcuccggcaagaagcgcggcuucgccuucgucaccuucgacgaccacgacuccgucgacaagaucgucauccagaaguaccacaccgucaacggccacaacugcgagguccgcaaggcccucuccaagcaggagauggccuccgccuccuccucccagcgcggccgcuccggcuccggcaacuucggcggcggccgcggcggcggcuucggcggcaacgacaacuucggccgcggcggcaacuucuccggccgcggcggcuucggcggcucccgcggcggcggcggcuacggcggcuccggcgacggcuacaacggcuucggcaacgacggcuccaacuucggcggcggcggcuccuacaacgacuucggcaacuacaacaaccaguccuccaacuucggccccaugaagggcggcaacuucggcggccgcuccuccggccccuacggcggcggcggccaguacuucgccaagccccgcaaccagggcggcuacggcggcuccuccuccuccuccuccuacggcuccggccgccgcuucuga

SEQ ID NO: 44246 - RNA, 1026 nt, Artificial Sequence
  derived and/or modified sequence opt2 from HNRNPA2B1__Homo_sapiens__NP_002128
auggagcgcgagaaggagcaguuccgcaagcucuucaucggcggccucuccuucgagaccaccgaggagucccuccgcaacuacuacgagcaguggggcaagcucaccgacugcgucgucaugcgcgaccccgccuccaagcgcucccgcggcuucggcuucgucaccuucuccuccauggccgaggucgacgccgccauggccgcccgcccccacuccaucgacggccgcgucgucgagcccaagcgcgccgucgcccgcgaggaguccggcaagcccggcgcccacgucaccgucaagaagcucuucgucggcggcaucaaggaggacaccgaggagcaccaccuccgcgacuacuucgaggaguacggcaagaucgacaccaucgagaucaucaccgaccgccaguccggcaagaagcgcggcuucggcuucgucaccuucgacgaccacgaccccgucgacaagaucguccuccagaaguaccacaccaucaacggccacaacgccgagguccgcaaggcccucucccgccaggagaugcaggagguccaguccucccgcuccggccgcggcggcaacuucggcuucggcgacucccgcggcggcggcggcaacuucggccccggccccggcuccaacuuccgcggcggcuccgacggcuacggcuccggccgcggcuucggcgacggcuacaacggcuacggcggcggccccggcggcggcaacuucggcggcucccccggcuacggcggcggccgcggcggcuacggcggcggcggccccggcuacggcaaccagggcggcggcuacggcggcggcuacgacaacuacggcggcggcaacuacggcuccggcaacuacaacgacuucggcaacuacaaccagcagcccuccaacuacggccccaugaaguccggcaacuucggcggcucccgcaacaugggcggccccuacggcggcggcaacuacggccccggcggcuccggcggcuccggcggcuacggcggccgcucccgcuacuga

SEQ ID NO: 44247 - RNA, 1137 nt, Artificial Sequence
  derived and/or modified sequence opt2 from HNRNPA3__Homo_sapiens__XP_005246437
auggaggucaagcccccccccggccgcccccagcccgacuccggccgccgccgccgccgccgcggcgaggagggccacgaccccaaggagcccgagcagcuccgcaagcucuucaucggcggccucuccuucgagaccaccgacgacucccuccgcgagcacuucgagaaguggggcacccucaccgacugcgucgucaugcgcgacccccagaccaagcgcucccgcggcuucggcuucgucaccuacuccugcgucgaggaggucgacgccgccaugugcgcccgcccccacaaggucgacggccgcgucgucgagcccaagcgcgccgucucccgcgaggacuccgucaagcccggcgcccaccucaccgucaagaagaucuucgucggcggcaucaaggaggacaccgaggaguacaaccuccgcgacuacuucgagaaguacggcaagaucgagaccaucgaggucauggaggaccgccaguccggcaagaagcgcggcuucgccuucgucaccuucgacgaccacgacaccgucgacaagaucgucguccagaaguaccacaccaucaacggccacaacugcgaggucaagaaggcccucuccaagcaggagaugcaguccgccggcucccagcgcggccgcggcggcggcuccggcaacuucaugggccgcggcggcaacuucggcggcggcggcggcaacuucggccgcggcggcaacuucggcggccgcggcggcuacggcggcggcggcggcggcucccgcggcuccuacggcggcggcgacggcggcuacaacggcuucggcggcgacggcggcaacuacggcggcggccccggcuacuccucccgcggcggcuacggcggcggcggccccggcuacggcaaccagggcggcggcuacggcggcggcggcggcuacgacggcuacaacgagggcggcaacuucggcggcggcaacuacggcggcggcggcaacuacaacgacuucggcaacuacuccggccagcagcaguccaacuacggccccaugaagggcggcuccuucggcggccgcuccuccggcucccccuacggcggcggcuacggcuccggcggcggcuccggcggcuacggcucccgccgcuucuga

SEQ ID NO: 44248 - RNA, 858 nt, Artificial Sequence
  derived and/or modified sequence opt2 from HNRNPAB__Homo_sapiens__NP_004490
auguccgaggccggcgaggagcagcccauggagaccaccggcgccaccgagaacggccacgaggccguccccgagggcgagucccccgccggcgccggcaccggcgccgccgccggcgccggcggcgccaccgccgccccccccuccggcaaccagaacggcgccgagggcgaccagaucaacgccuccaagaacgaggaggacgccggcaagauguucgucggcggccucuccugggacaccuccaagaaggaccucaaggacuacuucaccaaguucggcgaggucgucgacugcaccaucaagauggaccccaacaccggccgcucccgcggcuucggcuucauccucuucaaggacgccgccuccgucgagaagguccucgaccagaaggagcaccgccucgacggccgcgucaucgaccccaagaaggccauggccaugaagaaggaccccgucaagaagaucuucgucggcggccucaaccccgaggccaccgaggagaagauccgcgaguacuucggcgaguucggcgagaucgaggccaucgagcuccccauggaccccaagcucaacaagcgccgcggcuucgucuucaucaccuucaaggaggaggagcccgucaagaagguccucgagaagaaguuccacaccgucuccggcuccaagugcgagaucaaggucgcccagcccaaggaggucuaccagcagcagcaguacggcuccggcggccgcggcaaccgcaaccgcggcaaccgcggcuccggcggcggcggcggcggcggcggccagggcuccaccaacuacggcaagucccagcgccgcggcggccaccagaacaacuacaagcccuacuga

SEQ ID NO: 44249 - RNA, 921 nt, Artificial Sequence
  derived and/or modified sequence opt2 from HNRNPC__Homo_sapiens__XP_011535013
auggccuccaacgucaccaacaagaccgacccccgcuccaugaacucccgcgucuucaucggcaaccucaacacccucgucgucaagaaguccgacgucgaggccaucuucuccaaguacggcaagaucgucggcugcuccguccacaagggcuucgccuucguccaguacgucaacgagcgcaacgcccgcgccgccgucgccggcgaggacggccgcaugaucgccggccagguccucgacaucaaccucgccgccgagcccaaggucaaccgcggcaaggccggcgucaagcgcuccgccgccgagauguacggcuccgucaccgagcaccccucccccuccccccuccucuccuccuccuucgaccucgacuacgacuuccagcgcgacuacuacgaccgcauguacuccuaccccgcccgcguccccccccccccccccaucgcccgcgccgucguccccuccaagcgccagcgcgucuccggcaacaccucccgccgcggcaaguccggcuucaacuccaaguccggccagcgcggcuccuccaaguccggcaagcucaagggcgacgaccuccaggccaucaagaaggagcucacccagaucaagcagaaggucgacucccuccucgagaaccucgagaagaucgagaaggagcaguccaagcaggccgucgagaugaagaacgacaaguccgaggaggagcaguccuccuccuccgucaagaaggacgagaccaacgucaagauggaguccgagggcggcgccgacgacuccgccgaggagggcgaccuccucgacgacgacgacaacgaggaccgcggcgacgaccagcucgagcucaucaaggacgacgagaaggaggccgaggagggcgaggacgaccgcgacuccgccaacggcgaggacgacuccuga

SEQ ID NO: 44250 - RNA, 864 nt, Artificial Sequence
  derived and/or modified sequence opt2 from HNRNPD__Homo_sapiens__NP_001003810
auguccgaggagcaguucggcggcgacggcgccgccgccgccgccaccgccgccgucggcggcuccgccggcgagcaggagggcgccauggucgccgccacccagggcgccgccgccgccgccggcuccggcgccggcaccggcggcggcaccgccuccggcggcaccgagggcggcuccgccgaguccgagggcgccaagaucgacgccuccaagaacgaggaggacgagggcaagauguucaucggcggccucuccugggacaccaccaagaaggaccucaaggacuacuucuccaaguucggcgaggucgucgacugcacccucaagcucgaccccaucaccggccgcucccgcggcuucggcuucguccucuucaaggaguccgaguccgucgacaaggucauggaccagaaggagcacaagcucaacggcaaggucaucgaccccaagcgcgccaaggccaugaagaccaaggagcccgucaagaagaucuucgucggcggccucucccccgacacccccgaggagaagauccgcgaguacuucggcggcuucggcgaggucgaguccaucgagcuccccauggacaacaagaccaacaagcgccgcggcuucugcuucaucaccuucaaggaggaggagcccgucaagaagaucauggagaagaaguaccacaacgucggccucuccaagugcgagaucaaggucgccauguccaaggagcaguaccagcagcagcagcaguggggcucccgcggcggcuucgccggccgcgcccgcggccgcggcggcgaccagcaguccggcuacggcaaggucucccgccgcggcggccaccagaacuccuacaagcccuacuga

SEQ ID NO: 44251 - RNA, 1092 nt, Artificial Sequence
  derived and/or modified sequence opt2 from HNRNPDL__Homo_sapiens__NP_001193929
auggagguccccccccgccucucccacgucccccccccccucuuccccuccgcccccgccacccucgccucccgcucccucucccacuggcgcccccgccccccccgccagcucgccccccuccuccccucccucgcccccuccuccgcccgccagggcgcccgccgcgcccagcgccacgucaccgcccagcagcccucccgccucgccggcggcgccgccaucaagggcggccgccgccgccgccccgaccucuuccgccgccacuucaaguccuccuccauccagcgcuccgccgccgccgccgccgccacccgcaccgcccgccagcacccccccgccgacuccuccgucaccauggaggacaugaacgaguacuccaacaucgaggaguucgccgagggcuccaagaucaacgccuccaagaaccagcaggacgacggcaagauguucaucggcggccucuccugggacaccuccaagaaggaccucaccgaguaccucucccgcuucggcgaggucgucgacugcaccaucaagaccgaccccgucaccggccgcucccgcggcuucggcuucguccucuucaaggacgccgccuccgucgacaagguccucgagcucaaggagcacaagcucgacggcaagcucaucgaccccaagcgcgccaaggcccucaagggcaaggagccccccaagaaggucuucgucggcggccucucccccgacaccuccgaggagcagaucaaggaguacuucggcgccuucggcgagaucgagaacaucgagcuccccauggacaccaagaccaacgagcgccgcggcuucugcuucaucaccuacaccgacgaggagcccgucaagaagcuccucgagucccgcuaccaccagaucggcuccggcaagugcgagaucaaggucgcccagcccaaggaggucuaccgccagcagcagcagcagcagaagggcggccgcggcgccgccgccggcggccgcggcggcacccgcggccgcggccgcggccagcaguccaccuacggcaaggccucccgcggcggcggcaaccaccagaacaacuaccagcccuacuga

SEQ ID NO: 44252 - RNA, 1248 nt, Artificial Sequence
  derived and/or modified sequence opt2 from HNRNPF__Homo_sapiens__NP_001091676
augaugcucggccccgagggcggcgagggcuucgucgucaagcuccgcggccuccccugguccugcuccgucgaggacguccagaacuuccucuccgacugcaccauccacgacggcgccgccggcguccacuucaucuacacccgcgagggccgccaguccggcgaggccuucgucgagcucggcuccgaggacgacgucaagauggcccucaagaaggaccgcgaguccaugggccaccgcuacaucgaggucuucaagucccaccgcaccgagauggacuggguccucaagcacuccggccccaacuccgccgacuccgccaacgacggcuucguccgccuccgcggccuccccuucggcugcaccaaggaggagaucguccaguucuucuccggccucgagaucguccccaacggcaucacccuccccgucgaccccgagggcaagaucaccggcgaggccuucguccaguucgccucccaggagcucgccgagaaggcccucggcaagcacaaggagcgcaucggccaccgcuacaucgaggucuucaaguccucccaggaggagguccgcuccuacuccgaccccccccucaaguucauguccguccagcgccccggccccuacgaccgccccggcaccgcccgccgcuacaucggcaucgucaagcaggccggccucgagcgcaugcgccccggcgccuacuccaccggcuacggcggcuacgaggaguacuccggccucuccgacggcuacggcuucaccaccgaccucuucggccgcgaccucuccuacugccucuccggcauguacgaccaccgcuacggcgacuccgaguucaccguccaguccaccaccggccacugcguccacaugcgcggccuccccuacaaggccaccgagaacgacaucuacaacuucuucuccccccucaaccccguccgcguccacaucgagaucggccccgacggccgcgucaccggcgaggccgacgucgaguucgccacccacgaggaggccgucgccgccauguccaaggaccgcgccaacaugcagcaccgcuacaucgagcucuuccucaacuccaccaccggcgccuccaacggcgccuacuccucccaggucaugcagggcaugggcgucuccgccgcccaggccaccuacuccggccucgagucccaguccgucuccggcugcuacggcgccggcuacuccggccagaacuccaugggcggcuacgacuga

SEQ ID NO: 44253 - RNA, 1350 nt, Artificial Sequence
  derived and/or modified sequence opt2 from HNRNPH1__Homo_sapiens__NP_005511
augaugcucggcaccgagggcggcgagggcuucgucgucaagguccgcggccuccccugguccugcuccgccgacgagguccagcgcuucuucuccgacugcaagauccagaacggcgcccagggcauccgcuucaucuacacccgcgagggccgccccuccggcgaggccuucgucgagcucgaguccgaggacgaggucaagcucgcccucaagaaggaccgcgagaccaugggccaccgcuacgucgaggucuucaaguccaacaacgucgagauggacuggguccucaagcacaccggccccaacucccccgacaccgccaacgacggcuucguccgccuccgcggccuccccuucggcugcuccaaggaggagaucguccaguucuucuccggccucgagaucguccccaacggcaucacccuccccgucgacuuccagggccgcuccaccggcgaggccuucguccaguucgccucccaggagaucgccgagaaggcccucaagaagcacaaggagcgcaucggccaccgcuacaucgagaucuucaaguccucccgcgccgagguccgcacccacuacgaccccccccgcaagcucauggccaugcagcgccccggccccuacgaccgccccggcgccggccgcggcuacaacuccaucggccgcggcgccggcuucgagcgcaugcgccgcggcgccuacggcggcggcuacggcggcuacgacgacuacaacggcuacaacgacggcuacggcuucggcuccgaccgcuucggccgcgaccucaacuacugcuucuccggcauguccgaccaccgcuacggcgacggcggcuccaccuuccaguccaccaccggccacugcguccacaugcgcggccuccccuaccgcgccaccgagaacgacaucuacaacuucuucuccccccucaaccccguccgcguccacaucgagaucggccccgacggccgcgucaccggcgaggccgacgucgaguucgccacccacgaggacgccgucgccgccauguccaaggacaaggccaacaugcagcaccgcuacgucgagcucuuccucaacuccaccgccggcgccuccggcggcgccuacgagcaccgcuacgucgagcucuuccucaacuccaccgccggcgccuccggcggcgccuacggcucccagaugaugggcggcaugggccucuccaaccaguccuccuacggcggccccgccucccagcagcucuccggcggcuacggcggcggcuacggcggccaguccuccauguccggcuacgaccagguccuccaggagaacuccuccgacuuccaguccaacaucgccuga

SEQ ID NO: 44254 - RNA, 1350 nt, Artificial Sequence
  derived and/or modified sequence opt2 from HNRNPH2__Homo_sapiens__NP_001027565
augaugcucuccaccgagggccgcgagggcuucgucgucaagguccgcggccuccccugguccugcuccgccgacgaggucaugcgcuucuucuccgacugcaagauccagaacggcaccuccggcauccgcuucaucuacacccgcgagggccgccccuccggcgaggccuucgucgagcucgaguccgaggaggaggucaagcucgcccucaagaaggaccgcgagaccaugggccaccgcuacgucgaggucuucaaguccaacuccgucgagauggacuggguccucaagcacaccggccccaacucccccgacaccgccaacgacggcuucguccgccuccgcggccuccccuucggcugcuccaaggaggagaucguccaguucuucuccggccucgagaucguccccaacggcaugacccuccccgucgacuuccagggccgcuccaccggcgaggccuucguccaguucgccucccaggagaucgccgagaaggcccucaagaagcacaaggagcgcaucggccaccgcuacaucgagaucuucaaguccucccgcgccgagguccgcacccacuacgaccccccccgcaagcucauggccaugcagcgccccggccccuacgaccgccccggcgccggccgcggcuacaacuccaucggccgcggcgccggcuucgagcgcaugcgccgcggcgccuacggcggcggcuacggcggcuacgacgacuacggcggcuacaacgacggcuacggcuucggcuccgaccgcuucggccgcgaccucaacuacugcuucuccggcauguccgaccaccgcuacggcgacggcggcuccuccuuccaguccaccaccggccacugcguccacaugcgcggccuccccuaccgcgccaccgagaacgacaucuacaacuucuucuccccccucaaccccaugcgcguccacaucgagaucggccccgacggccgcgucaccggcgaggccgacgucgaguucgccacccacgaggacgccgucgccgccauggccaaggacaaggccaacaugcagcaccgcuacgucgagcucuuccucaacuccaccgccggcaccuccggcggcgccuacgaccacuccuacgucgagcucuuccucaacuccaccgccggcgccuccggcggcgccuacggcucccagaugaugggcggcaugggccucuccaaccaguccuccuacggcggccccgccucccagcagcucuccggcggcuacggcggcggcuacggcggccaguccuccauguccggcuacgaccagguccuccaggagaacuccuccgacuaccaguccaaccucgccuga

SEQ ID NO: 44255 - RNA, 1395 nt, Artificial Sequence
  derived and/or modified sequence opt2 from HNRNPK__Homo_sapiens__NP_112553
auggagaccgagcagcccgaggagaccuuccccaacaccgagaccaacggcgaguucggcaagcgccccgccgaggacauggaggaggagcaggccuucaagcgcucccgcaacaccgacgagauggucgagcuccgcauccuccuccaguccaagaacgccggcgccgucaucggcaagggcggcaagaacaucaaggcccuccgcaccgacuacaacgccuccgucuccguccccgacuccuccggccccgagcgcauccucuccaucuccgccgacaucgagaccaucggcgagauccucaagaagaucauccccacccucgaggagggccuccagcuccccucccccaccgccaccucccagcucccccucgaguccgacgccgucgagugccucaacuaccagcacuacaagggcuccgacuucgacugcgagcuccgccuccucauccaccagucccucgccggcggcaucaucggcgucaagggcgccaagaucaaggagcuccgcgagaacacccagaccaccaucaagcucuuccaggagugcugcccccacuccaccgaccgcgucguccucaucggcggcaagcccgaccgcgucgucgagugcaucaagaucauccucgaccucaucuccgagucccccaucaagggccgcgcccagcccuacgaccccaacuucuacgacgagaccuacgacuacggcggcuucaccaugauguucgacgaccgccgcggccgccccgucggcuuccccaugcgcggccgcggcggcuucgaccgcaugccccccggccgcggcggccgccccaugccccccucccgccgcgacuacgacgacauguccccccgccgcggcccccccccccccccccccggccgcggcggccgcggcggcucccgcgcccgcaaccucccccuccccccccccccccccccccgcggcggcgaccucauggccuacgaccgccgcggccgccccggcgaccgcuacgacggcauggucggcuucuccgccgacgagaccugggacuccgccaucgacaccuggucccccuccgaguggcagauggccuacgagccccagggcggcuccggcuacgacuacuccuacgccggcggccgcggcuccuacggcgaccucggcggccccaucaucaccacccaggucaccauccccaaggaccucgccggcuccaucaucggcaagggcggccagcgcaucaagcagauccgccacgaguccggcgccuccaucaagaucgacgagccccucgagggcuccgaggaccgcaucaucaccaucaccggcacccaggaccagauccagaacgcccaguaccuccuccagaacuccgucaagcaguacgccgacgucgagggcuucuga

SEQ ID NO: 44256 - RNA, 1770 nt, Artificial Sequence
  derived and/or modified sequence opt2 from HNRNPL__Homo_sapiens__NP_001524
augucccgccgccuccucccccgcgccgagaagcgccgccgccgccucgagcagcgccagcagcccgacgagcagcgccgccgcuccggcgccauggucaagauggccgccgccggcggcggcggcggcggcggccgcuacuacggcggcggcuccgagggcggccgcgcccccaagcgccucaagaccgacaacgccggcgaccagcacggcggcggcggcggcggcggcggcggcgccggcgccgccggcggcggcggcggcggcgagaacuacgacgacccccacaagacccccgccucccccgucguccacauccgcggccucaucgacggcgucgucgaggccgaccucgucgaggcccuccaggaguucggccccaucuccuacgucgucgucaugcccaagaagcgccaggcccucgucgaguucgaggacguccucggcgccugcaacgccgucaacuacgccgccgacaaccagaucuacaucgccggccaccccgccuucgucaacuacuccaccucccagaagaucucccgccccggcgacuccgacgacucccgcuccgucaacuccguccuccucuucaccauccucaaccccaucuacuccaucaccaccgacguccucuacaccaucugcaaccccugcggccccguccagcgcaucgucaucuuccgcaagaacggcguccaggccauggucgaguucgacuccguccaguccgcccagcgcgccaaggccucccucaacggcgccgacaucuacuccggcugcugcacccucaagaucgaguacgccaagcccacccgccucaacgucuucaagaacgaccaggacaccugggacuacaccaaccccaaccucuccggccagggcgaccccggcuccaaccccaacaagcgccagcgccagcccccccuccucggcgaccaccccgccgaguacggcggcccccacggcggcuaccacucccacuaccacgacgagggcuacggccccccccccccccacuacgagggccgccgcaugggcccccccgucggcggccaccgccgcggccccucccgcuacggcccccaguacggccacccccccccccccccccccccccccgaguacggcccccacgccgacucccccguccucauggucuacggccucgaccaguccaagaugaacugcgaccgcgucuucaacgucuucugccucuacggcaacgucgagaaggucaaguucaugaaguccaagcccggcgccgccauggucgagauggccgacggcuacgccgucgaccgcgccaucacccaccucaacaacaacuucauguucggccagaagcucaacgucugcgucuccaagcagcccgccaucaugcccggccaguccuacggccucgaggacggcuccugcuccuacaaggacuucuccgagucccgcaacaaccgcuucuccacccccgagcaggccgccaagaaccgcauccagcaccccuccaacguccuccacuucuucaacgccccccucgaggucaccgaggagaacuucuucgagaucugcgacgagcucggcgucaagcgccccuccuccgucaaggucuucuccggcaaguccgagcgcuccuccuccggccuccucgagugggaguccaaguccgacgcccucgagacccucggcuuccucaaccacuaccagaugaagaaccccaacggccccuaccccuacacccucaagcucugcuucuccaccgcccagcacgccuccuga

SEQ ID NO: 44257 - RNA, 2193 nt, Artificial Sequence
  derived and/or modified sequence opt2 from HNRNPM__Homo_sapiens__NP_005959
auggccgccggcgucgaggccgccgccgaggucgccgccaccgagaucaagauggaggaggaguccggcgcccccggcguccccuccggcaacggcgcccccggccccaagggcgagggcgagcgccccgcccagaacgagaagcgcaaggagaagaacaucaagcgcggcggcaaccgcuucgagcccuacgccaaccccaccaagcgcuaccgcgccuucaucaccaacauccccuucgacgucaaguggcagucccucaaggaccucgucaaggagaaggucggcgaggucaccuacgucgagcuccucauggacgccgagggcaagucccgcggcugcgccgucgucgaguucaagauggaggaguccaugaagaaggccgccgagguccucaacaagcacucccucuccggccgcccccucaaggucaaggaggaccccgacggcgagcacgcccgccgcgccaugcagaaggucauggccaccaccggcggcaugggcaugggccccggcggccccggcaugaucaccaucccccccuccauccucaacaaccccaacauccccaacgagaucauccacgcccuccaggccggccgccucggcuccaccgucuucgucgccaaccucgacuacaaggucggcuggaagaagcucaaggaggucuucuccauggccggcgucgucguccgcgccgacauccucgaggacaaggacggcaagucccgcggcaucggcaccgucaccuucgagcaguccaucgaggccguccaggccaucuccauguucaacggccagcuccucuucgaccgccccaugcacgucaagauggacgagcgcgcccuccccaagggcgacuucuucccccccgagcgcccccagcagcucccccacggccucggcggcaucggcaugggccucggccccggcggccagcccaucgacgccaaccaccucaacaagggcaucggcaugggcaacaucggccccgccggcaugggcauggagggcaucggcuucggcaucaacaagaugggcggcauggagggccccuucggcggcggcauggagaacaugggccgcuucggcuccggcaugaacaugggccgcaucaacgagauccucuccaacgcccucaagcgcggcgagaucaucgccaagcagggcggcggcggcggcggcggcuccguccccggcaucgagcgcaugggccccggcaucgaccgccucggcggcgccggcauggagcgcaugggcgccggccucggccacggcauggaccgcgucggcuccgagaucgagcgcaugggccucgucauggaccgcaugggcuccgucgagcgcaugggcuccggcaucgagcgcaugggcccccucggccucgaccacauggccuccuccaucgagcgcaugggccagaccauggagcgcaucggcuccggcgucgagcgcaugggcgccggcaugggcuucggccucgagcgcauggccgcccccaucgaccgcgucggccagaccaucgagcgcaugggcuccggcgucgagcgcaugggccccgccaucgagcgcaugggccucuccauggagcgcaugguccccgccggcaugggcgccggccucgagcgcaugggccccgucauggaccgcauggccaccggccucgagcgcaugggcgccaacaaccucgagcgcaugggccucgagcgcaugggcgccaacucccucgagcgcaugggccucgagcgcaugggcgccaacucccucgagcgcaugggccccgccaugggccccgcccucggcgccggcaucgagcgcaugggccucgccaugggcggcggcggcggcgccuccuucgaccgcgccaucgagauggagcgcggcaacuucggcggcuccuucgccggcuccuucggcggcgccggcggccacgcccccggcgucgcccgcaaggccugccagaucuucguccgcaaccuccccuucgacuucaccuggaagaugcucaaggacaaguucaacgagugcggccacguccucuacgccgacaucaagauggagaacggcaaguccaagggcugcggcgucgucaaguucgagucccccgaggucgccgagcgcgccugccgcaugaugaacggcaugaagcucuccggccgcgagaucgacguccgcaucgaccgcaacgccuga

SEQ ID NO: 44258 - RNA, 1788 nt, Artificial Sequence
  derived and/or modified sequence opt2 from HNRNPR__Homo_sapiens__NP_001284549
auggccaaccaggucaacggcaacgccguccagcucaaggaggaggaggagcccauggacaccuccuccgucacccacaccgagcacuacaagacccucaucgaggccggccucccccagaaggucgccgagcgccucgacgagaucuuccagaccggccucgucgccuacgucgaccucgacgagcgcgccaucgacgcccuccgcgaguucaacgaggagggcgcccucuccguccuccagcaguucaaggaguccgaccucucccacguccagaacaaguccgccuuccucugcggcgucaugaagaccuaccgccagcgcgagaagcagggcuccaagguccaggaguccaccaagggccccgacgaggccaagaucaaggucuucgucggcaagaucccccgcgaccucuacgaggacgagcucgucccccucuucgagaaggccggccccaucugggaccuccgccucaugauggacccccucuccggccagaaccgcggcuacgccuucaucaccuucugcggcaaggaggccgcccaggaggccgucaagcucugcgacuccuacgagauccgccccggcaagcaccucggcgucugcaucuccgucgccaacaaccgccucuucgucggcuccauccccaagaacaagaccaaggagaacauccucgaggaguucuccaaggucaccgagggccucgucgacgucauccucuaccaccagcccgacgacaagaagaagaaccgcggcuucugcuuccucgaguacgaggaccacaaguccgccgcccaggcccgccgccgccucauguccggcaaggucaaggucuggggcaacgucgucaccgucgagugggccgaccccgucgaggagcccgaccccgaggucauggccaaggucaagguccucuucguccgcaaccucgccaccaccgucaccgaggagauccucgagaaguccuucuccgaguucggcaagcucgagcgcgucaagaagcucaaggacuacgccuucguccacuucgaggaccgcggcgccgccgucaaggccauggacgagaugaacggcaaggagaucgagggcgaggagaucgagaucguccucgccaagccccccgacaagaagcgcaaggagcgccaggccgcccgccaggccucccgcuccaccgccuacgaggacuacuacuaccacccccccccccgcaugcccccccccauccgcggccgcggccgcggcggcggccgcggcggcuacggcuacccccccgacuacuacggcuacgaggacuacuacgacgacuacuacggcuacgacuaccacgacuaccgcggcggcuacgaggaccccuacuacggcuacgacgacggcuacgccguccgcggccgcggcggcggccgcggcggccgcggcgcccccccccccccccgcggccgcggcgccccccccccccgcggccgcgccggcuacucccagcgcggcgccccccucggccccccccgcggcucccgcggcggccgcggcggccccgcccagcagcagcgcggccgcggcucccgcggcucccgcggcaaccgcggcggcaacgucggcggcaagcgcaaggccgacggcuacaaccagcccgacuccaagcgccgccagaccaacaaccagcagaacuggggcucccagcccaucgcccagcagccccuccagcagggcggcgacuacuccggcaacuacggcuacaacaacgacaaccaggaguucuaccaggacaccuacggccagcaguggaaguga

SEQ ID NO: 44259 - RNA, 2421 nt, Artificial Sequence
  derived and/or modified sequence opt2 from HNRNPU__Homo_sapiens__NP_004492
auguccuccucccccgucaacgucaagaagcucaaggucuccgagcucaaggaggagcucaagaagcgccgccucuccgacaagggccucaaggccgagcucauggagcgccuccaggccgcccucgacgacgaggaggccggcggccgccccgccauggagcccggcaacggcucccucgaccucggcggcgacuccgccggccgcuccggcgccggccucgagcaggaggccgccgccggcggcgacgaggaggaggaggaggaggaggaggaggaggagggcaucuccgcccucgacggcgaccagauggagcucggcgaggagaacggcgccgccggcgccgccgacuccggccccauggaggaggaggaggccgccuccgaggacgagaacggcgacgaccagggcuuccaggagggcgaggacgagcucggcgacgaggaggagggcgccggcgacgagaacggccacggcgagcagcagccccagccccccgccacccagcagcagcagccccagcagcagcgcggcgccgccaaggaggccgccggcaaguccuccggccccaccucccucuucgccgucaccgucgccccccccggcgcccgccagggccagcagcaggccggcggcgacggcaagaccgagcagaagggcggcgacaagaagcgcggcgucaagcgcccccgcgaggaccacggccgcggcuacuucgaguacaucgaggagaacaaguacucccgcgccaaguccccccagccccccgucgaggaggaggacgagcacuucgacgacaccgucgucugccucgacaccuacaacugcgaccuccacuucaagaucucccgcgaccgccucuccgccuccucccucaccauggaguccuucgccuuccucugggccggcggccgcgccuccuacggcgucuccaagggcaaggucugcuucgagaugaaggucaccgagaagauccccguccgccaccucuacaccaaggacaucgacauccacgagguccgcaucggcuggucccucaccaccuccggcaugcuccucggcgaggaggaguucuccuacggcuacucccucaagggcaucaagaccugcaacugcgagaccgaggacuacggcgagaaguucgacgagaacgacgucaucaccugcuucgccaacuucgaguccgacgaggucgagcucuccuacgccaagaacggccaggaccucggcgucgccuucaagaucuccaaggagguccucgccggccgcccccucuucccccacguccucugccacaacugcgccgucgaguucaacuucggccagaaggagaagcccuacuuccccauccccgaggaguacaccuucauccagaacgucccccucgaggaccgcguccgcggccccaagggccccgaggagaagaaggacugcgaggucgucaugaugaucggccuccccggcgccggcaagaccaccugggucaccaagcacgccgccgagaaccccggcaaguacaacauccucggcaccaacaccaucauggacaagaugauggucgccggcuucaagaagcagauggccgacaccggcaagcucaacacccuccuccagcgcgccccccagugccucggcaaguucaucgagaucgccgcccgcaagaagcgcaacuucauccucgaccagaccaacgucuccgccgccgcccagcgccgcaagaugugccucuucgccggcuuccagcgcaaggccgucgucgucugccccaaggacgaggacuacaagcagcgcacccagaagaaggccgaggucgagggcaaggaccuccccgagcacgccguccucaagaugaagggcaacuucacccuccccgaggucgccgagugcuucgacgagaucaccuacgucgagcuccagaaggaggaggcccagaagcuccucgagcaguacaaggaggaguccaagaaggcccucccccccgagaagaagcagaacaccggcuccaagaaguccaacaagaacaaguccggcaagaaccaguucaaccgcggcggcggccaccgcggccgcggcggcuucaacaugcgcggcggcaacuuccgcggcggcgcccccggcaaccgcggcggcuacaaccgccgcggcaacaugccccagcgcggcggcggcggcggcggcuccggcggcaucggcuaccccuacccccgcgcccccgucuuccccggccgcggcuccuacuccaaccgcggcaacuacaaccgcggcggcaugcccaaccgcggcaacuacaaccagaacuuccgcggccgcggcaacaaccgcggcuacaagaaccagucccagggcuacaaccaguggcagcagggccaguucuggggccagaagcccuggucccagcacuaccaccagggcuacuacuga

SEQ ID NO: 44260 - RNA, 2571 nt, Artificial Sequence
  derived and/or modified sequence opt2 from HNRNPUL1__Homo_sapiens__NP_008971
auggacguccgccgccucaaggucaacgagcuccgcgaggagcuccagcgccgcggccucgacacccgcggccucaaggccgagcucgccgagcgccuccaggccgcccucgaggccgaggagcccgacgacgagcgcgagcucgacgccgacgacgagcccggccgccccggccacaucaacgaggaggucgagaccgagggcggcuccgagcucgagggcaccgcccagccccccccccccggccuccagccccacgccgagcccggcggcuacuccggccccgacggccacuacgccauggacaacaucacccgccagaaccaguucuacgacacccaggucaucaagcaggagaacgaguccggcuacgagcgccgcccccucgagauggagcagcagcaggccuaccgccccgagaugaagaccgagaugaagcagggcgcccccaccuccuuccucccccccgaggccucccagcucaagcccgaccgccagcaguuccagucccgcaagcgccccuacgaggagaaccgcggccgcggcuacuucgagcaccgcgaggaccgccgcggccgcuccccccagccccccgccgaggaggacgaggacgacuucgacgacacccucgucgccaucgacaccuacaacugcgaccuccacuucaaggucgcccgcgaccgcuccuccggcuacccccucaccaucgagggcuucgccuaccucugguccggcgcccgcgccuccuacggcguccgccgcggccgcgucugcuucgagaugaagaucaacgaggagaucuccgucaagcaccuccccuccaccgagcccgacccccacgucguccgcaucggcuggucccucgacuccugcuccacccagcucggcgaggagcccuucuccuacggcuacggcggcaccggcaagaaguccaccaacucccgcuucgagaacuacggcgacaaguucgccgagaacgacgucaucggcugcuucgccgacuucgagugcggcaacgacgucgagcucuccuucaccaagaacggcaaguggaugggcaucgccuuccgcauccagaaggaggcccucggcggccaggcccucuacccccacguccucgucaagaacugcgccgucgaguucaacuucggccagcgcgccgagcccuacugcuccguccuccccggcuucaccuucauccagcaccucccccucuccgagcgcauccgcggcaccgucggccccaaguccaaggccgagugcgagauccucaugauggucggccuccccgccgccggcaagaccaccugggccaucaagcacgccgccuccaaccccuccaagaaguacaacauccucggcaccaacgccaucauggacaagaugcgcgucaugggccuccgccgccagcgcaacuacgccggccgcugggacguccucauccagcaggccacccagugccucaaccgccucauccagaucgccgcccgcaagaagcgcaacuacauccucgaccagaccaacgucuacggcuccgcccagcgccgcaagaugcgccccuucgagggcuuccagcgcaaggccaucgucaucugccccaccgacgaggaccucaaggaccgcaccaucaagcgcaccgacgaggagggcaaggacguccccgaccacgccguccucgagaugaaggccaacuucacccuccccgacgucggcgacuuccucgacgagguccucuucaucgagcuccagcgcgaggaggccgacaagcucguccgccaguacaacgaggagggccgcaaggccggccccccccccgagaagcgcuucgacaaccgcggcggcggcggcuuccgcggccgcggcggcggcggcggcuuccagcgcuacgagaaccgcggcccccccggcggcaaccgcggcggcuuccagaaccgcggcggcggcuccggcggcggcggcaacuaccgcggcggcuucaaccgcuccggcggcggcggcuacucccagaaccgcuggggcaacaacaaccgcgacaacaacaacuccaacaaccgcggcuccuacaaccgcgccccccagcagcagccccccccccagcagcccccccccccccagccccccccccagcagcccccccccccccccuccuacucccccgcccgcaacccccccggcgccuccaccuacaacaagaacuccaacauccccggcuccuccgccaacaccuccacccccaccgucuccuccuacucccccccccagcccuccuacucccagccccccuacaaccagggcggcuacucccagggcuacaccgcccccccccccccccccccccccccccccgccuacaacuacggcuccuacggcggcuacaaccccgcccccuacacccccccccccccccccaccgcccagaccuacccccagcccuccuacaaccaguaccagcaguacgcccagcaguggaaccaguacuaccagaaccagggccaguggccccccuacuacggcaacuacgacuacggcuccuacuccggcaacacccagggcggcaccuccacccaguga

SEQ ID NO: 44261 - RNA, 495 nt, Artificial Sequence
  derived and/or modified sequence opt2 from HOGA1__Homo_sapiens__NP_001128142
augcucggcccccaggucugguccuccguccgccagggccucucccgcucccucucccgcaacgucggcgucugggccuccggcgagggcaagaaggucgacaucgccggcaucuacccccccgucaccacccccuucaccgccaccgccgaggucgacuacggcaagcucgaggagaaccuccacaagcucggcaccuuccccuuccgcggcgccgucggcggcgucugcgcccucgccaacguccucggcgcccaggucugccagcucgagcgccucugcugcaccggccagugggaggacgcccagaagcuccagcaccgccucaucgagcccaacgccgccgucacccgccgcuucggcauccccggccucaagaagaucauggacugguucggcuacuacggcggccccugccgcgccccccuccaggagcucucccccgccgaggaggaggcccuccgcauggacuucaccuccaacggcuggcucuga

SEQ ID NO: 44262 - RNA, 675 nt, Artificial Sequence
  derived and/or modified sequence opt2 from HOMER1__Homo_sapiens__NP_001264006
augggcgagcagcccaucuucuccacccgcgcccacgucuuccagaucgaccccaacaccaagaagaacuggguccccaccuccaagcacgccgucaccgucuccuacuucuacgacuccacccgcaacgucuaccgcaucaucucccucgacggcuccaaggccaucaucaacuccaccaucacccccaacaugaccuucaccaagaccucccagaaguucggccagugggccgacucccgcgccaacaccgucuacggccucggcuucuccuccgagcaccaccucuccaaggucaccgagcucgagugcgucuccucccaggccaacgccguccacacccacaagaccgagcucaaccagaccauccaggagcucgaggagacccucaagcucaaggaggaggagaucgagcgccucaagcaggagaucgacaacgcccgcgagcuccaggagcagcgcgacucccucacccagaagcuccaggaggucgagauccgcaacaaggaccucgagggccagcucuccgaccucgagcagcgccucgagaagucccagaacgagcaggaggccuuccgcaacaaccucaagacccuccucgagauccucgacggcaagaucuucgagcucaccgagcuccgcgacaaccucgccaagcuccucgagugcuccuga

SEQ ID NO: 44263 - RNA, 1032 nt, Artificial Sequence
  derived and/or modified sequence opt2 from HOMER2__Homo_sapiens__NP_004830
augggcgagcagcccaucuucaccacccgcgcccacgucuuccagaucgaccccaacaccaagaagaacuggaugcccgccuccaagcaggccgucaccgucuccuacuucuacgacgucacccgcaacuccuaccgcaucaucuccgucgacggcgccaaggucaucaucaacuccaccaucacccccaacaugaccuucaccaagaccucccagaaguucggccagugggccgacucccgcgccaacaccgucuucggccucggcuucuccuccgagcagcagcucaccaaguucgccgagaaguuccaggaggucaaggaggccgccaagaucgccaaggacaagacccaggagaagaucgagaccuccuccaaccacucccaggccuccuccgucaacggcaccgacgacgagaaggccucccacgccggccccgccaacacccaccucaaguccgagaacgacaagcucaagaucgcccucacccaguccgccgccaacgucaagaagugggagaucgagcuccagacccuccgcgaguccaacgcccgccucaccaccgcccuccaggaguccgccgccuccgucgagcaguggaagcgccaguucuccaucugccgcgacgagaacgaccgccuccgcaacaagaucgacgagcucgaggagcagugcuccgagaucaaccgcgagaaggagaagaacacccagcucaagcgccgcaucgaggagcucgaggccgagcuccgcgagaaggagaccgagcucaaggaccuccgcaagcaguccgagaucaucccccagcucauguccgagugcgaguacgucuccgagaagcucgaggccgccgagcgcgacaaccagaaccucgaggacaagguccgcucccucaagaccgacaucgaggaguccaaguaccgccagcgccaccucaaggucgagcucaaguccuuccucgagguccucgacggcaagaucgacgaccuccacgacuuccgccgcggccucuccaagcucggcaccgacaacuga

SEQ ID NO: 44264 - RNA, 1077 nt, Artificial Sequence
  derived and/or modified sequence opt2 from HOMER3__Homo_sapiens__NP_001139193
auguccaccgcccgcgagcagcccaucuucuccacccgcgcccacgucuuccagaucgaccccgccaccaagcgcaacuggauccccgccggcaagcacgcccucaccgucuccuacuucuacgacgccacccgcaacgucuaccgcaucaucuccaucggcggcgccaaggccaucaucaacuccaccgucacccccaacaugaccuucaccaagaccucccagaaguucggccagugggccgacucccgcgccaacaccgucuacggccucggcuucgccuccgagcagcaccucacccaguucgccgagaaguuccaggaggucaaggaggccgcccgccucgcccgcgagaagucccaggacggcggcgagcucaccucccccgcccucggccucgccucccaccaggucccccccuccccccucgucuccgccaacggccccggcgaggagaagcucuuccgcucccaguccgccgacgcccccggccccaccgagcgcgagcgccucaagaagaugcucuccgagggcuccgucggcgagguccagugggaggccgaguucuucgcccuccaggacuccaacaacaagcucgccggcgcccuccgcgaggccaacgccgccgccgcccaguggcgccagcagcucgaggcccagcgcgccgaggccgagcgccuccgccagcgcgucgccgagcucgaggcccaggccgccuccgaggucacccccaccggcgagaaggagggccucggccagggccagucccucgagcagcucgaggcccucguccagaccaaggaccaggagauccagacccucaagucccagaccggcggcccccgcgaggcccucgaggccgccgagcgcgaggagacccagcagaagguccagacccgcaacgccgagcucgagcaccagcuccgcgccauggagcgcucccucgaggaggcccgcgccgagcgcgagcgcgcccgcgccgaggucggccgcgccgcccagcuccucgacgucucccucuucgagcucuccgagcuccgcgagggccucgcccgccucgccgaggccgcccccuga

SEQ ID NO: 44265 - RNA, 1653 nt, Artificial Sequence
  derived and/or modified sequence opt2 from HOMEZ__Homo_sapiens__NP_065885
augguccgcggcugggagcccccccccggccucgacugcgccaucuccgagggccacaaguccgagggcaccaugccccccaacaaggaggccuccggccucuccuccucccccgccggccucaucugccucccccccaucuccgaggagcuccagcucgucuggacccaggccgcccagaccuccgagcucgacuccaacgagcaccuccucaagaccuucuccuacuuccccuaccccucccucgccgacaucgcccuccucugccuccgcuacggccuccagauggagaaggucaagaccugguucauggcccagcgccuccgcugcggcaucuccugguccuccgaggagaucgaggagacccgcgcccgcgucgucuaccgccgcgaccagcuccacuucaagucccuccucuccuucacccaccacgccggccgcccccccgaggaggucccccccccccccguccccgcccccgagcaggucggcaucggcaucggcccccccacccucuccaagcccacccagaccaagggccucaaggucgagcccgaggagcccucccagaugcccccccucccccagucccaccagaagcucaaggagucccucaugacccccggcuccggcgccuuccccuaccaguccgacuucuggcagcaccuccaguccuccggccucuccaaggagcaggccggccgcggccccaaccagucccacggcaucggcaccgccuccuggaaccacuccaccaccgucccccagccccaggcccgcgacaagcccccccccaucgcccucaucgccuccuccugcaaggaggaguccgccuccuccgucacccccuccuccuccuccaccuccuccuccuuccagguccucgccaacggcgccaccgccgccuccaagccccuccagccccucggcugcgucccccaguccgucucccccuccgagcaggcccuccccccccaccucgagcccgccuggccccagggccuccgccacaacuccguccccggccgcgucggccccaccgaguaccucucccccgacaugcagcgccagcgcaagaccaagcgcaagaccaaggagcagcucgccauccucaaguccuucuuccuccagugccagugggcccgccgcgaggacuaccagaagcucgagcagaucaccggccucccccgccccgagaucauccagugguucggcgacacccgcuacgcccucaagcacggccagcucaagugguuccgcgacaacgccguccccggcgcccccuccuuccaggaccccgccauccccacccccccccccuccacccgcucccucaacgagcgcgccgagacccccccccuccccauccccccccccccccccgacauccagccccucgagcgcuacugggccgcccaccagcagcuccgcgagaccgacaucccccagcucucccaggccucccgccucuccacccagcagguccucgacugguucgacucccgccucccccagcccgccgaggucgucgucugccucgacgaggaggaggaggaggaggaggaggagcuccccgaggacgacgaggaggaggaggaggaggaggaggaggacgacgacgacgacgacgacgacgucaucauccaggacuga

SEQ ID NO: 44266 - RNA, 2154 nt, Artificial Sequence
  derived and/or modified sequence opt2 from HOOK2__Homo_sapiens__NP_001093646
auguccgucgacaaggccgagcucugcggcucccuccucaccuggcuccagaccuuccacguccccucccccugcgccuccccccaggaccucuccuccggccucgccgucgccuacguccucaaccagaucgaccccuccugguucaacgaggccuggcuccagggcaucuccgaggaccccggccccaacuggaagcucaaggucuccaaccucaagaugguccuccgcucccucgucgaguacucccaggacguccucgcccaccccgucuccgaggagcaccuccccgacgucucccucaucggcgaguucuccgaccccgccgagcucggcaagcuccuccagcucguccucggcugcgccaucuccugcgagaagaagcaggaccacauccagcgcaucaugacccucgaggaguccguccagcacgucgucauggaggccauccaggagcucaugaccaaggacacccccgacucccucucccccgagaccuacggcaacuucgacucccagucccgccgcuacuacuuccucuccgaggaggccgaggagggcgacgagcuccagcagcgcugccucgaccucgagcgccagcucaugcuccucuccgaggagaagcagucccucgcccaggagaacgccggccuccgcgagcgcaugggccgccccgagggcgagggcacccccggccucaccgccaagaagcuccuccuccuccagucccagcucgagcagcuccaggaggagaacuuccgccucgaguccggccgcgaggacgagcgccuccgcugcgccgagcucgagcgcgaggucgccgagcuccagcaccgcaaccaggcccucaccucccucgcccaggaggcccaggcccucaaggacgagauggacgagcuccgccaguccuccgagcgcgccggccagcucgaggccacccucaccuccugccgccgccgccucggcgagcuccgcgagcuccgccgccagguccgccagcucgaggagcgcaacgccggccacgccgagcgcacccgccagcucgaggacgagcuccgccgcgccggcucccuccgcgcccagcucgaggcccagcgccgccagguccaggagcuccagggccagcgccaggaggaggccaugaaggccgagaaguggcucuucgagugccgcaaccucgaggagaaguacgaguccgucaccaaggagaaggagcgccuccucgccgagcgcgacucccuccgcgaggccaacgaggagcuccgcugcgcccagcuccagccccgcggccucacccaggccgaccccucccucgaccccaccuccacccccgucgacaaccucgccgccgagauccuccccgccgagcuccgcgagacccuccuccgccuccagcucgagaacaagcgccucugccgccaggaggccgccgaccgcgagcgccaggaggagcuccagcgccaccucgaggacgccaaccgcgcccgccacggccucgagacccagcaccgccucaaccagcagcagcucuccgagcuccgcgcccaggucgaggaccuccagaaggcccuccaggagcagggcggcaagaccgaggacuccauccuccucaagcgcaagcucgaggagcaccuccagaagcuccacgaggccgaccucgagcuccagcgcaagcgcgaguacaucgaggagcucgagccccccaccgacuccuccaccgcccgccgcaucgaggagcuccagcacaaccuccagaagaaggacgccgaccuccgcgccauggaggagcgcuaccgccgcuacgucgacaaggcccgcauggucaugcagaccauggagcccaagcagcgccccgccgccggcgccccccccgagcuccacucccuccgcacccagcuccgcgagcgcgacguccgcauccgccaccucgagauggacuucgagaagucccgcucccagcgcgagcaggaggagaagcuccucaucuccgccugguacaacaugggcauggcccuccagcagcgcgccggcgaggagcgcgcccccgcccacgcccaguccuuccucgcccagcagcgccucgccaccaacucccgccgcggcccccucggccgccucgccucccucaaccuccgccccaccgacaagcacuga

SEQ ID NO: 44267 - RNA, 2157 nt, Artificial Sequence
  derived and/or modified sequence opt2 from HOOK3__Homo_sapiens__NP_115786
auguucuccgucgagucccucgagcgcgccgagcucugcgagucccuccucaccuggauccagaccuucaacgucgacgcccccugccagaccgucgaggaccucaccaacggcgucgucauggcccagguccuccagaagaucgaccccgccuacuucgacgagaacuggcucaaccgcaucaagaccgaggucggcgacaacuggcgccucaagaucuccaaccucaagaagauccucaagggcauccucgacuacaaccacgagauccucggccagcagaucaacgacuucacccuccccgacgucaaccucaucggcgagcacuccgacgccgccgagcucggccgcaugcuccagcucauccucggcugcgccgucaacugcgagcagaagcaggaguacauccaggccaucaugaugauggaggaguccguccagcacgucgucaugaccgccauccaggagcucauguccaaggagucccccgucuccgccggcaacgacgccuacgucgaccucgaccgccagcucaagaagaccaccgaggagcucaacgaggcccucuccgccaaggaggagaucgcccagcgcugccacgagcucgacaugcaggucgccgcccuccaggaggagaaguccucccuccucgccgagaaccagguccucauggagcgccucaaccaguccgacuccaucgaggaccccaacucccccgccggccgccgccaccuccagcuccagacccagcucgagcagcuccaggaggagaccuuccgccucgaggccgccaaggacgacuaccgcauccgcugcgaggagcucgagaaggagaucuccgagcuccgccagcagaacgacgagcucaccacccucgccgacgaggcccagucccucaaggacgagaucgacguccuccgccacuccuccgacaaggucuccaagcucgagggccaggucgaguccuacaagaagaagcucgaggaccucggcgaccuccgccgccaggucaagcuccucgaggagaagaacaccauguacaugcagaacaccgucucccucgaggaggagcuccgcaaggccaacgccgcccgcucccagcucgagaccuacaagcgccaggucgucgagcuccagaaccgccucuccgaggaguccaagaaggccgacaagcucgacuucgaguacaagcgccucaaggagaaggucgacucccuccagaaggagaaggaccgccuccgcaccgagcgcgacucccucaaggagaccaucgaggagcuccgcugcguccaggcccaggagggccagcucaccacccagggccucaugccccucggcucccaggaguccuccgacucccucgccgccgagaucgucacccccgagauccgcgagaagcucauccgccuccagcacgagaacaagaugcucaagcucaaccaggagggcuccgacaacgagaagaucgcccuccuccagucccuccucgacgacgccaaccuccgcaagaacgagcucgagaccgagaaccgccucgucaaccagcgccuccucgagguccagucccaggucgaggagcuccagaagucccuccaggaccagggcuccaaggccgaggacuccguccuccucaagaagaagcucgaggagcaccucgagaagcuccacgaggccaacaacgagcuccagaagaagcgcgccaucaucgaggaccucgagccccgcuucaacaacuccucccucaagaucgaggagcuccaggaggcccuccgcaagaaggaggaggagaugaagcagauggaggagcgcuacaagaaguaccucgagaaggccaaguccgucauccgcacccucgaccccaagcagaaccagggcgccgcccccgagauccaggcccucaagaaccagcuccaggagcgcgaccgccucuuccacucccucgagaaggaguacgagaagaccaagucccagcgcgagauggaggagaaguacaucgucuccgccugguacaacaugggcaugacccuccacaagaaggccgccgaggaccgccucgccuccaccggcuccggccaguccuuccucgcccgccagcgccaggccaccuccucccgccgcuccuaccccggccacguccagcccgccaccgcccgcuga

SEQ ID NO: 44268 - RNA, 222 nt, Artificial Sequence
  derived and/or modified sequence opt2 from HOPX__Homo_sapiens__NP_001138931
auguccgccgagaccgccuccggccccaccgaggaccaggucgagauccucgaguacaacuucaacaaggucgacaagcaccccgacuccaccacccucugccucaucgccgccgaggccggccucuccgaggaggagacccagaagugguucaagcagcgccucgccaaguggcgccgcuccgagggccuccccuccgagugccgcuccgucaccgacuga

SEQ ID NO: 44269 - RNA, 924 nt, Artificial Sequence
  derived and/or modified sequence opt2 from HORMAD2__Homo_sapiens__NP_689723
auggccaccgcccagcucucccacugcaucaccauccacaaggccuccaaggagaccgucuuccccucccagaucaccaacgagcacgagucccucaagauggucaagaagcucuucgccaccuccaucuccugcaucaccuaccuccgcggccucuuccccgaguccuccuacggcgagcgccaccucgacgaccucucccucaagauccuccgcgaggacaagaagugccccggcucccuccacaucauccgcuggauccagggcugcuucgacgcccucgagaagcgcuaccuccgcauggccguccucacccucuacaccgaccccaugggcuccgagaaggucaccgagauguaccaguucaaguucaaguacaccaaggagggcgccaccauggacuucgacucccacuccuccuccaccuccuucgaguccggcaccaacaacgaggacaucaagaaggccuccguccuccucauccgcaagcucuacauccucaugcaggaccucgagccccuccccaacaacgucguccucaccaugaagcuccacuacuacaacgccgucaccccccacgacuaccagccccucggcuucaaggagggcgucaacucccacuuccuccucuucgacaaggagcccaucaacguccaggucggcuucgucuccaccggcuuccacuccaugaaggucaaggucaugaccgaggccaccaaggucaucgaccucgagaacaaccucuuccgcgagaacuccaccaccgagaucgcccaccagggccucgacugcgacgaggaggaggagugcaacgaccacauccagcgcaugaacuucgucugcucccagcaguccuccgagugcucccgcaagaagcgcaaggucuccgagcccgucaaggucuucauccccaaccgcaaguga

SEQ ID NO: 44270 - RNA, 1233 nt, Artificial Sequence
  derived and/or modified sequence opt2 from HOXA10__Homo_sapiens__NP_061824
auguccgcccgcaagggcuaccuccuccccucccccaacuaccccaccaccauguccugcuccgagucccccgccgccaacuccuuccucgucgacucccucaucuccuccggccgcggcgaggccggcggcggcggcggcggcgccggcggcggcggcggcggcggcuacuacgcccacggcggcgucuaccucccccccgccgccgaccuccccuacggccuccaguccugcggccucuuccccacccucggcggcaagcgcaacgaggccgccucccccggcuccggcggcggcggcggcggccucggccccggcgcccacggcuacggccccucccccaucgaccucuggcucgacgccccccgcuccugccgcauggagccccccgacggcccccccccccccccccagcagcagccccccccccccccccagcccccccagcccgccccccaggccaccuccugcuccuucgcccagaacaucaaggaggaguccuccuacugccucuacgacuccgccgacaagugccccaaggucuccgccaccgccgccgagcucgcccccuucccccgcggccccccccccgacggcugcgcccucggcaccuccuccggcguccccguccccggcuacuuccgccucucccaggccuacggcaccgccaagggcuacggcuccggcggcggcggcgcccagcagcucggcgccggccccuuccccgcccagccccccggccgcggcuucgaccucccccccgcccucgccuccggcuccgccgacgccgcccgcaaggagcgcgcccucgacuccccccccccccccacccucgccugcggcuccggcggcggcucccagggcgacgaggaggcccacgccuccuccuccgccgccgaggagcucucccccgcccccuccgaguccuccaaggccucccccgagaaggacucccucggcaacuccaagggcgagaacgccgccaacuggcucaccgccaaguccggccgcaagaagcgcugccccuacaccaagcaccagacccucgagcucgagaaggaguuccucuucaacauguaccucacccgcgagcgccgccucgagaucucccgcuccguccaccucaccgaccgccaggucaagaucugguuccagaaccgccgcaugaagcucaagaagaugaaccgcgagaaccgcauccgcgagcucaccgccaacuucaacuucuccuga

SEQ ID NO: 44271 - RNA, 942 nt, Artificial Sequence
  derived and/or modified sequence opt2 from HOXA11__Homo_sapiens__NP_005514
auggacuucgacgagcgcggccccugcuccuccaacauguaccuccccuccugcaccuacuacgucuccggccccgacuucuccucccuccccuccuuccucccccagacccccuccucccgccccaugaccuacuccuacuccuccaaccucccccagguccagcccguccgcgaggucaccuuccgcgaguacgccaucgagcccgccaccaaguggcacccccgcggcaaccucgcccacugcuacuccgccgaggagcucguccaccgcgacugccuccaggcccccuccgccgccggcguccccggcgacguccucgccaaguccuccgccaacgucuaccaccaccccacccccgccgucuccuccaacuucuacuccaccgucggccgcaacggcguccucccccaggccuucgaccaguucuucgagaccgccuacggcacccccgagaaccucgccuccuccgacuaccccggcgacaaguccgccgagaagggcccccccgccgccaccgccaccuccgccgccgccgccgccgccgccaccggcgcccccgccaccuccuccuccgacuccggcggcggcggcggcugccgcgagaccgccgccgccgccgaggagaaggagcgccgccgccgccccgaguccuccuccucccccgaguccuccuccggccacaccgaggacaaggccggcggcuccuccggccagcgcacccgcaagaagcgcugccccuacaccaaguaccagauccgcgagcucgagcgcgaguucuucuucuccgucuacaucaacaaggagaagcgccuccagcucucccgcaugcucaaccucaccgaccgccaggucaagaucugguuccagaaccgccgcaugaaggagaagaagaucaaccgcgaccgccuccaguacuacuccgccaacccccuccucuga

SEQ ID NO: 44272 - RNA, 1167 nt, Artificial Sequence
  derived and/or modified sequence opt2 from HOXA13__Homo_sapiens__XP_011513646
augaccgccuccguccuccuccacccccgcuggaucgagcccaccgucauguuccucuacgacaacggcggcggccucgucgccgacgagcucaacaagaacauggagggcgccgccgccgccgccgccgccgccgccgccgccgccgccgccggcgccggcggcggcggcuucccccaccccgccgccgccgccgccggcggcaacuucuccgucgccgccgccgccgccgccgccgccgccgccgccgccaaccagugccgcaaccucauggcccaccccgccccccucgcccccggcgccgccuccgccuacuccuccgcccccggcgaggccccccccuccgccgccgccgccgccgccgccgccgccgccgccgccgccgccgccgccgccgccuccuccuccggcggccccggccccgccggccccgccggcgccgaggccgccaagcagugcucccccugcuccgccgccgcccaguccuccuccggccccgccgcccuccccuacggcuacuucggcuccggcuacuaccccugcgcccgcaugggcccccaccccaacgccaucaaguccugcgcccagcccgccuccgccgccgccgccgccgccuucgccgacaaguacauggacaccgccggccccgccgccgaggaguucuccucccgcgccaaggaguucgccuucuaccaccagggcuacgccgccggccccuaccaccaccaccagcccaugcccggcuaccucgacaugcccgucguccccggccucggcggccccggcgagucccgccacgagccccucggccuccccauggaguccuaccagcccugggcccuccccaacggcuggaacggccagauguacugccccaaggagcaggcccagcccccccaccucuggaaguccacccuccccgacgucgucucccaccccuccgacgccuccuccuaccgccgcggccgcaagaagcgcguccccuacaccaagguccagcucaaggagcucgagcgcgaguacgccaccaacaaguucaucaccaaggacaagcgccgccgcaucuccgccaccaccaaccucuccgagcgccaggucaccaucugguuccagaaccgccgcgucaaggagaagaaggucaucaacaagcucaagaccaccuccuga

SEQ ID NO: 44273 - RNA, 1008 nt, Artificial Sequence
  derived and/or modified sequence opt2 from HOXA1__Homo_sapiens__NP_005513
auggacaacgcccgcaugaacuccuuccucgaguaccccauccucuccuccggcgacuccggcaccugcuccgcccgcgccuaccccuccgaccaccgcaucaccaccuuccaguccugcgccgucuccgccaacuccugcggcggcgacgaccgcuuccucgucggccgcggcguccagaucggcuccccccaccaccaccaccaccaccaccaccaccacccccagcccgccaccuaccagaccuccggcaaccucggcgucuccuacucccacuccuccugcggccccuccuacggcucccagaacuucuccgcccccuacucccccuacgcccucaaccaggaggccgacgucuccggcggcuacccccagugcgcccccgccgucuacuccggcaaccucuccucccccaugguccagcaccaccaccaccaccagggcuacgccggcggcgccgucggcuccccccaguacauccaccacuccuacggccaggagcaccagucccucgcccucgccaccuacaacaacucccucuccccccuccacgccucccaccaggaggccugccgcucccccgccuccgagaccuccucccccgcccagaccuucgacuggaugaaggucaagcgcaacccccccaagaccggcaaggucggcgaguacggcuaccucggccagcccaacgccguccgcaccaacuucaccaccaagcagcucaccgagcucgagaaggaguuccacuucaacaaguaccucacccgcgcccgccgcgucgagaucgccgccucccuccagcucaacgagacccaggucaagaucugguuccagaaccgccgcaugaagcagaagaagcgcgagaaggagggccuccuccccaucucccccgccaccccccccggcaacgacgagaaggccgaggaguccuccgagaaguccuccuccucccccugcguccccucccccggcuccuccaccuccgacacccucaccaccucccacuga

SEQ ID NO: 44274 - RNA, 1131 nt, Artificial Sequence
  derived and/or modified sequence opt2 from HOXA2__Homo_sapiens__NP_006726
augaacuacgaguucgagcgcgagaucggcuucaucaacucccagcccucccucgccgagugccucaccuccuucccccccgucgccgacaccuuccaguccuccuccaucaagaccuccacccucucccacuccacccucauccccccccccuucgagcagaccauccccucccucaaccccggcucccacccccgccacggcgccggcggccgccccaagcccucccccgccggcucccgcggcucccccguccccgccggcgcccuccagccccccgaguaccccuggaugaaggagaagaaggccgccaagaagaccgcccuccuccccgccgccgccgccgccgccaccgccgccgccaccggccccgccugccucucccacaaggagucccucgagaucgccgacggcuccggcggcggcucccgccgccuccgcaccgccuacaccaacacccagcuccucgagcucgagaaggaguuccacuucaacaaguaccucugccgcccccgccgcgucgagaucgccgcccuccucgaccucaccgagcgccaggucaaggucugguuccagaaccgccgcaugaagcacaagcgccagacccagugcaaggagaaccagaacuccgagggcaagugcaagucccucgaggacuccgagaaggucgaggaggacgaggaggagaagacccucuucgagcaggcccucuccgucuccggcgcccuccucgagcgcgagggcuacaccuuccagcagaacgcccucucccagcagcaggcccccaacggccacaacggcgacucccaguccuuccccgucuccccccucaccuccaacgagaagaaccucaagcacuuccagcaccagucccccaccguccccaacugccucuccaccaugggccagaacugcggcgccggccucaacaacgacucccccgaggcccucgagguccccucccuccaggacuucuccgucuucuccaccgacuccugccuccagcucuccgacgccgucucccccucccuccccggcucccucgacucccccgucgacaucuccgccgacucccucgacuucuucaccgacacccucaccaccaucgaccuccagcaccucaacuacuga

SEQ ID NO: 44275 - RNA, 1332 nt, Artificial Sequence
  derived and/or modified sequence opt2 from HOXA3__Homo_sapiens__XP_005249788
augcagaaggccaccuacuacgacuccuccgccaucuacggcggcuaccccuaccaggccgccaacggcuucgccuacaacgccaaccagcagcccuaccccgccuccgccgcccucggcgccgacggcgaguaccaccgccccgccugcucccuccagucccccuccuccgccggcggccaccccaaggcccacgagcucuccgaggccugccuccgcacccucuccgccccccccucccagccccccucccucggcgagcccccccuccaccccccccccccccaggccgccccccccgccccccagcccccccagcccgccccccagccccccgcccccacccccgccgccccccccccccccuccuccgccucccccccccagaacgccuccaacaaccccacccccgccaacgccgccaaguccccccuccucaacucccccaccgucgccaagcagaucuuccccuggaugaaggagucccgccagaacaccaagcagaagaccuccuccuccuccuccggcgaguccugcgccggcgacaaguccccccccggccaggccuccuccaagcgcgcccgcaccgccuacaccuccgcccagcucgucgagcucgagaaggaguuccacuucaaccgcuaccucugccgcccccgccgcgucgagauggccaaccuccucaaccucaccgagcgccagaucaagaucugguuccagaaccgccgcaugaaguacaagaaggaccagaagggcaagggcaugcucaccuccuccggcggccagucccccucccgcucccccgucccccccggcgccggcggcuaccucaacuccaugcacucccucgucaacuccguccccuacgagccccagucccccccccccuucuccaagcccccccagggcaccuacggccucccccccgccuccuaccccgccucccuccccuccugcgccccccccccccccccccagaagcgcuacaccgccgccggcgccggcgccggcggcacccccgacuacgacccccacgcccacggccuccagggcaacggcuccuacggcaccccccacauccagggcucccccgucuucgucggcggcuccuacgucgagcccauguccaacuccggccccgcccucuucggccucacccaccucccccacgccgccuccggcgccauggacuacggcggcgccggcccccucggcuccggccaccaccacggccccggccccggcgagccccaccccaccuacaccgaccucaccggccaccaccccucccagggccgcauccaggaggcccccaagcucacccaccucuga

SEQ ID NO: 44276 - RNA, 963 nt, Artificial Sequence
  derived and/or modified sequence opt2 from HOXA4__Homo_sapiens__NP_002132
augaccauguccuccuuccucaucaacuccaacuacaucgagcccaaguucccccccuucgaggaguacgcccagcacuccggcuccggcggcgccgacggcggccccggcggcggccccggcuaccagcagccccccgccccccccacccagcaccucccccuccagcagccccagcucccccacgccggcggcggccgcgagcccaccgccuccuacuacgccccccgcaccgcccgcgagcccgccuaccccgccgccgcccucuaccccgcccacggcgccgccgacaccgccuaccccuacggcuaccgcggcggcgccucccccggccgccccccccagcccgagcagccccccgcccaggccaagggccccgcccacggccuccacgccucccacguccuccagccccagcucccccccccccuccagccccgcgccgucccccccgccgccccccgccgcugcgaggccgcccccgccacccccggcguccccgccggcggcuccgcccccgccugcccccuccuccucgccgacaaguccccccucggccucaagggcaaggagcccgucgucuaccccuggaugaagaagauccacgucuccgccgucaaccccuccuacaacggcggcgagcccaagcgcucccgcaccgccuacacccgccagcagguccucgagcucgagaaggaguuccacuucaaccgcuaccucacccgccgccgccgcaucgagaucgcccacacccucugccucuccgagcgccaggucaagaucugguuccagaaccgccgcaugaaguggaagaaggaccacaagcuccccaacaccaagaugcgcuccuccaacuccgccuccgccuccgccggcccccccggcaaggcccagacccaguccccccaccuccacccccacccccaccccuccaccuccacccccguccccuccuccaucuga

SEQ ID NO: 44277 - RNA, 813 nt, Artificial Sequence
  derived and/or modified sequence opt2 from HOXA5__Homo_sapiens__NP_061975
auguccuccuacuucgucaacuccuucugcggccgcuaccccaacggccccgacuaccagcuccacaacuacggcgaccacuccuccgucuccgagcaguuccgcgacuccgccuccaugcacuccggccgcuacggcuacggcuacaacggcauggaccucuccgucggccgcuccggcuccggccacuucggcuccggcgagcgcgcccgcuccuacgccgccuccgccuccgccgcccccgccgagccccgcuacucccagcccgccaccuccacccacuccccccagcccgacccccuccccugcuccgccgucgcccccucccccggcuccgacucccaccacggcggcaagaacucccucuccaacuccuccggcgccuccgccgacgccggcuccacccacaucuccucccgcgagggcgucggcaccgccuccggcgccgaggaggacgcccccgccuccuccgagcaggccuccgcccaguccgagcccucccccgccccccccgcccagccccagaucuaccccuggaugcgcaagcuccacaucucccacgacaacaucggcggccccgagggcaagcgcgcccgcaccgccuacacccgcuaccagacccucgagcucgagaaggaguuccacuucaaccgcuaccucacccgccgccgccgcaucgagaucgcccacgcccucugccucuccgagcgccagaucaagaucugguuccagaaccgccgcaugaaguggaagaaggacaacaagcucaaguccauguccauggccgccgccggcggcgccuuccgccccuga

SEQ ID NO: 44278 - RNA, 702 nt, Artificial Sequence
  derived and/or modified sequence opt2 from HOXA6__Homo_sapiens__NP_076919
auguccuccuacuucgucaaccccaccuuccccggcucccuccccuccggccaggacuccuuccucggccagcucccccucuaccaggccggcuacgacgcccuccgccccuuccccgccuccuacggcgccuccucccuccccgacaagaccuacaccucccccugcuucuaccagcaguccaacuccguccucgccugcaaccgcgccuccuacgaguacggcgccuccugcuucuacuccgacaaggaccucuccggcgccucccccuccggcuccggcaagcagcgcggccccggcgacuaccuccacuucucccccgagcagcaguacaagcccgacuccuccuccggccagggcaaggcccuccacgacgagggcgccgaccgcaaguacaccucccccgucuaccccuggaugcagcgcaugaacuccugcgccggcgccgucuacggcucccacggccgccgcggccgccagaccuacacccgcuaccagacccucgagcucgagaaggaguuccacuucaaccgcuaccucacccgccgccgccgcaucgagaucgccaacgcccucugccucaccgagcgccagaucaagaucugguuccagaaccgccgcaugaaguggaagaaggagaacaagcucaucaacuccacccagcccuccggcgaggacuccgaggccaaggccggcgaguga

SEQ ID NO: 44279 - RNA, 693 nt, Artificial Sequence
  derived and/or modified sequence opt2 from HOXA7__Homo_sapiens__NP_008827
auguccuccuccuacuacgucaacgcccucuucuccaaguacaccgccggcgccucccucuuccagaacgccgagcccaccuccugcuccuucgcccccaacucccagcgcuccggcuacggcgccggcgccggcgccuucgccuccaccguccccggccucuacaacgucaacuccccccucuaccagucccccuucgccuccggcuacggccucggcgccgacgccuacggcaaccuccccugcgccuccuacgaccagaacauccccggccucugcuccgaccucgccaagggcgccugcgacaagaccgacgagggcgcccuccacggcgccgccgaggccaacuuccgcaucuaccccuggaugcgcuccuccggccccgaccgcaagcgcggccgccagaccuacacccgcuaccagacccucgagcucgagaaggaguuccacuucaaccgcuaccucacccgccgccgccgcaucgagaucgcccacgcccucugccucaccgagcgccagaucaagaucugguuccagaaccgccgcaugaaguggaagaaggagcacaaggacgagggccccaccgccgccgccgcccccgagggcgccguccccuccgccgccgccaccgccgccgccgacaaggccgacgaggaggacgacgacgaggaggaggaggacgaggaggaguga

SEQ ID NO: 44280 - RNA, 819 nt, Artificial Sequence
  derived and/or modified sequence opt2 from HOXA9__Homo_sapiens__NP_689952
auggccaccaccggcgcccucggcaacuacuacgucgacuccuuccuccucggcgccgacgccgccgacgagcucuccgucggccgcuacgcccccggcacccucggccagcccccccgccaggccgccacccucgccgagcaccccgacuucucccccugcuccuuccaguccaaggccaccgucuucggcgccuccuggaaccccguccacgccgccggcgccaacgccguccccgccgccgucuaccaccaccaccaccaccaccccuacguccacccccaggcccccgucgccgccgccgcccccgacggccgcuacaugcgcuccuggcucgagcccacccccggcgcccucuccuucgccggccuccccuccucccgccccuacggcaucaagcccgagccccucuccgcccgccgcggcgacugccccacccucgacacccacacccucucccucaccgacuacgccugcggcuccccccccgucgaccgcgagaagcagcccuccgagggcgccuucuccgagaacaacgccgagaacgaguccggcggcgacaagccccccaucgaccccaacaaccccgccgccaacuggcuccacgcccgcuccacccgcaagaagcgcugccccuacaccaagcaccagacccucgagcucgagaaggaguuccucuucaacauguaccucacccgcgaccgccgcuacgaggucgcccgccuccucaaccucaccgagcgccaggucaagaucugguuccagaaccgccgcaugaagaugaagaagaucaacaaggaccgcgccaaggacgaguga

SEQ ID NO: 44281 - RNA, 855 nt, Artificial Sequence
  derived and/or modified sequence opt2 from HOXB13__Homo_sapiens__NP_006352
auggagcccggcaacuacgccacccucgacggcgccaaggacaucgagggccuccucggcgccggcggcggccgcaaccucgucgcccacuccccccucaccucccaccccgccgcccccacccucaugcccgccgucaacuacgccccccucgaccuccccggcuccgccgagccccccaagcagugccaccccugccccggcgucccccagggcaccucccccgcccccguccccuacggcuacuucggcggcggcuacuacuccugccgcgucucccgcuccucccucaagcccugcgcccaggccgccacccucgccgccuaccccgccgagacccccaccgccggcgaggaguaccccucccgccccaccgaguucgccuucuaccccggcuaccccggcaccuaccagcccauggccuccuaccucgacgucuccgucguccagacccucggcgcccccggcgagccccgccacgacucccuccuccccgucgacuccuaccaguccugggcccucgccggcggcuggaacucccagaugugcugccagggcgagcagaacccccccggccccuucuggaaggccgccuucgccgacuccuccggccagcacccccccgacgccugcgccuuccgccgcggccgcaagaagcgcauccccuacuccaagggccagcuccgcgagcucgagcgcgaguacgccgccaacaaguucaucaccaaggacaagcgccgcaagaucuccgccgccaccucccucuccgagcgccagaucaccaucugguuccagaaccgccgcgucaaggagaagaagguccucgccaaggucaagaacuccgccacccccuga

SEQ ID NO: 44282 - RNA, 906 nt, Artificial Sequence
  derived and/or modified sequence opt2 from HOXB1__Homo_sapiens__NP_002135
auggacuacaaccgcaugaacuccuuccucgaguacccccucugcaaccgcggccccuccgccuacuccgcccacuccgcccccaccuccuucccccccuccuccgcccaggccgucgacuccuacgccuccgagggccgcuacggcggcggccucuccucccccgccuuccagcagaacuccggcuaccccgcccagcagccccccuccacccucggcguccccuuccccuccuccgcccccuccggcuacgcccccgccgccugcucccccuccuacggccccucccaguacuacccccucggccaguccgagggcgacggcggcuacuuccaccccuccuccuacggcgcccagcucggcggccucuccgacggcuacggcgccggcggcgccggccccggccccuaccccccccagcacccccccuacggcaacgagcagaccgccuccuucgcccccgccuacgccgaccuccucuccgaggacaaggagacccccugccccuccgagcccaacacccccaccgcccgcaccuucgacuggaugaaggucaagcgcaacccccccaagaccgccaaggucuccgagcccggccucggcucccccuccggccuccgcaccaacuucaccacccgccagcucaccgagcucgagaaggaguuccacuucaacaaguaccucucccgcgcccgccgcgucgagaucgccgccacccucgagcucaacgagacccaggucaagaucugguuccagaaccgccgcaugaagcagaagaagcgcgagcgcgaggagggccgcgucccccccgccccccccggcugccccaaggaggccgccggcgacgccuccgaccaguccaccugcaccucccccgaggccucccccuccuccgucaccuccuga

SEQ ID NO: 44283 - RNA, 1071 nt, Artificial Sequence
  derived and/or modified sequence opt2 from HOXB2__Homo_sapiens__NP_002136
augaacuucgaguucgagcgcgagaucggcuucaucaacucccagcccucccucgccgagugccucaccuccuuccccgccguccucgagaccuuccagaccuccuccaucaaggaguccacccucauccccccccccccccccuucgagcagaccuuccccucccuccagcccggcgccuccacccuccagcgcccccgcucccagaagcgcgccgaggacggccccgcccucccccccccccccccccccccccuccccgccgccccccccgcccccgaguuccccuggaugaaggagaagaaguccgccaagaagcccucccaguccgccaccucccccucccccgccgccuccgccguccccgccuccggcgucggcucccccgccgacggccucggccuccccgaggccggcggcggcggcgcccgccgccuccgcaccgccuacaccaacacccagcuccucgagcucgagaaggaguuccacuucaacaaguaccucugccgcccccgccgcgucgagaucgccgcccuccucgaccucaccgagcgccaggucaaggucugguuccagaaccgccgcaugaagcacaagcgccagacccagcaccgcgagccccccgacggcgagcccgccugccccggcgcccucgaggacaucugcgaccccgccgaggagcccgccgccucccccggcggccccuccgccucccgcgccgccugggaggccugcugccacccccccgaggucguccccggcgcccucuccgccgacccccgcccccucgccguccgccucgagggcgccggcgccuccucccccggcugcgcccuccgcggcgccggcggccucgagcccggcccccuccccgaggacgucuucuccggccgccaggacucccccuuccuccccgaccucaacuucuucgccgccgacuccugccuccagcucuccggcggccucucccccucccuccagggcucccucgacucccccguccccuucuccgaggaggagcucgacuucuucaccuccacccucugcgccaucgaccuccaguuccccuga

SEQ ID NO: 44284 - RNA, 900 nt, Artificial Sequence
  derived and/or modified sequence opt2 from HOXB3__Homo_sapiens__XP_005257339
augaaggagucccgccagaccuccaagcucaagaacaacucccccggcaccgccgagggcugcggcggcggcggcggcggcggcggcggcggcggcuccggcggcuccggcggcggcggcggcggcggcggcggcggcgacaaguccccccccggcuccgccgccuccaagcgcgcccgcaccgccuacaccuccgcccagcucgucgagcucgagaaggaguuccacuucaaccgcuaccucugccgcccccgccgcgucgagauggccaaccuccucaaccucuccgagcgccagaucaagaucugguuccagaaccgccgcaugaaguacaagaaggaccagaaggccaagggccucgccuccuccuccggcggccccucccccgccggcucccccccccagcccaugcaguccaccgccggcuucaugaacgcccuccacuccaugacccccuccuacgagucccccuccccccccgccuucggcaaggcccaccagaacgccuacgcccuccccuccaacuaccagcccccccucaagggcugcggcgccccccagaaguacccccccacccccgcccccgaguacgagccccacguccuccaggccaacggcggcgccuacggcacccccaccaugcagggcucccccgucuacgucggcggcggcggcuacgccgacccccuccccccccccgccggccccucccucuacggccucaaccaccucucccaccaccccuccggcaaccucgacuacaacggcgccccccccauggcccccucccagcaccacggccccugcgagccccaccccaccuacaccgaccucuccucccaccacgccccccccccccagggccgcauccaggaggcccccaagcucacccaccucuga

SEQ ID NO: 44285 - RNA, 756 nt, Artificial Sequence
  derived and/or modified sequence opt2 from HOXB4__Homo_sapiens__NP_076920
auggccauguccuccuuccucaucaacuccaacuacgucgaccccaaguucccccccugcgaggaguacucccaguccgacuaccuccccuccgaccacucccccggcuacuacgccggcggccagcgccgcgaguccuccuuccagcccgaggccggcuucggccgccgcgccgccugcaccguccagcgcuacgccgccugccgcgaccccggccccccccccccccccccccccccccccccccccccccccccccccggccucuccccccgcgcccccgcccccccccccgccggcgcccuccuccccgagcccggccagcgcugcgaggccgucuccuccucccccccccccccccccugcgcccagaacccccuccaccccucccccucccacuccgccugcaaggagcccgucgucuaccccuggaugcgcaagguccacgucuccaccgucaaccccaacuacgccggcggcgagcccaagcgcucccgcaccgccuacacccgccagcagguccucgagcucgagaaggaguuccacuacaaccgcuaccucacccgccgccgccgcgucgagaucgcccacgcccucugccucuccgagcgccagaucaagaucugguuccagaaccgccgcaugaaguggaagaaggaccacaagcuccccaacaccaagauccgcuccggcggcgccgccggcuccgccggcggcccccccggccgccccaacggcggcccccgcgcccucuga

SEQ ID NO: 44286 - RNA, 810 nt, Artificial Sequence
  derived and/or modified sequence opt2 from HOXB5__Homo_sapiens__NP_002138
auguccuccuacuucgucaacuccuucuccggccgcuaccccaacggccccgacuaccagcuccucaacuacggcuccggcuccucccucuccggcuccuaccgcgaccccgccgccaugcacaccggcuccuacggcuacaacuacaacggcauggaccucuccgucaaccgcuccuccgccuccuccucccacuucggcgccgucggcgaguccucccgcgccuuccccgcccccgcccaggagccccgcuuccgccaggccgccuccuccugcucccucuccucccccgagucccuccccugcaccaacggcgacucccacggcgccaagcccuccgccuccucccccuccgaccaggccaccuccgccuccuccuccgccaacuucaccgagaucgacgaggccuccgccuccuccgagcccgaggaggccgccucccagcucuccucccccucccucgcccgcgcccagcccgagcccauggccaccuccaccgccgcccccgagggccagaccccccagaucuuccccuggaugcgcaagcuccacaucucccacgacaugaccggccccgacggcaagcgcgcccgcaccgccuacacccgcuaccagacccucgagcucgagaaggaguuccacuucaaccgcuaccucacccgccgccgccgcaucgagaucgcccacgcccucugccucuccgagcgccagaucaagaucugguuccagaaccgccgcaugaaguggaagaaggacaacaagcucaaguccaugucccucgccaccgccggcuccgccuuccagcccuga

SEQ ID NO: 44287 - RNA, 675 nt, Artificial Sequence
  derived and/or modified sequence opt2 from HOXB6__Homo_sapiens__XP_005257340
auguccuccuacuucgucaacuccaccuuccccgucacccucgccuccggccaggaguccuuccucggccagcucccccucuacuccuccggcuacgccgacccccuccgccacuaccccgcccccuacggccccggccccggccaggacaagggcuucgccaccuccuccuacuacccccccgccggcggcggcuacggccgcgccgcccccugcgacuacggccccgcccccgccuucuaccgcgagaaggaguccgccugcgcccucuccggcgccgacgagcagccccccuuccaccccgagccccgcaaguccgacugcgcccaggacaaguccgucuucggcgagaccgaggagcagaagugcuccacccccgucuaccccuggaugcagcgcaugaacuccugcaacuccuccuccuucggccccuccggccgccgcggccgccagaccuacacccgcuaccagacccucgagcucgagaaggaguuccacuacaaccgcuaccucacccgccgccgccgcaucgagaucgcccacgcccucugccucaccgagcgccagaucaagaucugguuccagaaccgccgcaugaaguggaagaaggaguccaagcuccucuccgccucccagcucuccgccgaggaggaggaggagaagcaggccgaguga

SEQ ID NO: 44288 - RNA, 654 nt, Artificial Sequence
  derived and/or modified sequence opt2 from HOXB7__Homo_sapiens__NP_004493
auguccucccucuacuacgccaacacccucuucuccaaguaccccgccuccuccuccgucuucgccaccggcgccuuccccgagcagaccuccugcgccuucgccuccaacccccagcgccccggcuacggcgccggcuccggcgccuccuucgccgccuccaugcagggccucuaccccggcggcggcggcauggccggccaguccgccgccggcgucuacgccgccggcuacggccucgagcccuccuccuucaacaugcacugcgcccccuucgagcagaaccucuccggcgucugccccggcgacuccgccaaggccgccggcgccaaggagcagcgcgacuccgaccucgccgccgaguccaacuuccgcaucuaccccuggaugcgcuccuccggcaccgaccgcaagcgcggccgccagaccuacacccgcuaccagacccucgagcucgagaaggaguuccacuacaaccgcuaccucacccgccgccgccgcaucgagaucgcccacacccucugccucaccgagcgccagaucaagaucugguuccagaaccgccgcaugaaguggaagaaggagaacaagaccgccggccccggcaccaccggccaggaccgcgccgaggccgaggaggaggaggaggaguga

SEQ ID NO: 44289 - RNA, 732 nt, Artificial Sequence
  derived and/or modified sequence opt2 from HOXB8__Homo_sapiens__NP_076921
auguccuccuacuucgucaacucccucuucuccaaguacaagaccggcgagucccuccgccccaacuacuacgacugcggcuucgcccaggaccucggcggccgccccaccgucgucuacggccccuccuccggcggcuccuuccagcaccccucccagauccaggaguucuaccacggccccuccucccucuccaccgcccccuaccagcagaaccccugcgccgucgccugccacggcgaccccggcaacuucuacggcuacgacccccuccagcgccagucccucuucggcgcccaggaccccgaccucguccaguacgccgacugcaagcucgccgccgccuccggccucggcgaggaggccgagggcuccgagcagucccccucccccacccagcucuuccccuggaugcgcccccaggccgccgccggccgccgccgcggccgccagaccuacucccgcuaccagacccucgagcucgagaaggaguuccucuucaaccccuaccucacccgcaagcgccgcaucgaggucucccacgcccucggccucaccgagcgccaggucaagaucugguuccagaaccgccgcaugaaguggaagaaggagaacaacaaggacaaguuccccuccuccaagugcgagcaggaggagcucgagaagcagaagcucgagcgcgcccccgaggccgccgacgagggcgacgcccagaagggcgacaagaaguga

SEQ ID NO: 44290 - RNA, 753 nt, Artificial Sequence
  derived and/or modified sequence opt2 from HOXB9__Homo_sapiens__NP_076922
auguccaucuccggcacccucuccuccuacuacgucgacuccaucaucucccacgaguccgaggacgccccccccgccaaguuccccuccggccaguacgccuccucccgccagcccggccacgccgagcaccucgaguuccccuccugcuccuuccagcccaaggcccccgucuucggcgccuccugggccccccucuccccccacgccuccggcucccuccccuccgucuaccaccccuacauccagccccagggcgucccccccgccgagucccgcuaccuccgcaccuggcucgagcccgccccccgcggcgaggccgcccccggccagggccaggccgccgucaaggccgagccccuccucggcgcccccggcgagcuccucaagcagggcacccccgaguacucccucgagaccuccgccggccgcgaggccguccucuccaaccagcgccccggcuacggcgacaacaagaucugcgagggcuccgaggacaaggagcgccccgaccagaccaaccccuccgccaacuggcuccacgcccgcuccucccgcaagaagcgcugccccuacaccaaguaccagacccucgagcucgagaaggaguuccucuucaacauguaccucacccgcgaccgccgccacgaggucgcccgccuccucaaccucuccgagcgccaggucaagaucugguuccagaaccgccgcaugaagaugaagaagaugaacaaggagcagggcaaggaguga

SEQ ID NO: 44291 - RNA, 1029 nt, Artificial Sequence
  derived and/or modified sequence opt2 from HOXC10__Homo_sapiens__NP_059105
augaccugcccccgcaacgucacccccaacuccuacgccgagccccucgccgcccccggcggcggcgagcgcuacucccgcuccgccggcauguacaugcaguccggcuccgacuucaacugcggcgucaugcgcggcugcggccucgcccccucccucuccaagcgcgacgagggcuccucccccucccucgcccucaacaccuaccccuccuaccucucccagcucgacuccuggggcgaccccaaggccgccuaccgccucgagcagcccgucggccgcccccucuccuccugcuccuacccccccuccgucaaggaggagaacgucugcugcauguacuccgccgagaagcgcgccaaguccggccccgaggccgcccucuacucccacccccuccccgaguccugccucggcgagcacgagguccccguccccuccuacuaccgcgccucccccuccuacuccgcccucgacaagaccccccacugcuccggcgccaacgacuucgaggcccccuucgagcagcgcgccucccucaacccccgcgccgagcaccucgaguccccccagcucggcggcaaggucuccuuccccgagacccccaaguccgacucccagacccccucccccaacgagaucaagaccgagcagucccucgccggccccaagggcucccccuccgaguccgagaaggagcgcgccaaggccgccgacuccucccccgacaccuccgacaacgaggccaaggaggagaucaaggccgagaacaccaccggcaacuggcucaccgccaaguccggccgcaagaagcgcugccccuacaccaagcaccagacccucgagcucgagaaggaguuccucuucaacauguaccucacccgcgagcgccgccucgagaucuccaagaccaucaaccucaccgaccgccaggucaagaucugguuccagaaccgccgcaugaagcucaagaagaugaaccgcgagaaccgcauccgcgagcucaccuccaacuucaacuucaccuga

SEQ ID NO: 44292 - RNA, 915 nt, Artificial Sequence
  derived and/or modified sequence opt2 from HOXC11__Homo_sapiens__NP_055027
auguucaacuccgucaaccucggcaacuucugcucccccucccgcaaggagcgcggcgccgacuucggcgagcgcggcuccugcgccuccaaccucuaccuccccuccugcaccuacuacaugcccgaguucuccaccgucuccuccuuccucccccaggcccccucccgccagaucuccuaccccuacuccgcccaggucccccccguccgcgaggucuccuacggccucgagcccuccggcaaguggcaccaccgcaacuccuacuccuccugcuacgccgccgccgacgagcucaugcaccgcgagugccucccccccuccaccgucaccgagauccucaugaagaacgagggcuccuacggcggccaccaccaccccuccgccccccacgccacccccgccggcuucuacuccuccgucaacaagaacuccguccucccccaggccuucgaccgcuucuucgacaacgccuacugcggcggcggcgacccccccgccgagccccccugcuccggcaagggcgaggccaagggcgagcccgaggccccccccgccuccggccucgccucccgcgccgaggccggcgccgaggccgaggccgaggaggagaacaccaaccccuccuccuccggcuccgcccacuccgucgccaaggagcccgccaagggcgccgcccccaacgccccccgcacccgcaagaagcgcugccccuacuccaaguuccagauccgcgagcucgagcgcgaguucuucuucaacgucuacaucaacaaggagaagcgccuccagcucucccgcaugcucaaccucaccgaccgccaggucaagaucugguuccagaaccgccgcaugaaggagaagaagcucucccgcgaccgccuccaguacuucuccggcaacccccuccucuga

SEQ ID NO: 44293 - RNA, 849 nt, Artificial Sequence
  derived and/or modified sequence opt2 from HOXC12__Homo_sapiens__NP_776272
augggcgagcacaaccuccucaaccccggcuucgucggcccccucgucaacauccacaccggcgacaccuucuacuuccccaacuuccgcgccuccggcgcccagcuccccggccuccccucccucuccuacccccgccgcgacaacgucugcucccucuccuggcccuccgccgagcccugcaacggcuacccccagcccuaccucggcucccccgucucccucaacccccccuucggccgcaccugcgagcucgcccgcgucgaggacggcaagggcuacuaccgcgagcccugcgccgagggcggcggcggcggccucaagcgcgaggagcgcggccgcgaccccggcgccggccccggcgccgcccuccucccccucgagcccuccggcccccccgcccucggcuucaaguacgacuacgccgccggcggcggcggcggcgacggcggcggcggcgccggccccccccacgacccccccuccugccagucccucgaguccgacuccuccuccucccuccucaacgagggcaacaagggcgccggcgccggcgaccccggcucccucgucuccccccucaaccccggcggcggccucuccgccuccggcgcccccugguaccccaucaacucccgcucccgcaagaagcgcaagcccuacuccaagcuccagcucgccgagcucgagggcgaguuccucgucaacgaguucaucacccgccagcgccgccgcgagcucuccgaccgccucaaccucuccgaccagcaggucaagaucugguuccagaaccgccgcaugaagaagaagcgccuccuccuccgcgagcaggcccucuccuucuucuga

SEQ ID NO: 44294 - RNA, 993 nt, Artificial Sequence
  derived and/or modified sequence opt2 from HOXC13__Homo_sapiens__NP_059106
augaccaccucccuccuccuccacccccgcuggcccgagucccucauguacgucuacgaggacuccgccgccgaguccggcaucggcggcggcggcggcggcggcggcggcggcaccggcggcgccggcggcggcugcuccggcgccucccccggcaaggcccccuccauggacggccucggcuccuccugccccgccucccacugccgcgaccuccucccccaccccguccucggccgcccccccgccccccucggcgccccccagggcgccgucuacaccgacauccccgcccccgaggccgcccgccagugcgcccccccccccgccccccccaccuccuccuccgccacccucggcuacggcuaccccuucggcggcuccuacuacggcugccgccucucccacaacgucaaccuccagcagaagcccugcgccuaccaccccggcgacaaguaccccgagcccuccggcgcccuccccggcgacgaccucuccucccgcgccaaggaguucgccuucuaccccuccuucgccuccuccuaccaggccaugcccggcuaccucgacgucuccgucguccccggcaucuccggccaccccgagccccgccacgacgcccucauccccgucgagggcuaccagcacugggcccucuccaacggcugggacucccaggucuacugcuccaaggagcagucccaguccgcccaccucuggaagucccccuuccccgacgucgucccccuccagcccgaggucuccuccuaccgccgcggccgcaagaagcgcguccccuacaccaagguccagcucaaggagcucgagaaggaguacgccgccuccaaguucaucaccaaggagaagcgccgccgcaucuccgccaccaccaaccucuccgagcgccaggucaccaucugguuccagaaccgccgcgucaaggagaagaaggucgucuccaaguccaaggccccccaccuccacuccaccuga

SEQ ID NO: 44295 - RNA, 795 nt, Artificial Sequence
  derived and/or modified sequence opt2 from HOXC4__Homo_sapiens__NP_705897
augaucauguccuccuaccucauggacuccaacuacaucgaccccaaguucccccccugcgaggaguacucccagaacuccuacauccccgagcacucccccgaguacuacggccgcacccgcgaguccggcuuccagcaccaccaccaggagcucuacccccccccccccccccgccccuccuaccccgagcgccaguacuccugcaccucccuccagggccccggcaacucccgcggccacggccccgcccaggccggccaccaccaccccgagaagucccagucccucugcgagcccgccccccucuccggcgccuccgccucccccucccccgccccccccgccugcucccagcccgcccccgaccaccccuccuccgccgccuccaagcagcccaucgucuaccccuggaugaagaagauccacgucuccaccgucaaccccaacuacaacggcggcgagcccaagcgcucccgcaccgccuacacccgccagcagguccucgagcucgagaaggaguuccacuacaaccgcuaccucacccgccgccgccgcaucgagaucgcccacucccucugccucuccgagcgccagaucaagaucugguuccagaaccgccgcaugaaguggaagaaggaccaccgccuccccaacaccaagguccgcuccgccccccccgccggcgccgcccccuccacccucuccgccgccacccccggcaccuccgaggaccacucccaguccgccaccccccccgagcagcagcgcgccgaggacaucacccgccucuga

SEQ ID NO: 44296 - RNA, 669 nt, Artificial Sequence
  derived and/or modified sequence opt2 from HOXC5__Homo_sapiens__NP_061826
auguccuccuacgucgccaacuccuucuacaagcagucccccaacauccccgccuacaacaugcagaccugcggcaacuacggcuccgccuccgagguccaggccucccgcuacugcuacggcggccucgaccucuccaucaccuuccccccccccgcccccuccaacucccuccacggcgucgacauggccgccaacccccgcgcccaccccgaccgccccgccugcuccgccgccgccgcccccggccacgcccccggccgcgacgaggccgccccccucaaccccggcauguacucccagaaggccgcccgccccgcccucgaggagcgcgccaaguccuccggcgagaucaaggaggagcaggcccagaccggccagcccgccggccucucccagccccccgcccccccccagaucuaccccuggaugaccaagcuccacaugucccacgagaccgacggcaagcgcucccgcaccuccuacacccgcuaccagacccucgagcucgagaaggaguuccacuucaaccgcuaccucacccgccgccgccgcaucgagaucgccaacaaccucugccucaacgagcgccagaucaagaucugguuccagaaccgccgcaugaaguggaagaaggacuccaagaugaaguccaaggaggcccucuga

SEQ ID NO: 44297 - RNA, 708 nt, Artificial Sequence
  derived and/or modified sequence opt2 from HOXC6__Homo_sapiens__NP_004494
augaacuccuacuucaccaaccccucccucuccugccaccucgccggcggccaggacguccuccccaacgucgcccucaacuccaccgccuacgaccccguccgccacuucuccaccuacggcgccgccgucgcccagaaccgcaucuacuccacccccuucuacuccccccaggagaacgucgucuucuccuccucccgcggccccuacgacuacggcuccaacuccuucuaccaggagaaggacaugcucuccaacugccgccagaacacccucggccacaacacccagaccuccaucgcccaggacuucuccuccgagcagggccgcaccgccccccaggaccagaaggccuccauccagaucuaccccuggaugcagcgcaugaacucccacuccggcgucggcuacggcgccgaccgccgccgcggccgccagaucuacucccgcuaccagacccucgagcucgagaaggaguuccacuucaaccgcuaccucacccgccgccgccgcaucgagaucgccaacgcccucugccucaccgagcgccagaucaagaucugguuccagaaccgccgcaugaaguggaagaaggaguccaaccucaccuccacccucuccggcggcggcggcggcgccaccgccgacucccucggcggcaaggaggagaagcgcgaggagaccgaggaggagaagcagaaggaguga

SEQ ID NO: 44298 - RNA, 729 nt, Artificial Sequence
  derived and/or modified sequence opt2 from HOXC8__Homo_sapiens__NP_073149
auguccuccuacuucgucaacccccucuucuccaaguacaaggccggcgagucccucgagcccgccuacuacgacugccgcuucccccaguccgucggccgcucccacgcccucgucuacggccccggcggcuccgcccccggcuuccagcacgccucccaccacguccaggacuucuuccaccacggcaccuccggcaucuccaacuccggcuaccagcagaaccccugcucccucuccugccacggcgacgccuccaaguucuacggcuacgaggcccucccccgccagucccucuacggcgcccagcaggaggccuccgucguccaguaccccgacugcaaguccuccgccaacaccaacuccuccgagggccagggccaccucaaccagaacuccucccccucccucauguuccccuggaugcgcccccacgcccccggccgccgcuccggccgccagaccuacucccgcuaccagacccucgagcucgagaaggaguuccucuucaaccccuaccucacccgcaagcgccgcaucgaggucucccacgcccucggccucaccgagcgccaggucaagaucugguuccagaaccgccgcaugaaguggaagaaggagaacaacaaggacaagcuccccggcgcccgcgacgaggagaaggucgaggaggagggcaacgaggaggaggagaaggaggaggaggagaaggaggagaacaaggacuga

SEQ ID NO: 44299 - RNA, 783 nt, Artificial Sequence
  derived and/or modified sequence opt2 from HOXC9__Homo_sapiens__NP_008828
auguccgccaccggccccaucuccaacuacuacgucgacucccucaucucccacgacaacgaggaccuccucgccucccgcuuccccgccaccggcgcccaccccgccgccgcccgccccuccggccucguccccgacugcuccgacuuccccuccugcuccuucgcccccaagcccgccgucuucuccaccuccugggcccccguccccucccaguccuccgucgucuaccaccccuacggcccccagccccaccucggcgccgacacccgcuacaugcgcaccuggcucgagccccucuccggcgccgucuccuuccccuccuuccccgccggcggccgccacuacgcccucaagcccgacgccuaccccggccgccgcgccgacugcggccccggcgagggccgcuccuaccccgacuacauguacggcucccccggcgagcuccgcgaccgcgccccccagacccuccccucccccgaggccgacgcccucgccggcuccaagcacaaggaggagaaggccgaccucgaccccuccaaccccgucgccaacuggauccacgcccgcuccacccgcaagaagcgcugccccuacaccaaguaccagacccucgagcucgagaaggaguuccucuucaacauguaccucacccgcgaccgccgcuacgaggucgcccgcguccucaaccucaccgagcgccaggucaagaucugguuccagaaccgccgcaugaagaugaagaagaugaacaaggagaagaccgacaaggagcaguccuga

SEQ ID NO: 44300 - RNA, 1023 nt, Artificial Sequence
  derived and/or modified sequence opt2 from HOXD10__Homo_sapiens__NP_002139
auguccuuccccaacuccucccccgccgccaacaccuuccucgucgacucccucaucuccgccugccgcuccgacuccuucuacuccuccuccgccuccauguacaugcccccccccuccgccgacaugggcaccuacggcaugcagaccugcggccuccuccccucccucgccaagcgcgaggucaaccaccagaacaugggcaugaacguccaccccuacaucccccaggucgacuccuggaccgaccccaaccgcuccugccgcaucgagcagcccgucacccagcagguccccaccugcuccuucaccaccaacaucaaggaggaguccaacugcugcauguacuccgacaagcgcaacaagcucaucuccgccgagguccccuccuaccagcgccucguccccgaguccugccccgucgagaaccccgagguccccguccccggcuacuuccgccucucccagaccuacgccaccggcaagacccaggaguacaacaacucccccgagggcuccuccaccgucaugcuccagcucaacccccgcggcgccgccaagccccagcucuccgccgcccagcuccagauggagaagaagaugaacgagcccgucuccggccaggagcccaccaaggucucccaggucgagucccccgaggccaagggcggccuccccgaggagcgcuccugccucgccgaggucuccgucuccucccccgagguccaggagaaggaguccaaggaggagaucaaguccgacacccccaccuccaacuggcucaccgccaaguccggccgcaagaagcgcugccccuacaccaagcaccagacccucgagcucgagaaggaguuccucuucaacauguaccucacccgcgagcgccgccucgagaucuccaaguccgucaaccucaccgaccgccaggucaagaucugguuccagaaccgccgcaugaagcucaagaagaugucccgcgagaaccgcauccgcgagcucaccgccaaccucaccuucuccuga

SEQ ID NO: 44301 - RNA, 1017 nt, Artificial Sequence
  derived and/or modified sequence opt2 from HOXD11__Homo_sapiens__NP_067015
augaacgacuucgacgagugcggccaguccgccgccuccauguaccuccccggcugcgccuacuacgucgcccccuccgacuucgccuccaagcccuccuuccucucccagcccuccuccugccagaugaccuuccccuacuccuccaaccucgccccccacguccagcccguccgcgaggucgccuuccgcgacuacggccucgagcgcgccaaguggcccuaccgcggcggcggcggcggcggcuccgccggcggcggcuccuccggcggcggccccggcggcggcggcggcggcgccggcggcuacgcccccuacuacgccgccgccgccgccgccgccgccgccgccgccgccgccgaggaggccgccaugcagcgcgagcuccucccccccgccggccgccgccccgacguccucuucaaggcccccgagcccgucugcgccgcccccggccccccccacggccccgccggcgccgccuccaacuucuacuccgccgucggccgcaacggcauccucccccagggcuucgaccaguucuacgaggccgcccccggcccccccuucgccggcccccagcccccccccccccccgcccccccccagcccgagggcgccgccgacaagggcgacccccgcaccggcgccggcggcggcggcggcucccccugcaccaaggccacccccggcuccgagcccaagggcgccgccgagggcuccggcggcgacggcgagggcccccccggcgaggccggcgccgagaaguccuccuccgccgucgccccccagcgcucccgcaagaagcgcugccccuacaccaaguaccagauccgcgagcucgagcgcgaguucuucuucaacgucuacaucaacaaggagaagcgccuccagcucucccgcaugcucaaccucaccgaccgccaggucaagaucugguuccagaaccgccgcaugaaggagaagaagcucaaccgcgaccgccuccaguacuucaccggcaacccccucuucuga

SEQ ID NO: 44302 - RNA, 813 nt, Artificial Sequence
  derived and/or modified sequence opt2 from HOXD12__Homo_sapiens__NP_067016
augugcgagcgcucccucuaccgcgccggcuacgucggcucccuccucaaccuccagucccccgacuccuucuacuucuccaaccuccgccccaacggcggccagcucgccgcccucccccccaucuccuacccccgcggcgcccuccccugggccgccacccccgccuccugcgcccccgcccagcccgccggcgccaccgccuucggcggcuucucccagcccuaccucgccggcuccggcccccucggccuccagccccccaccgccaaggacggccccgaggagcaggccaaguucuacgcccccgaggccgccgccggccccgaggagcgcggccgcacccgccccuccuucgcccccgaguccucccucgcccccgccgucgccgcccucaaggccgccaaguacgacuacgccggcgucggccgcgccacccccggcuccaccacccuccuccagggcgcccccugcgcccccggcuucaaggacgacaccaagggcccccucaaccucaacaugaccguccaggccgccggcgucgccuccugccuccgccccucccuccccgacggccuccccuggggcgccgcccccggccgcgcccgcaagaagcgcaagcccuacaccaagcagcagaucgccgagcucgagaacgaguuccucgucaacgaguucaucaaccgccagaagcgcaaggagcucuccaaccgccucaaccucuccgaccagcaggucaagaucugguuccagaaccgccgcaugaagaagaagcgcgucguccuccgcgagcaggcccucgcccucuacuga

SEQ ID NO: 44303 - RNA, 1032 nt, Artificial Sequence
  derived and/or modified sequence opt2 from HOXD13__Homo_sapiens__NP_000514
augucccgcgccggcuccugggacauggacggccuccgcgccgacggcggcggcgccggcggcgcccccgccuccuccuccuccuccuccgucgccgccgccgccgccuccggccagugccgcggcuuccucuccgcccccgucuucgccggcacccacuccggccgcgccgccgccgccgccgccgccgccgccgccgccgccgccgccgccuccggcuucgccuaccccggcaccuccgagcgcaccggcuccuccuccuccuccuccuccuccgccgucgucgccgcccgccccgaggccccccccgccaaggagugccccgcccccacccccgccgccgccgccgccgccccccccuccgcccccgcccucggcuacggcuaccacuucggcaacggcuacuacuccugccgcaugucccacggcgucggccuccagcagaacgcccucaaguccuccccccacgccucccucggcggcuuccccgucgagaaguacauggacgucuccggccucgccuccuccuccguccccgccaacgagguccccgcccgcgccaaggaggucuccuucuaccagggcuacaccucccccuaccagcacguccccggcuacaucgacauggucuccaccuucggcuccggcgagccccgccacgaggccuacaucuccauggagggcuaccaguccuggacccucgccaacggcuggaacucccaggucuacugcaccaaggaccagccccagggcucccacuucuggaaguccuccuuccccggcgacgucgcccucaaccagcccgacaugugcgucuaccgccgcggccgcaagaagcgcguccccuacaccaagcuccagcucaaggagcucgagaacgaguacgccaucaacaaguucaucaacaaggacaagcgccgccgcaucuccgccgccaccaaccucuccgagcgccaggucaccaucugguuccagaaccgccgcgucaaggacaagaagaucgucuccaagcucaaggacaccgucuccuga

SEQ ID NO: 44304 - RNA, 987 nt, Artificial Sequence
  derived and/or modified sequence opt2 from HOXD1__Homo_sapiens__NP_078777
auguccuccuaccucgaguacgucuccugcuccuccuccggcggcgucggcggcgacguccucucccucgcccccaaguucugccgcuccgacgcccgccccgucgcccuccagcccgccuucccccucggcaacggcgacggcgccuucgucuccugccucccccucgccgccgcccgccccucccccuccccccccgccgcccccgcccgccccuccguccccccccccgccgccccccaguacgcccagugcacccucgagggcgccuacgagcccggcgccgcccccgccgccgccgccggcggcgccgacuacggcuuccucggcuccggccccgccuacgacuuccccggcguccucggccgcgccgccgacgacggcggcucccacguccacuacgccaccuccgccgucuucuccggcggcggcuccuuccuccucuccggccaggucgacuacgccgccuucggcgagcccggccccuuccccgccugccucaaggccuccgccgacggccaccccggcgccuuccagaccgccucccccgcccccggcaccuaccccaaguccgucucccccgccuccggccuccccgccgccuucuccaccuucgaguggaugaaggucaagcgcaacgccuccaagaagggcaagcucgccgaguacggcgccgccucccccuccuccgccauccgcaccaacuucuccaccaagcagcucaccgagcucgagaaggaguuccacuucaacaaguaccucacccgcgcccgccgcaucgagaucgccaacugccuccaccucaacgacacccaggucaagaucugguuccagaaccgccgcaugaagcagaagaagcgcgagcgcgagggccuccucgccaccgccauccccgucgccccccuccagcucccccucuccggcaccacccccaccaaguucaucaagaaccccggcucccccucccagucccaggagcccuccuga

SEQ ID NO: 44305 - RNA, 1299 nt, Artificial Sequence
  derived and/or modified sequence opt2 from HOXD3__Homo_sapiens__XP_006712540
augcucuucgagcagggccagcaggcccucgagcuccccgagugcaccaugcagaaggccgccuacuacgagaaccccggccucuucggcggcuacggcuacuccaagaccaccgacaccuacggcuacuccaccccccaccagcccuaccccccccccgccgccgccuccucccucgacaccgacuaccccggcuccgccugcuccauccaguccuccgccccccuccgcgcccccgcccacaagggcgccgagcucaacggcuccugcaugcgccccggcaccggcaacucccagggcggcggcggcggcucccagccccccggccucaacuccgagcagcagcccccccagccccccccccccccccccacccucccccccuccucccccaccaaccccggcggcggcguccccgccaagaagcccaagggcggccccaacgccuccuccuccuccgccaccaucuccaagcagaucuuccccuggaugaaggagucccgccagaacuccaagcagaagaacuccugcgccaccgccggcgaguccugcgaggacaaguccccccccggccccgccuccaagcgcguccgcaccgccuacaccuccgcccagcucgucgagcucgagaaggaguuccacuucaaccgcuaccucugccgcccccgccgcgucgagauggccaaccuccucaaccucaccgagcgccagaucaagaucugguuccagaaccgccgcaugaaguacaagaaggaccagaaggccaagggcauccuccacucccccgccucccagucccccgagcgcucccccccccucggcggcgccgccggccacgucgccuacuccggccagcucccccccguccccggccucgccuacgacgcccccuccccccccgccuucgccaagucccagcccaacauguacggccucgccgccuacaccgccccccucuccuccugccucccccagcagaagcgcuacgccgcccccgaguucgagccccaccccauggccuccaacggcggcggcuucgccuccgccaaccuccagggcucccccgucuacgucggcggcaacuucgucgaguccauggcccccgccuccggccccgucuucaaccucggccaccucucccaccccuccuccgccuccgucgacuacuccugcgccgcccagauccccggcaaccaccaccacggccccugcgacccccaccccaccuacaccgaccucuccgcccaccacuccucccagggccgccuccccgaggcccccaagcucacccaccucuga

SEQ ID NO: 44306 - RNA, 768 nt, Artificial Sequence
  derived and/or modified sequence opt2 from HOXD4__Homo_sapiens__NP_055436
auggucauguccuccuacauggucaacuccaaguacgucgaccccaaguucccccccugcgaggaguaccuccagggcggcuaccucggcgagcagggcgccgacuacuacggcggcggcgcccagggcgccgacuuccagccccccggccucuacccccgccccgacuucggcgagcagcccuucggcggcuccggccccggccccggcuccgcccuccccgcccgcggccacggccaggagcccggcggccccggcggccacuacgccgcccccggcgagcccugccccgccccccccgcccccccccccgccccccuccccggcgcccgcgccuacucccaguccgaccccaagcagccccccuccggcaccgcccucaagcagcccgccgucgucuaccccuggaugaagaagguccacgucaacuccgucaaccccaacuacaccggcggcgagcccaagcgcucccgcaccgccuacacccgccagcagguccucgagcucgagaaggaguuccacuucaaccgcuaccucacccgccgccgccgcaucgagaucgcccacacccucugccucuccgagcgccagaucaagaucugguuccagaaccgccgcaugaaguggaagaaggaccacaagcuccccaacaccaagggccgcuccuccuccuccuccuccuccuccuccugcuccuccuccgucgcccccucccagcaccuccagcccauggccaaggaccaccacaccgaccucaccacccucuga

SEQ ID NO: 44307 - RNA, 870 nt, Artificial Sequence
  derived and/or modified sequence opt2 from HOXD8__Homo_sapiens__NP_001186675
auguccuccuacuucgucaacccccucuacuccaaguacaaggccgccgccgccgccgccgccgccgccggcgaggccaucaaccccaccuacuacgacugccacuucgcccccgaggucggcggccgccacgccgccgccgccgccgcccuccagcucuacggcaacuccgccgccggcuucccccacgcccccccccaggcccacgcccacccccaccccucccccccccccuccggcaccggcugcggcggccgcgagggccgcggccaggaguacuuccaccccggcggcggcucccccgccgccgccuaccaggccgccccccccccccccccccaccccccccccccccccccccccccccccugcggcggcaucgccugccacggcgagcccgccaaguucuacggcuacgacaaccuccagcgccagcccaucuucaccacccagcaggaggccgagcucguccaguaccccgacugcaaguccuccuccggcaacaucggcgaggaccccgaccaccucaaccaguccuccucccccucccagauguuccccuggaugcgcccccaggcccccggccgccgccgcggccgccagaccuacucccgcuuccagacccucgagcucgagaaggaguuccucuucaaccccuaccucacccgcaagcgccgcaucgaggucucccacgcccucgcccucaccgagcgccaggucaagaucugguuccagaaccgccgcaugaaguggaagaaggagaacaacaaggacaaguuccccgucucccgccaggaggucaaggacggcgagaccaagaaggaggcccaggagcucgaggaggaccgcgccgagggccucaccaacuga

SEQ ID NO: 44308 - RNA, 1059 nt, Artificial Sequence
  derived and/or modified sequence opt2 from HOXD9__Homo_sapiens__NP_055028
augcucggcggcuccgccggccgccucaagauguccuccuccggcacccucuccaacuacuacgucgacucccucaucggccacgagggcgacgaggucuucgccgcccgcuucggcccccccggccccggcgcccagggccgccccgccggcgucgccgacggccccgccgccaccgccgccgaguucgccuccugcuccuucgccccccgcuccgccgucuucuccgccuccugguccgccguccccucccagccccccgccgccgccgccauguccggccucuaccaccccuacguccccccccccccccucgccgccuccgccuccgagcccggccgcuacguccgcuccuggauggagccccuccccggcuuccccggcggcgccggcggcggcggcggcggcggcggcggcggccccggccgcggccccucccccggccccuccggccccgccaacggccgccacuacggcaucaagcccgagacccgcgccgcccccgcccccgccaccgccgccuccaccaccuccuccuccuccaccucccucuccuccuccuccaagcgcaccgagugcuccgucgcccgcgagucccagggcuccuccggccccgaguucuccugcaacuccuuccuccaggagaaggccgccgccgccaccggcggcaccggccccggcgccggcaucggcgccgccaccggcaccggcggcuccuccgagcccuccgccugcuccgaccaccccauccccggcugcucccucaaggaggaggagaagcagcacucccagccccagcagcagcagcucgaccccaacaaccccgccgccaacuggauccacgcccgcuccacccgcaagaagcgcugccccuacaccaaguaccagacccucgagcucgagaaggaguuccucuucaacauguaccucacccgcgaccgccgcuacgaggucgcccgcauccucaaccucaccgagcgccaggucaagaucugguuccagaaccgccgcaugaagaugaagaagauguccaaggagaagugccccaagggcgacuga

SEQ ID NO: 44309 - RNA, 1548 nt, Artificial Sequence
  derived and/or modified sequence opt2 from HP1BP3__Homo_sapiens__XP_011539836
augcccauccgccgcaccgucaacuccacccgcgagaccccccccaaguccaagcucgccgagggcgaggaggagaagcccgagcccgacaucuccuccgaggaguccgucuccaccgucgaggagcaggagaacgagaccccccccgccaccuccuccgaggccgagcagcccaagggcgagcccgagaacgaggagaaggaggagaacaaguccuccgaggagaccaagaaggacgagaaggaccaguccaaggagaaggagaagaaggucaagaagaccauccccuccugggccacccucuccgccucccagcucgcccgcgcccagaagcagacccccauggccuccuccccccgccccaagauggacgccauccucaccgaggccaucaaggccugcuuccagaaguccggcgccuccgucgucgccauccgcaaguacaucauccacaaguaccccucccucgagcucgagcgccgcggcuaccuccucaagcaggcccucaagcgcgagcucaaccgcggcgucaucaagcaggucaagggcaagggcgccuccggcuccuucgucgucguccagaagucccgcaagaccccccagaagucccgcaaccgcaagaaccgcuccuccgccgucgaccccgagccccaggucaagcucgaggacguccucccccucgccuucacccgccucugcgagcccaaggaggccuccuacucccucauccgcaaguacgucucccaguacuaccccaagcuccgcgucgacauccgcccccagcuccucaagaacgcccuccagcgcgccgucgagcgcggccagcucgagcagaucaccggcaagggcgccuccggcaccuuccagcucaagaaguccggcgagaagccccuccucggcggcucccucauggaguacgccauccucuccgccaucgccgccaugaacgagcccaagaccugcuccaccaccgcccucaagaaguacguccucgagaaccaccccggcaccaacuccaacuaccagaugcaccuccucaagaagacccuccagaagugcgagaagaacggcuggauggagcagaucuccggcaagggcuucuccggcaccuuccagcucugcuuccccuacuaccccucccccggcguccucuuccccaagaaggagcccgacgacucccgcgacgaggacgaggacgaggacgaguccuccgaggaggacuccgaggacgaggagcccccccccaagcgccgccuccagaagaagacccccgccaagucccccggcaaggccgccuccgucaagcagcgcggcuccaagcccgcccccaaggucuccgccgcccagcgcggcaaggcccgcccccuccccaagaaggccccccccaaggccaagacccccgccaagaagacccgccccuccuccaccgucaucaagaagcccuccggcggcuccuccaagaagcccgccaccuccgcccgcaaggaggucaagcuccccggcaagggcaaguccaccaugaagaaguccuuccgcgucaagaaguga

SEQ ID NO: 44310 - RNA, 582 nt, Artificial Sequence
  derived and/or modified sequence opt2 from HPCAL1__Homo_sapiens__XP_011508650
augggcaagcagaacuccaagcuccgccccgagguccuccaggaccuccgcgagaacaccgaguucaccgaccacgagcuccaggagugguacaagggcuuccucaaggacugccccaccggccaccucaccgucgacgaguucaagaagaucuacgccaacuucuuccccuacggcgacgccuccaaguucgccgagcacgucuuccgcaccuucgacaccaacggcgacggcaccaucgacuuccgcgaguucaucaucgcccucuccgucaccucccgcggcaagcucgagcagaagcucaagugggccuucuccauguacgaccucgacggcaacggcuacaucucccgcuccgagaugcucgagaucguccaggccaucuacaagauggucuccuccgucaugaagaugcccgaggacgaguccacccccgagaagcgcaccgacaagaucuuccgccagauggacaccaacaacgacggcaagcucucccucgaggaguucauccgcggcgccaaguccgaccccuccaucguccgccuccuccagugcgaccccuccuccgccucccaguucuga

SEQ ID NO: 44311 - RNA, 1065 nt, Artificial Sequence
  derived and/or modified sequence opt2 from HPD__Homo_sapiens__NP_001165464
augggcuucgagccccucgccuaccgcggccucgagaccggcucccgcgaggucgucucccacgucaucaagcagggcaagaucgucuucguccucuccuccgcccucaaccccuggaacaaggagaugggcgaccaccucgucaagcacggcgacggcgucaaggacaucgccuucgaggucgaggacugcgacuacaucguccagaaggcccgcgagcgcggcgccaagaucaugcgcgagcccugggucgagcaggacaaguucggcaaggucaaguucgccguccuccagaccuacggcgacaccacccacacccucgucgagaagaugaacuacaucggccaguuccuccccggcuacgaggcccccgccuucauggacccccuccuccccaagcuccccaagugcucccucgagaugaucgaccacaucgucggcaaccagcccgaccaggagauggucuccgccuccgagugguaccucaagaaccuccaguuccaccgcuucugguccgucgacgacacccagguccacaccgaguacuccucccuccgcuccaucgucgucgccaacuacgaggaguccaucaagaugcccaucaacgagcccgcccccggcaagaagaagucccagauccaggaguacgucgacuacaacggcggcgccggcguccagcacaucgcccucaagaccgaggacaucaucaccgccauccgccaccuccgcgagcgcggccucgaguuccucuccguccccuccaccuacuacaagcagcuccgcgagaagcucaagaccgccaagaucaaggucaaggagaacaucgacgcccucgaggagcucaagauccucgucgacuacgacgagaagggcuaccuccuccagaucuucaccaagcccguccaggaccgccccacccucuuccucgaggucauccagcgccacaaccaccagggcuucggcgccggcaacuucaacucccucuucaaggccuucgaggaggagcagaaccuccgcggcaaccucaccaacauggagaccaacggcgucguccccggcauguga

SEQ ID NO: 44312 - RNA, 801 nt, Artificial Sequence
  derived and/or modified sequence opt2 from HPGD__Homo_sapiens__NP_000851
augcacgucaacggcaaggucgcccucgucaccggcgccgcccagggcaucggccgcgccuucgccgaggcccuccuccucaagggcgccaaggucgcccucgucgacuggaaccucgaggccggcguccagugcaaggccgcccucgacgagcaguucgagccccagaagacccucuucauccagugcgacgucgccgaccagcagcagcuccgcgacaccuuccgcaaggucgucgaccacuucggccgccucgacauccucgucaacaacgccggcgucaacaacgagaagaacugggagaagacccuccagaucaaccucgucuccgucaucuccggcaccuaccucggccucgacuacauguccaagcagaacggcggcgagggcggcaucaucaucaacauguccucccucgccggccucaugcccgucgcccagcagcccgucuacugcgccuccaagcacggcaucgucggcuucacccgcuccgccgcccucgccgccaaccucaugaacuccggcguccgccucaacgccaucugccccggcuucgucaacaccgccauccucgaguccaucgagaaggaggagaacaugggccaguacaucgaguacaaggaccacaucaaggacaugaucaaguacuacggcauccucgaccccccccucaucgccaacggccucaucacccucaucgaggacgacgcccucaacggcgccaucaugaagaucaccaccuccaagggcauccacuuccaggacuacgacaccacccccuuccaggccaagacccaguga

SEQ ID NO: 44313 - RNA, 600 nt, Artificial Sequence
  derived and/or modified sequence opt2 from HPGDS__Homo_sapiens__NP_055300
augcccaacuacaagcucaccuacuucaacaugcgcggccgcgccgagaucauccgcuacaucuucgccuaccucgacauccaguacgaggaccaccgcaucgagcaggccgacuggcccgagaucaaguccacccuccccuucggcaagauccccauccucgaggucgacggccucacccuccaccagucccucgccaucgcccgcuaccucaccaagaacaccgaccucgccggcaacaccgagauggagcagugccacgucgacgccaucgucgacacccucgacgacuucauguccugcuuccccugggccgagaagaagcaggacgucaaggagcagauguucaacgagcuccucaccuacaacgccccccaccucaugcaggaccucgacaccuaccucggcggccgcgaguggcucaucggcaacuccgucaccugggccgacuucuacugggagaucugcuccaccacccuccucgucuucaagcccgaccuccucgacaaccacccccgccucgucacccuccgcaagaagguccaggccauccccgccgucgccaacuggaucaagcgccgcccccagaccaagcucuga

SEQ ID NO: 44314 - RNA, 1044 nt, Artificial Sequence
  derived and/or modified sequence opt2 from HP__Homo_sapiens__NP_001119574
auguccgcccucggcgccgucaucgcccuccuccucuggggccagcucuucgccgucgacuccggcaacgacgucaccgacaucgccgacgacggcugccccaagccccccgagaucgcccacggcuacgucgagcacuccguccgcuaccagugcaagaacuacuacaagcuccgcaccgagggcgacggcgucuacacccucaacaacgagaagcaguggaucaacaaggccgucggcgacaagcuccccgagugcgaggccgucugcggcaagcccaagaaccccgccaaccccguccagcgcauccucggcggccaccucgacgccaagggcuccuuccccuggcaggccaagauggucucccaccacaaccucaccaccggcgccacccucaucaacgagcaguggcuccucaccaccgccaagaaccucuuccucaaccacuccgagaacgccaccgccaaggacaucgcccccacccucacccucuacgucggcaagaagcagcucgucgagaucgagaaggucguccuccaccccaacuacucccaggucgacaucggccucaucaagcucaagcagaaggucuccgucaacgagcgcgucaugcccaucugccuccccuccaaggacuacgccgaggucggccgcgucggcuacgucuccggcuggggccgcaacgccaacuucaaguucaccgaccaccucaaguacgucaugcuccccgucgccgaccaggaccagugcauccgccacuacgagggcuccaccguccccgagaagaagacccccaagucccccgucggcguccagcccauccucaacgagcacaccuucugcgccggcauguccaaguaccaggaggacaccugcuacggcgacgccggcuccgccuucgccguccacgaccucgaggaggacaccugguacgccaccggcauccucuccuucgacaaguccugcgccgucgccgaguacggcgucuacgucaaggucaccuccauccaggacuggguccagaagaccaucgccgagaacuga

SEQ ID NO: 44315 - RNA, 1254 nt, Artificial Sequence
  derived and/or modified sequence opt2 from HPN__Homo_sapiens__NP_892028
auggcccagaaggagggcggccgcaccguccccugcugcucccgccccaaggucgccgcccucaccgccggcacccuccuccuccucaccgccaucggcgccgccuccugggccaucgucgccguccuccuccgcuccgaccaggagccccucuaccccguccaggucuccuccgccgacgcccgccucauggucuucgacaagaccgagggcaccuggcgccuccucugcuccucccgcuccaacgcccgcgucgccggccucuccugcgaggagaugggcuuccuccgcgcccucacccacuccgagcucgacguccgcaccgccggcgccaacggcaccuccggcuucuucugcgucgacgagggccgccucccccacacccagcgccuccucgaggucaucuccgucugcgacugcccccgcggccgcuuccucgccgccaucugccaggacugcggccgccgcaagcuccccgucgaccgcaucgucggcggccgcgacaccucccucggccgcuggcccuggcaggucucccuccgcuacgacggcgcccaccucugcggcggcucccuccucuccggcgacuggguccucaccgccgcccacugcuuccccgagcgcaaccgcguccucucccgcuggcgcgucuucgccggcgccgucgcccaggccuccccccacggccuccagcucggcguccaggccgucgucuaccacggcggcuaccuccccuuccgcgaccccaacuccgaggagaacuccaacgacaucgcccucguccaccucuccuccccccucccccucaccgaguacauccagcccgucugccuccccgccgccggccaggcccucgucgacggcaagaucugcaccgucaccggcuggggcaacacccaguacuacggccagcaggccggcguccuccaggaggcccgcguccccaucaucuccaacgacgucugcaacggcgccgacuucuacggcaaccagaucaagcccaagauguucugcgccggcuaccccgagggcggcaucgacgccugccagggcgacuccggcggccccuucgucugcgaggacuccaucucccgcaccccccgcuggcgccucugcggcaucgucuccuggggcaccggcugcgcccucgcccagaagcccggcgucuacaccaaggucuccgacuuccgcgaguggaucuuccaggccaucaagacccacuccgaggccuccggcauggucacccagcucuga

SEQ ID NO: 44316 - RNA, 1047 nt, Artificial Sequence
  derived and/or modified sequence opt2 from HPR__Homo_sapiens__NP_066275
auguccgaccucggcgccgucaucucccuccuccucuggggccgccagcucuucgcccucuacuccggcaacgacgucaccgacaucuccgacgaccgcuuccccaagccccccgagaucgccaacggcuacgucgagcaccucuuccgcuaccagugcaagaacuacuaccgccuccgcaccgagggcgacggcgucuacacccucaacgacaagaagcaguggaucaacaaggccgucggcgacaagcuccccgagugcgaggccgucugcggcaagcccaagaaccccgccaaccccguccagcgcauccucggcggccaccucgacgccaagggcuccuuccccuggcaggccaagauggucucccaccacaaccucaccaccggcgccacccucaucaacgagcaguggcuccucaccaccgccaagaaccucuuccucaaccacuccgagaacgccaccgccaaggacaucgcccccacccucacccucuacgucggcaagaagcagcucgucgagaucgagaaggucguccuccaccccaacuaccaccaggucgacaucggccucaucaagcucaagcagaagguccucgucaacgagcgcgucaugcccaucugccuccccuccaagaacuacgccgaggucggccgcgucggcuacgucuccggcuggggccaguccgacaacuucaagcucaccgaccaccucaaguacgucaugcuccccgucgccgaccaguacgacugcaucacccacuacgagggcuccaccugccccaaguggaaggcccccaagucccccgucggcguccagcccauccucaacgagcacaccuucugcgucggcauguccaaguaccaggaggacaccugcuacggcgacgccggcuccgccuucgccguccacgaccucgaggaggacaccugguacgccgccggcauccucuccuucgacaaguccugcgccgucgccgaguacggcgucuacgucaaggucaccuccauccagcacuggguccagaagaccaucgccgagaacuga

SEQ ID NO: 44317 - RNA, 657 nt, Artificial Sequence
  derived and/or modified sequence opt2 from HPRT1__Homo_sapiens__NP_000185
auggccacccgcucccccggcgucgucaucuccgacgacgagcccggcuacgaccucgaccucuucugcauccccaaccacuacgccgaggaccucgagcgcgucuucaucccccacggccucaucauggaccgcaccgagcgccucgcccgcgacgucaugaaggagaugggcggccaccacaucgucgcccucugcguccucaagggcggcuacaaguucuucgccgaccuccucgacuacaucaaggcccucaaccgcaacuccgaccgcuccauccccaugaccgucgacuucauccgccucaaguccuacugcaacgaccaguccaccggcgacaucaaggucaucggcggcgacgaccucuccacccucaccggcaagaacguccucaucgucgaggacaucaucgacaccggcaagaccaugcagacccuccucucccucguccgccaguacaaccccaagauggucaaggucgccucccuccucgucaagcgcaccccccgcuccgucggcuacaagcccgacuucgucggcuucgagauccccgacaaguucgucgucggcuacgcccucgacuacaacgaguacuuccgcgaccucaaccacgucugcgucaucuccgagaccggcaaggccaaguacaaggccuga

SEQ ID NO: 44318 - RNA, 2103 nt, Artificial Sequence
  derived and/or modified sequence opt2 from HPS1__Homo_sapiens__NP_000186
augaagugcguccucgucgccaccgagggcgccgagguccucuucuacuggaccgaccaggaguucgaggagucccuccgccucaaguucggccaguccgagaacgaggaggaggagcuccccgcccucgaggaccagcucuccacccuccucgcccccgucaucaucuccuccaugaccaugcucgagaagcucuccgacaccuacaccugcuucuccaccgagaacggcaacuuccucuacguccuccaccucuucggcgagugccucuucaucgccaucaacggcgaccacaccgaguccgagggcgaccuccgccgcaagcucuacguccucaaguaccucuucgagguccacuucggccucgucaccgucgacggccaccucauccgcaaggagcuccgcccccccgaccucgcccagcgcguccagcucugggagcacuuccagucccuccucuggaccuacucccgccuccgcgagcaggagcagugcuucgccgucgaggcccucgagcgccucauccacccccagcucugcgagcucugcaucgaggcccucgagcgccacgucauccaggccgucaacaccucccccgagcgcggcggcgaggaggcccuccacgccuuccuccucguccacuccaagcuccucgccuucuacuccucccacuccgccuccucccuccgccccgccgaccuccucgcccucauccuccucguccaggaccucuaccccuccgaguccaccgccgaggacgacauccagcccuccccccgccgcgcccgcuccucccagaacauccccguccagcaggccugguccccccacuccaccggccccaccggcggcuccuccgccgagaccgagaccgacuccuucucccuccccgaggaguacuucacccccgcccccucccccggcgaccaguccuccggcuccaccaucuggcucgagggcggcaccccccccauggacgcccuccagaucgccgaggacacccuccagacccucgucccccacugccccguccccuccggcccccgccgcaucuuccucgacgccaacgucaaggaguccuacugcccccucgucccccacaccauguacugccucccccucuggcagggcaucaaccucguccuccucacccgcucccccuccgccccccucgcccucguccucucccagcucauggacggcuucuccaugcucgagaagaagcucaaggagggccccgagcccggcgccucccuccgcucccagccccucgucggcgaccuccgccagcgcauggacaaguucgucaagaaccgcggcgcccaggagauccaguccaccuggcucgaguucaaggccaaggccuucuccaaguccgagcccggcuccuccugggagcuccuccaggccugcggcaagcucaagcgccagcucugcgccaucuaccgccucaacuuccucaccaccgcccccucccgcggcggcccccaccucccccagcaccuccaggaccagguccagcgccucaugcgcgagaagcucaccgacuggaaggacuuccuccucgucaagucccgccgcaacaucaccauggucuccuaccucgaggacuuccccggccucguccacuucaucuacgucgaccgcaccaccggccagauggucgcccccucccucaacugcucccagaagaccuccuccgagcucggcaagggcccccucgccgccuucgucaagaccaaggucuggucccucauccagcucgcccgccgcuaccuccagaagggcuacaccacccuccucuuccaggagggcgacuucuacugcuccuacuuccucugguucgagaacgacaugggcuacaagcuccagaugaucgagguccccguccucuccgacgacuccguccccaucggcaugcucggcggcgacuacuaccgcaagcuccuccgcuacuacuccaagaaccgccccaccgaggccguccgcugcuacgagcuccucgcccuccaccucuccgucauccccaccgaccuccucguccagcaggccggccagcucgcccgccgccucugggaggccucccgcaucccccuccucuga

SEQ ID NO: 44319 - RNA, 3015 nt, Artificial Sequence
  derived and/or modified sequence opt2 from HPS3__Homo_sapiens__NP_115759
augguccagcucuacaaccuccaccccuucggcucccagcaggucguccccugcaagcucgagcccgaccgcuucugcggcggcggccgcgacgcccucuucgucgccgccggcugcaaggucgaggccuucgccgucgccggccaggagcucugccagccccgcugcgccuucuccacccucggccgcguccuccgccucgccuacuccgaggccggcgacuaccucgucgccaucgaggagaagaacaaggccaccuuccuccgcgccuacgucaacuggcgcaacaagcgcaccgagaacucccgcgucugcauccgcaugaucggccacaacgucgagggccccuucuccaaggccuuccgcgaccagauguacaucaucgagaugccccucuccgaggccccccucugcaucuccugcugccccgucaagggcgaccuccucgucggcugcaccaacaagcucguccucuucucccucaaguaccagaucaucaacgaggaguucucccuccucgacuucgagcgcucccucaucauccacaucgacaacaucacccccgucgaggucuccuucugcgucggcuacgucgccgucauguccgaccucgagguccucaucgucaagcucgaguccggccccaagaacggcgagcgcguccaccaccacccccacaagaccaacaaccgcauccgccgcaccgaggagggcaucuccaacgagaucucccagcucgaguccgacgacuucgucaucugccagaagccccucgagcuccucggcgagaaguccgagcaguccggccucuccgucacccucgaguccaccggccucgccgacgagaagcgcaaguacucccacuuccagcaccuccucuaccgccgcuucgcccccgacaucuccuccuacguccucuccgacgacaucaagcuccacucccuccagcuccuccccaucuaccagaccggcucccucaccuccgacggcaagaaccucucccaggagaaggagcuccucucccucuucugcuucuucucccucccccacgucggcuaccucuacauggucgucaaguccgucgagcucauguccgucuaccaguaccccgagaagucccagcaggccguccucaccccccaguuccuccacgucaucaccuccaacaaccuccagugcuucaccguccgcugcuccgccgccgccgcccgcgaggaggaccccuacauggacaccacccucaaggccugcccccccgucuccauggacgucugcgcccuccgcauccagcucuucaucggccucaaggccaucugccacuucaagaaccacaucauccuccucaccaaggccgagcccgaggccauccccgagcgccgccagucccccaagcgccuccucucccgcaaggacaccuccgucaagaucaagaucccccccgucgccgaggccggcuggaaccucuacaucgucaacaccaucucccccguccagcucuacaaggagauggucgacuacuccaacaccuacaagaccgucaagacccaguccugcauccaccuccucuccgaggcccaccuccucguccgcgccgcccucauggacgccucccagcucgagcccggcgagaaggccgagcuccucgaggccuucaaggaguccugcggccaccucggcgacugcuacucccgccucgacucccagcacucccaccucacccuccccuacuacaagauguccggccucuccauggccgagguccucgcccgcaccgacuggaccgucgaggacggccuccagaaguacgagcgcggccucaucuucuacaucaaccacucccucuacgagaaccucgacgaggagcucaacgaggagcucgccgccaaggucguccagauguucuacgucgccgagcccaagcaggucccccacauccucugcucccccuccaugaagaacaucaacccccucaccgccauguccuaccuccgcaagcucgacaccuccggcuucuccuccauccucgucacccucaccaaggccgccgucgcccucaagaugggcgaccucgacaugcaccgcaacgagaugaagucccacuccgagaugaagcucgucugcggcuucauccucgagccccgccuccucauccagcagcgcaagggccagaucguccccaccgagcucgcccuccaccucaaggagacccagcccggccuccucgucgccuccguccucggccuccagaagaacaacaagaucggcaucgaggaggccgacuccuucuucaagguccucugcgccaaggacgaggacaccaucccccagcuccucgucgacuucugggaggcccagcucgucgccugccuccccgacgucguccuccaggagcucuucuucaagcucaccucccaguacaucuggcgccucuccaagcgccagccccccgacaccaccccccuccgcaccuccgaggaccucaucaacgccugcucccacuacggccucaucuaccccuggguccacgucgucaucuccuccgacucccucgccgacaagaacuacaccgaggaccucuccaagcuccagucccucaucugcggccccuccuucgacaucgccuccaucauccccuuccucgagccccucuccgaggacaccaucgccggccucuccguccacguccucugccgcacccgccucaaggaguacgagcagugcaucgacauccuccucgagcgcugccccgaggccgucauccccuacgccaaccacgagcucaaggaggagaaccgcacccucugguggaagaagcuccuccccgagcucugccagcgcaucaagugcggcggcgagaaguaccagcucuaccucuccucccucaaggagacccucuccaucgucgccgucgagcucgagcucaaggacuucaugaacguccuccccgaggacggcaccgccaccuucuuccuccccuaccuccucuacugcucccgcaagaagccccucaccuga

SEQ ID NO: 44320 - RNA, 2127 nt, Artificial Sequence
  derived and/or modified sequence opt2 from HPS4__Homo_sapiens__NP_071364
auggccaccuccaccuccaccgaggccaaguccgccuccugguggaacuacuucuuccucuacgacggcuccaaggucaaggaggagggcgaccccacccgcgccggcaucugcuacuucuaccccucccagacccuccucgaccagcaggagcuccucugcggccagaucgccggcgucguccgcugcgucuccgacaucuccgacuccccccccacccucguccgccuccgcaagcucaaguucgccaucaaggucgacggcgacuaccucuggguccucggcugcgccgucgagcuccccgacgucuccugcaagcgcuuccucgaccagcucgucggcuucuucaacuucuacaacggccccgucucccucgccuacgagaacugcucccaggaggagcucuccaccgagugggacaccuucaucgagcagauccucaagaacaccuccgaccuccacaagaucuucaacucccucuggaaccucgaccagaccaaggucgagccccuccuccuccucaaggccgcccgcauccuccagaccugccagcgcuccccccacauccucgccggcugcauccucuacaagggccucaucgucuccacccagcucccccccucccucaccgccaagguccuccuccaccgcaccgccccccaggagcagcgccuccccaccggcgaggacgccccccaggagcacggcgccgcccucccccccaacguccagaucauccccgucuucgucaccaaggaggaggccaucucccuccacgaguuccccgucgagcagaugacccgcucccucgccucccccgccggccuccaggacggcuccgcccagcaccaccccaagggcggcuccaccuccgcccucaaggagaacgccaccggccacgucgaguccauggccuggaccacccccgaccccaccucccccgacgaggccugccccgacggccgcaaggagaacggcugccucuccggccacgaccucgaguccauccgccccgccggccuccacaacuccgcccgcggcgagguccucggccucuccuccucccucggcaaggagcucgucuuccuccaggaggagcucgaccucuccgagauccacauccccgaggcccaggaggucgagauggccuccggccacuucgccuuccuccacguccccguccccgacggccgcgcccccuacugcaaggccucccucuccgccuccuccucccucgagcccaccccccccgaggacaccgccaucuccucccuccgcccccccuccgcccccgagaugcucacccagcacggcgcccaggagcagcucgaggaccaccccggccacuccucccaggcccccaucccccgcgccgacccccucccccgccgcacccgccgcccccuccuccucccccgccucgaccccggccagcgcggcaacaagcuccccaccggcgagcagggccucgacgaggacgucgacggcgucugcgagucccacgccgcccccggccucgagugcuccuccggcuccgccaacugccagggcgccggccccuccgccgacggcaucuccucccgccucacccccgccgaguccugcaugggccucguccgcaugaaccucuacacccacugcgucaagggccucguccucucccuccucgccgaggagccccuccucggcgacuccgccgccaucgaggaggucuaccacuccucccucgccucccucaacggccucgagguccaccucaaggagacccucccccgcgacgaggccgccuccaccuccuccaccuacaacuucacccacuacgaccgcauccagucccuccucauggccaaccucccccaggucgccaccccccaggaccgccgcuuccuccaggccgucucccucaugcacuccgaguucgcccagcuccccgcccucuacgagaugaccguccgcaacgccuccaccgccgucuacgccugcugcaaccccauccaggagaccuacuuccagcagcucgcccccgccgcccgcuccuccggcuuccccaacccccaggacggcgccuucucccucuccggcaaggccaagcagaagcuccucaagcacggcgucaaccuccucuga

SEQ ID NO: 44321 - RNA, 3390 nt, Artificial Sequence
  derived and/or modified sequence opt2 from HPS5__Homo_sapiens__NP_852608
auggccuucguccccgucauccccgaguccuacucccacguccucgccgaguucgagucccucgacccccuccucuccgcccuccgccucgacuccucccgccucaagugcaccuccaucgccgucucccgcaaguggcucgcccucggcuccuccggcggcggccuccaccucauccagaaggagggcuggaagcaccgccucuuccucucccaccgcgagggcgccaucucccaggucgccugcugccuccacgacgacgacuacgucgccgucgccaccucccagggccucgucgucgucugggagcucaaccaggagcgccgcggcaagcccgagcagauguacgucuccuccgagcacaagggccgccgcgucaccgcccucugcugggacaccgccauccuccgcgucuucgucggcgaccacgccggcaaggucuccgccaucaagcucaacaccuccaagcaggccaaggccgccgccgccuucgucauguuccccguccagaccaucaccaccgucgacuccugcgucguccagcucgacuaccucgacggccgccuccucaucuccucccucacccgcuccuuccucugcgacaccgagcgcgagaaguucuggaagaucggcaacaaggagcgcgacggcgaguacggcgccugcuucuuccccggccgcugcuccggcggccagcagccccucaucuacugcgcccgccccggcucccgcaugugggaggucaacuucgacggcgaggucaucuccacccaccaguucaagaagcuccucucccuccccccccuccccgucaucacccuccgcuccgagccccaguacgaccacaccgccggcuccucccagucccucuccuuccccaagcuccuccaccucuccgagcacugcguccucaccuggaccgagcgcggcaucuacaucuucaucccccagaacguccagguccuccucugguccgaggucaaggacauccaggacgucgccgucugccgcaacgagcucuucugccuccaccucaacggcaaggucucccaccucucccucaucuccgucgagcgcugcgucgagcgccuccuccgccgcggccucuggaaccucgccgcccgcaccugcugccucuuccagaacuccgucaucgccucccgcgcccgcaagacccucaccgccgacaagcucgagcaccucaagucccagcucgaccacggcaccuacaacgaccucaucucccagcucgaggagcucauccucaaguucgagccccucgacuccgccugcuccucccgccgcuccuccaucuccucccacgaguccuucuccauccucgacuccggcaucuaccgcaucaucuccucccgccgcggcucccaguccgacgaggacuccugcucccuccacucccagacccucuccgaggacgagcgcuucaaggaguucaccucccagcaggaggaggaccuccccgaccagugcugcggcucccacggcaacgaggacaacgucucccacgcccccgucauguucgagaccgacaagaacgagaccuuccuccccuucggcaucccccuccccuuccgcucccccuccccccucgucucccuccaggccgucaaggaguccgucuccuccuucguccgcaagaccaccgagaagaucggcacccuccacaccucccccgaccucaagguccgccccgagcuccgcggcgacgagcaguccugcgaggaggacgucuccuccgacaccugccccaaggaggaggacaccgaggaggagaaggaggucaccucccccccccccgaggaggaccgcuuccaggagcucaaggucgccaccgccgaggccaugaccaagcuccaggacccccucguccucuucgaguccgagucccuccgcaugguccuccaggaguggcucucccaccucgagaagaccuucgccaugaaggacuucuccggcgucuccgacaccgacaacuccuccaugaagcucaaccaggacguccuccucgucaacgaguccaagaagggcauccucgacgaggacaacgagaaggagaagcgcgacucccucggcaacgaggaguccgucgacaagaccgccugcgagugcguccgcuccccccgcgagucccucgacgaccucuuccagaucugcucccccugcgccaucgccuccggccuccgcaacgaccucgccgagcucaccacccucugccucgagcucaacguccucaacuccaagaucaaguccaccuccggccacgucgaccacacccuccagcaguacucccccgagauccucgccugccaguuccucaagaaguacuucuuccuccucaaccucaagcgcgccaaggaguccaucaagcucuccuacuccaacucccccuccgucugggacaccuucaucgagggccucaaggagauggccuccuccaaccccgucuacauggagauggagaagggcgaccuccccacccgccucaagcuccucgacgacgagguccccuucgacuccccccuccucgucgucuacgccacccgccucuacgagaaguucggcgaguccgcccuccgcucccucaucaaguucuuccccuccauccuccccuccgacaucauccagcucugccaccaccaccccgccgaguuccucgccuaccucgacucccucgucaagucccgccccgaggaccagcgcuccuccuuccucgagucccuccuccagcccgagucccuccgccucgacuggcuccuccucgccgucucccucgacgccccccccuccaccuccaccauggacgacgagggcuacccccgcccccacucccaccuccucuccuggggcuacucccagcucauccuccaccucaucaagcuccccgccgacuucaucaccaaggagaagaugaccgacaucugccgcuccugcggcuucuggcccggcuaccucauccucugccucgagcucgagcgccgccgcgaggccuucaccaacaucgucuaccucaacgacaugucccucauggagggcgacaacggcuggauccccgagaccgucgaggaguggaagcuccuccuccaccucauccaguccaaguccacccgccccgccccccaggagucccucaacggcucccucuccgacggccccucccccaucaacgucgagaacgucgcccuccuccucgccaaggccaugggccccgaccgcgccuggucccuccuccaggagugcggccucgcccucgagcucuccgagaaguucacccgcaccugcgacauccuccgcaucgccgagaagcgccagcgcgcccucauccaguccaugcucgagaagugcgaccgcuuccucuggucccagcaggccuga

SEQ ID NO: 44322 - RNA, 2328 nt, Artificial Sequence
  derived and/or modified sequence opt2 from HPS6__Homo_sapiens__NP_079023
augaagcgcuccggcacccuccgccuccucuccgaccucuccgccuucggcggcgccgcccgccuccgcgagcucgucgccggcgacuccgccguccgcguccgcggcucccccgacggccgccaccuccuccuccuccgcccccccggcgccgucgccccccagcuccucgucgccucccgcggccccggcgccgagcucgagcgcgccuggcccgccggccagcccuccccccucgacgccuucuuccuccccuggcccgcccgccccgcccucguccucgucugggaguccggccucgccgaggucuggggcgccggcgucggccccggcuggcgcccccuccaguccaccgagcucugccccggcggcggcgcccgcgucgucgccgucgccgcccuccgcggccgccucgucuggugcgaggagcgccaggcccgcgccgagggccccuccggcucccccgccgccgccuucucccacugcgucugcguccgcacccucgagcccuccggcgaggccuccaccucccucggccgcacccacguccuccuccaccacugccccgccuucggccuccucgccuccugccgccagcucuuccucguccccaccgccaccaccuggcccggcgucgcccacguccuccucaucuggucccccggcaagggcaaggucauggucgccgccccccgccucggccucuccuacuccaagucccucaaccccggccgcggcgacaccugggacuuccgcacccuccuccgcggccuccccggccuccucuccccccgcgagccccucgccguccacaccugggcccccaccccccagggccuccuccuccucgacuucggcggcaccgucucccuccuccagucccacggcggcacccgcgccgucggcacccuccaggaggcccccgucggccccuggggcuccgccgcccucggcaccuuccagggcacccucgccugcguccucggcuccacccucgagcuccucgacaugggcuccggccagcuccucgagcgcaagguccucuccaccgaccgcguccaccuccucgagccccccgcccccggcauggaggacgaggaggagcucgagacccgcggcaaccuccgccuccucuccgcccucggccucuucugcgucggcugggaggccccccagggcgucgagcuccccuccgccaaggaccucgucuucgaggaggccugcggcuacuaccagcgccgcucccuccgcggcgcccagcucacccccgaggagcuccgccacuccuccaccuuccgcgccccccaggcccucgccuccauccuccagggccaccucccccccuccgcccuccucaccaugcuccgcaccgagcuccgcgacuaccgcggccucgagcagcucaaggcccagcucgucgccggcgacgacgaggaggccggcuggaccgagcucgccgagcaggaggucgcccgccuccuccgcaccgagcucaucggcgaccagcucgcccagcucaacaccgucuuccaggcccuccccaccgccgccuggggcgccacccuccgcgcccuccagcuccagcucgacggcaacggcaagcuccgcucccaggccccccccgacgucuggaagaagguccucggcggcaucaccgccggcaaggagccccccaacggcauccucccccccuucgagcuccucugccagugccucugccagcucgagccccgcuggcucccccccuucgucgagcucgcccagcagcagggcggccccggcuggggcgccggcggccccggccucccccucuaccgccgcgcccucgccguccucggcgaggagggcacccgccccgaggcccucgagcucgagcuccuccucuccuccggccgccccaaggccguccuccaggccgucggccagcucguccagaaggagcagugggaccgcgcccucgacgccggccucgcccucggccccuccuccccccuccuccgcuccgagaucuucaagcuccuccucgccgaguucgcccagcaccgccgccucgacgcccaccucccccuccucugccgccucugcccccccgagcucgcccccgccgagcuccuccuccuccuccgcaccuaccuccccgacgaggucggcccccccacccccuuccccgagcccggcgccgagcccccccucaccgucggccuccucaaggcccuccucgagcagaccggcgcccagggcuggcucuccggccccguccucucccccuacgaggacauccucugggaccccuccacccccccccccacccccccccgcgaccucuga

SEQ ID NO: 44323 - RNA, 1605 nt, Artificial Sequence
  derived and/or modified sequence opt2 from HPSE2__Homo_sapiens__NP_001159716
augcgcguccucugcgccuuccccgaggccaugcccuccuccaacucccgcccccccgccugccucgcccccggcgcccucuaccucgcccuccuccuccaccucucccucuccucccaggccggcgaccgccgcccccuccccgucgaccgcgccgccggccucaaggagaagacccucauccuccucgacgucuccaccaagaaccccguccgcaccgucaacgagaacuuccucucccuccagcucgaccccuccaucauccacgacggcuggcucgacuuccucuccuccaagcgccucgucacccucgcccgcggccucucccccgccuuccuccgcuucggcggcaagcgcaccgacuuccuccaguuccagaaccuccgcaaccccgccaagucccgcggcggccccggccccgacuacuaccucaagaacuacgaggacgacaucguccgcuccgacgucgcccucgacaagcagaagggcugcaagaucgcccagcaccccgacgucaugcucgagcuccagcgcgagaaggccgcccagaugcaccucguccuccucaaggagcaguucuccaacaccuacuccaaccucauccucaccgagcccaacaacuaccgcaccaugcacggccgcgccgucaacggcucccagcucggcaaggacuacauccagcucaagucccuccuccagcccauccgcaucuacucccgcgccucccucuacggccccaacaucggccgcccccgcaagaacgucaucgcccuccucgacggcuucaugaaggucgccggcuccaccgucgacgccgucaccuggcagcacugcuacaucgacggccgcgucgucaaggucauggacuuccucaagacccgccuccucgacacccucuccgaccagauccgcaagauccagaaggucgucaacaccuacacccccggcaagaagaucuggcucgagggcgucgucaccaccuccgccggcggcaccaacaaccucuccgacuccuacgccgccggcuuccucuggcucaacacccucggcaugcucgccaaccagggcaucgacgucgucauccgccacuccuucuucgaccacggcuacaaccaccucgucgaccagaacuucaacccccuccccgacuacuggcucucccuccucuacaagcgccucaucggccccaagguccucgccguccacgucgccggccuccagcgcaagccccgccccggccgcgucauccgcgacaagcuccgcaucuacgcccacugcaccaaccaccacaaccacaacuacguccgcggcuccaucacccucuucaucaucaaccuccaccgcucccgcaagaagaucaagcucgccggcacccuccgcgacaagcucguccaccaguaccuccuccagcccuacggccaggagggccucaaguccaaguccguccagcucaacggccagccccucgucauggucgacgacggcacccuccccgagcucaagccccgcccccuccgcgccggccgcacccucgucaucccccccgucaccaugggcuucuacgucgucaagaacgucaacgcccucgccugccgcuaccgcuga

SEQ ID NO: 44324 - RNA, 1632 nt, Artificial Sequence
  derived and/or modified sequence opt2 from HPSE__Homo_sapiens__NP_001092010
augcuccuccgcuccaagcccgcccucccccccccccucaugcuccuccuccucggcccccucggcccccucucccccggcgcccucccccgccccgcccaggcccaggacgucgucgaccucgacuucuucacccaggagccccuccaccucgucucccccuccuuccucuccgucaccaucgacgccaaccucgccaccgacccccgcuuccucauccuccucggcucccccaagcuccgcacccucgcccgcggccucucccccgccuaccuccgcuucggcggcaccaagaccgacuuccucaucuucgaccccaagaaggaguccaccuucgaggagcgcuccuacuggcagucccaggucaaccaggacaucugcaaguacggcuccaucccccccgacgucgaggagaagcuccgccucgaguggcccuaccaggagcagcuccuccuccgcgagcacuaccagaagaaguucaagaacuccaccuacucccgcuccuccgucgacguccucuacaccuucgccaacugcuccggccucgaccucaucuucggccucaacgcccuccuccgcaccgccgaccuccaguggaacuccuccaacgcccagcuccuccucgacuacugcuccuccaagggcuacaacaucuccugggagcucggcaacgagcccaacuccuuccucaagaaggccgacaucuucaucaacggcucccagcucggcgaggacuucauccagcuccacaagcuccuccgcaaguccaccuucaagaacgccaagcucuacggccccgacgucggccagccccgccgcaagaccgccaagaugcucaaguccuuccucaaggccggcggcgaggucaucgacuccgucaccuggcaccacuacuaccucaacggccgcaccgccaccaaggaggacuuccucaaccccgacguccucgacaucuucaucuccuccguccagaaggucuuccaggucgucgaguccacccgccccggcaagaaggucuggcucggcgagaccuccuccgccuacggcggcggcgccccccuccucuccgacaccuucgccgccggcuucauguggcucgacaagcucggccucuccgcccgcaugggcaucgaggucgucaugcgccaggucuucuucggcgccggcaacuaccaccucgucgacgagaacuucgacccccuccccgacuacuggcucucccuccucuucaagaagcucgucggcaccaagguccucauggccuccguccagggcuccaagcgccgcaagcuccgcgucuaccuccacugcaccaacaccgacaacccccgcuacaaggagggcgaccucacccucuacgccaucaaccuccacaacgucaccaaguaccuccgccuccccuaccccuucuccaacaagcaggucgacaaguaccuccuccgcccccucggcccccacggccuccucuccaaguccguccagcucaacggccucacccucaagauggucgacgaccagacccuccccccccucauggagaagccccuccgccccggcuccucccucggccuccccgccuucuccuacuccuucuucgucauccgcaacgccaaggucgccgccugcaucuga

SEQ ID NO: 44325 - RNA, 1389 nt, Artificial Sequence
  derived and/or modified sequence opt2 from HPX__Homo_sapiens__XP_005252940
auggcccgcguccucggcgcccccgucgcccucggccucuggucccucugcuggucccucgccaucgccaccccccucccccccaccuccgcccacggcaacgucgccgagggcgagaccaagcccgaccccgacgucaccgagcgcugcuccgacggcugguccuucgacgccaccacccucgacgacaacggcaccaugcucuucuucaagggcgaguucgucuggaagucccacaagugggaccgcgagcucaucuccgagcgcuggaagaacuuccccucccccgucgacgccgccuuccgccagggccacaacuccgucuuccucaucaagggcgacaaggucugggucuacccccccgagaagaaggagaagggcuaccccaagcuccuccaggacgaguuccccggcauccccuccccccucgacgccgccgucgagugccaccgcggcgagugccaggccgagggcguccucuucuuccagggcgaccgcgagugguucugggaccucgccaccggcaccaugaaggagcgcuccuggcccgccgucggcaacugcuccuccgcccuccgcuggcucggccgcuacuacugcuuccagggcaaccaguuccuccgcuucgaccccguccgcggcgagguccccccccgcuacccccgcgacguccgcgacuacuucaugcccugccccggccgcggccacggccaccgcaacggcaccggccacggcaacuccacccaccacggccccgaguacaugcgcugcuccccccaccucguccucuccgcccucaccuccgacaaccacggcgccaccuacgccuucuccggcacccacuacuggcgccucgacaccucccgcgacggcuggcacuccuggcccaucgcccaccaguggccccagggccccuccgccgucgacgccgccuucuccugggaggagaagcucuaccucguccagggcacccaggucuacgucuuccucaccaagggcggcuacacccucgucuccggcuaccccaagcgccucgagaaggaggucggcaccccccacggcaucauccucgacuccgucgacgccgccuucaucugccccggcuccucccgccuccacaucauggccggccgccgccucugguggcucgaccucaaguccggcgcccaggccaccuggaccgagcuccccuggccccacgagaaggucgacggcgcccucugcauggagaagucccucggccccaacuccugcuccgccaacggccccggccucuaccucauccacggccccaaccucuacugcuacuccgacgucgagaagcucaacgccgccaaggcccucccccagccccagaacgucaccucccuccucggcugcacccacuga

SEQ ID NO: 44326 - RNA, 570 nt, Artificial Sequence
  derived and/or modified sequence opt2 from HRAS__Homo_sapiens__NP_001123914
augaccgaguacaagcucgucgucgucggcgccggcggcgucggcaaguccgcccucaccauccagcucauccagaaccacuucgucgacgaguacgaccccaccaucgaggacuccuaccgcaagcaggucgucaucgacggcgagaccugccuccucgacauccucgacaccgccggccaggaggaguacuccgccaugcgcgaccaguacaugcgcaccggcgagggcuuccucugcgucuucgccaucaacaacaccaaguccuucgaggacauccaccaguaccgcgagcagaucaagcgcgucaaggacuccgacgacguccccaugguccucgucggcaacaagugcgaccucgccgcccgcaccgucgagucccgccaggcccaggaccucgcccgcuccuacggcauccccuacaucgagaccuccgccaagacccgccagggcgucgaggacgccuucuacacccucguccgcgagauccgccagcacaagcuccgcaagcucaacccccccgacgaguccggccccggcugcauguccugcaagugcguccucuccuga

SEQ ID NO: 44327 - RNA, 822 nt, Artificial Sequence
  derived and/or modified sequence opt2 from HRASLS__Homo_sapiens__NP_065119
augguccgcgccuccugccgccucggcuccgcccgcacccccucccccgcccgccgcccccccggcguccgcgccucccagucccgcggcggcgccgccggcaccgucuccgccuggcgccgcuggugcuggcgcuggcccuggcgcaccgcccccuccgacggcuggcgccucccccccggcugccuccccggcaccgacggcgucgucccccgcccccccgccgcccgcuccgccgccgcccgcccccgcgagacccccggccacacccagcucccccccggcgcccgccgccgcccccgccucgaguccgagauggccuucaacgacugcuucucccucaacuaccccggcaaccccugccccggcgaccucaucgaggucuuccgccccggcuaccagcacugggcccucuaccucggcgacggcuacgucaucaacaucgcccccgucgacggcauccccgccuccuucaccuccgccaaguccgucuucuccuccaaggcccucgucaagaugcagcuccucaaggacgucgucggcaacgacaccuaccgcaucaacaacaaguacgacgagaccuaccccccccuccccgucgaggagaucaucaagcgcuccgaguucgucaucggccaggaggucgccuacaaccuccucgucaacaacugcgagcacuucgucacccuccuccgcuacggcgagggcgucuccgagcaggccaaccgcgccaucuccaccgucgaguucgucaccgccgccgucggcgucuucuccuuccucggccucuuccccaagggccagcgcgccaaguacuacuga

SEQ ID NO: 44328 - RNA, 2100 nt, Artificial Sequence
  derived and/or modified sequence opt2 from HRC__Homo_sapiens__NP_002143
augggccaccaccgccccuggcuccacgccuccguccucugggccggcgucgccucccuccuccucccccccgccaugacccagcagcuccgcggcgacggccucggcuuccgcaaccgcaacaacuccaccggcgucgccggccucuccgaggaggccuccgccgagcuccgccaccaccuccacuccccccgcgaccaccccgacgagaacaaggacgucuccaccgagaacggccaccacuucuggucccaccccgaccgcgagaaggaggacgaggacgucuccaaggaguacggccaccuccuccccggccaccgcucccaggaccacaaggucggcgacgagggcgucuccggcgaggaggucuucgccgagcacggcggccaggcccgcggccaccgcggccacggcuccgaggacaccgaggacuccgccgagcaccgccaccaccuccccucccaccgcucccacucccaccaggacgaggacgaggacgaggucgucuccuccgagcaccaccaccacauccuccgccacggccaccgcggccacgacggcgaggacgacgagggcgaggaggaggaggaggaggaggaggaggaggaggaggccuccaccgaguacggccaccaggcccaccgccaccgcggccacggcuccgaggaggacgaggacgucuccgacggccaccaccaccacggccccucccaccgccaccagggccacgaggaggacgacgacgacgacgacgacgacgacgacgacgacgacgacgacgacgucuccaucgaguaccgccaccaggcccaccgccaccagggccacggcaucgaggaggacgaggacgucuccgacggccaccaccaccgcgaccccucccaccgccaccgcucccacgaggaggacgacaacgacgacgacgacgucuccaccgaguacggccaccaggcccaccgccaccaggaccaccgcaaggaggaggucgaggccgucuccggcgagcaccaccaccacguccccgaccaccgccaccagggccaccgcgacgaggaggaggacgaggacgucuccaccgagcgcuggcaccagggcccccagcacguccaccacggccucgucgacgaggaggaggaggaggaggagaucaccguccaguucggccacuacgucgccucccaccagccccgcggccacaaguccgacgaggaggacuuccaggacgaguacaagaccgaggucccccaccaccaccaccaccgcgucccccgcgaggaggacgaggaggucuccgccgagcucggccaccaggcccccucccaccgccagucccaccaggacgaggagaccggccacggccagcgcggcuccaucaaggagaugucccaccacccccccggccacaccgucgucaaggaccgcucccaccuccgcaaggacgacuccgaggaggagaaggagaaggaggaggaccccggcucccacgaggaggacgacgaguccuccgagcagggcgagaagggcacccaccacggcucccgcgaccaggaggacgaggaggacgaggaggagggccacggccucucccucaaccaggaggaggaggaggaggaggacaaggaggaggaggaggaggaggaggacgaggagcgccgcgaggagcgcgccgaggucggcgccccccucucccccgaccacuccgaggaggaggaggaggaggaggagggccucgaggaggacgagccccgcuucaccaucauccccaacccccucgaccgccgcgaggaggccggcggcgccuccuccgaggaggaguccggcgaggacaccggcccccaggacgcccaggaguacggcaacuaccagcccggcucccucugcggcuacugcuccuucugcaaccgcugcaccgagugcgaguccugccacugcgacgaggagaacaugggcgagcacugcgaccagugccagcacugccaguucugcuaccucugcccccucgucugcgagaccgucugcgcccccggcuccuacgucgacuacuucuccuccucccucuaccaggcccucgccgacaugcucgagacccccgagcccuga

SEQ ID NO: 44329 - RNA, 1578 nt, Artificial Sequence
  derived and/or modified sequence opt2 from HRG__Homo_sapiens__NP_000403
augaaggcccucaucgccgcccuccuccucaucacccuccaguacuccugcgccgucucccccaccgacugcuccgccgucgagcccgaggccgagaaggcccucgaccucaucaacaagcgccgccgcgacggcuaccucuuccagcuccuccgcaucgccgacgcccaccucgaccgcgucgagaacaccaccgucuacuaccucguccucgacguccaggaguccgacugcuccguccucucccgcaaguacuggaacgacugcgagccccccgacucccgccgccccuccgagaucgucaucggccagugcaaggucaucgccacccgccacucccacgagucccaggaccuccgcgucaucgacuucaacugcaccaccuccuccgucuccuccgcccucgccaacaccaaggacucccccguccucaucgacuucuucgaggacaccgagcgcuaccgcaagcaggccaacaaggcccucgagaaguacaaggaggagaacgacgacuucgccuccuuccgcgucgaccgcaucgagcgcgucgcccgcguccgcggcggcgagggcaccggcuacuucgucgacuucuccguccgcaacugcccccgccaccacuucccccgccaccccaacgucuucggcuucugccgcgccgaccucuucuacgacgucgaggcccucgaccucgagucccccaagaaccucgucaucaacugcgaggucuucgacccccaggagcacgagaacaucaacggcguccccccccaccucggccaccccuuccacuggggcggccacgagcgcuccuccaccaccaagccccccuucaagccccacggcucccgcgaccaccaccacccccacaagccccacgagcacggccccccccccccccccgacgagcgcgaccacucccacggccccccccucccccagggcccccccccccuccuccccauguccugcuccuccugccagcacgccaccuucggcaccaacggcgcccagcgccacucccacaacaacaacuccuccgaccuccacccccacaagcaccacucccacgagcagcacccccacggccaccacccccacgcccaccacccccacgagcacgacacccaccgccagcacccccacggccaccacccccacggccaccacccccacggccaccacccccacggccaccacccccacggccaccacccccacugccacgacuuccaggacuacggccccugcgacccccccccccacaaccagggccacugcugccacggccacggccccccccccggccaccuccgccgccgcggccccggcaagggcccccgccccuuccacugccgccagaucggcuccgucuaccgccuccccccccuccgcaagggcgagguccucccccuccccgaggccaacuuccccuccuucccccucccccaccacaagcacccccucaagcccgacaaccagcccuucccccaguccgucuccgaguccugccccggcaaguucaaguccggcuucccccaggucuccauguucuucacccacaccuuccccaaguga

SEQ ID NO: 44330 - RNA, 1464 nt, Artificial Sequence
  derived and/or modified sequence opt2 from HRH1__Homo_sapiens__NP_001091683
augucccuccccaacuccuccugccuccucgaggacaagaugugcgagggcaacaagaccaccauggccuccccccagcucaugccccucgucgucguccucuccaccaucugccucgucaccgucggccucaaccuccucguccucuacgccguccgcuccgagcgcaagcuccacaccgucggcaaccucuacaucgucucccucuccgucgccgaccucaucgucggcgccgucgucaugcccaugaacauccucuaccuccucauguccaaguggucccucggccgcccccucugccucuucuggcucuccauggacuacgucgccuccaccgccuccaucuucuccgucuucauccucugcaucgaccgcuaccgcuccguccagcagccccuccgcuaccucaaguaccgcaccaagacccgcgccuccgccaccauccucggcgccugguuccucuccuuccucugggucauccccauccucggcuggaaccacuucaugcagcagaccuccguccgccgcgaggacaagugcgagaccgacuucuacgacgucaccugguucaaggucaugaccgccaucaucaacuucuaccuccccacccuccucaugcucugguucuacgccaagaucuacaaggccguccgccagcacugccagcaccgcgagcucaucaaccgcucccuccccuccuucuccgagaucaagcuccgccccgagaaccccaagggcgacgccaagaagcccggcaaggagucccccugggagguccucaagcgcaagcccaaggacgccggcggcggcuccguccucaagucccccucccagacccccaaggagaugaagucccccgucgucuucucccaggaggacgaccgcgaggucgacaagcucuacugcuucccccucgacaucguccacaugcaggccgccgccgagggcuccucccgcgacuacgucgccgucaaccgcucccacggccagcucaagaccgacgagcagggccucaacacccacggcgccuccgagaucuccgaggaccagaugcucggcgacucccaguccuucucccgcaccgacuccgacaccaccaccgagaccgcccccggcaagggcaagcuccgcuccggcuccaacaccggccucgacuacaucaaguucaccuggaagcgccuccgcucccacucccgccaguacgucuccggccuccacaugaaccgcgagcgcaaggccgccaagcagcucggcuucaucauggccgccuucauccucugcuggauccccuacuucaucuucuucauggucaucgccuucugcaagaacugcugcaacgagcaccuccacauguucaccaucuggcucggcuacaucaacuccacccucaacccccucaucuacccccucugcaacgagaacuucaagaagaccuucaagcgcauccuccacauccgcuccuga

SEQ ID NO: 44331 - RNA, 1194 nt, Artificial Sequence
  derived and/or modified sequence opt2 from HRH2__Homo_sapiens__NP_001124527
auggcccccaacggcaccgccuccuccuucugccucgacuccaccgccugcaagaucaccaucaccgucguccucgccguccucauccucaucaccgucgccggcaacgucgucgucugccucgccgucggccucaaccgccgccuccgcaaccucaccaacugcuucaucgucucccucgccaucaccgaccuccuccucggccuccucguccuccccuucuccgccaucuaccagcucuccugcaagugguccuucggcaaggucuucugcaacaucuacaccucccucgacgucaugcucugcaccgccuccauccucaaccucuucaugaucucccucgaccgcuacugcgccgucauggacccccuccgcuaccccguccucgucacccccguccgcgucgccaucucccucguccucaucugggucaucuccaucacccucuccuuccucuccauccaccucggcuggaacucccgcaacgagaccuccaagggcaaccacaccaccuccaagugcaagguccaggucaacgaggucuacggccucgucgacggccucgucaccuucuaccucccccuccucaucaugugcaucaccuacuaccgcaucuucaaggucgcccgcgaccaggccaagcgcaucaaccacaucuccuccuggaaggccgccaccauccgcgagcacaaggccaccgucacccucgccgccgucaugggcgccuucaucaucugcugguuccccuacuucaccgccuucgucuaccgcggccuccgcggcgacgacgccaucaacgagguccucgaggccaucguccucuggcucggcuacgccaacuccgcccucaaccccauccucuacgccgcccucaaccgcgacuuccgcaccggcuaccagcagcucuucugcugccgccucgccaaccgcaacucccacaagaccucccuccgcuccaacgccucccagcucucccgcacccagucccgcgagccccgccagcaggaggagaagccccucaagcuccaggucugguccggcaccgaggucaccgccccccagggcgccaccgaccgccccuggcucugccuccccgagugcugguccgucgagcucacccacuccuucauccaccucuucauccacuccuucgccaacauccaccccauccccaccaccugccaggagcucuga

SEQ ID NO: 44332 - RNA, 1338 nt, Artificial Sequence
  derived and/or modified sequence opt2 from HRH3__Homo_sapiens__NP_009163
auggagcgcgccccccccgacggcccccucaacgccuccggcgcccucgccggcgaggccgccgccgccggcggcgcccgcggcuucuccgccgccuggaccgccguccucgccgcccucauggcccuccucaucgucgccaccguccucggcaacgcccucgucaugcucgccuucgucgccgacuccucccuccgcacccagaacaacuucuuccuccucaaccucgccaucuccgacuuccucgucggcgccuucugcaucccccucuacguccccuacguccucaccggccgcuggaccuucggccgcggccucugcaagcucuggcucgucgucgacuaccuccucugcaccuccuccgccuucaacaucguccucaucuccuacgaccgcuuccucuccgucacccgcgccgucuccuaccgcgcccagcagggcgacacccgccgcgccguccgcaagaugcuccucgucuggguccucgccuuccuccucuacggccccgccauccucuccugggaguaccucuccggcggcuccuccauccccgagggccacugcuacgccgaguucuucuacaacugguacuuccucaucaccgccuccacccucgaguucuucacccccuuccucuccgucaccuucuucaaccucuccaucuaccucaacauccagcgccgcacccgccuccgccucgacggcgcccgcgaggccgccggccccgagcccccccccgaggcccagcccucccccccccccccccccggcugcuggggcugcuggcagaagggccacggcgaggccaugccccuccaccgcuacggcgucggcgaggccgccgucggcgccgaggccggcgaggccacccucggcggcggcggcggcggcggcuccgucgccucccccaccuccuccuccggcuccuccucccgcggcaccgagcgcccccgcucccucaagcgcggcuccaagcccuccgccuccuccgccucccucgagaagcgcaugaagauggucucccaguccuucacccagcgcuuccgccucucccgcgaccgcaaggucgccaagucccucgccgucaucgucuccaucuucggccucugcugggcccccuacacccuccucaugaucauccgcgccgccugccacggccacugcguccccgacuacugguacgagaccuccuucuggcuccucugggccaacuccgccgucaaccccguccucuacccccucugccaccacuccuuccgccgcgccuucaccaagcuccucugcccccagaagcucaagauccagccccacuccucccucgagcacugcuggaaguga

SEQ ID NO: 44333 - RNA, 909 nt, Artificial Sequence
  derived and/or modified sequence opt2 from HRH4__Homo_sapiens__NP_001137300
augcccgacaccaacuccaccaucaaccucucccucuccacccgcgucacccucgccuucuucaugucccucgucgccuucgccaucaugcucggcaacgcccucgucauccucgccuucgucgucgacaagaaccuccgccaccgcuccuccuacuucuuccucaaccucgccaucuccgacuucuucgucgucuccgaguccuggaaggacgagggcuccgagugcgagcccggcuucuucuccgagugguacauccucgccaucaccuccuuccucgaguucgucauccccgucauccucgucgccuacuucaacaugaacaucuacuggucccucuggaagcgcgaccaccucucccgcugccagucccaccccggccucaccgccgucuccuccaacaucugcggccacuccuuccgcggccgccucuccucccgccgcucccucuccgccuccaccgagguccccgccuccuuccacuccgagcgccagcgccgcaaguccucccucauguucuccucccgcaccaagaugaacuccaacaccaucgccuccaagaugggcuccuucucccaguccgacuccgucgcccuccaccagcgcgagcacgucgagcuccuccgcgcccgccgccucgccaagucccucgccauccuccucggcgucuucgccgucugcugggcccccuacucccucuucaccaucguccucuccuucuacuccuccgccaccggccccaaguccgucugguaccgcaucgccuucuggcuccagugguucaacuccuucgucaacccccuccucuacccccucugccacaagcgcuuccagaaggccuuccucaagaucuucugcaucaagaagcagccccuccccucccagcacucccgcuccgucuccuccuga

SEQ ID NO: 44334 - RNA, 3570 nt, Artificial Sequence
  derived and/or modified sequence opt2 from HR__Homo_sapiens__NP_005135
auggaguccacccccuccuuccucaagggcacccccaccugggagaagaccgcccccgagaacggcaucguccgccaggagcccggcucccccccccgcgacggccuccaccacggcccccucugccucggcgagcccgcccccuucuggcgcggcguccucuccacccccgacuccuggcucccccccggcuucccccagggccccaaggacaugcucccccucgucgagggcgagggcccccagaacggcgagcgcaaggucaacuggcucggcuccaaggagggccuccgcuggaaggaggccaugcucacccacccccucgccuucugcggccccgccugccccccccgcugcggcccccucaugcccgagcacuccggcggccaccucaaguccgaccccgucgccuuccgccccuggcacugccccuuccuccucgagaccaagauccucgagcgcgcccccuucuggguccccaccugccucccccccuaccucgucuccggccucccccccgagcaccccugcgacuggccccucaccccccaccccugggucuacuccggcggccagcccaagguccccuccgccuucucccucggcuccaagggcuucuacuacaaggaccccuccaucccccgccucgccaaggagccccucgccgccgccgagcccggccucuucggccucaacuccggcggccaccuccagcgcgccggcgaggccgagcgccccucccuccaccagcgcgacggcgagaugggcgccggccgccagcagaaccccugcccccucuuccucggccagcccgacaccguccccuggaccuccuggcccgccugcccccccggccucguccacacccucggcaacgucugggccggccccggcgacggcaaccucggcuaccagcucggcccccccgccaccccccgcugccccucccccgagccccccgucacccagcgcggcugcugcuccuccuacccccccaccaagggcggcggccucggccccugcggcaagugccaggagggccucgagggcggcgccuccggcgccuccgagcccuccgaggaggucaacaaggccuccggcccccgcgccugcccccccucccaccacaccaagcucaagaagaccuggcucacccgccacuccgagcaguucgagugcccccgcggcugccccgaggucgaggagcgccccgucgcccgccuccgcgcccucaagcgcgccggcucccccgagguccagggcgccaugggcucccccgcccccaagcgcccccccgaccccuuccccggcaccgccgagcagggcgccggcggcuggcaggagguccgcgacaccuccaucggcaacaaggacgucgacuccggccagcacgacgagcagaagggcccccaggacggccaggccucccuccaggaccccggccuccaggacauccccugccucgcccuccccgccaagcucgcccagugccaguccugcgcccaggccgccggcgagggcggcggccacgccugccacucccagcagguccgccgcuccccccucggcggcgagcuccagcaggaggaggacaccgccaccaacuccuccuccgaggagggccccggcuccggccccgacucccgccucuccaccggccucgccaagcaccuccucuccggccucggcgaccgccucugccgccuccuccgccgcgagcgcgaggcccucgccugggcccagcgcgagggccagggccccgccgucaccgaggacucccccggcaucccccgcugcugcucccgcugccaccacggccucuucaacacccacuggcgcugcccccgcugcucccaccgccucugcgucgccugcggccgcgucgccggcaccggccgcgcccgcgagaaggccggcuuccaggagcaguccgccgaggagugcacccaggaggccggccacgccgccugcucccucaugcucacccaguucgucuccucccaggcccucgccgagcucuccaccgccaugcaccaggucugggucaaguucgacauccgcggccacugccccugccaggccgacgcccgcgucugggcccccggcgacgccggccagcagaaggaguccacccagaagaccccccccaccccccagcccuccugcaacggcgacacccaccgcaccaaguccaucaaggaggagacccccgacuccgccgagacccccgccgaggaccgcgccggccgcggcccccuccccugccccucccucugcgagcuccucgccuccaccgccgucaagcucugccucggccacgagcgcauccacauggccuucgcccccgucacccccgcccuccccuccgacgaccgcaucaccaacauccucgacuccaucaucgcccaggucgucgagcgcaagauccaggagaaggcccucggccccggccuccgcgccggccccggccuccgcaagggccucggccucccccucucccccguccgcccccgccuccccccccccggcgcccuccucuggcuccaggagccccagcccugcccccgccgcggcuuccaccucuuccaggagcacuggcgccagggccagcccguccucgucuccggcauccagcgcacccuccagggcaaccucuggggcaccgaggcccucggcgcccucggcggccagguccaggcccucuccccccucggccccccccagcccuccucccucggcuccaccaccuucugggagggcuucuccuggcccgagcuccgccccaaguccgacgagggcuccguccuccuccuccaccgcgcccucggcgacgaggacaccucccgcgucgagaaccucgccgccucccucccccuccccgaguacugcgcccuccacggcaagcucaaccucgccuccuaccucccccccggccucgcccuccgcccccucgagccccagcucugggccgccuacggcgucuccccccaccgcggccaccucggcaccaagaaccucugcgucgaggucgccgaccucgucuccauccucguccacgccgacaccccccuccccgccuggcaccgcgcccagaaggacuuccucuccggccucgacggcgagggccucuggucccccggcucccaggucuccaccgucuggcacgucuuccgcgcccaggacgcccagcgcauccgccgcuuccuccagauggucugccccgccggcgccggcgcccucgagcccggcgcccccggcuccugcuaccucgacgccggccuccgccgccgccuccgcgaggaguggggcgucuccugcuggacccuccuccaggcccccggcgaggccguccucguccccgccggcgccccccaccagguccagggccucgucuccaccgucuccgucacccagcacuuccucucccccgagaccuccgcccucuccgcccagcucugccaccagggccccucccucccccccgacugccaccuccucuacgcccagauggacugggccgucuuccaggccgucaaggucgccgucggcacccuccaggaggccaaguga

SEQ ID NO: 44335 - RNA, 276 nt, Artificial Sequence
  derived and/or modified sequence opt2 from HRK__Homo_sapiens__NP_003797
augugccccugcccccuccaccgcggccgcggcccccccgccgucugcgccugcuccgccggccgccucggccuccgcuccuccgccgcccagcucaccgccgcccgccucaaggcccucggcgacgagcuccaccagcgcaccauguggcgccgccgcgcccgcucccgccgcgcccccgcccccggcgcccuccccaccuacuggcccuggcucugcgccgccgcccaggucgccgcccucgccgccuggcuccucggccgccgcaaccucuga

SEQ ID NO: 44336 - RNA, 8553 nt, Artificial Sequence
  derived and/or modified sequence opt2 from HRNR__Homo_sapiens__NP_001009931
augcccaagcuccuccagggcgucaucaccgucaucgacgucuucuaccaguacgccacccagcacggcgaguacgacacccucaacaaggccgagcucaaggagcuccucgagaacgaguuccaccagauccucaagaaccccaacgaccccgacaccgucgacaucauccuccagucccucgaccgcgaccacaacaagaaggucgacuucaccgaguaccuccucaugaucuucaagcucguccaggcccgcaacaagaucaucggcaaggacuacugccaggucuccggcuccaagcuccgcgacgacacccaccagcaccaggaggagcaggaggagaccgagaaggaggagaacaagcgccaggaguccuccuucucccacuccuccugguccgccggcgagaacgacuccuacucccgcaacguccgcggcucccucaagcccggcaccgaguccaucucccgccgccucuccuuccagcgcgacuucuccggccagcacaacuccuacuccggccaguccuccuccuacggcgagcagaacuccgacucccaccaguccuccggccgcggccagugcggcuccggcuccggccagucccccaacuacggccagcacggcuccggcuccggccaguccuccuccaacgacacccacggcuccggcuccggccaguccuccggcuucucccagcacaaguccuccuccggccaguccuccggcuacucccagcacggcuccggcuccggccacuccuccggcuacggccagcacggcucccgcuccggccaguccucccgcggcgagcgccaccgcuccuccuccggcuccuccuccuccuacggccagcacggcuccggcucccgccagucccucggccacggccgccagggcuccggcucccgccagucccccucccacguccgccacggcuccggcuccggccacuccuccucccacggccagcacggcuccggcuccuccuacuccuacucccgcggccacuacgaguccggcuccggccagaccuccggcuucggccagcacgaguccggcuccggccaguccuccggcuacuccaagcacggcuccggcuccggccacuccuccucccagggccagcacggcuccaccuccggccaggccuccuccuccggccagcacggcuccuccucccgccaguccuccuccuacggccagcacgaguccgccucccgccacuccuccggccgcggccagcacuccuccggcuccggccagucccccggccacggccagcgcggcuccggcuccggccagucccccuccuccggccagcacggcaccggcuucggccgcuccuccuccuccggccccuacgucuccggcuccggcuacuccuccggcuucggccaccacgaguccuccuccgagcacuccuccggcuacacccagcacggcuccggcuccggccacuccuccggccacggccagcacggcucccgcuccggccaguccucccgcggcgagcgccagggcuccuccgccggcuccuccuccuccuacggccagcacggcuccggcucccgccagucccucggccacucccgccacggcuccggcuccggccagucccccucccccucccgcggccgccacgaguccggcucccgccaguccuccuccuacggcccccacggcuacggcuccggccgcuccuccucccgcggccccuacgaguccggcuccggccacuccuccggccucggccaccaggagucccgcuccggccaguccuccggcuacggccagcacggcuccuccuccggccacuccuccacccacggccagcacggcuccaccuccggccaguccuccuccugcggccagcacggcgccaccuccggccaguccuccucccacggccagcacggcuccggcuccucccaguccucccgcuacggccagcagggcuccggcuccggccagucccccucccgcggccgccacggcuccgacuucggccacuccuccuccuacggccagcacggcuccggcuccggcugguccuccuccaacggcccccacggcuccgucuccggccaguccuccggcuucggccacaaguccggcuccggccaguccuccggcuacucccagcacggcuccggcuccucccacuccuccggcuaccgcaagcacggcucccgcuccggccaguccucccgcuccgagcagcacggcuccuccuccggccucuccuccuccuacggccagcacggcuccggcucccaccaguccuccggccacggccgccagggcuccggcuccggccacucccccucccgcguccgccacggcuccuccuccggccacuccuccucccacggccagcacggcuccggcaccuccugcuccuccuccugcggccacuacgaguccggcuccggccaggccuccggcuucggccagcacgaguccggcuccggccagggcuacucccagcacggcuccgccuccggccacuucuccucccagggccgccacggcuccaccuccggccaguccuccuccuccggccagcacgacuccuccuccggccaguccuccuccuacggccagcacgaguccgccucccaccacgccuccggccgcggccgccacggcuccggcuccggccagucccccggccacggccagcgcggcuccggcuccggccagucccccuccuacggccgccacggcuccggcuccggccgcuccuccuccuccggccgccacggcuccggcuccggccaguccuccggcuucggccacaaguccuccuccggccaguccuccggcuacacccagcacggcuccggcuccggccacuccuccuccuacgagcagcacggcucccgcuccggccaguccucccgcuccgagcagcacggcuccuccuccggcuccuccuccuccuacggccagcacggcuccggcucccgccagucccucggccacggccagcacggcuccggcuccggccagucccccucccccucccgcggccgccacggcuccggcuccggccaguccuccuccuacggccccuaccgcuccggcuccggcugguccuccucccgcggccccuacgaguccggcuccggccacuccuccggccucggccaccgcgagucccgcuccggccaguccuccggcuacggccagcacggcuccuccuccggccacuccuccacccacggccagcacggcuccaccuccggccaguccuccuccugcggccagcacggcgccuccuccggccaguccuccucccacggccagcacggcuccggcuccucccaguccuccggcuacggccgccagggcuccggcuccggccagucccccggccacggccagcgcggcuccggcucccgccagucccccuccuacggccgccacggcuccggcuccggccgcuccuccuccuccggccagcacggcuccggccucggcgaguccuccggcuucggccaccacgaguccuccuccggccaguccuccuccuacucccagcacggcuccggcuccggccacuccuccggcuacggccagcacggcucccgcuccggccaguccucccgcggcgagcgccacggcuccuccuccggcuccuccucccacuacggccagcacggcuccggcucccgccaguccuccggccacggccgccagggcuccggcuccggccacucccccucccgcggccgccacggcuccggccucggccacuccuccucccacggccagcacggcuccggcuccggccgcuccuccucccgcggccccuacgagucccgcuccggccacuccuccgucuucggccagcacgaguccggcuccggccacuccuccgccuacucccagcacggcuccggcuccggccacuucugcucccagggccagcacggcuccaccuccggccaguccuccaccuucgaccaggagggcuccuccaccggccaguccuccuccuacggccaccgcggcuccggcuccucccaguccuccggcuacggccgccacggcgccggcuccggccagucccccucccgcggccgccacggcuccggcuccggccacuccuccuccuacggccagcacggcuccggcuccggcugguccuccuccuccggccgccacggcuccggcuccggccaguccuccggcuucggccaccacgaguccuccuccuggcaguccuccggcugcacccagcacggcuccggcuccggccacuccuccuccuacgagcagcacggcucccgcuccggccaguccucccgcggcgagcgccacggcuccuccuccggcuccuccuccuccuacggccagcacggcuccggcucccgccagucccucggccacggccagcacggcuccggcuccggccagucccccucccccucccgcggccgccacggcuccggcuccggccaguccuccuccuacucccccuacggcuccggcuccggcugguccuccucccgcggccccuacgaguccggcuccucccacuccuccggccucggccaccgcgagucccgcuccggccaguccuccggcuacggccagcacggcuccuccuccggccacuccuccacccacggccagcacggcuccaccuccggccaguccuccuccugcggccagcacggcgccuccuccggccaguccuccucccacggccagcacggcuccggcuccucccaguccuccggcuacggccgccagggcuccggcuccggccagucccccggccacggccagcgcggcuccggcucccgccagucccccuccuacggccgccacggcuccggcuccggccgcuccuccuccuccggccagcacggcuccggccucggcgaguccuccggcuucggccaccacgaguccuccuccggccaguccuccuccuacucccagcacggcuccggcuccggccacuccuccggcuacggccagcacggcucccgcuccggccaguccucccgcggcgagcgccacggcuccuccucccgcuccuccucccgcuacggccagcacggcuccggcucccgccaguccuccggccacggccgccagggcuccggcuccggccagucccccucccgcggccgccacggcuccggccucggccacuccuccucccacggccagcacggcuccggcuccggccgcuccuccucccgcggccccuacgagucccgcuccggccacuccuccgucuucggccagcacgaguccggcuccggccacuccuccgccuacucccagcacggcuccggcuccggccacuucugcucccagggccagcacggcuccaccuccggccaguccuccaccuucgaccaggagggcuccuccaccggccaguccuccucccacggccagcacggcuccggcuccucccaguccuccuccuacggccagcagggcuccggcuccggccagucccccucccgcggccgccacggcuccggcuccggccacuccuccuccuacggccagcacggcuccggcuccggcugguccuccuccuccggccgccacggcuccggcuccggccaguccuccggcuucggccaccacgaguccuccuccuggcaguccuccggcuacacccagcacggcuccggcuccggccacuccuccuccuacgagcagcacggcucccgcuccggccaguccucccgcggcgagcagcacggcuccuccuccggcuccuccuccuccuacggccagcacggcuccggcucccgccagucccucggccacggccagcacggcuccggcuccggccagucccccucccccucccgcggccgccacggcuccggcuccggccaguccuccuccuacggccccuacggcuccggcuccggcugguccuccucccgcggccccuacgaguccggcuccggccacuccuccggccucggccaccgcgagucccgcuccggccaguccuccggcuacggccagcacggcuccuccuccggccacuccuccacccacggccagcacggcuccgccuccggccaguccuccuccugcggccagcacggcgccuccuccggccaguccuccucccacggccagcacggcuccggcuccucccaguccuccggcuacggccgccagggcuccggcuccggccagucccccggccacggccagcgcggcuccggcucccgccagucccccuccuacggccgccacggcuccggcuccggccgcuccuccuccuccggccagcacggccccggccucggcgaguccuccggcuucggccaccacgaguccuccuccggccaguccuccuccuacucccagcacggcuccggcuccggccacuccuccggcuacggccagcacggcucccgcuccggccaguccucccgcggcgagcgccacggcuccuccuccggcuccuccucccgcuacggccagcacggcuccggcucccgccaguccuccggccacggccgccagggcuccggcuccggccacucccccucccgcggccgccacggcuccggcuccggccacuccuccucccacggccagcacggcuccggcuccggccgcuccuccucccgcggccccuacgagucccgcuccggccacuccuccgucuucggccagcacgaguccggcuccggccacuccuccgccuacucccagcacggcuccggcuccggccacuucugcucccagggccagcacggcuccaccuccggccaguccuccaccuucgaccaggagggcuccuccaccggccaguccuccucccacggccagcacggcuccggcuccucccaguccuccuccuacggccagcagggcuccggcuccggccagucccccucccgcggccgccacggcuccggcuccggccacuccuccuccuacggccagcacggcuccggcuccggcugguccuccuccuccggccgccacggcuccggcuccggccaguccuccggcuucggccaccacgaguccuccuccuggcaguccuccggcuacacccagcacggcuccggcuccggccacuccuccuccuacgagcagcacggcucccgcuccggccaguccucccgcggcgagcgccacggcuccuccuccggcuccuccuccuccuacggccagcacggcuccggcucccgccagucccucggccacggccagcacggcuccggcuccggccagucccccucccccucccgcggccgccacggcuccggcuccggccaguccuccuccuacucccccuacggcuccggcuccggcugguccuccucccgcggccccuacgaguccggcuccggccacuccuccggccucggccaccgcgagucccgcuccggccaguccuccggcuacggccagcacggcuccuccuccggccacuccuccacccacggccagcacggcuccaccuccggccaguccuccuccugcggccagcacggcgccuccuccggccaguccuccucccacggccagcacggcuccggcuccucccaguccuccggcuacggccgccagggcuccggcuccggccagucccccggccacggccagcgcggcuccggcucccgccagucccccuccuacggccgccacggcuccggcuccggccgcuccuccuccuccggccagcacggcuccggccucggcgaguccuccggcuucggccaccacgaguccuccuccggccaguccuccuccuacucccagcacggcuccggcuccggccacuccuccggcuacggccagcacggcucccgcuccggccaguccucccgcggcgagcgccacggcuccuccuccggcuccuccucccacuacggccagcacggcuccggcucccgccaguccuccggccacggccgccagggcuccggcuccggccagucccccucccgcggccgccacggcuccggccucggccacuccuccucccacggccagcacggcuccggcuccggccgcuccuccucccgcggccccuacgagucccgccucggccacuccuccgucuucggccagcacgaguccggcuccggccacuccuccgccuacucccagcacggcuccggcuccggccacuucugcucccagggccagcacggcuccaccuccggccaguccuccaccuucgaccaggagggcuccuccaccggccaguccuccuccuacggccaccgcggcuccggcuccucccaguccuccggcuacggccgccacggcgccggcuccggccagucccucucccacggccgccacggcuccggcuccggccaguccuccuccuacggccagcacggcuccggcuccggccaguccuccggcuacucccagcacggcuccggcuccggccaggacggcuacuccuacugcaagggcggcuccaaccacgacggcggcuccuccggcuccuacuuccucuccuuccccuccuccaccucccccuacgaguacguccaggagcagcgcugcuacuucuaccaguga

SEQ ID NO: 44337 - RNA, 414 nt, Artificial Sequence
  derived and/or modified sequence opt2 from HRSP12__Homo_sapiens__NP_005827
auguccucccucauccgccgcgucaucuccaccgccaaggcccccggcgccaucggccccuacucccaggccguccucgucgaccgcaccaucuacaucuccggccagaucggcauggaccccuccuccggccagcucgucuccggcggcgucgccgaggaggccaagcaggcccucaagaacaugggcgagauccucaaggccgccggcugcgacuucaccaacgucgucaagaccaccguccuccucgccgacaucaacgacuucaacaccgucaacgagaucuacaagcaguacuucaaguccaacuuccccgcccgcgccgccuaccaggucgccgcccuccccaagggcucccgcaucgagaucgaggccgucgccauccagggcccccucaccaccgccucccucuga

SEQ ID NO: 44338 - RNA, 1179 nt, Artificial Sequence
  derived and/or modified sequence opt2 from HS1BP3__Homo_sapiens__NP_071905
augcagucccccgccguccucgucaccucccgccgccuccagaacgcccacaccggccucgaccucaccgucccccagcaccaggagguccgcggcaagaugauguccggccacgucgaguaccagauccucgucgucacccgccucgccgccuucaaguccgccaagcaccgccccgaggacgucguccaguuccucgucuccaagaaguacuccgagaucgaggaguucuaccagaagcucuccucccgcuacgccgccgccucccuccccccccucccccgcaagguccucuucgucggcgaguccgacauccgcgagcgccgcgccgucuucaacgagauccuccgcugcgucuccaaggacgccgagcucgccggcucccccgagcuccucgaguuccucggcacccgcucccccggcgccgccggccucaccucccgcgacuccuccguccucgacggcaccgacucccagaccggcaacgacgaggaggccuucgacuucuucgaggagcaggaccaggucgccgaggagggcccccccguccagucccucaagggcgaggacgccgaggagucccucgaggaggaggaggcccucgacccccucggcaucaugcgcuccaagaagcccaagaagcaccccaaggucgccgucaaggccaagcccuccccccgccucaccaucuucgacgaggaggucgaccccgacgagggccucuucggccccggccgcaagcucuccccccaggaccccuccgaggacgucuccuccgucgacccccucaagcucuucgacgaccccgaccucggcggcgccaucccccucggcgacucccuccuccuccccgccgccugcgaguccggcggccccacccccucccucucccaccgcgacgccuccaaggagcucuuccgcgucgaggaggaccucgaccagauccucaaccucggcgccgagcccaagcccaagccccagcucaagcccaagccccccgucgccgccaagcccgucaucccccgcaagcccgccgucccccccaaggccggccccgccgaggccgucgccggccagcagaagccccaggagcagauccaggccauggacgagauggacauccuccaguacauccaggaccacgacacccccgcccaggccgcccccucccucuucuga

SEQ ID NO: 44339 - RNA, 924 nt, Artificial Sequence
  derived and/or modified sequence opt2 from HS3ST1__Homo_sapiens__NP_005105
auggccgcccuccuccucggcgccguccuccucgucgcccagccccagcucguccccucccgccccgccgagcucggccagcaggagcuccuccgcaaggccggcacccuccaggacgacguccgcgacggcgucgcccccaacggcuccgcccagcagcucccccagaccaucaucaucggcguccgcaagggcggcacccgcgcccuccucgagaugcucucccuccaccccgacgucgccgccgccgagaacgagguccacuucuucgacugggaggagcacuacucccacggccucggcugguaccucucccagaugcccuucuccuggccccaccagcucaccgucgagaagacccccgccuacuucaccucccccaagguccccgagcgcgucuacuccaugaaccccuccauccgccuccuccucauccuccgcgaccccuccgagcgcguccucuccgacuacacccaggucuucuacaaccacaugcagaagcacaagcccuaccccuccaucgaggaguuccucguccgcgacggccgccucaacgucgacuacaaggcccucaaccgcucccucuaccacguccacaugcagaacuggcuccgcuucuucccccuccgccacauccacaucgucgacggcgaccgccucauccgcgaccccuuccccgagauccagaaggucgagcgcuuccucaagcucuccccccagaucaacgccuccaacuucuacuucaacaagaccaagggcuucuacugccuccgcgacuccggccgcgaccgcugccuccacgaguccaagggccgcgcccacccccaggucgaccccaagcuccucaacaagcuccacgaguacuuccacgagcccaacaagaaguucuucgagcucgucggccgcaccuucgacuggcacuga

SEQ ID NO: 44340 - RNA, 1104 nt, Artificial Sequence
  derived and/or modified sequence opt2 from HS3ST2__Homo_sapiens__NP_006034
auggccuaccgcguccucggccgcgccggccccccccagccccgccgcgcccgccgccuccucuucgccuucacccucucccucuccugcaccuaccucugcuacuccuuccucugcugcugcgacgaccucggccgcucccgccuccucggcgccccccgcugccuccgcggccccuccgccggcggccagaagcuccuccagaagucccgccccugcgaccccuccggccccacccccuccgagcccuccgcccccuccgcccccgccgccgccguccccgccccccgccucuccggcuccaaccacuccggcucccccaagcucggcaccaagcgccucccccaggcccucaucgucggcgucaagaagggcggcacccgcgccguccucgaguucauccgcguccaccccgacguccgcgcccucggcaccgagccccacuucuucgaccgcaacuacggccgcggccucgacugguaccgcucccucaugccccgcacccucgagucccagaucacccucgagaagacccccuccuacuucgucacccaggaggccccccgccgcaucuucaacaugucccgcgacaccaagcucaucgucgucguccgcaaccccgucacccgcgccaucuccgacuacacccagacccucuccaagaagcccgacauccccaccuucgagggccucuccuuccgcaaccgcacccucggccucgucgacgucuccuggaacgccauccgcaucggcauguacguccuccaccucgaguccuggcuccaguacuucccccucgcccagauccacuucgucuccggcgagcgccucaucaccgaccccgccggcgagaugggccgcguccaggacuuccucggcaucaagcgcuucaucaccgacaagcacuucuacuucaacaagaccaagggcuuccccugccucaagaagaccgaguccucccuccucccccgcugccucggcaaguccaagggccgcacccacguccagaucgaccccgaggucaucgaccagcuccgcgaguucuaccgccccuacaacaucaaguucuacgagaccgucggccaggacuuccgcugggaguga

SEQ ID NO: 44341 - RNA, 1221 nt, Artificial Sequence
  derived and/or modified sequence opt2 from HS3ST3A1__Homo_sapiens__NP_006033
auggccccccccggccccgccuccgcccucuccaccuccgccgagccccucucccgcuccaucuuccgcaaguuccuccucaugcucugcucccuccucaccucccucuacgucuucuacugccucgccgagcgcugccagacccucuccggccccgucgucggccucuccggcggcggcgaggaggccggcgcccccggcggcggcguccucgccggcggcccccgcgagcucgccgucuggcccgccgccgcccagcgcaagcgccuccuccagcucccccaguggcgccgccgccgcccccccgccccccgcgacgacggcgaggaggccgccugggaggaggagucccccggccucuccggcggccccggcggcuccggcgccggcuccaccgucgccgaggccccccccggcacccucgcccuccuccucgacgagggcuccaagcagcucccccaggccaucaucaucggcgucaagaagggcggcacccgcgcccuccucgaguuccuccgcguccaccccgacguccgcgccgucggcgccgagccccacuucuucgaccgcuccuacgacaagggccucgccugguaccgcgaccucaugccccgcacccucgacggccagaucaccauggagaagacccccuccuacuucgucacccgcgaggcccccgcccgcaucuccgccauguccaaggacaccaagcucaucgucgucguccgcgaccccgucacccgcgccaucuccgacuacacccagacccucuccaagcgccccgacauccccaccuucgagucccucaccuucaagaaccgcaccgccggccucaucgacaccuccugguccgccauccagaucggcaucuacgccaagcaccucgagcacuggcuccgccacuuccccauccgccagaugcucuucgucuccggcgagcgccucaucuccgaccccgccggcgagcucggccgcguccaggacuuccucggccucaagcgcaucaucaccgacaagcacuucuacuucaacaagaccaagggcuuccccugccucaagaaggccgagggcuccucccgcccccacugccucggcaagaccaagggccgcacccaccccgagaucgaccgcgaggucguccgccgccuccgcgaguucuaccgccccuucaaccucaaguucuaccagaugaccggccacgacuucggcugggacggcuga

SEQ ID NO: 44342 - RNA, 1173 nt, Artificial Sequence
  derived and/or modified sequence opt2 from HS3ST3B1__Homo_sapiens__NP_006032
augggccagcgccucuccggcggccgcuccugccucgacguccccggccgccuccucccccagcccccccccccccccccccccguccgccgcaagcucgcccuccucuucgccaugcucugcgucuggcucuacauguuccucuacuccugcgccggcuccugcgccgccgcccccggccuccuccuccucggcuccggcucccgcgccgcccacgacccccccgcccucgccaccgcccccgacggcacccccccccgccuccccuuccgcgccccccccgccaccccccucgccuccggcaaggagauggccgagggcgccgccucccccgaggagcagucccccgagguccccgacucccccucccccaucuccuccuucuucuccggcuccggcuccaagcagcucccccaggccaucaucaucggcgucaagaagggcggcacccgcgcccuccucgaguuccuccgcguccaccccgacguccgcgccgucggcgccgagccccacuucuucgaccgcuccuacgacaagggccucgccugguaccgcgaccucaugccccgcacccucgacggccagaucaccauggagaagacccccuccuacuucgucacccgcgaggcccccgcccgcaucuccgccauguccaaggacaccaagcucaucgucgucguccgcgaccccgucacccgcgccaucuccgacuacacccagacccucuccaagcgccccgacauccccaccuucgagucccucaccuucaagaaccgcaccgccggccucaucgacaccuccugguccgccauccagaucggcaucuacgccaagcaccucgagcacuggcuccgccacuuccccauccgccagaugcucuucgucuccggcgagcgccucaucuccgaccccgccggcgagcucggccgcguccaggacuuccucggccucaagcgcaucaucaccgacaagcacuucuacuucaacaagaccaagggcuuccccugccucaagaaggccgagggcuccucccgcccccacugccucggcaagaccaagggccgcacccaccccgagaucgaccgcgaggucguccgccgccuccgcgaguucuaccgccccuucaaccucaaguucuaccagaugaccggccacgacuucggcugggacuga

SEQ ID NO: 44343 - RNA, 1371 nt, Artificial Sequence
  derived and/or modified sequence opt2 from HS3ST4__Homo_sapiens__NP_006031
auggcccgcuggcccgcccccccccccccccccccccccccccccccccucgccgccccccccccccccggcgccuccgccaagggcccccccgcccgcaagcuccucuucaugugcacccucucccucuccgucaccuaccucugcuacucccuccucggcggcuccggcucccuccaguucccccucgcccuccaggagucccccggcgccgccgccgagcccccccccuccccccccccccccucccuccuccccacccccguccgccucggcgcccccucccagccccccgccccccccccccucgacaacgccucccacggcgagccccccgagccccccgagcagcccgccgcccccggcaccgacggcuggggccuccccuccggcggcggcggcgcccaggacgccuggcuccgcaccccccucgcccccuccgagaugaucaccgcccaguccgcccuccccgagcgcgaggcccaggaguccuccaccaccgacgaggaccucgccggccgccgcgccgccaacggcuccuccgagcgcggcggcgccgucuccacccccgacuacggcgagaagaagcucccccaggcccucaucaucggcgucaagaagggcggcacccgcgcccuccucgaggccauccgcguccaccccgacguccgcgccgucggcgucgagccccacuucuucgaccgcaacuacgagaagggccucgagugguaccgcaacgucaugcccaagacccucgacggccagaucaccauggagaagacccccuccuacuucgucaccaacgaggcccccaagcgcauccacuccauggccaaggacaucaagcucaucgucgucguccgcaaccccgucacccgcgccaucuccgacuacacccagacccucuccaagaagcccgagauccccaccuucgagguccucgccuucaagaaccgcacccucggccucaucgacgccuccugguccgccauccgcaucggcaucuacgcccuccaccucgagaacuggcuccaguacuucccccucucccagauccucuucgucuccggcgagcgccucaucgucgaccccgccggcgagauggccaagguccaggacuuccucggccucaagcgcgucgucaccgagaagcacuucuacuucaacaagaccaagggcuuccccugccucaagaagcccgaggacuccuccgccccccgcugccucggcaaguccaagggccgcacccacccccgcaucgaccccgacgucauccaccgccuccgcaaguucuacaagcccuucaaccucauguucuaccagaugaccggccaggacuuccagugggagcaggaggagggcgacaaguga

SEQ ID NO: 44344 - RNA, 1041 nt, Artificial Sequence
  derived and/or modified sequence opt2 from HS3ST5__Homo_sapiens__NP_705840
augcucuucaagcagcaggccuggcuccgccagaagcuccucguccucggcucccucgccgucggcucccuccucuaccucgucgcccgcgucggcucccucgaccgccuccagcccaucugccccaucgagggccgccucggcggcgcccgcacccaggccgaguucccccuccgcgcccuccaguucaagcgcggccuccuccacgaguuccgcaagggcaacgccuccaaggagcagguccgccuccacgaccucguccagcagcuccccaaggccaucaucaucggcguccgcaagggcggcacccgcgcccuccucgagaugcucaaccuccaccccgccgucgucaaggccucccaggagauccacuucuucgacaacgacgagaacuacggcaagggcaucgagugguaccgcaagaagaugcccuucuccuacccccagcagaucaccaucgagaagucccccgccuacuucaucaccgaggagguccccgagcgcaucuacaagaugaacuccuccaucaagcuccucaucaucguccgcgagcccaccacccgcgccaucuccgacuacacccagguccucgagggcaaggagcgcaagaacaagaccuacuacaaguucgagaagcucgccaucgaccccaacaccugcgaggucaacaccaaguacaaggccguccgcaccuccaucuacaccaagcaccucgagcgcuggcucaaguacuuccccaucgagcaguuccacgucgucgacggcgaccgccucaucaccgagccccuccccgagcuccagcucgucgagaaguuccucaaccuccccccccgcaucucccaguacaaccucuacuucaacgccacccgcggcuucuacugccuccgcuucaacaucaucuucaacaagugccucgccggcuccaagggccgcauccaccccgaggucgaccccuccgucaucaccaagcuccgcaaguucuuccaccccuucaaccagaaguucuaccagaucaccggccgcacccucaacuggcccuga

SEQ ID NO: 44345 - RNA, 1029 nt, Artificial Sequence
  derived and/or modified sequence opt2 from HS3ST6__Homo_sapiens__NP_001009606
auggccggcuccggcggccucggcggcggcgccggcggcggccagggcgccggcgccggccagggcgccgcccuccgcgccucccgcgcccccaugcuccucgucgcccucguccucggcgccuacugccucugcgcccuccccggccgcugcccccccgccgcccgcgcccccgcccccgcccccgcccccuccgagcccuccuccuccguccaccgccccggcgcccccggccucccccucgccuccggccccggccgccgccgcuucccccaggcccucaucgucggcgucaagaagggcggcacccgcgcccuccucgaguuccuccgccuccaccccgacguccgcgcccucggcuccgagccccacuucuucgaccgcugcuacgagcgcggccucgccugguaccgcucccucaugccccgcacccucgacggccagaucaccauggagaagacccccuccuacuucgucacccgcgaggccccccgccgcauccacgccaugucccccgacaccaagcucaucgucgucguccgcaaccccgucacccgcgccaucuccgacuacgcccagacccucuccaagacccccggccuccccuccuuccgcgcccucgccuuccgccacggccucggccccgucgacaccgccugguccgccguccgcaucggccucuacgcccagcaccucgaccacuggcuccgcuacuucccccucucccacuuccucuucgucuccggcgagcgccucgucuccgaccccgccggcgaggucggccgcguccaggacuuccucggccucaagcgcgucgucaccgacaagcacuucuacuucaacgccaccaagggcuuccccugccucaagaaggcccagggcggcucccgcccccgcugccucggcaaguccaagggccgcccccacccccgcgucccccaggcccucguccgccgccuccaggaguucuaccgccccuucaaccgccgcuucuaccagaugaccggccaggacuucggcuggggcuga

SEQ ID NO: 44346 - RNA, 1236 nt, Artificial Sequence
  derived and/or modified sequence opt2 from HS6ST1__Homo_sapiens__NP_004798
augcgccgccgccgcgccggcggccgcaccauggucgagcgcgccuccaaguucguccucgucgucgccggcuccgucugcuucaugcucauccucuaccaguacgccggccccggccucucccucggcgcccccggcggccgcgccccccccgacgaccucgaccucuuccccacccccgacccccacuacgagaagaaguacuacuuccccguccgcgagcucgagcgcucccuccgcuucgacaugaagggcgacgacgucaucgucuuccuccacauccagaagaccggcggcaccaccuucggccgccaccucguccagaacguccgccucgagguccccugcgacugccgccccggccagaagaagugcaccugcuaccgccccaaccgccgcgagaccuggcucuucucccgcuucuccaccggcugguccugcggccuccacgccgacuggaccgagcucaccaacugcguccccggcguccucgaccgccgcgacuccgccgcccuccgcaccccccgcaaguucuacuacaucacccuccuccgcgaccccgucucccgcuaccucuccgaguggcgccacguccagcgcggcgccaccuggaagaccucccuccacaugugcgacggccgcacccccacccccgaggagcucccccccugcuacgagggcaccgacugguccggcugcacccuccaggaguucauggacugccccuacaaccucgccaacaaccgccagguccgcaugcucgccgaccucucccucgucggcugcuacaaccucuccuucauccccgagggcaagcgcgcccagcuccuccucgaguccgccaagaagaaccuccgcggcauggccuucuucggccucaccgaguuccagcgcaagacccaguaccucuucgagcgcaccuucaaccucaaguucauccgccccuucaugcaguacaacuccacccgcgccggcggcgucgaggucgacgaggacaccauccgccgcaucgaggagcucaacgaccucgacaugcagcucuacgacuacgccaaggaccucuuccagcagcgcuaccaguacaagcgccagcucgagcgccgcgagcagcgccuccgcucccgcgaggagcgccuccuccaccgcgccaaggaggcccucccccgcgaggacgccgacgagcccggccgcguccccaccgaggacuacaugucccacaucaucgagaagugguga

SEQ ID NO: 44347 - RNA, 1938 nt, Artificial Sequence
  derived and/or modified sequence opt2 from HS6ST2__Homo_sapiens__NP_001070656
auggcccuccccgccugcgccguccgcgaguucgagcccccccgccagcccgagcgcggcgcccccguccgcaccaccugcccccgccgccacucccgcgucgaggccgagcucgccgccucccgccccggcuccgucgccgccuccguccgcgccggccccccccgcggcgucucccacggcuuccacacccgcccccuccucgacaagccccgcaaggccuccuccucccucgccggcgccgccugcgccccccucuucgcccuccucucccgcggccgccgccgccgcaugcacguccuccgccgccgcugggaccucggcucccucugccgcgcccuccucacccgcggccucgccgcccucggccacucccucaagcacguccucggcgccaucuucuccaagaucuucggccccauggccuccgucggcaacauggacgagaaguccaacaagcuccuccucgcccucgucaugcucuuccucuucgccgucaucguccuccaguacgucugccccggcaccgagugccagcuccuccgccuccaggccuucuccucccccguccccgaccccuaccgcuccgaggacgaguccuccgcccgcuucgucccccgcuacaacuucacccgcggcgaccuccuccgcaaggucgacuucgacaucaagggcgacgaccucaucgucuuccuccacauccagaagaccggcggcaccaccuucggccgccaccucguccgcaacauccagcucgagcagcccugcgagugccgcgucggccagaagaagugcaccugccaccgccccggcaagcgcgagaccuggcucuucucccgcuucuccaccggcugguccugcggccuccacgccgacuggaccgagcucaccuccugcguccccuccgucgucgacggcaagcgcgacgcccgccuccgccccucccgcuggcgcaucuuccagauccucgacgccgccuccaaggacaagcgcggcucccccaacaccaacgccggcgccaacucccccuccuccaccaagacccgcaacaccuccaaguccggcaagaacuuccacuacaucaccauccuccgcgaccccgucucccgcuaccucuccgaguggcgccacguccagcgcggcgccaccuggaaggccucccuccacgucugcgacggccgcccccccaccuccgaggagcuccccuccugcuacaccggcgacgacugguccggcugcccccucaaggaguucauggacugccccuacaaccucgccaacaaccgccagguccgcaugcucuccgaccucacccucgucggcugcuacaaccucuccgucaugcccgagaagcagcgcaacaagguccuccucgaguccgccaaguccaaccucaagcacauggccuucuucggccucaccgaguuccagcgcaagacccaguaccucuucgagaagaccuucaacaugaacuucaucucccccuucacccaguacaacaccacccgcgccuccuccgucgagaucaacgaggagauccagaagcgcaucgagggccucaacuuccucgacauggagcucuacuccuacgccaaggaccucuuccuccagcgcuaccaguucaugcgccagaaggagcaccaggaggcccgccgcaagcgccaggagcagcgcaaguuccucaagggccgccuccuccagacccacuuccagucccagggccagggccagucccagaaccccaaccagaaccagucccagaaccccaaccccaacgccaaccagaaccucacccagaaccucaugcagaaccucacccagucccucucccagaaggagaaccgcgagucccccaagcagaacuccggcaaggagcagaacgacaacaccuccaacggcaccaacgacuacaucggcuccgucgagaaguggcgcuga

SEQ ID NO: 44348 - RNA, 1416 nt, Artificial Sequence
  derived and/or modified sequence opt2 from HS6ST3__Homo_sapiens__NP_703157
auggacgagcgcuucaacaaguggcuccucacccccguccucacccuccucuucgucgucaucauguaccaguacgucucccccuccugcaccuccuccugcaccaacuucggcgagcagccccgcgccggcgaggccggcccccccgccguccccggccccgcccgccgcgcccaggccccccccgaggagugggagcgccgcccccagcuccccccccccccccgcggcccccccgagggcccccgcggcgccgccgcccccgaggaggaggacgaggagcccggcgacccccgcgagggcgaggaggaggaggaggaggacgagcccgaccccgaggcccccgagaacggcucccucccccgcuucgucccccgcuucaacuucucccucaaggaccucacccgcuucgucgacuucaacaucaagggccgcgacgucaucgucuuccuccacauccagaagaccggcggcaccaccuucggccgccaccucgucaagaacauccgccucgagcagcccugcuccugcaaggccggccagaagaagugcaccugccaccgccccggcaagaaggagaccuggcucuucucccgcuucuccaccggcugguccugcggccuccacgccgacuggaccgagcucaccaacugcguccccgccaucauggagaagaaggacugcccccgcaaccacucccacacccgcaacuucuacuacaucaccaugcuccgcgaccccgucucccgcuaccucuccgaguggaagcacguccagcgcggcgccaccuggaagaccucccuccacaugugcgacggccgcucccccacccccgacgagcuccccaccugcuaccccggcgacgacugguccggcgucucccuccgcgaguucauggacugcaccuacaaccucgccaacaaccgccagguccgcaugcucgccgaccucucccucgucggcugcuacaaccucaccuucaugaacgaguccgagcgcaacaccauccuccuccaguccgccaagaacaaccucaagaacauggccuucuucggccucaccgaguuccagcgcaagacccaguuccucuucgagcgcaccuucaaccucaaguucaucucccccuucacccaguucaacaucacccgcgccuccaacgucgagaucaacgagggcgcccgccagcgcaucgaggaccucaacuuccucgacaugcagcucuacgaguacgccaaggaccucuuccagcagcgcuaccaccacaccaagcagcucgagcaccagcgcgaccgccagaagcgccgcgaggagcgccgccuccagcgcgagcaccgcgaccaccaguggcccaaggaggacggcgccgccgagggcaccgucaccgaggacuacaacucccaggucguccgcugguga

SEQ ID NO: 44349 - RNA, 231 nt, Artificial Sequence
  derived and/or modified sequence opt2 from HSBP1__Homo_sapiens__NP_001528
auggccgagaccgaccccaagaccguccaggaccucaccuccgucguccagacccuccuccagcagaugcaggacaaguuccagaccauguccgaccagaucaucggccgcaucgacgacauguccucccgcaucgacgaccucgagaagaacaucgccgaccucaugacccaggccggcgucgaggagcucgaguccgagaacaagauccccgccacccagaaguccuga

SEQ ID NO: 44350 - RNA, 879 nt, Artificial Sequence
  derived and/or modified sequence opt2 from HSD11B1__Homo_sapiens__NP_001193670
auggccuucaugaagaaguaccuccuccccauccucggccucuucauggccuacuacuacuacuccgccaacgaggaguuccgccccgagaugcuccagggcaagaaggucaucgucaccggcgccuccaagggcaucggccgcgagauggccuaccaccucgccaagaugggcgcccacgucgucgucaccgcccgcuccaaggagacccuccagaaggucgucucccacugccucgagcucggcgccgccuccgcccacuacaucgccggcaccauggaggacaugaccuucgccgagcaguucgucgcccaggccggcaagcucaugggcggccucgacaugcucauccucaaccacaucaccaacaccucccucaaccucuuccacgacgacauccaccacguccgcaaguccauggaggucaacuuccucuccuacgucguccucaccgucgccgcccuccccaugcucaagcaguccaacggcuccaucgucgucgucuccucccucgccggcaaggucgccuaccccauggucgccgccuacuccgccuccaaguucgcccucgacggcuucuucuccuccauccgcaaggaguacuccgucucccgcgucaacgucuccaucacccucugcguccucggccucaucgacaccgagaccgccaugaaggccgucuccggcaucguccacaugcaggccgcccccaaggaggagugcgcccucgagaucaucaagggcggcgcccuccgccaggaggaggucuacuacgacuccucccucuggaccacccuccucauccgcaaccccugccgcaagauccucgaguuccucuacuccaccuccuacaacauggaccgcuucaucaacaaguga

SEQ ID NO: 44351 - RNA, 1002 nt, Artificial Sequence
  derived and/or modified sequence opt2 from HSD11B1L__Homo_sapiens__NP_001254797
auggccaaccucggcacccuccagcuccuccccccccgcuucaagcgcuucuccugccucucccuccccaacaucuggaucaccggcaugcccguccccgccaccuccguccccugccccuccgccggcccccaccgcaccaugaagguccuccuccucaccggccucggcgcccucuucuucgccuacuacugggacgacaacuucgaccccgccucccuccagggcgcccgcguccuccucaccggcgccaacgccggcgucggcgaggagcucgccuaccacuacgcccgccucggcucccaccucguccucaccgcccacaccgaggcccuccuccagaaggucgucggcaacugccgcaagcucggcgcccccaaggucuucuacaucgccgccgacauggccucccccgaggcccccgaguccgucguccaguucgcccucgacaagcucggcggccucgacuaccucguccucaaccacaucggcggcgcccccgccggcacccgcgcccgcuccccccaggccacccgcuggcucaugcaggucaacuucgucuccuacguccagcucaccucccgcgcccuccccucccucaccgacuccaagggcucccucgucgucgucuccucccuccucggccgcguccccaccuccuucuccacccccuacuccgccgccaaguucgcccucgacggcuucuucggcucccuccgccgcgagcucgacguccaggacgucaacgucgccaucaccaugugcguccucggccuccgcgaccgcgccuccgccgccgaggccguccgcggcgucacccgcgucaaggccgcccccggccccaaggccgcccucgccgucauccgcggcggcgccacccgcgccgccggcgucuucuaccccuggcgcuuccgccuccucugccuccuccgccgcuggcucccccgcccccgcgccugguucauccgccaggagcucaacgucaccgccgccgccgccuga

SEQ ID NO: 44352 - RNA, 1218 nt, Artificial Sequence
  derived and/or modified sequence opt2 from HSD11B2__Homo_sapiens__NP_000187
auggagcgcuggcccuggcccuccggcggcgccuggcuccucgucgccgcccgcgcccuccuccagcuccuccgcuccgaccuccgccucggccgcccccuccucgccgcccucgcccuccucgccgcccucgacuggcucugccagcgccuccuccccccccccgccgcccucgccguccucgccgccgccggcuggaucgcccucucccgccucgcccgcccccagcgccuccccgucgccacccgcgccguccucaucaccggcugcgacuccggcuucggcaaggagaccgccaagaagcucgacuccaugggcuucaccguccucgccaccguccucgagcucaacucccccggcgccaucgagcuccgcaccugcugcuccccccgccuccgccuccuccagauggaccucaccaagcccggcgacaucucccgcguccucgaguucaccaaggcccacaccaccuccaccggccucuggggccucgucaacaacgccggccacaacgaggucgucgccgacgccgagcucucccccgucgccaccuuccgcuccugcauggaggucaacuucuucggcgcccucgagcucaccaagggccuccucccccuccuccgcuccucccgcggccgcaucgucaccgucggcucccccgccggcgacaugcccuaccccugccucggcgccuacggcaccuccaaggccgccgucgcccuccucauggacaccuucuccugcgagcuccuccccuggggcgucaaggucuccaucauccagcccggcugcuucaagaccgaguccguccgcaacgucggccagugggagaagcgcaagcagcuccuccucgccaaccucccccaggagcuccuccaggccuacggcaaggacuacaucgagcaccuccacggccaguuccuccacucccuccgccucgccauguccgaccucacccccgucgucgacgccaucaccgacgcccuccucgccgcccgcccccgccgccgcuacuaccccggccagggccucggccucauguacuucauccacuacuaccuccccgagggccuccgccgccgcuuccuccaggccuucuucaucucccacugccucccccgcgcccuccagcccggccagcccggcaccacccccccccaggacgccgcccaggaccccaaccucucccccggccccucccccgccgucgcccgcuga

SEQ ID NO: 44353 - RNA, 759 nt, Artificial Sequence
  derived and/or modified sequence opt2 from HSD17B10__Homo_sapiens__NP_001032900
auggccgccgccugccgcuccgucaagggccucgucgccgucaucaccggcggcgccuccggccucggccucgccaccgccgagcgccucgucggccagggcgccuccgccguccuccucgaccuccccaacuccggcggcgaggcccaggccaagaagcucggcaacaacugcgucuucgcccccgccgacgucaccuccgagaaggacguccagaccgcccucgcccucgccaagggcaaguucggccgcgucgacgucgccgucaacugcgccggcaucgccgucgccuccaagaccuacaaccucaagaagggccagacccacacccucgaggacuuccagcgcguccucgacgucaaccucaugggcaccuucaacgucauccgccucgucgccggcgagaugggccagaacgagcccgaccagggcggccagcgcggcgucaucaucaacaccgccuccgucgccgccuucgagggccaggucggccaggccgccuacuccgccuccaagggcggcaucgucggcaugacccuccccaucgcccgcgaccucgcccccaucggccucuucggcaccccccuccucaccucccuccccgagaaggucugcaacuuccucgccucccagguccccuuccccucccgccucggcgaccccgccgaguacgcccaccucguccaggccaucaucgagaaccccuuccucaacggcgaggucauccgccucgacggcgccauccgcaugcagcccuga

SEQ ID NO: 44354 - RNA, 903 nt, Artificial Sequence
  derived and/or modified sequence opt2 from HSD17B11__Homo_sapiens__NP_057329
augaaguuccuccucgacauccuccuccuccucccccuccucaucgucugcucccucgaguccuucgucaagcucuucauccccaagcgccgcaaguccgucaccggcgagaucguccucaucaccggcgccggccacggcaucggccgccucaccgccuacgaguucgccaagcucaaguccaagcucguccucugggacaucaacaagcacggccucgaggagaccgccgccaagugcaagggccucggcgccaagguccacaccuucgucgucgacugcuccaaccgcgaggacaucuacuccuccgccaagaaggucaaggccgagaucggcgacgucuccauccucgucaacaacgccggcgucgucuacaccuccgaccucuucgccacccaggacccccagaucgagaagaccuucgaggucaacguccucgcccacuucuggaccaccaaggccuuccuccccgccaugaccaagaacaaccacggccacaucgucaccgucgccuccgccgccggccacgucuccguccccuuccuccucgccuacugcuccuccaaguucgccgccgucggcuuccacaagacccucaccgacgagcucgccgcccuccagaucaccggcgucaagaccaccugccucugccccaacuucgucaacaccggcuucaucaagaaccccuccaccucccucggccccacccucgagcccgaggaggucgucaaccgccucaugcacggcauccucaccgagcagaagaugaucuucauccccuccuccaucgccuuccucaccacccucgagcgcauccuccccgagcgcuuccucgccguccucaagcgcaagaucuccgucaaguucgacgccgucaucggcuacaagaugaaggcccaguga

SEQ ID NO: 44355 - RNA, 939 nt, Artificial Sequence
  derived and/or modified sequence opt2 from HSD17B12__Homo_sapiens__NP_057226
auggaguccgcccuccccgccgccggcuuccucuacugggucggcgccggcaccgucgccuaccucgcccuccgcaucuccuacucccucuucaccgcccuccgcgucuggggcgucggcaacgaggccggcgucggccccggccucggcgagugggccgucgucaccggcuccaccgacggcaucggcaaguccuacgccgaggagcucgccaagcacggcaugaaggucguccucaucucccgcuccaaggacaagcucgaccaggucuccuccgagaucaaggagaaguucaaggucgagacccgcaccaucgccgucgacuucgccuccgaggacaucuacgacaagaucaagaccggccucgccggccucgagaucggcauccucgucaacaacgucggcauguccuacgaguaccccgaguacuuccucgacguccccgaccucgacaacgucaucaagaagaugaucaacaucaacauccucuccgucugcaagaugacccagcucguccuccccggcauggucgagcgcuccaagggcgccauccucaacaucuccuccggcuccggcaugcuccccgucccccuccucaccaucuacuccgccaccaagaccuucgucgacuucuucucccagugccuccacgaggaguaccgcuccaagggcgucuucguccaguccguccuccccuacuucgucgccaccaagcucgccaagauccgcaagcccacccucgacaagcccucccccgagaccuucgucaaguccgccaucaagaccgucggccuccagucccgcaccaacggcuaccucauccacgcccucaugggcuccaucaucuccaaccuccccuccuggaucuaccucaagaucgucaugaacaugaacaaguccacccgcgcccacuaccucaagaagaccaagaagaacuga

SEQ ID NO: 44356 - RNA, 795 nt, Artificial Sequence
  derived and/or modified sequence opt2 from HSD17B13__Homo_sapiens__NP_001129702
augaacaucauccucgagauccuccuccuccucaucaccaucaucuacuccuaccucgagucccucgucaaguucuucaucccccagcgccgcaaguccgucgccggcgagaucguccucaucaccggcgccggccacggcaucggccgccagaccaccuacgaguucgccaagcgccaguccauccucguccucugggacaucaacaaggucaagaaggaggucggcgacgucaccaucgucgucaacaacgccggcaccgucuaccccgccgaccuccucuccaccaaggacgaggagaucaccaagaccuucgaggucaacauccucggccacuucuggaucaccaaggcccuccuccccuccaugauggagcgcaaccacggccacaucgucaccgucgccuccgucugcggccacgagggcauccccuaccucauccccuacugcuccuccaaguucgccgccgucggcuuccaccgcggccucaccuccgagcuccaggcccucggcaagaccggcaucaagaccuccugccucugccccgucuucgucaacaccggcuucaccaagaaccccuccacccgccucuggcccguccucgagaccgacgaggucguccgcucccucaucgacggcauccucaccaacaagaagaugaucuucguccccuccuacaucaacaucuuccuccgccuccagaaguuccuccccgagcgcgccuccgccauccucaaccgcaugcagaacauccaguucgaggccgucgucggccacaagaucaagaugaaguga

SEQ ID NO: 44357 - RNA, 813 nt, Artificial Sequence
  derived and/or modified sequence opt2 from HSD17B14__Homo_sapiens__NP_057330
auggccaccggcacccgcuacgccggcaaggucgucgucgucaccggcggcggccgcggcaucggcgccggcaucguccgcgccuucgucaacuccggcgcccgcgucgucaucugcgacaaggacgaguccggcggccgcgcccucgagcaggagcuccccggcgccgucuucauccucugcgacgucacccaggaggacgacgucaagacccucgucuccgagaccauccgccgcuucggccgccucgacugcgucgucaacaacgccggccaccacccccccccccagcgccccgaggagaccuccgcccagggcuuccgccagcuccucgagcucaaccuccucggcaccuacacccucaccaagcucgcccuccccuaccuccgcaagucccagggcaacgucaucaacaucuccucccucgucggcgccaucggccaggcccaggccguccccuacgucgccaccaagggcgccgucaccgccaugaccaaggcccucgcccucgacgagucccccuacggcguccgcgucaacugcaucucccccggcaacaucuggaccccccucugggaggagcucgccgcccucaugcccgacccccgcgccaccauccgcgagggcaugcucgcccagccccucggccgcaugggccagcccgccgaggucggcgccgccgccgucuuccucgccuccgaggccaacuucugcaccggcaucgagcuccucgucaccggcggcgccgagcucggcuacggcugcaaggccucccgcuccacccccgucgacgcccccgacauccccuccuga

SEQ ID NO: 44358 - RNA, 987 nt, Artificial Sequence
  derived and/or modified sequence opt2 from HSD17B1__Homo_sapiens__NP_000404
auggcccgcaccgucguccucaucaccggcugcuccuccggcaucggccuccaccucgccguccgccucgccuccgaccccucccaguccuucaaggucuacgccacccuccgcgaccucaagacccagggccgccucugggaggccgcccgcgcccucgccugcccccccggcucccucgagacccuccagcucgacguccgcgacuccaaguccgucgccgccgcccgcgagcgcgucaccgagggccgcgucgacguccucgucugcaacgccggccucggccuccucggcccccucgaggcccucggcgaggacgccgucgccuccguccucgacgucaacgucgucggcaccguccgcaugcuccaggccuuccuccccgacaugaagcgccgcggcuccggccgcguccucgucaccggcuccgucggcggccucaugggccuccccuucaacgacgucuacugcgccuccaaguucgcccucgagggccucugcgagucccucgccguccuccuccuccccuucggcguccaccucucccucaucgagugcggccccguccacaccgccuucauggagaagguccucggcucccccgaggagguccucgaccgcaccgacauccacaccuuccaccgcuucuaccaguaccucgcccacuccaagcaggucuuccgcgaggccgcccagaaccccgaggaggucgccgaggucuuccucaccgcccuccgcgcccccaagcccacccuccgcuacuucaccaccgagcgcuuccucccccuccuccgcaugcgccucgacgaccccuccggcuccaacuacgucaccgccaugcaccgcgaggucuucggcgacguccccgccaaggccgaggccggcgccgaggccggcggcggcgccggccccggcgccgaggacgaggccggccgcggcgccgucggcgaccccgagcucggcgacccccccgccgccccccaguga

SEQ ID NO: 44359 - RNA, 1164 nt, Artificial Sequence
  derived and/or modified sequence opt2 from HSD17B2__Homo_sapiens__NP_002144
auguccaccuucuucuccgacaccgccuggaucugccucgccguccccaccguccucugcggcaccgucuucugcaaguacaagaaguccuccggccagcucugguccuggauggucugccucgccggccucugcgccgucugccuccucauccucucccccuucuggggccucauccucuucuccgucuccugcuuccucauguacaccuaccucuccggccaggagcuccuccccgucgaccagaaggccguccucgucaccggcggcgacugcggccucggccacgcccucugcaaguaccucgacgagcucggcuucaccgucuucgccggcguccucaacgagaacggccccggcgccgaggagcuccgccgcaccugcuccccccgccucuccguccuccagauggacaucaccaagcccguccagaucaaggacgccuacuccaaggucgccgccaugcuccaggaccgcggccucugggccgucaucaacaacgccggcguccucggcuuccccaccgacggcgagcuccuccucaugaccgacuacaagcagugcauggccgucaacuucuucggcaccgucgaggucaccaagaccuuccucccccuccuccgcaaguccaagggccgccucgucaacgucuccuccaugggcggcggcgcccccauggagcgccucgccuccuacggcuccuccaaggccgccgucaccauguucuccuccgucaugcgccucgagcucuccaaguggggcaucaaggucgccuccauccagcccggcggcuuccucaccaacaucgccggcaccuccgacaagugggagaagcucgagaaggacauccucgaccaccuccccgccgagguccaggaggacuacggccaggacuacauccucgcccagcgcaacuuccuccuccucaucaacucccucgccuccaaggacuucucccccguccuccgcgacauccagcacgccauccucgccaagucccccuucgccuacuacacccccggcaagggcgccuaccucuggaucugccucgcccacuaccuccccaucggcaucuacgacuacuucgccaagcgccacuucggccaggacaagcccaugccccgcgcccuccgcaugcccaacuacaagaagaaggccaccuga

SEQ ID NO: 44360 - RNA, 933 nt, Artificial Sequence
  derived and/or modified sequence opt2 from HSD17B3__Homo_sapiens__NP_000188
augggcgacguccucgagcaguucuucauccucaccggccuccucgucugccucgccugccucgccaagugcguccgcuucucccgcugcguccuccucaacuacuggaagguccuccccaaguccuuccuccgcuccaugggccagugggccgucaucaccggcgccggcgacggcaucggcaaggccuacuccuucgagcucgccaagcgcggccucaacgucguccucaucucccgcacccucgagaagcucgaggccaucgccaccgagaucgagcgcaccaccggccgcuccgucaagaucauccaggccgacuucaccaaggacgacaucuacgagcacaucaaggagaagcucgccggccucgagaucggcauccucgucaacaacgucggcaugcuccccaaccuccuccccucccacuuccucaacgcccccgacgagauccagucccucauccacugcaacaucaccuccgucgucaagaugacccagcucauccucaagcacauggagucccgccagaagggccucauccucaacaucuccuccggcaucgcccucuuccccuggccccucuacuccauguacuccgccuccaaggccuucgucugcgccuucuccaaggcccuccaggaggaguacaaggccaaggaggucaucauccagguccucacccccuacgccgucuccaccgccaugaccaaguaccucaacaccaacgucaucaccaagaccgccgacgaguucgucaaggagucccucaacuacgucaccaucggcggcgagaccugcggcugccucgcccacgagauccucgccggcuuccucucccucauccccgccugggccuucuacuccggcgccuuccagcgccuccuccucacccacuacgucgccuaccucaagcucaacaccaagguccgcuga

SEQ ID NO: 44361 - RNA, 2211 nt, Artificial Sequence
  derived and/or modified sequence opt2 from HSD17B4__Homo_sapiens__NP_000405
augggcuccccccuccgcuucgacggccgcgucguccucgucaccggcgccggcgccggccucggccgcgccuacgcccucgccuucgccgagcgcggcgcccucgucgucgucaacgaccucggcggcgacuucaagggcgucggcaagggcucccucgccgccgacaaggucgucgaggagauccgccgccgcggcggcaaggccgucgccaacuacgacuccgucgaggagggcgagaaggucgucaagaccgcccucgacgccuucggccgcaucgacgucgucgucaacaacgccggcauccuccgcgaccgcuccuucgcccgcaucuccgacgaggacugggacaucauccaccgcguccaccuccgcggcuccuuccaggucacccgcgccgccugggagcacaugaagaagcagaaguacggccgcaucaucaugaccuccuccgccuccggcaucuacggcaacuucggccaggccaacuacuccgccgccaagcucggccuccucggccucgccaacucccucgccaucgagggccgcaaguccaacauccacugcaacaccaucgcccccaacgccggcucccgcaugacccagaccgucaugcccgaggaccucgucgaggcccucaagcccgaguacgucgccccccucguccucuggcucugccacgaguccugcgaggagaacggcggccucuucgaggucggcgccggcuggaucggcaagcuccgcugggagcgcacccucggcgccaucguccgccagaagaaccaccccaugacccccgaggccgucaaggccaacuggaagaagaucugcgacuucgagaacgccuccaagccccaguccauccaggaguccaccggcuccaucaucgagguccucuccaagaucgacuccgagggcggcgucuccgccaaccacaccucccgcgccaccuccaccgccaccuccggcuucgccggcgccaucggccagaagcucccccccuucuccuacgccuacaccgagcucgaggccaucauguacgcccucggcgucggcgccuccaucaaggaccccaaggaccucaaguucaucuacgagggcuccuccgacuucuccugccuccccaccuucggcgucaucaucggccagaaguccaugaugggcggcggccucgccgagauccccggccucuccaucaacuucgccaagguccuccacggcgagcaguaccucgagcucuacaagccccucccccgcgccggcaagcucaagugcgaggccgucgucgccgacguccucgacaagggcuccggcgucgucaucaucauggacgucuacuccuacuccgagaaggagcucaucugccacaaccaguucucccucuuccucgucggcuccggcggcuucggcggcaagcgcaccuccgacaaggucaaggucgccgucgccauccccaaccgcccccccgacgccguccucaccgacaccaccucccucaaccaggccgcccucuaccgccucuccggcgacuggaacccccuccacaucgaccccaacuucgccucccucgccggcuucgacaagcccauccuccacggccucugcaccuucggcuucuccgcccgccgcguccuccagcaguucgccgacaacgacgucucccgcuucaaggccaucaaggcccgcuucgccaagcccgucuaccccggccagacccuccagaccgagauguggaaggagggcaaccgcauccacuuccagaccaagguccaggagaccggcgacaucgucaucuccaacgccuacgucgaccucgcccccaccuccggcaccuccgccaagacccccuccgagggcggcaagcuccaguccaccuucgucuucgaggagaucggccgccgccucaaggacaucggccccgaggucgucaagaaggucaacgccgucuucgaguggcacaucaccaagggcggcaacaucggcgccaaguggaccaucgaccucaaguccggcuccggcaaggucuaccagggccccgccaagggcgccgccgacaccaccaucauccucuccgacgaggacuucauggaggucguccucggcaagcucgacccccagaaggccuucuucuccggccgccucaaggcccgcggcaacaucaugcucucccagaagcuccagaugauccucaaggacuacgccaagcucuga

SEQ ID NO: 44362 - RNA, 954 nt, Artificial Sequence
  derived and/or modified sequence opt2 from HSD17B6__Homo_sapiens__XP_006719735
auguggcucuaccucgccgccuucgucggccucuacuaccuccuccacugguaccgcgagcgccaggucgucucccaccuccaggacaaguacgucuucaucaccggcugcgacuccggcuucggcaaccuccucgcccgccagcucgacgcccgcggccuccgcguccucgccgccugccucaccgagaagggcgccgagcagcuccgcggccagaccuccgaccgccucgagaccgucacccucgacgucaccaagauggaguccaucgccgccgccacccagugggucaaggagcacgucggcgaccgcggccucuggggccucgucaacaacgccggcauccucacccccaucacccucugcgaguggcucaacaccgaggacuccaugaacaugcucaaggucaaccucaucggcgucauccaggucacccucuccaugcucccccucguccgccgcgcccgcggccgcaucgucaacgucuccuccauccucggccgcgucgccuucuucgucggcggcuacugcgucuccaaguacggcgucgaggccuucuccgacauccuccgccgcgagauccagcacuucggcgucaagaucuccaucgucgagcccggcuacuuccgcaccggcaugaccaacaugacccagucccucgagcgcaugaagcaguccuggaaggaggcccccaagcacaucaaggagaccuacggccagcaguacuucgacgcccucuacaacaucaugaaggagggccuccucaacugcuccaccaaccucaaccucgucaccgacugcauggagcacgcccucaccuccguccacccccgcacccgcuacuccgccggcugggacgccaaguucuucuucaucccccucuccuaccuccccaccucccucgccgacuacauccucacccgcuccuggcccaagcccgcccaggccgucuga

SEQ ID NO: 44363 - RNA, 468 nt, Artificial Sequence
  derived and/or modified sequence opt2 from HSD17B7__Homo_sapiens__NP_001291441
augcgcaaggucguccucaucaccggcgccuccuccggcaucggccucgcccucugcaagcgccuccucgccgaggacgacgagcuccaccucugccucgccugccgcaacauguccaaggccgaggccgucugcgccgcccuccucgccucccaccccaccgccgaggucaccaucguccaggucgacgucuccaaccuccaguccgucuuccgcgccuccaaggagcucaagcagcgcuuccagcgccucgacugcaucuaccucaacgccggcaucaugcccaacccccagcucaacaucaaggcccucuucuucggccucuucucccgcaaggucauccacauguucuccaccgccgagggccuccucacccagggcgacaagaucaccgccgacggccuccaggaggucuucgagaccaacgucuucggccacuucauccucgucaagaagcucugggccuga

SEQ ID NO: 44364 - RNA, 786 nt, Artificial Sequence
  derived and/or modified sequence opt2 from HSD17B8__Homo_sapiens__NP_055049
auggccucccagcuccagaaccgccuccgcuccgcccucgcccucgucaccggcgccggcuccggcaucggccgcgccgucuccguccgccucgccggcgagggcgccaccgucgccgccugcgaccucgaccgcgccgccgcccaggagaccguccgccuccucggcggccccggcuccaaggagggccccccccgcggcaaccacgccgccuuccaggccgacgucuccgaggcccgcgccgcccgcugccuccucgagcagguccaggccugcuucucccgcccccccuccgucgucgucuccugcgccggcaucacccaggacgaguuccuccuccacauguccgaggacgacugggacaaggucaucgccgucaaccucaagggcaccuuccucgucacccaggccgccgcccaggcccucgucuccaacggcugccgcggcuccaucaucaacaucuccuccaucgucggcaaggucggcaacgucggccagaccaacuacgccgccuccaaggccggcgucaucggccucacccagaccgccgcccgcgagcucggccgccacggcauccgcugcaacuccguccuccccggcuucaucgccacccccaugacccagaaggucccccagaaggucgucgacaagaucaccgagaugauccccaugggccaccucggcgaccccgaggacgucgccgacgucgucgccuuccucgccuccgaggacuccggcuacaucaccggcaccuccgucgaggucaccggcggccucuucauguga

SEQ ID NO: 44365 - RNA, 1128 nt, Artificial Sequence
  derived and/or modified sequence opt2 from HSD3B1__Homo_sapiens__XP_011539616
auggccaugaccggcugguccugccucgucaccggcgccggcggcuuccucggccagcgcaucauccgccuccucgucaaggagaaggagcucaaggagauccgcguccucgacaaggccuucggccccgagcuccgcgaggaguucuccaagcuccagaacaagaccaagcucaccguccucgagggcgacauccucgacgagcccuuccucaagcgcgccugccaggacgucuccgucaucauccacaccgccugcaucaucgacgucuucggcgucacccaccgcgaguccaucaugaacgucaacgucaagggcacccagcuccuccucgaggccugcguccaggccuccguccccgucuucaucuacaccuccuccaucgaggucgccggccccaacuccuacaaggagaucauccagaacggccacgaggaggagccccucgagaacaccuggcccgcccccuacccccacuccaagaagcucgccgagaaggccguccucgccgccaacggcuggaaccucaagaacggcggcacccucuacaccugcgcccuccgccccauguacaucuacggcgagggcucccgcuuccucuccgccuccaucaacgaggcccucaacaacaacggcauccucuccuccgucggcaaguucuccaccgucaaccccgucuacgucggcaacgucgccugggcccacauccucgcccuccgcgcccuccaggaccccaagaaggcccccuccauccgcggccaguucuacuacaucuccgacgacaccccccaccaguccuacgacaaccucaacuacacccucuccaaggaguucggccuccgccucgacucccgcugguccuucccccucucccucauguacuggaucggcuuccuccucgagaucgucuccuuccuccuccgccccaucuacaccuaccgcccccccuucaaccgccacaucgucacccucuccaacuccgucuucaccuucuccuacaagaaggcccagcgcgaccucgccuacaagccccucuacuccugggaggaggccaagcagaagaccgucgagugggucggcucccucgucgaccgccacaaggagacccucaaguccaagacccaguga

SEQ ID NO: 44366 - RNA, 591 nt, Artificial Sequence
  derived and/or modified sequence opt2 from HSD3B7__Homo_sapiens__NP_001136250
auggccgacuccgcccaggcccagaagcucgucuaccucgucaccggcggcugcggcuuccucggcgagcacgucguccgcaugcuccuccagcgcgagccccgccucggcgagcuccgcgucuucgaccagcaccucggccccuggcucgaggagcucaagaccggccccguccgcgucaccgccauccagggcgacgucacccaggcccacgaggucgccgccgccgucgccggcgcccacgucgucauccacaccgccggccucgucgacgucuucggccgcgccucccccaagaccauccacgaggucaacguccagggcacccgcaacgucaucgaggccugcguccagaccggcacccgcuuccucgucuacaccuccuccauggaggucgucggccccaacaccaagggccaccccuucuaccgcggcaacgaggacacccccuacgaggccguccaccgccaccccuaccccugcuccaaggcccucgccgaguggcucguccucgaggccaacggccgcaaggccaugcuccccggcugcaccugcuggcagcccggcuccugguccuccggccagcccuga

SEQ ID NO: 44367 - RNA, 828 nt, Artificial Sequence
  derived and/or modified sequence opt2 from HSDL1__Homo_sapiens__NP_001139523
auggccgccgucgacuccuucuaccuccucuaccgcgagaucgcccgcuccugcaacugcuacauggaggcccucgcccucgucggcgccugguacaccgcccgcaaguccaucaccgucaucugcgacuucuacucccucauccgccuccacuucaucccccgccucggcucccgcgccgaccucaucaagcaguacggccgcugggccgucgucuccggcgccaccgacggcaucggcaaggccuacgccgaggagcucgccucccgcggccucaacaucauccucaucucccgcaacgaggagaagcuccaguacuucacccagcucuccgaggacaagcucugggacaucaucaacgucaacaucgccgccgccucccucaugguccacgucguccuccccggcauggucgagcgcaagaagggcgccaucgucaccaucuccuccggcuccugcugcaagcccaccccccagcucgccgccuucuccgccuccaaggccuaccucgaccacuucucccgcgcccuccaguacgaguacgccuccaagggcaucuucguccagucccucauccccuucuacgucgccaccuccaugaccgcccccuccaacuuccuccaccgcugcuccuggcucguccccucccccaaggucuacgcccaccacgccgucuccacccucggcaucuccaagcgcaccaccggcuacuggucccacuccauccaguuccucuucgcccaguacaugcccgaguggcucugggucuggggcgccaacauccucaaccgcucccuccgcaaggaggcccucuccugcaccgccuga

SEQ ID NO: 44368 - RNA, 1038 nt, Artificial Sequence
  derived and/or modified sequence opt2 from HSDL2__Homo_sapiens__NP_001182751
augcuccccaacaccggccgccucgccggcugcaccgucuucaucaccggcgccucccgcggcaucggcaaggccaucgcccucaaggccgccaaggacggcgccaacaucgucaucgccgccaagaccgcccagccccaccccaagcuccucggcaccaucuacaccgccgccgaggagaucgaggccgucggcggcaaggcccuccccugcaucgucgacguccgcgacgagcagcagaucuccgccgccgucgagaaggccaucaagaaguucggcgccuacaccaucgccaaguacggcauguccauguacguccucggcauggccgaggaguucaagggcgagaucgccgucaacgcccucuggcccaagaccgccauccacaccgccgccauggacaugcucggcggccccggcaucgagucccagugccgcaaggucgacaucaucgccgacgccgccuacuccaucuuccagaagcccaaguccuucaccggcaacuucgucaucgacgagaacauccucaaggaggagggcaucgagaacuucgacgucuacgccaucaagcccggccacccccuccagcccgacuucuuccucgacgaguaccccgaggccgucuccaagaaggucgaguccaccggcgccguccccgaguucaaggaggagaagcuccagcuccagcccaagccccgcuccggcgccgucgaggagaccuuccgcaucgucaaggacucccucuccgacgacgucgucaaggccacccaggccaucuaccucuucgagcucuccggcgaggacggcggcaccugguuccucgaccucaaguccaagggcggcaacgucggcuacggcgagcccuccgaccaggccgacgucgucauguccaugaccaccgacgacuucgucaagauguucuccggcaagcucaagcccaccauggccuucauguccggcaagcucaagaucaagggcaacauggcccucgccaucaagcucgagaagcucaugaaccagaugaacgcccgccucuga

SEQ ID NO: 44369 - RNA, 1590 nt, Artificial Sequence
  derived and/or modified sequence opt2 from HSF1__Homo_sapiens__NP_005517
auggaccuccccgucggccccggcgccgccggccccuccaacguccccgccuuccucaccaagcucuggacccucgucuccgaccccgacaccgacgcccucaucugcuggucccccuccggcaacuccuuccacgucuucgaccagggccaguucgccaaggagguccuccccaaguacuucaagcacaacaacauggccuccuucguccgccagcucaacauguacggcuuccgcaaggucguccacaucgagcagggcggccucgucaagcccgagcgcgacgacaccgaguuccagcaccccugcuuccuccgcggccaggagcagcuccucgagaacaucaagcgcaaggucaccuccgucuccacccucaaguccgaggacaucaagauccgccaggacuccgucaccaagcuccucaccgacguccagcucaugaagggcaagcaggagugcauggacuccaagcuccucgccaugaagcacgagaacgaggcccucuggcgcgaggucgccucccuccgccagaagcacgcccagcagcagaaggucgucaacaagcucauccaguuccucaucucccucguccaguccaaccgcauccucggcgucaagcgcaagaucccccucaugcucaacgacuccggcuccgcccacuccaugcccaaguacucccgccaguucucccucgagcacguccacggcuccggccccuacuccgcccccucccccgccuacuccuccuccucccucuacgcccccgacgccgucgccuccuccggccccaucaucuccgacaucaccgagcucgcccccgccucccccauggccucccccggcggcuccaucgacgagcgcccccucuccuccuccccccucguccgcgucaaggaggagccccccucccccccccaguccccccgcgucgaggaggccucccccggccgccccuccuccgucgacacccuccucucccccaccgcccucaucgacuccauccuccgcgaguccgagcccgcccccgccuccgucaccgcccucaccgacgcccgcggccacaccgacaccgagggccgcccccccucccccccccccaccuccacccccgagaagugccucuccgucgccugccucgacaagaacgagcucuccgaccaccucgacgccauggacuccaaccucgacaaccuccagaccaugcucuccucccacggcuucuccgucgacaccuccgcccuccucgaccucuucucccccuccgucaccguccccgacaugucccuccccgaccucgacuccucccucgccuccauccaggagcuccucuccccccaggagcccccccgcccccccgaggccgagaacuccucccccgacuccggcaagcagcucguccacuacaccgcccagccccucuuccuccucgaccccggcuccgucgacaccggcuccaacgaccuccccguccucuucgagcucggcgagggcuccuacuucuccgagggcgacggcuucgccgaggaccccaccaucucccuccucaccggcuccgagccccccaaggccaaggaccccaccgucuccuga

SEQ ID NO: 44370 - RNA, 1557 nt, Artificial Sequence
  derived and/or modified sequence opt2 from HSF2__Homo_sapiens__NP_001129036
augaagcaguccuccaacguccccgccuuccucuccaagcucuggacccucgucgaggagacccacaccaacgaguucaucaccuggucccagaacggccaguccuuccucguccucgacgagcagcgcuucgccaaggagauccuccccaaguacuucaagcacaacaacauggccuccuucguccgccagcucaacauguacggcuuccgcaaggucguccacaucgacuccggcaucgucaagcaggagcgcgacggccccgucgaguuccagcaccccuacuucaagcagggccaggacgaccuccucgagaacaucaagcgcaaggucuccuccuccaagcccgaggagaacaagauccgccaggaggaccucaccaagaucaucuccuccgcccagaagguccagaucaagcaggagaccaucgagucccgccucuccgagcucaaguccgagaacgagucccucuggaaggaggucuccgagcuccgcgccaagcacgcccagcagcagcaggucauccgcaagaucguccaguucaucgucacccucguccagaacaaccagcucgucucccucaagcgcaagcgcccccuccuccucaacaccaacggcgcccagaagaagaaccucuuccagcacaucgucaaggagcccaccgacaaccaccaccacaaggucccccacucccgcaccgagggccucaagccccgcgagcgcaucuccgacgacaucaucaucuacgacgucaccgacgacaacgccgacgaggagaacauccccgucauccccgagaccaacgaggacgucaucuccgaccccuccaacugcucccaguaccccgacaucgucaucgucgaggacgacaacgaggacgaguacgcccccgucauccaguccggcgagcagaacgagcccgcccgcgagucccucuccuccggcuccgacggcuccuccccccucauguccuccgccguccagcucaacggcuccuccucccucaccuccgaggaccccgucaccaugauggacuccauccucaacgacaacaucaaccuccucggcaaggucgagcuccucgacuaccucgacuccaucgacugcucccucgaggacuuccaggccaugcucuccggccgccaguucuccaucgaccccgaccuccucgucgacuccgagaacaagggccucgagaccaccaagaacaacgucguccagcccgucuccgaggagggccgcaaguccaaguccaagcccgacaagcagcucauccaguacaccgccuucccccuccucgccuuccucgacggcaaccccgccuccuccgucgagcaggccuccaccaccgccuccuccgagguccucuccuccgucgacaagcccaucgaggucgacgagcuccucgacuccucccucgaccccgagcccacccaguccaagcucguccgccucgagccccucaccgaggccgaggccuccgaggccacccucuucuaccucugcgagcucgcccccgccccccucgacuccgacaugccccuccucgacuccuga

SEQ ID NO: 44371 - RNA, 1479 nt, Artificial Sequence
  derived and/or modified sequence opt2 from HSF4__Homo_sapiens__NP_001035757
augcaggaggcccccgccgcccuccccaccgagcccggccccucccccguccccgccuuccucggcaagcucugggcccucgucggcgaccccggcaccgaccaccucauccgcuggucccccuccggcaccuccuuccucgucuccgaccagucccgcuucgccaaggagguccucccccaguacuucaagcacuccaacauggccuccuucguccgccagcucaacauguacggcuuccgcaaggucgucuccaucgagcagggcggccuccuccgccccgagcgcgaccacgucgaguuccagcaccccuccuucguccgcggccgcgagcagcuccucgagcgcguccgccgcaagguccccgcccuccgcggcgacgacggccgcuggcgccccgaggaccucggccgccuccucggcgagguccaggcccuccgcggcguccaggaguccaccgaggcccgccuccgcgagcuccgccagcagaacgagauccucuggcgcgaggucgucacccuccgccagucccacggccagcagcaccgcgucaucggcaagcucauccagugccucuucggcccccuccaggccggccccuccaacgccggcggcaagcgcaagcucucccucaugcucgacgagggcuccuccugccccacccccgccaaguucaacaccugcccccuccccggcgcccuccuccaggaccccuacuucauccaguccccccuccccgagaccaaccucggccucuccccccaccgcgcccgcggccccaucaucuccgacauccccgaggacucccccucccccgagggcacccgccucucccccuccuccgacggccgccgcgagaagggccucgcccuccucaaggaggagcccgccucccccggcggcgacggcgaggccggccucgcccucgcccccaacgagugcgacuucugcgucaccgccccccccccccuccccgucgccgucguccaggccauccucgagggcaagggcuccuucucccccgagggcccccgcaacgcccagcagcccgagcccggcgacccccgcgagauccccgaccgcggcccccucggccucgaguccggcgaccgcucccccgagucccuccucccccccaugcuccuccagcccccccaggaguccgucgagcccgccggcccccucgacguccucggccccucccuccagggccgcgaguggacccucauggaccucgacauggagcucucccucaugcagccccucguccccgagcgcggcgagcccgagcucgccgucaagggccucaacucccccucccccggcaaggaccccacccucggcgccccccuccuccucgacguccaggccgcccucggcggccccgcccucggccuccccggcgcccucaccaucuacuccacccccgagucccgcaccgccuccuaccucggccccgaggccucccccucccccuga

SEQ ID NO: 44372 - RNA, 1791 nt, Artificial Sequence
  derived and/or modified sequence opt2 from HSF5__Homo_sapiens__NP_001073908
auggaggcccuccucuccacccccaucaaccccaacaacuuccccgccaagcucuggcgccucgucaacuccccccgcuaccgcuccauccgcugggacggccgcggcgagggccuccucaucgaccagccccucuucgaggccgagcuccucuccccccccggccccggcggcggcggcggcaccgccggcgccggcgccgagcccgagcucuucaagaccaccuccuucaccuccuucauccgccagcucaaccucuacggcuuccgcaaggucguccucggcggccccggcggcggcaagcccgccggcaacggcccccuccaccacuuccacaacccccacuuccgccgcgaccagccccagcuccucguccaccucaagcgccucaccuccgccaacaaggccaagcucgccgccggccucgagguccccugccgcccccccaaccgcuuccagcgccuccucaucaccuccgccuccgccgccaccgccccccuccagcaccagcagccccccccccccgccggcccccgccccgagccccacggccccgucgccgucggccaguuccaccgcuccuuccgccgcgacucccucucccccuacuccugcgucuccacccccucccacgaccacuccaccuacccccucaagggccucgaccgcacccccgucccccaccgcaucuggcagaacucccucggcaugcaccccggccaggucgagaccucccccaccuucuccgacaagggcguccccuuccccguccuccagcgcuuccccaccgaggucaccuacacccuccagcccuccaccaccuccguccacguccagcagggcccccagaccauggucuccuccucccagaaguacuccaacuacacccccuccgcccaguacucccaggccuacuaccccaccgccguccuccagugcugcucccccacccacauggacgcccucuccuccugcgucacccccaccgccuccuccuacgcccacugcaacuacuuccagaaccccuccaugcaguccuccuaccccgucgaguuccuccccuccaacuggcccugcuccaccaccgacgagaacaccaagaccgaggucaaccucgaggccgucuuccagaucgucgacgagcuccacuccucccccaagcucgagauggucaaggucgagcccgucgagaaccagugccccaccucccccuccuaccgcggccagcacauccucgccaacuccaacaacuccaaccccugcuccgccucccaggccucccagcucgagccccucacccccgucggcuccgacaucauguccuucgucgucggcaccgagcaggccgucgccugcucccucccccagucccccgaguacaucuacaccauccacaccgcccagcccgucgagaacuccaccauccaggaguccgccgccauccagcaggcccacgucaagcucaaggagcaccucaaccacaaccccucccccuccuccgucgucuucguccaggagggcccccccuucuccacccaccaggucgacgccaacaucaagugccagaccuccucccgcgagaacauccuccccuccgagcagaugggcuuccucaucuccgagaugggccccgccuccaagcccuccgaggacaccggccucgccacccccgcccgcuaccgcgagcaccgcuccaacucccagcagggcaagucccccgaccuccaccuccucgucgacgucgccugcaagcaggagcgcuuccccaaggaggaggagcucaaggaguga

SEQ ID NO: 44373 - RNA, 612 nt, Artificial Sequence
  derived and/or modified sequence opt2 from HSFY2__Homo_sapiens__NP_001001877
auggcccacgucuccuccgagacccaggacgucucccccaaggacgagcucaccgccuccgaggccuccacccgcuccccccucugcgagcacaccuuccccggcgacuccgaccuccgcuccaugaucgaggagcacgccuuccagguccucucccagggcucccuccucgagucccccuccuacaccgucugcgucuccgagcccgacaaggacgacgacuuccucucccucaacuucccccgcaagcucuggaagaucgucgaguccgaccaguucaaguccaucuccugggacgagaacggcaccugcaucgucaucaacgaggagcucuucaagaaggagauccucgagaccaaggcccccuaccgcaucuuccagaccgacgccaucaaguccuucguccgccagcucaaccucuacggcuucuccaagauccagcagaacuuccagcgcuccgccuuccucgccaccuuccucuccgaggagaaggaguccuccguccucuccaagauccgcuucaccaagaugaagcucucccgcuccuccaccuacgagaaccgcuaccucugcugcaaccuccaccucaaggacgaguccaacuacuccuga

SEQ ID NO: 44374 - RNA, 888 nt, Artificial Sequence
  derived and/or modified sequence opt2 from HSH2D__Homo_sapiens__NP_001278203
augcgcggcucccgcaugucccagcccccccagugccuccgccgcgcccaguccuccugcugccacuucauggucaagcuccucgacgacggcaccuucaugauccccggcgagaaggucgcccacaccucccucgacgcccucgucaccuuccaccagcagaagcccaucgagccccgccgcgagcuccucacccagcccugccgccagaaggaccccgccaacgucgacuacgaggaccucuuccucuacuccaacgccgucgccgaggaggccgccugccccgucuccgcccccgaggaggccucccccaagcccguccucugccaccaguccaaggagcgcaagcccuccgccgagaugaaccgcaucaccaccaaggaggccaccuccuccugcccccccaaguccccccucggcgagacccgccagaagcucuggcgcucccucaagaugcuccccgagcgcggccagcgcguccgccagcagcucaagucccaccucgccaccgucaaccucuccucccuccucgacguccgccgcuccaccgucaucuccggccccggcaccggcaagggcucccaggaccacuccggcgaccccaccuccggcgaccgcggcuacaccgaccccugcgucgccaccucccucaagucccccucccagccccaggcccccaaggaccgcaagguccccacccgcaaggccgagcgcuccgucuccugcaucgaggucacccccggcgaccgcuccuggcaccagauggucguccgcgcccucuccucccaggaguccaagcccgagcaccagggccucgccgagcccgagaacgaccagcuccccgaggaguaccagcagcccccccccuucgcccccggcuacugcuga

SEQ ID NO: 44375 - RNA, 2565 nt, Artificial Sequence
  derived and/or modified sequence opt2 from HSP90AA1__Homo_sapiens__NP_001017963
augccccccugcuccggcggcgacggcuccaccccccccggccccucccuccgcgaccgcgacugccccgcccaguccgccgaguacccccgcgaccgccucgacccccgccccggcucccccuccgaggccuccuccccccccuuccuccgcucccgcgcccccgucaacugguaccaggagaaggcccaggucuuccucuggcaccucauggucuccggcuccaccacccuccucugccucuggaagcagcccuuccacgucuccgccuuccccgucaccgccucccucgccuuccgccagucccagggcgccggccagcaccucuacaaggaccuccagcccuucauccuccuccgccuccucaugcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacuga

SEQ ID NO: 44376 - RNA, 2175 nt, Artificial Sequence
  derived and/or modified sequence opt2 from HSP90AB1__Homo_sapiens__NP_001258898
augcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacuga

SEQ ID NO: 44377 - RNA, 2412 nt, Artificial Sequence
  derived and/or modified sequence opt2 from HSP90B1__Homo_sapiens__NP_003290
augcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucuga

SEQ ID NO: 44378 - RNA, 2028 nt, Artificial Sequence
  derived and/or modified sequence opt2 from HSPA12A__Homo_sapiens__NP_079291
auggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacuga

SEQ ID NO: 44379 - RNA, 2061 nt, Artificial Sequence
  derived and/or modified sequence opt2 from HSPA12B__Homo_sapiens__NP_443202
augcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacuga

SEQ ID NO: 44380 - RNA, 1416 nt, Artificial Sequence
  derived and/or modified sequence opt2 from HSPA13__Homo_sapiens__NP_008879
auggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacuga

SEQ ID NO: 44381 - RNA, 432 nt, Artificial Sequence
  derived and/or modified sequence opt2 from HSPA14__Homo_sapiens__NP_001265134
auggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgccgcguccucucccgcgacccccagcuccagcagcucccccagcccuuccagcgcugcuccugcucccucuccgagcagccccacggccagaccggcugcguccgcggcgcccagccccuccaccagcaccagccccagcacuccuggggcucccuccacaccgccgacuccucccuccucuucgaguccugguucugcuucugguggggcuga

SEQ ID NO: 44382 - RNA, 1926 nt, Artificial Sequence
  derived and/or modified sequence opt2 from HSPA1A__Homo_sapiens__NP_005336
auggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacuga

SEQ ID NO: 44383 - RNA, 1926 nt, Artificial Sequence
  derived and/or modified sequence opt2 from HSPA1L__Homo_sapiens__NP_005518
auggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacuga

SEQ ID NO: 44384 - RNA, 1920 nt, Artificial Sequence
  derived and/or modified sequence opt2 from HSPA2__Homo_sapiens__NP_068814
auguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacuga

SEQ ID NO: 44385 - RNA, 2523 nt, Artificial Sequence
  derived and/or modified sequence opt2 from HSPA4__Homo_sapiens__NP_002145
auguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacuga

SEQ ID NO: 44386 - RNA, 2520 nt, Artificial Sequence
  derived and/or modified sequence opt2 from HSPA4L__Homo_sapiens__NP_055093
auguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacuga

SEQ ID NO: 44387 - RNA, 1965 nt, Artificial Sequence
  derived and/or modified sequence opt2 from HSPA5__Homo_sapiens__NP_005338
augaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucuga

SEQ ID NO: 44388 - RNA, 1932 nt, Artificial Sequence
  derived and/or modified sequence opt2 from HSPA6__Homo_sapiens__NP_002146
augcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacuga

SEQ ID NO: 44389 - RNA, 1941 nt, Artificial Sequence
  derived and/or modified sequence opt2 from HSPA8__Homo_sapiens__NP_006588
auguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacuga

SEQ ID NO: 44390 - RNA, 2040 nt, Artificial Sequence
  derived and/or modified sequence opt2 from HSPA9__Homo_sapiens__NP_004125
augaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcaguga

SEQ ID NO: 44391 - RNA, 618 nt, Artificial Sequence
  derived and/or modified sequence opt2 from HSPB1__Homo_sapiens__NP_001531
augaccgagcgccgcguccccuucucccuccuccgcggccccuccugggaccccuuccgcgacugguacccccacucccgccucuucgaccaggccuucggccucccccgccuccccgaggaguggucccaguggcucggcggcuccuccuggcccggcuacguccgcccccucccccccgccgccaucgagucccccgccgucgccgcccccgccuacucccgcgcccucucccgccagcucuccuccggcgucuccgagauccgccacaccgccgaccgcuggcgcgucucccucgacgucaaccacuucgcccccgacgagcucaccgucaagaccaaggacggcgucgucgagaucaccggcaagcacgaggagcgccaggacgagcacggcuacaucucccgcugcuucacccgcaaguacacccucccccccggcgucgaccccacccaggucuccuccucccucucccccgagggcacccucaccgucgaggcccccaugcccaagcucgccacccaguccaacgagaucaccauccccgucaccuucgagucccgcgcccagcucggcggccccgaggccgccaaguccgacgagaccgccgccaaguga

SEQ ID NO: 44392 - RNA, 549 nt, Artificial Sequence
  derived and/or modified sequence opt2 from HSPB2__Homo_sapiens__NP_001532
auguccggccgcuccgucccccacgcccaccccgccaccgccgaguacgaguucgccaaccccucccgccucggcgagcagcgcuucggcgagggccuccuccccgaggagauccucacccccacccucuaccacggcuacuacguccgcccccgcgccgcccccgccggcgagggcucccgcgccggcgccuccgagcuccgccucuccgagggcaaguuccaggccuuccucgacgucucccacuucacccccgacgaggucaccguccgcaccgucgacaaccuccucgaggucuccgcccgccacccccagcgccucgaccgccacggcuucgucucccgcgaguucugccgcaccuacguccuccccgccgacgucgaccccuggcgcguccgcgccgcccucucccacgacggcauccucaaccucgaggccccccgcggcggccgccaccucgacaccgaggucaacgaggucuacaucucccuccuccccgccccccccgaccccgaggaggaggaggaggccgccaucgucgagcccuga

SEQ ID NO: 44393 - RNA, 453 nt, Artificial Sequence
  derived and/or modified sequence opt2 from HSPB3__Homo_sapiens__NP_006299
auggccaagaucauccuccgccaccucaucgagauccccguccgcuaccaggaggaguucgaggcccgcggccucgaggacugccgccucgaccacgcccucuacgcccuccccggccccaccaucgucgaccuccgcaagacccgcgccgcccaguccccccccgucgacuccgccgccgagacccccccccgcgagggcaagucccacuuccagauccuccucgacgucguccaguuccuccccgaggacaucaucauccagaccuucgagggcuggcuccucaucaaggcccagcacggcacccgcauggacgagcacggcuucaucucccgcuccuucacccgccaguacaagcuccccgacggcgucgagaucaaggaccucuccgccguccucugccacgacggcauccucgucgucgaggucaaggaccccgucggcaccaaguga

SEQ ID NO: 44394 - RNA, 483 nt, Artificial Sequence
  derived and/or modified sequence opt2 from HSPB6__Homo_sapiens__NP_653218
auggagauccccguccccguccagcccuccuggcuccgccgcgccuccgccccccuccccggccucuccgcccccggccgccucuucgaccagcgcuucggcgagggccuccucgaggccgagcucgccgcccucugccccaccacccucgcccccuacuaccuccgcgcccccuccgucgcccuccccgucgcccagguccccaccgaccccggccacuucuccguccuccucgacgucaagcacuucucccccgaggagaucgccgucaaggucgucggcgagcacgucgagguccacgcccgccacgaggagcgccccgacgagcacggcuucgucgcccgcgaguuccaccgccgcuaccgccucccccccggcgucgaccccgccgccgucaccuccgcccucucccccgagggcguccucuccauccaggccgcccccgccuccgcccaggcccccccccccgccgccgccaaguga

SEQ ID NO: 44395 - RNA, 792 nt, Artificial Sequence
  derived and/or modified sequence opt2 from HSPB7__Homo_sapiens__XP_011539551
auguccggcugcgagcucuccccccucggccuccgcgucggccucuccgccggccccgcccacggccgccgcuuccccgcccccuccggccccuggcgcggccucaaccucgccucccgccagggcgccggccccaagccccgcgacucccgccccuacaaggccgccgccgucggcgccuggcacgcccgccccgaggccugcgcccacacccucuccugccccgcccucgcccgccucggccgcgcccgccgccgccccuggaugucccaccgcaccuccuccaccuuccgcgccgagcgcuccuuccacuccuccuccuccuccuccuccuccuccaccuccuccuccgccucccgcgcccuccccgcccaggacccccccauggagaaggcccucuccauguucuccgacgacuucggcuccuucaugcgcccccacuccgagccccucgccuuccccgccgcccaccccaccgcccgccccggcggcgccggcaacaucaagacccucggcgacgccuacgaguucgccgucgacguccgcgacuucucccccgaggacaucaucgucaccaccuccaacaaccacaucgagguccgcgccgagaagcucgccgccgacggcaccgucaugaacaccuucgcccacaagugccagcuccccgaggacgucgaccccaccuccgucaccuccgcccuccgcgaggacggcucccucaccauccgcgcccgccgccacccccacaccgagcacguccagcagaccuuccgcaccgagaucaagaucuga

SEQ ID NO: 44396 - RNA, 591 nt, Artificial Sequence
  derived and/or modified sequence opt2 from HSPB8__Homo_sapiens__NP_055180
auggccgacggccagaugcccuucuccugccacuaccccucccgccuccgccgcgaccccuuccgcgacuccccccucuccucccgccuccucgacgacggcuucggcauggaccccuuccccgacgaccucaccgccuccuggcccgacugggcccucccccgccucuccuccgccuggcccggcacccuccgcuccggcauggucccccgcggccccaccgccaccgcccgcuucggcguccccgccgagggccgcacccccccccccuuccccggcgagcccuggaaggucugcgucaacguccacuccuucaagcccgaggagcucauggucaagaccaaggacggcuacgucgaggucuccggcaagcacgaggagaagcagcaggagggcggcaucgucuccaagaacuucaccaagaagauccagcuccccgccgaggucgaccccgucaccgucuucgccucccucucccccgagggccuccucaucaucgaggccccccaggucccccccuacuccaccuucggcgaguccuccuucaacaacgagcucccccaggacucccaggaggucaccugcaccuga

SEQ ID NO: 44397 - RNA, 480 nt, Artificial Sequence
  derived and/or modified sequence opt2 from HSPB9__Homo_sapiens__NP_149971
augcagcgcgucggcaacaccuucuccaacgagucccgcgucgccucccgcugccccuccgucggccucgccgagcgcaaccgcgucgccaccaugcccguccgccuccuccgcgacucccccgccgcccaggaggacaacgaccacgcccgcgacggcuuccagaugaagcucgacgcccacggcuucgcccccgaggagcucgucguccaggucgacggccaguggcucauggucaccggccagcagcagcucgacguccgcgaccccgagcgcgucuccuaccgcaugucccagaagguccaccgcaagaugcuccccuccaaccucucccccaccgccaugaccugcugccucacccccuccggccagcucuggguccgcggccagugcgucgcccucgcccuccccgaggcccagaccggccccuccccccgccucggcucccucggcuccaaggccuccaaccucacccgcuga

SEQ ID NO: 44398 - RNA, 1467 nt, Artificial Sequence
  derived and/or modified sequence opt2 from HSPBAP1__Homo_sapiens__NP_078886
auggccgccggcuccgaggccaccacccccgucaucgucgccgccggcgccggcggcgaggagggcgagcacgucaagcccuucaagcccgagaaggccaaggagaucaucaugucccuccagcagcccgccaucuucugcaacauggucuucgacuggcccgcccgccacuggaacgccaaguaccucucccagguccuccacggcaagcagauccgcuuccgcaugggcaugaaguccauguccaccgucccccaguucgagaccaccugcaacuacgucgaggccacccucgaggaguuccucaccuggaacugcgaccaguccuccaucuccggccccuuccgcgacuacgaccacuccaaguucugggccuacgccgacuacaaguacuucgucucccucuucgaggacaagaccgaccucuuccaggacgucaagugguccgacuucggcuuccccggccgcaacggccaggaguccacccucuggaucggcucccucggcgcccacacccccugccaccucgacuccuacggcugcaaccucgucuuccagguccagggccgcaagcgcuggcaccucuucccccccgaggacacccccuuccucuaccccacccgcauccccuacgaggaguccuccgucuucuccaagaucaacgucgucaaccccgaccucaagcgcuucccccaguuccgcaaggcccagcgccacgccgucacccucucccccggccagguccucuucgucccccgccacugguggcacuacgucgaguccaucgaccccgucaccgucuccaucaacuccuggaucgagcucgaggaggaccaccucgcccgcgucgaggaggccaucacccgcaugcucgucugcgcccucaagaccgccgagaacccccagaacacccgcgccuggcucaaccccaccgaggucgaggagaccucccacgccgucaacugcugcuaccucaacgccgccgucuccgccuucuucgaccgcugccgcaccuccgaggucgucgagauccaggcccuccgcaccgacggcgagcacaugaagaaggaggagcucaacgucugcaaccacauggaggucggccagaccggcucccagaaccucaccaccggcaccgacaagcccgaggccgccucccccuucggccccgaccucguccccgucgcccagcgcuccgaggagccccccuccgagcgcggcggcaucuucggcuccgacggcaaggacuucgucgacaaggacggcgagcacuucggcaagcuccacugcgccaagcgccagcagaucauguccaacuccgagaacgccaucgaggagcagaucgccuccaacaccaccaccaccccccagaccuucaucuccaccgacgaccuccucgacugccucgucaacccccaggucacccgcaucgucgcccagcuccucauccagggccgcucccucuga

SEQ ID NO: 44399 - RNA, 1080 nt, Artificial Sequence
  derived and/or modified sequence opt2 from HSPBP1__Homo_sapiens__NP_001123578
auguccgacgagggcucccgcggcucccgccucccccucgcccucccccccgccucccagggcugcuccuccggcggcggcggcggcggcuccuccgccggcggcuccggcaacucccgccccccccgcaaccuccagggccuccuccagauggccaucaccgccggcuccgaggagcccgaccccccccccgagcccauguccgaggagcgccgccaguggcuccaggaggccauguccgccgccuuccgcggccagcgcgaggaggucgagcagaugaaguccugccuccgcguccucucccagcccaugccccccaccgccggcgaggccgagcaggccgccgaccagcaggagcgcgagggcgcccucgagcuccucgccgaccucugcgagaacauggacaacgccgccgacuucugccagcucuccggcaugcaccuccucgucggccgcuaccucgaggccggcgccgccggccuccgcuggcgcgccgcccagcucaucggcaccugcucccagaacgucgccgccauccaggagcagguccucggccucggcgcccuccgcaagcuccuccgccuccucgaccgcgacgccugcgacaccguccgcgucaaggcccucuucgccaucuccugccucguccgcgagcaggaggccggccuccuccaguuccuccgccucgacggcuucuccguccucaugcgcgccaugcagcagcagguccagaagcucaaggucaaguccgccuuccuccuccagaaccuccucgucggccaccccgagcacaagggcacccucugcuccaugggcaugguccagcagcucgucgcccucguccgcaccgagcacucccccuuccacgagcacguccucggcgcccucugcucccucgucaccgacuucccccagggcguccgcgagugccgcgagcccgagcucggccucgaggagcuccuccgccaccgcugccagcuccuccagcagcacgaggaguaccaggaggagcucgaguucugcgagaagcuccuccagaccugcuucuccucccccgccgacgacuccauggaccgcuga

SEQ ID NO: 44400 - RNA, 1722 nt, Artificial Sequence
  derived and/or modified sequence opt2 from HSPD1__Homo_sapiens__NP_002147
augcuccgccuccccaccgucuuccgccagaugcgccccgucucccgcguccucgccccccaccucacccgcgccuacgccaaggacgucaaguucggcgccgacgcccgcgcccucaugcuccagggcgucgaccuccucgccgacgccgucgccgucaccaugggccccaagggccgcaccgucaucaucgagcaguccuggggcucccccaaggucaccaaggacggcgucaccgucgccaaguccaucgaccucaaggacaaguacaagaacaucggcgccaagcucguccaggacgucgccaacaacaccaacgaggaggccggcgacggcaccaccaccgccaccguccucgcccgcuccaucgccaaggagggcuucgagaagaucuccaagggcgccaaccccgucgagauccgccgcggcgucaugcucgccgucgacgccgucaucgccgagcucaagaagcaguccaagcccgucaccacccccgaggagaucgcccaggucgccaccaucuccgccaacggcgacaaggagaucggcaacaucaucuccgacgccaugaagaaggucggccgcaagggcgucaucaccgucaaggacggcaagacccucaacgacgagcucgagaucaucgagggcaugaaguucgaccgcggcuacaucucccccuacuucaucaacaccuccaagggccagaagugcgaguuccaggacgccuacguccuccucuccgagaagaagaucuccuccauccaguccaucguccccgcccucgagaucgccaacgcccaccgcaagccccucgucaucaucgccgaggacgucgacggcgaggcccucuccacccucguccucaaccgccucaaggucggccuccaggucgucgccgucaaggcccccggcuucggcgacaaccgcaagaaccagcucaaggacauggccaucgccaccggcggcgccgucuucggcgaggagggccucacccucaaccucgaggacguccagccccacgaccucggcaaggucggcgaggucaucgucaccaaggacgacgccaugcuccucaagggcaagggcgacaaggcccagaucgagaagcgcauccaggagaucaucgagcagcucgacgucaccaccuccgaguacgagaaggagaagcucaacgagcgccucgccaagcucuccgacggcgucgccguccucaaggucggcggcaccuccgacgucgaggucaacgagaagaaggaccgcgucaccgacgcccucaacgccacccgcgccgccgucgaggagggcaucguccucggcggcggcugcgcccuccuccgcugcauccccgcccucgacucccucacccccgccaacgaggaccagaagaucggcaucgagaucaucaagcgcacccucaagauccccgccaugaccaucgccaagaacgccggcgucgagggcucccucaucgucgagaagaucaugcaguccuccuccgaggucggcuacgacgccauggccggcgacuucgucaacauggucgagaagggcaucaucgaccccaccaaggucguccgcaccgcccuccucgacgccgccggcgucgccucccuccucaccaccgccgaggucgucgucaccgagauccccaaggaggagaaggaccccggcaugggcgccaugggcggcaugggcggcggcaugggcggcggcauguucuga

SEQ ID NO: 44401 - RNA, 309 nt, Artificial Sequence
  derived and/or modified sequence opt2 from HSPE1__Homo_sapiens__NP_002148
auggccggccaggccuuccgcaaguuccucccccucuucgaccgcguccucgucgagcgcuccgccgccgagaccgucaccaagggcggcaucaugcuccccgagaagucccagggcaagguccuccaggccaccgucgucgccgucggcuccggcuccaagggcaagggcggcgagauccagcccgucuccgucaaggucggcgacaagguccuccuccccgaguacggcggcaccaaggucguccucgacgacaaggacuacuuccucuuccgcgacggcgacauccucggcaaguacgucgacuga

SEQ ID NO: 44402 - RNA, 13179 nt, Artificial Sequence
  derived and/or modified sequence opt2 from HSPG2__Homo_sapiens__NP_001278789
augggcuggcgcgccgccggcgcccuccuccucgcccuccuccuccacggccgccuccucgccgucacccacggccuccgcgccuacgacggccucucccuccccgaggacaucgagaccgucaccgccucccagaugcgcuggacccacuccuaccucuccgacgacgaggacaugcucgccgacuccaucuccggcgacgaccucggcuccggcgaccucggcuccggcgacuuccagauggucuacuuccgcgcccucgucaacuucacccgcuccaucgaguacuccccccagcucgaggacgccggcucccgcgaguuccgcgaggucuccgaggccgucgucgacacccucgaguccgaguaccucaagauccccggcgaccaggucgucuccgucgucuucaucaaggagcucgacggcugggucuucgucgagcucgacgucggcuccgagggcaacgccgacggcgcccagauccaggagaugcuccuccgcgucaucuccuccggcuccgucgccuccuacgucaccuccccccagggcuuccaguuccgccgccucggcaccgucccccaguucccccgcgccugcaccgaggccgaguucgccugccacuccuacaacgagugcgucgcccucgaguaccgcugcgaccgccgccccgacugccgcgacauguccgacgagcucaacugcgaggagcccguccucggcaucucccccaccuucucccuccucgucgagaccaccucccuccccccccgccccgagaccaccaucaugcgccagccccccgucacccacgccccccagccccuccuccccggcuccguccgcccccuccccugcggcccccaggaggccgccugccgcaacggccacugcaucccccgcgacuaccucugcgacggccaggaggacugcgaggacggcuccgacgagcucgacugcggcccccccccccccugcgagcccaacgaguuccccugcggcaacggccacugcgcccucaagcucuggcgcugcgacggcgacuucgacugcgaggaccgcaccgacgaggccaacugccccaccaagcgccccgaggaggucugcggccccacccaguuccgcugcgucuccaccaacaugugcauccccgccuccuuccacugcgacgaggaguccgacugccccgaccgcuccgacgaguucggcugcaugcccccccaggucgucacccccccccgcgaguccauccaggccucccgcggccagaccgucaccuucaccugcgucgccaucggcguccccacccccaucaucaacuggcgccucaacuggggccacauccccucccacccccgcgucaccgucaccuccgagggcggccgcggcacccucaucauccgcgacgucaaggaguccgaccagggcgccuacaccugcgaggccaugaacgcccgcggcauggucuucggcauccccgacggcguccucgagcucgucccccagcgcgccggccccugccccgacggccacuucuaccucgagcacuccgccgccugccuccccugcuucugcuucggcaucaccuccgucugccaguccacccgccgcuuccgcgaccagauccgccuccgcuucgaccagcccgacgacuucaagggcgucaacgucaccaugcccgcccagcccggcacccccccccucuccuccacccagcuccagaucgaccccucccuccacgaguuccagcucgucgaccucucccgccgcuuccucguccacgacuccuucugggcccuccccgagcaguuccucggcaacaaggucgacuccuacggcggcucccuccgcuacaacguccgcuacgagcucgcccgcggcaugcucgagcccguccagcgccccgacgucguccucaugggcgccggcuaccgccuccucucccgcggccacacccccacccagcccggcgcccucaaccagcgccagguccaguucuccgaggagcacuggguccacgaguccggccgccccguccagcgcgccgagcuccuccagguccuccagucccucgaggccguccucauccagaccgucuacaacaccaagauggccuccgucggccucuccgacaucgccauggacaccaccgucacccacgccaccucccacggccgcgcccacuccgucgaggagugccgcugccccaucggcuacuccggccucuccugcgaguccugcgacgcccacuucacccgcguccccggcggccccuaccucggcaccugcuccggcugcaacugcaacggccacgccuccuccugcgaccccgucuacggccacugccucaacugccagcacaacaccgagggcccccagugcaacaagugcaaggccggcuucuucggcgacgccaugaaggccaccgccaccuccugccgccccugccccugccccuacaucgacgccucccgccgcuucuccgacaccugcuuccucgacaccgacggccaggccaccugcgacgccugcgcccccggcuacaccggccgccgcugcgaguccugcgcccccggcuacgagggcaaccccauccagcccggcggcaagugccgccccgucaaccaggagaucguccgcugcgacgagcgcggcuccaugggcaccuccggcgaggccugccgcugcaagaacaacgucgucggccgccucugcaacgagugcgccgacggcuccuuccaccucuccacccgcaaccccgacggcugccucaagugcuucugcaugggcgucucccgccacugcaccuccuccuccuggucccgcgcccagcuccacggcgccuccgaggagcccggccacuucucccucaccaacgccgccuccacccacaccaccaacgagggcaucuucucccccacccccggcgagcucggcuucuccuccuuccaccgccuccucuccggccccuacuucuggucccuccccucccgcuuccucggcgacaaggucaccuccuacggcggcgagcuccgcuucaccgucacccagcgcucccagcccggcuccaccccccuccacggccagccccucgucguccuccagggcaacaacaucauccucgagcaccacgucgcccaggagcccucccccggccagcccuccaccuucaucguccccuuccgcgagcaggccuggcagcgccccgacggccagcccgccacccgcgagcaccuccucauggcccucgccggcaucgacacccuccucauccgcgccuccuacgcccagcagcccgccgagucccgcgucuccggcaucuccauggacgucgccguccccgaggagaccggccaggaccccgcccucgaggucgagcagugcuccugcccccccggcuaccgcggccccuccugccaggacugcgacaccggcuacacccgcacccccuccggccucuaccucggcaccugcgagcgcugcuccugccacggccacuccgaggccugcgagcccgagaccggcgccugccagggcugccagcaccacaccgagggcccccgcugcgagcagugccagcccggcuacuacggcgacgcccagcgcggcaccccccaggacugccagcucugccccugcuacggcgaccccgccgccggccaggccgcccacaccugcuuccucgacaccgacggccaccccaccugcgacgccugcucccccggccacuccggccgccacugcgagcgcugcgcccccggcuacuacggcaaccccucccagggccagcccugccagcgcgacucccagguccccggccccaucggcugcaacugcgacccccagggcuccgucuccucccagugcgacgccgccggccagugccagugcaaggcccaggucgagggccucaccugcucccacugccgcccccaccacuuccaccucuccgccuccaaccccgacggcugccuccccugcuucugcaugggcaucacccagcagugcgccuccuccgccuacacccgccaccucaucuccacccacuucgcccccggcgacuuccagggcuucgcccucgucaacccccagcgcaacucccgccucaccggcgaguucaccgucgagcccguccccgagggcgcccagcucuccuucggcaacuucgcccagcucggccacgaguccuucuacuggcagcuccccgagaccuaccagggcgacaaggucgccgccuacggcggcaagcuccgcuacacccucuccuacaccgccggcccccagggcuccccccucuccgaccccgacguccagaucaccggcaacaacaucaugcucgucgccucccagcccgcccuccagggccccgagcgccgcuccuacgagaucauguuccgcgaggaguucuggcgccgccccgacggccagcccgccacccgcgagcaccuccucauggcccucgccgaccucgacgagcuccucauccgcgccaccuucuccuccgucccccucgccgccuccaucuccgccgucucccucgaggucgcccagcccggccccuccaaccgcccccgcgcccucgaggucgaggagugccgcugcccccccggcuacaucggccucuccugccaggacugcgcccccggcuacacccgcaccggcuccggccucuaccucggccacugcgagcucugcgagugcaacggccacuccgaccucugccaccccgagaccggcgccugcucccagugccagcacaacgccgccggcgaguucugcgagcucugcgcccccggcuacuacggcgacgccaccgccggcacccccgaggacugccagcccugcgccugcccccucaccaaccccgagaacauguucucccgcaccugcgagucccucggcgccggcggcuaccgcugcaccgccugcgagcccggcuacaccggccaguacugcgagcagugcggccccggcuacgucggcaaccccuccguccagggcggccagugccuccccgagaccaaccaggccccccucgucgucgagguccaccccgcccgcuccaucgucccccagggcggcucccacucccuccgcugccaggucuccggcucccccccccacuacuucuacuggucccgcgaggacggccgccccguccccuccggcacccagcagcgccaccagggcuccgagcuccacuuccccuccguccagcccuccgacgccggcgucuacaucugcaccugccgcaaccuccaccaguccaacaccucccgcgccgagcuccucgucaccgaggcccccuccaagcccaucaccgucaccgucgaggagcagcgcucccaguccguccgccccggcgccgacgucaccuucaucugcaccgccaaguccaagucccccgccuacacccucgucuggacccgccuccacaacggcaagcuccccacccgcgccauggacuucaacggcauccucaccauccgcaacguccagcucuccgacgccggcaccuacgucugcaccggcuccaacauguucgccauggaccagggcaccgccacccuccacguccaggccuccggcacccucuccgcccccgucgucuccauccaccccccccagcucaccguccagcccggccagcucgccgaguuccgcugcuccgccaccggcucccccacccccacccucgaguggaccggcggccccggcggccagcuccccgccaaggcccagauccacggcggcauccuccgccuccccgccgucgagcccaccgaccaggcccaguaccucugccgcgcccacuccuccgccggccagcaggucgcccgcgccguccuccacguccacggcggcggcggcccccgcguccaggucucccccgagcgcacccagguccacgccggccgcaccguccgccucuacugccgcgccgccggcguccccuccgccaccaucaccuggcgcaaggagggcggcucccuccccccccaggcccgcuccgagcgcaccgacaucgccacccuccucauccccgccaucaccaccgccgacgccggcuucuaccucugcgucgccaccucccccgccggcaccgcccaggcccgcauccaggucgucguccucuccgccuccgacgccucccccccccccgucaagaucgaguccuccucccccuccgucaccgagggccagacccucgaccucaacugcgucgucgccggcuccgcccacgcccaggucaccugguaccgccgcggcggcucccuccccccccacacccagguccacggcucccgccuccgccucccccaggucucccccgccgacuccggcgaguacgucugccgcgucgagaacggcuccggccccaaggaggccuccaucaccgucuccguccuccacggcacccacuccggccccuccuacacccccguccccggcuccacccgccccauccgcaucgagcccuccuccucccacgucgccgagggccagacccucgaccucaacugcgucguccccggccaggcccacgcccaggucaccuggcacaagcgcggcggcucccuccccgcccgccaccagacccacggcucccuccuccgccuccaccaggucacccccgccgacuccggcgaguacgucugccacgucgucggcaccuccggcccccucgaggccuccguccucgucaccaucgaggccuccgucauccccggccccaucccccccguccgcaucgaguccuccuccuccaccgucgccgagggccagacccucgaccucuccugcgucgucgccggccaggcccacgcccaggucaccugguacaagcgcggcggcucccuccccgcccgccaccagguccgcggcucccgccucuacaucuuccaggccucccccgccgacgccggccaguacgucugccgcgccuccaacggcauggaggccuccaucaccgucaccgucaccggcacccagggcgccaaccucgccuaccccgccggcuccacccagcccauccgcaucgagcccuccuccucccaggucgccgagggccagacccucgaccucaacugcgucguccccggccagucccacgcccaggucaccuggcacaagcgcggcggcucccuccccguccgccaccagacccacggcucccuccuccgccucuaccaggccucccccgccgacuccggcgaguacgucugccgcguccucggcuccuccgucccccucgaggccuccguccucgucaccaucgagcccgccggcuccguccccgcccucggcgucacccccaccguccgcaucgaguccuccuccucccaggucgccgagggccagacccucgaccucaacugccucgucgccggccaggcccacgcccaggucaccuggcacaagcgcggcggcucccuccccgcccgccaccagguccacggcucccgccuccgccuccuccaggucacccccgccgacuccggcgaguacgucugccgcgucgucggcuccuccggcacccaggaggccuccguccucgucaccauccagcagcgccucuccggcucccacucccagggcgucgccuaccccguccgcaucgaguccuccuccgccucccucgccaacggccacacccucgaccucaacugccucgucgccucccaggccccccacaccaucaccugguacaagcgcggcggcucccuccccucccgccaccagaucgucggcucccgccuccgcaucccccaggucacccccgccgacuccggcgaguacgucugccacgucuccaacggcgccggcucccgcgagaccucccucaucgucaccauccagggcuccggcuccucccacguccccuccgucuccccccccauccgcaucgaguccuccucccccaccgucgucgagggccagacccucgaccucaacugcgucgucgcccgccagccccaggccaucaucaccugguacaagcgcggcggcucccuccccucccgccaccagacccacggcucccaccuccgccuccaccagauguccgucgccgacuccggcgaguacgucugccgcgccaacaacaacaucgacgcccucgaggccuccaucgucaucuccgucucccccuccgccggcucccccuccgcccccggcuccuccaugcccauccgcaucgaguccuccuccucccacgucgccgagggcgagacccucgaccucaacugcgucguccccggccaggcccacgcccaggucaccuggcacaagcgcggcggcucccuccccucccaccaccagacccgcggcucccgccuccgccuccaccacgucucccccgccgacuccggcgaguacgucugccgcgucaugggcuccuccggcccccucgaggccuccguccucgucaccaucgaggccuccggcuccuccgccguccacguccccgcccccggcggcgccccccccauccgcaucgagcccuccuccucccgcgucgccgagggccagacccucgaccucaagugcgucguccccggccaggcccacgcccaggucaccuggcacaagcgcggcggcaaccuccccgcccgccaccagguccacggcccccuccuccgccucaaccaggucucccccgccgacuccggcgaguacuccugccaggucaccggcuccuccggcacccucgaggccuccguccucgucaccaucgagcccuccucccccggccccauccccgcccccggccucgcccagcccaucuacaucgaggccuccuccucccacgucaccgagggccagacccucgaccucaacugcgucguccccggccaggcccacgcccaggucaccugguacaagcgcggcggcucccuccccgcccgccaccagacccacggcucccagcuccgccuccaccucgucucccccgccgacuccggcgaguacgucugccgcgccgccuccggccccggccccgagcaggaggccuccuucaccgucaccgucccccccuccgagggcuccuccuaccgccuccgcucccccgucaucuccaucgacccccccuccuccaccguccagcagggccaggacgccuccuucaagugccucauccacgacggcgccgcccccaucucccucgaguggaagacccgcaaccaggagcucgaggacaacguccacaucucccccaacggcuccaucaucaccaucgucggcacccgccccuccaaccacggcaccuaccgcugcgucgccuccaacgccuacggcgucgcccaguccgucgucaaccucuccguccacggcccccccaccgucuccguccuccccgagggccccgucugggucaaggucggcaaggccgucacccucgagugcgucuccgccggcgagccccgcuccuccgcccgcuggacccgcaucuccuccacccccgccaagcucgagcagcgcaccuacggccucauggacucccacgccguccuccagaucuccuccgccaagcccuccgacgccggcaccuacgucugccucgcccagaacgcccucggcaccgcccagaagcaggucgaggucaucgucgacaccggcgccauggcccccggcgccccccagguccaggccgaggaggccgagcucaccgucgaggccggccacaccgccacccuccgcugcuccgccaccggcucccccgcccccaccauccacugguccaagcuccgcuccccccuccccuggcagcaccgccucgagggcgacacccucaucaucccccgcgucgcccagcaggacuccggccaguacaucugcaacgccaccucccccgccggccacgccgaggccaccaucauccuccacgucgaguccccccccuacgccaccaccguccccgagcacgccuccguccaggccggcgagaccguccagcuccagugccucgcccacggcacccccccccucaccuuccaguggucccgcgucggcuccucccuccccggccgcgccaccgcccgcaacgagcuccuccacuucgagcgcgccgcccccgaggacuccggccgcuaccgcugccgcgucaccaacaaggucggcuccgccgaggccuucgcccagcuccucguccagggcccccccggcucccuccccgccaccuccauccccgccggcuccacccccaccguccaggucaccccccagcucgagaccaaguccaucggcgccuccgucgaguuccacugcgccguccccuccgaccgcggcacccagcuccgcugguucaaggagggcggccagcucccccccggccacuccguccaggacggcguccuccgcauccagaaccucgaccaguccugccagggcaccuacaucugccaggcccacggccccuggggcaaggcccaggccuccgcccagcucgucauccaggcccuccccuccguccucaucaacauccgcaccuccguccagaccgucgucgucggccacgccgucgaguucgagugccucgcccucggcgaccccaagccccaggucaccugguccaaggucggcggccaccuccgccccggcaucguccaguccggcggcgucguccgcaucgcccacgucgagcucgccgacgccggccaguaccgcugcaccgccaccaacgccgccggcaccacccagucccacguccuccuccucguccaggcccucccccagaucuccaugccccaggagguccgcguccccgccggcuccgccgccgucuuccccugcaucgccuccggcuaccccacccccgacaucuccugguccaagcucgacggcucccucccccccgacucccgccucgagaacaacaugcucaugcuccccuccguccgcccccaggacgccggcaccuacgucugcaccgccaccaaccgccagggcaaggucaaggccuucgcccaccuccagguccccgagcgcgucguccccuacuucacccagacccccuacuccuuccucccccuccccaccaucaaggacgccuaccgcaaguucgagaucaagaucaccuuccgccccgacuccgccgacggcaugcuccucuacaacggccagaagcgcguccccggcucccccaccaaccucgccaaccgccagcccgacuucaucuccuucggccucgucggcggccgccccgaguuccgcuucgacgccggcuccggcauggccaccauccgccaccccaccccccucgcccucggccacuuccacaccgucacccuccuccgcucccucacccagggcucccucaucgucggcgaccucgcccccgucaacggcaccucccagggcaaguuccagggccucgaccucaacgaggagcucuaccucggcggcuaccccgacuacggcgccauccccaaggccggccucuccuccggcuucaucggcugcguccgcgagcuccgcauccagggcgaggagaucgucuuccacgaccucaaccucaccgcccacggcaucucccacugccccaccugccgcgaccgccccugccagaacggcggccagugccacgacuccgaguccuccuccuacgucugcgucugccccgccggcuucaccggcucccgcugcgagcacucccaggcccuccacugccaccccgaggccugcggccccgacgccaccugcgucaaccgccccgacggccgcggcuacaccugccgcugccaccucggccgcuccggccuccgcugcgaggagggcgucaccgucaccacccccucccucuccggcgccggcuccuaccucgcccuccccgcccucaccaacacccaccacgagcuccgccucgacgucgaguucaagccccucgcccccgacggcguccuccucuucuccggcggcaaguccggccccgucgaggacuucgucucccucgccauggucggcggccaccucgaguuccgcuacgagcucggcuccggccucgccguccuccgcuccgccgagccccucgcccucggccgcuggcaccgcgucuccgccgagcgccucaacaaggacggcucccuccgcgucaacggcggccgccccguccuccgcuccucccccggcaagucccagggccucaaccuccacacccuccucuaccucggcggcgucgagcccuccgucccccucucccccgccaccaacauguccgcccacuuccgcggcugcgucggcgaggucuccgucaacggcaagcgccucgaccucaccuacuccuuccucggcucccagggcaucggccagugcuacgacuccucccccugcgagcgccagcccugccagcacggcgccaccugcaugcccgccggcgaguacgaguuccagugccucugccgcgacggcuucaagggcgaccucugcgagcacgaggagaaccccugccagcuccgcgagcccugccuccacggcggcaccugccagggcacccgcugccucugccuccccggcuucuccggcccccgcugccagcagggcuccggccacggcaucgccgaguccgacuggcaccucgagggcuccggcggcaacgacgcccccggccaguacggcgccuacuuccacgacgacggcuuccucgccuuccccggccacgucuucucccgcucccuccccgagguccccgagaccaucgagcucgagguccgcaccuccaccgccuccggccuccuccucuggcagggcgucgaggucggcgaggccggccagggcaaggacuucaucucccucggccuccaggacggccaccucgucuuccgcuaccagcucggcuccggcgaggcccgccucgucuccgaggaccccaucaacgacggcgaguggcaccgcgucaccgcccuccgcgagggccgccgcggcuccauccaggucgacggcgaggagcucgucuccggccgcucccccggccccaacgucgccgucaacgccaagggcuccgucuacaucggcggcgcccccgacgucgccacccucaccggcggccgcuucuccuccggcaucaccggcugcgucaagaaccucguccuccacuccgcccgccccggcgccccccccccccagccccucgaccuccagcaccgcgcccaggccggcgccaacacccgccccugccccuccuga

SEQ ID NO: 44403 - RNA, 2445 nt, Artificial Sequence
  derived and/or modified sequence opt2 from HSPH1__Homo_sapiens__NP_001273432
auguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacgccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacuga

SEQ ID NO: 44404 - RNA, 831 nt, Artificial Sequence
  derived and/or modified sequence opt2 from HTATIP2__Homo_sapiens__NP_001091990
auggccggccccgccgcccucuccgccgccgccgccgccgcccucgccgccgcccuccuccuccuccgccgcgaggaccccggccccggcgccggccccuccauggccgagaccgaggcccucuccaagcuccgcgaggacuuccgcaugcagaacaaguccgucuucauccucggcgccuccggcgagaccggccgcguccuccucaaggagauccucgagcagggccucuucuccaaggucacccucaucggccgccgcaagcucaccuucgacgaggaggccuacaagaacgucaaccaggaggucgucgacuucgagaagcucgacgacuacgccuccgccuuccagggccacgacgucggcuucugcugccucggcaccacccgcggcaaggccggcgccgagggcuucguccgcgucgaccgcgacuacguccucaaguccgccgagcucgccaaggccggcggcugcaagcacuucaaccuccucuccuccaagggcgccgacaaguccuccaacuuccucuaccuccaggucaagggcgaggucgaggccaaggucgaggagcucaaguucgaccgcuacuccgucuuccgccccggcguccuccucugcgaccgccaggagucccgccccggcgaguggcucguccgcaaguucuucggcucccuccccgacuccugggccuccggccacuccguccccgucgucaccgucguccgcgccaugcucaacaacgucguccgcccccgcgacaagcagauggagcuccucgagaacaaggccauccacgaccucggcaaggcccacggcucccucaagcccuga

SEQ ID NO: 44405 - RNA, 174 nt, Artificial Sequence
  derived and/or modified sequence opt2 from HTN1__Homo_sapiens__NP_002150
augaaguucuucgucuucgcccucguccucgcccucaugaucuccaugaucuccgccgacucccacgagaagcgccaccacggcuaccgccgcaaguuccacgagaagcaccacucccaccgcgaguuccccuucuacggcgacuacggcuccaacuaccucuacgacaacuga

SEQ ID NO: 44406 - RNA, 156 nt, Artificial Sequence
  derived and/or modified sequence opt2 from HTN3__Homo_sapiens__NP_000191
augaaguucuucgucuucgcccucauccucgcccucaugcucuccaugaccggcgccgacucccacgccaagcgccaccacggcuacaagcgcaaguuccacgagaagcaccacucccaccgcggcuaccgcuccaacuaccucuacgacaacuga

SEQ ID NO: 44407 - RNA, 1269 nt, Artificial Sequence
  derived and/or modified sequence opt2 from HTR1A__Homo_sapiens__NP_000515
auggacguccucucccccggccagggcaacaacaccaccuccccccccgcccccuucgagaccggcggcaacaccaccggcaucuccgacgucaccgucuccuaccaggucaucaccucccuccuccucggcacccucaucuucugcgccguccucggcaacgccugcgucgucgccgccaucgcccucgagcgcucccuccagaacgucgccaacuaccucaucggcucccucgccgucaccgaccucauggucuccguccucguccuccccauggccgcccucuaccagguccucaacaaguggacccucggccaggucaccugcgaccucuucaucgcccucgacguccucugcugcaccuccuccauccuccaccucugcgccaucgcccucgaccgcuacugggccaucaccgaccccaucgacuacgucaacaagcgcaccccccgccgcgccgccgcccucaucucccucaccuggcucaucggcuuccucaucuccaucccccccaugcucggcuggcgcacccccgaggaccgcuccgaccccgacgccugcaccaucuccaaggaccacggcuacaccaucuacuccaccuucggcgccuucuacaucccccuccuccucaugcucguccucuacggccgcaucuuccgcgccgcccgcuuccgcauccgcaagaccgucaagaaggucgagaagaccggcgccgacacccgccacggcgccucccccgccccccagcccaagaaguccgucaacggcgaguccggcucccgcaacuggcgccucggcgucgaguccaaggccggcggcgcccucugcgccaacggcgccguccgccagggcgacgacggcgccgcccucgaggucaucgagguccaccgcgucggcaacuccaaggagcaccucccccuccccuccgaggccggccccacccccugcgcccccgccuccuucgagcgcaagaacgagcgcaacgccgaggccaagcgcaagauggcccucgcccgcgagcgcaagaccgucaagacccucggcaucaucaugggcaccuucauccucugcuggcuccccuucuucaucgucgcccucguccuccccuucugcgaguccuccugccacaugcccacccuccucggcgccaucaucaacuggcucggcuacuccaacucccuccucaaccccgucaucuacgccuacuucaacaaggacuuccagaacgccuucaagaagaucaucaagugcaaguucugccgccaguga

SEQ ID NO: 44408 - RNA, 1173 nt, Artificial Sequence
  derived and/or modified sequence opt2 from HTR1B__Homo_sapiens__NP_000854
auggaggagcccggcgcccagugcgccccccccccccccgccggcuccgagaccugggucccccaggccaaccucuccuccgcccccucccagaacugcuccgccaaggacuacaucuaccaggacuccaucucccuccccuggaagguccuccucgucaugcuccucgcccucaucacccucgccaccacccucuccaacgccuucgucaucgccaccgucuaccgcacccgcaagcuccacacccccgccaacuaccucaucgccucccucgccgucaccgaccuccucgucuccauccucgucaugcccaucuccaccauguacaccgucaccggccgcuggacccucggccaggucgucugcgacuucuggcucuccuccgacaucaccugcugcaccgccuccauccuccaccucugcgucaucgcccucgaccgcuacugggccaucaccgacgccgucgaguacuccgccaagcgcacccccaagcgcgccgccgucaugaucgcccucgucugggucuucuccaucuccaucucccucccccccuucuucuggcgccaggccaaggccgaggaggaggucuccgagugcgucgucaacaccgaccacauccucuacaccgucuacuccaccgucggcgccuucuacuuccccacccuccuccucaucgcccucuacggccgcaucuacgucgaggcccgcucccgcauccucaagcagacccccaaccgcaccggcaagcgccucacccgcgcccagcucaucaccgacucccccggcuccaccuccuccgucaccuccaucaacucccgcguccccgacguccccuccgaguccggcucccccgucuacgucaaccaggucaagguccgcgucuccgacgcccuccucgagaagaagaagcucauggccgcccgcgagcgcaaggccaccaagacccucggcaucauccucggcgccuucaucgucugcuggcuccccuucuucaucaucucccucgucaugcccaucugcaaggacgccugcugguuccaccucgccaucuucgacuucuucaccuggcucggcuaccucaacucccucaucaaccccaucaucuacaccauguccaacgaggacuucaagcaggccuuccacaagcucauccgcuucaagugcaccuccuga

SEQ ID NO: 44409 - RNA, 1098 nt, Artificial Sequence
  derived and/or modified sequence opt2 from HTR1E__Homo_sapiens__XP_011534092
augaacaucaccaacugcaccaccgaggccuccauggccauccgccccaagaccaucaccgagaagaugcucaucugcaugacccucgucgucaucaccacccucaccacccuccucaaccucgccgucaucauggccaucggcaccaccaagaagcuccaccagcccgccaacuaccucaucugcucccucgccgucaccgaccuccucgucgccguccucgucaugccccucuccaucaucuacaucgucauggaccgcuggaagcucggcuacuuccucugcgaggucuggcucuccgucgacaugaccugcugcaccugcuccauccuccaccucugcgucaucgcccucgaccgcuacugggccaucaccaacgccaucgaguacgcccgcaagcgcaccgccaagcgcgccgcccucaugauccucaccgucuggaccaucuccaucuucaucuccaugcccccccucuucuggcgcucccaccgccgccucucccccccccccucccagugcaccauccagcacgaccacgucaucuacaccaucuacuccacccucggcgccuucuacaucccccucacccucauccucauccucuacuaccgcaucuaccacgccgccaagucccucuaccagaagcgcggcuccucccgccaccucuccaaccgcuccaccgacucccagaacuccuucgccuccugcaagcucacccagaccuucugcgucuccgacuucuccaccuccgaccccaccaccgaguucgagaaguuccacgccuccauccgcaucccccccuucgacaacgaccucgaccaccccggcgagcgccagcagaucuccuccacccgcgagcgcaaggccgcccgcauccucggccucauccucggcgccuucauccucuccuggcuccccuucuucaucaaggagcucaucgucggccucuccaucuacaccgucuccuccgaggucgccgacuuccucaccuggcucggcuacgucaacucccucaucaacccccuccucuacaccuccuucaacgaggacuucaagcucgccuucaagaagcucauccgcugccgcgagcacaccuga

SEQ ID NO: 44410 - RNA, 1101 nt, Artificial Sequence
  derived and/or modified sequence opt2 from HTR1F__Homo_sapiens__NP_000857
auggacuuccucaacuccuccgaccagaaccucaccuccgaggagcuccucaaccgcaugcccuccaagauccucgucucccucacccucuccggccucgcccucaugaccaccaccaucaacucccucgucaucgccgccaucaucgucacccgcaagcuccaccaccccgccaacuaccucaucugcucccucgccgucaccgacuuccucgucgccguccucgucaugcccuucuccaucgucuacaucguccgcgaguccuggaucaugggccaggucgucugcgacaucuggcucuccgucgacaucaccugcugcaccugcuccauccuccaccucuccgccaucgcccucgaccgcuaccgcgccaucaccgacgccgucgaguacgcccgcaagcgcacccccaagcacgccggcaucaugaucaccaucgucuggaucaucuccgucuucaucuccaugcccccccucuucuggcgccaccagggcaccucccgcgacgacgagugcaucaucaagcacgaccacaucgucuccaccaucuacuccaccuucggcgccuucuacaucccccucgcccucauccucauccucuacuacaagaucuaccgcgccgccaagacccucuaccacaagcgccaggccucccgcaucgccaaggaggaggucaacggccagguccuccucgaguccggcgagaaguccaccaaguccgucuccaccuccuacguccucgagaagucccucuccgaccccuccaccgacuucgacaagauccacuccaccguccgcucccuccgcuccgaguucaagcacgagaaguccuggcgccgccagaagaucuccggcacccgcgagcgcaaggccgccaccacccucggccucauccucggcgccuucgucaucugcuggcuccccuucuucgucaaggagcucgucgucaacgucugcgacaagugcaagaucuccgaggagauguccaacuuccucgccuggcucggcuaccucaacucccucaucaacccccucaucuacaccaucuucaacgaggacuucaagaaggccuuccagaagcucguccgcugccgcugcuga

SEQ ID NO: 44411 - RNA, 1416 nt, Artificial Sequence
  derived and/or modified sequence opt2 from HTR2A__Homo_sapiens__NP_000612
auggacauccucugcgaggagaacaccucccucuccuccaccaccaacucccucaugcagcucaacgacgacacccgccucuacuccaacgacuucaacuccggcgaggccaacaccuccgacgccuucaacuggaccgucgacuccgagaaccgcaccaaccucuccugcgagggcugccucucccccuccugccucucccuccuccaccuccaggagaagaacugguccgcccuccucaccgccgucgucaucauccucaccaucgccggcaacauccucgucaucauggccgucucccucgagaagaagcuccagaacgccaccaacuacuuccucaugucccucgccaucgccgacaugcuccucggcuuccucgucaugcccgucuccaugcucaccauccucuacggcuaccgcuggccccuccccuccaagcucugcgccgucuggaucuaccucgacguccucuucuccaccgccuccaucaugcaccucugcgccaucucccucgaccgcuacgucgccauccagaaccccauccaccacucccgcuucaacucccgcaccaaggccuuccucaagaucaucgccgucuggaccaucuccgucggcaucuccaugcccauccccgucuucggccuccaggacgacuccaaggucuucaaggagggcuccugccuccucgccgacgacaacuucguccucaucggcuccuucgucuccuucuucaucccccucaccaucauggucaucaccuacuuccucaccaucaagucccuccagaaggaggccacccucugcgucuccgaccucggcacccgcgccaagcucgccuccuucuccuuccucccccaguccucccucuccuccgagaagcucuuccagcgcuccauccaccgcgagcccggcuccuacaccggccgccgcaccaugcaguccaucuccaacgagcagaaggccugcaagguccucggcaucgucuucuuccucuucgucgucauguggugccccuucuucaucaccaacaucauggccgucaucugcaaggaguccugcaacgaggacgucaucggcgcccuccucaacgucuucgucuggaucggcuaccucuccuccgccgucaacccccucgucuacacccucuucaacaagaccuaccgcuccgccuucucccgcuacauccagugccaguacaaggagaacaagaagccccuccagcucauccucgucaacaccauccccgcccucgccuacaaguccucccagcuccagaugggccagaagaagaacuccaagcaggacgccaagaccaccgacaacgacugcuccauggucgcccucggcaagcagcacuccgaggaggccuccaaggacaacuccgacggcgucaacgagaaggucuccugcgucuga

SEQ ID NO: 44412 - RNA, 1446 nt, Artificial Sequence
  derived and/or modified sequence opt2 from HTR2B__Homo_sapiens__NP_000858
auggcccucuccuaccgcgucuccgagcuccaguccaccauccccgagcacauccuccaguccaccuucguccacgucaucuccuccaacugguccggccuccagaccgaguccauccccgaggagaugaagcagaucgucgaggagcagggcaacaagcuccacugggccgcccuccucauccucauggucaucauccccaccaucggcggcaacacccucgucauccucgccgucucccucgagaagaagcuccaguacgccaccaacuacuuccucaugucccucgccgucgccgaccuccucgucggccucuucgucaugcccaucgcccuccucaccaucauguucgaggccauguggccccucccccucguccucugccccgccuggcucuuccucgacguccucuucuccaccgccuccaucaugcaccucugcgccaucuccgucgaccgcuacaucgccaucaagaagcccauccaggccaaccaguacaacucccgcgccaccgccuucaucaagaucaccgucgucuggcucaucuccaucggcaucgccauccccguccccaucaagggcaucgagaccgacgucgacaaccccaacaacaucaccugcguccucaccaaggagcgcuucggcgacuucaugcucuucggcucccucgccgccuucuucaccccccucgccaucaugaucgucaccuacuuccucaccauccacgcccuccagaagaaggccuaccucgucaagaacaagcccccccagcgccucaccuggcucaccgucuccaccgucuuccagcgcgacgagacccccugcuccucccccgagaaggucgccaugcucgacggcucccgcaaggacaaggcccuccccaacuccggcgacgagacccucaugcgccgcaccuccaccaucggcaagaaguccguccagaccaucuccaacgagcagcgcgccuccaagguccucggcaucgucuucuuccucuuccuccucauguggugccccuucuucaucaccaacaucacccucguccucugcgacuccugcaaccagaccacccuccagaugcuccucgagaucuucgucuggaucggcuacgucuccuccggcgucaacccccucgucuacacccucuucaacaagaccuuccgcgacgccuucggccgcuacaucaccugcaacuaccgcgccaccaaguccgucaagacccuccgcaagcgcuccuccaagaucuacuuccgcaaccccauggccgagaacuccaaguucuucaagaagcacggcauccgcaacggcaucaaccccgccauguaccagucccccaugcgccuccgcuccuccaccauccaguccuccuccaucauccuccucgacacccuccuccucaccgagaacgagggcgacaagaccgaggagcaggucuccuacgucuga

SEQ ID NO: 44413 - RNA, 1377 nt, Artificial Sequence
  derived and/or modified sequence opt2 from HTR2C__Homo_sapiens__NP_001243689
auggucaaccuccgcaacgccguccacuccuuccucguccaccucaucggccuccucgucuggcagugcgacaucuccgucucccccgucgccgccaucgucaccgacaucuucaacaccuccgacggcggccgcuucaaguuccccgacggcguccagaacuggcccgcccucuccaucgucaucaucaucaucaugaccaucggcggcaacauccucgucaucauggccgucuccauggagaagaagcuccacaacgccaccaacuacuuccucaugucccucgccaucgccgacaugcucgucggccuccucgucaugccccucucccuccucgccauccucuacgacuacgucuggccccucccccgcuaccucugccccgucuggaucucccucgacguccucuucuccaccgccuccaucaugcaccucugcgccaucucccucgaccgcuacgucgccauccgcaaccccaucgagcacucccgcuucaacucccgcaccaaggccaucaugaagaucgccaucgucugggccaucuccaucggcgucuccguccccauccccgucaucggccuccgcgacgaggagaaggucuucgucaacaacaccaccugcguccucaacgaccccaacuucguccucaucggcuccuucgucgccuucuucaucccccucaccaucauggucaucaccuacugccucaccaucuacguccuccgccgccaggcccucaugcuccuccacggccacaccgaggagccccccggccucucccucgacuuccucaagugcugcaagcgcaacaccgccgaggaggagaacuccgccaaccccaaccaggaccagaacgcccgccgccgcaagaagaaggagcgccgcccccgcggcaccaugcaggccaucaacaacgagcgcaaggccuccaagguccucggcaucgucuucuucgucuuccucaucauguggugccccuucuucaucaccaacauccucuccguccucugcgagaaguccugcaaccagaagcucauggagaagcuccucaacgucuucgucuggaucggcuacgucugcuccggcaucaacccccucgucuacacccucuucaacaagaucuaccgccgcgccuucuccaacuaccuccgcugcaacuacaaggucgagaagaagccccccguccgccagaucccccgcgucgccgccaccgcccucuccggccgcgagcucaacgucaacaucuaccgccacaccaacgagcccgucaucgagaaggccuccgacaacgagcccggcaucgagaugcaggucgagaaccucgagcuccccgucaaccccuccuccgucgucuccgagcgcaucuccuccgucuga

SEQ ID NO: 44414 - RNA, 1455 nt, Artificial Sequence
  derived and/or modified sequence opt2 from HTR3A__Homo_sapiens__NP_000860
augcucggcaagcucgccaugcuccucuggguccagcaggcccuccucgcccuccuccuccccacccuccucgcccagggcgaggcccgccgcucccgcaacaccacccgccccgcccuccuccgccucuccgacuaccuccucaccaacuaccgcaagggcguccgccccguccgcgacuggcgcaagcccaccaccgucuccaucgacgucaucgucuacgccauccucaacgucgacgagaagaaccagguccucaccaccuacaucugguaccgccaguacuggaccgacgaguuccuccaguggaaccccgaggacuucgacaacaucaccaagcucuccauccccaccgacuccaucuggguccccgacauccucaucaacgaguucgucgacgucggcaagucccccaacauccccuacgucuacauccgccaccagggcgagguccagaacuacaagccccuccaggucgucaccgccugcucccucgacaucuacaacuuccccuucgacguccagaacugcucccucaccuucaccuccuggcuccacaccauccaggacaucaacaucucccucuggcgccuccccgagaaggucaaguccgaccgcuccgucuucaugaaccagggcgagugggagcuccucggcguccuccccuacuuccgcgaguucuccauggaguccuccaacuacuacgccgagaugaaguucuacgucgucauccgccgccgcccccucuucuacgucgucucccuccuccuccccuccaucuuccucauggucauggacaucgucggcuucuaccucccccccaacuccggcgagcgcgucuccuucaagaucacccuccuccucggcuacuccgucuuccucaucaucgucuccgacacccuccccgccaccgccaucggcaccccccucaucggcgucuacuucgucgucugcauggcccuccucgucaucucccucgccgagaccaucuucaucguccgccucguccacaagcaggaccuccagcagcccguccccgccuggcuccgccaccucguccucgagcgcaucgccuggcuccucugccuccgcgagcaguccaccucccagcgcccccccgccaccucccaggccaccaagaccgacgacugcuccgccaugggcaaccacugcucccacaugggcggcccccaggacuucgagaaguccccccgcgaccgcugcuccccccccccccccccccgcgaggccucccucgccgucugcggccuccuccaggagcucuccuccauccgccaguuccucgagaagcgcgacgagauccgcgaggucgcccgcgacuggcuccgcgucggcuccguccucgacaagcuccucuuccacaucuaccuccucgccguccucgccuacuccaucacccucgucaugcucugguccaucuggcaguacgccuga

SEQ ID NO: 44415 - RNA, 1326 nt, Artificial Sequence
  derived and/or modified sequence opt2 from HTR3B__Homo_sapiens__NP_006019
augcucuccuccgucauggccccccucugggccugcauccucgucgccgccggcauccucgccaccgacacccaccacccccaggacuccgcccucuaccaccucuccaagcagcuccuccagaaguaccacaaggagguccgccccgucuacaacuggaccaaggccaccaccgucuaccucgaccucuucguccacgccauccucgacgucgacgccgagaaccagauccucaagaccuccgucugguaccaggaggucuggaacgacgaguuccucuccuggaacuccuccauguucgacgagauccgcgagaucucccucccccucuccgccaucugggcccccgacaucaucaucaacgaguucgucgacaucgagcgcuaccccgaccuccccuacgucuacgucaacuccuccggcaccaucgagaacuacaagcccauccaggucgucuccgccugcucccucgagaccuacgccuuccccuucgacguccagaacugcucccucaccuucaaguccauccuccacaccgucgaggacgucgaccucgccuuccuccgcucccccgaggacauccagcacgacaagaaggccuuccucaacgacuccgagugggagcuccucuccgucuccuccaccuacuccauccuccaguccuccgccggcggcuucgcccagauccaguucaacgucgucaugcgccgccacccccucgucuacgucgucucccuccucauccccuccaucuuccucaugcucgucgaccucggcuccuucuaccucccccccaacugccgcgcccgcaucgucuucaagaccuccguccucgucggcuacaccgucuuccgcgucaacauguccaaccaggucccccgcuccgucggcuccaccccccucaucggccacuucuucaccaucugcauggccuuccucguccucucccucgccaaguccaucguccucgucaaguuccuccacgacgagcagcgcggcggccaggagcagcccuuccucugccuccgcggcgacaccgacgccgaccgcccccgcgucgagccccgcgcccagcgcgccgucgucaccgaguccucccucuacggcgagcaccucgcccagcccggcacccucaaggaggucuggucccagcuccaguccaucuccaacuaccuccagacccaggaccagaccgaccagcaggaggccgaguggcucguccuccucucccgcuucgaccgccuccucuuccaguccuaccucuucaugcucggcaucuacaccaucacccucugcucccucugggcccucuggggcggcgucuga

SEQ ID NO: 44416 - RNA, 1344 nt, Artificial Sequence
  derived and/or modified sequence opt2 from HTR3C__Homo_sapiens__NP_570126
auggagggcggcuggcccgcccgccaguccgcccuccucugccucaccgucucccuccuccuccagggccgcggcgacgccuucaccaucaacugcuccggcuucgaccagcacggcgucgaccccgccgucuuccaggccgucuucgaccgcaaggccuuccgccccuucaccaacuacuccauccccacccgcgucaacaucuccuucacccucuccgccauccucggcgucgacgcccagcuccagcuccucaccuccuuccucuggauggaccucgucugggacaaccccuucaucaacuggaaccccaaggagugcgucggcaucaacaagcucaccguccucgccgagaaccucuggcuccccgacaucuucaucgucgaguccauggacgucgaccagacccccuccggccucaccgccuacaucuccuccgagggccgcaucaaguacgacaagcccaugcgcgucaccuccaucugcaaccucgacaucuucuacuuccccuucgaccagcagaacugcaccuucaccuucuccuccuuccucuacaccgucgacuccaugcuccucggcauggacaaggaggucugggagaucaccgacaccucccgcaaggucauccagacccagggcgagugggagcuccucggcaucaacaaggccacccccaagauguccaugggcaacaaccucuacgaccagaucauguucuacgucgccauccgccgccgccccucccucuacaucaucaaccuccucguccccuccuccuuccucgucgccaucgacgcccucuccuucuaccuccccgccgaguccgagaaccgcgcccccuucaagaucacccuccuccucggcuacaacgucuuccuccucaugaugaacgaccuccuccccgccuccggcaccccccucaucuccgucuacuucgcccucugccucucccucauggucgucucccuccucgagaccgucuucaucaccuaccuccuccacgucgccaccacccagcccccccccaugccccgcuggcuccacucccuccuccuccacugcaccucccccggccgcugcugccccaccgccccccagaagggcaacaagggccucggccucacccucacccaccuccccggccccaaggagcccggcgagcucgccggcaagaagcucggcccccgcgagaccgagcccgacggcggcuccggcuggaccaagacccagcucauggagcucuggguccaguucucccacgccauggacacccuccucuuccgccucuaccuccucuucauggccuccuccauccucaccgucaucguccucuggaacaccuga

SEQ ID NO: 44417 - RNA, 1215 nt, Artificial Sequence
  derived and/or modified sequence opt2 from HTR3D__Homo_sapiens__NP_001138615
auggagcgcggcugguuccacggcaagggcuuccuccucggcuucauccuccaccuccuccuccaggacucccaccuccagcucgucaccuccuuccucuggcucaacauguggaaccccgacgagugcggcggcaucaagaaguccggcauggccaccgagaaccucuggcucuccgacgucuucaucgaggaguccgucgaccagacccccgccggccucauggccuccauguccaucgucaaggccaccuccaacaccaucucccagugcggcugguccgccuccgccaacuggacccccuccaucucccccuccauggaccgcggcgagcgcucccccuccgcccucucccccacccaggucacccgcgccuggcgccgcaugucccgcuccuuccagauccaccaccgcaccuccuuccgcacccgccgcgaguggguccuccucggcauccagaagcgcaccaucaaggucaccgucgccaccaaccaguacgagcaggccaucuuccacgucgccauccgccgccgcugccgccccucccccuacgucgucaacuuccucguccccuccggcauccucaucgccaucgacgcccucuccuucuaccucccccucgaguccggcaacugcgcccccuucaagaugaccguccuccucggcuacuccgucuuccuccucaugaugaacgaccuccuccccgccaccuccaccuccucccacgccucccucguccgcccccaccccucccgcgaccagaagcgcggcgucuacuucgcccucugccucucccucauggucggcucccuccucgagaccaucuucaucacccaccuccuccacgucgccaccacccagccccucccccucccccgcuggcuccacucccuccuccuccacugcaccggccagggccgcugcugccccaccgccccccagaagggcaacaagggccccggccucacccccacccaccuccccggcgucaaggagcccgaggucuccgccggccagaugcccggccccggcgaggccgagcucaccggcggcuccgaguggacccgcgcccagcgcgagcacgaggcccagaagcagcacuccgucgagcucuggguccaguucucccacgccauggacgcccuccucuuccgccucuaccuccucuucauggccuccuccaucaucaccgucaucugccucuggaacaccuga

SEQ ID NO: 44418 - RNA, 1371 nt, Artificial Sequence
  derived and/or modified sequence opt2 from HTR3E__Homo_sapiens__NP_001243542
auggagggcuccugguuccaccgcaagcgcuucuccuucuaccuccuccucggcuuccuccuccagggccgcggcgucaccuucaccaucaacugcuccggcuucggccagcacggcgccgaccccaccgcccucaacuccgucuucaaccgcaagcccuuccgccccgucaccaacaucuccguccccacccaggucaacaucuccuucgccauguccgccauccucgacgucaacgagcagcuccaccuccucuccuccuuccucuggcucgagauggucugggacaaccccuucaucuccuggaaccccgaggagugcgagggcaucaccaagauguccauggccgccaagaaccucuggcuccccgacaucuucaucaucgagcucauggacgucgacaagacccccaagggccucaccgccuacgucuccaacgagggccgcauccgcuacaagaagcccaugaaggucgacuccaucugcaaccucgacaucuucuacuuccccuucgaccagcagaacugcacccucaccuucuccuccuuccucuacaccgucgacuccaugcuccucgacauggagaaggaggucugggagaucaccgacgccucccgcaacauccuccagacccacggcgagugggagcuccucggccucuccaaggccaccgccaagcucucccgcggcggcaaccucuacgaccagaucgucuucuacgucgccauccgccgccgccccucccucuacgucaucaaccuccucguccccuccggcuuccucgucgccaucgacgcccucuccuucuaccuccccgucaaguccggcaaccgcguccccuucaagaucacccuccuccucggcuacaacgucuuccuccucaugauguccgaccuccuccccaccuccggcaccccccucaucggcgucuacuucgcccucugccucucccucauggucggcucccuccucgagaccaucuucaucacccaccuccuccacgucgccaccacccagccccccccccucccccgcuggcuccacucccuccuccuccacugcaacucccccggccgcugcugccccaccgccccccagaaggagaacaagggccccggccucacccccacccaccuccccggcgucaaggagcccgaggucuccgccggccagaugcccggccccgccgaggccgagcucaccggcggcuccgaguggacccgcgcccagcgcgagcacgaggcccagaagcagcacuccgucgagcucuggcuccaguucucccacgccauggacgccaugcucuuccgccucuaccuccucuucauggccuccuccaucaucaccgucaucugccucuggaacaccuga

SEQ ID NO: 44419 - RNA, 1167 nt, Artificial Sequence
  derived and/or modified sequence opt2 from HTR4__Homo_sapiens__NP_000861
auggacaagcucgacgccaacgucuccuccgaggagggcuucggcuccgucgagaaggucguccuccucaccuuccucuccaccgucauccucauggccauccucggcaaccuccucgucauggucgccgucugcugggaccgccagcuccgcaagaucaagaccaacuacuucaucgucucccucgccuucgccgaccuccucgucuccguccucgucaugcccuucggcgccaucgagcucguccaggacaucuggaucuacggcgaggucuucugccucguccgcaccucccucgacguccuccucaccaccgccuccaucuuccaccucugcugcaucucccucgaccgcuacuacgccaucugcugccagccccucgucuaccgcaacaagaugaccccccuccgcaucgcccucaugcucggcggcugcugggucauccccaccuucaucuccuuccuccccaucaugcagggcuggaacaacaucggcaucaucgaccucaucgagaagcgcaaguucaaccagaacuccaacuccaccuacugcgucuucauggucaacaagcccuacgccaucaccugcuccgucgucgccuucuacauccccuuccuccucaugguccucgccuacuaccgcaucuacgucaccgccaaggagcacgcccaccagauccagaugcuccagcgcgccggcgccuccuccgagucccgcccccaguccgccgaccagcacuccacccaccgcaugcgcaccgagaccaaggccgccaagacccucugcaucaucaugggcugcuucugccucugcugggcccccuucuucgucaccaacaucgucgaccccuucaucgacuacaccguccccggccaggucuggaccgccuuccucuggcucggcuacaucaacuccggccucaaccccuuccucuacgccuuccucaacaaguccuuccgccgcgccuuccucaucauccucugcugcgacgacgagcgcuaccgccgccccuccauccucggccagaccguccccugcuccaccaccaccaucaacggcuccacccacguccuccgcgacgccgucgagugcggcggccagugggagucccagugccacccccccgccaccuccccccucgucgccgcccagcccuccgacaccuga

SEQ ID NO: 44420 - RNA, 1074 nt, Artificial Sequence
  derived and/or modified sequence opt2 from HTR5A__Homo_sapiens__NP_076917
auggaccuccccgucaaccucaccuccuucucccucuccacccccuccccccucgagaccaaccacucccucggcaaggacgaccuccgccccuccuccccccuccucuccgucuucggcguccucauccucacccuccucggcuuccucgucgccgccaccuucgccuggaaccuccucguccucgccaccauccuccgcguccgcaccuuccaccgcgucccccacaaccucgucgccuccauggccgucuccgacguccucgucgccgcccucgucaugccccucucccucguccacgagcucuccggccgccgcuggcagcucggccgccgccucugccagcucuggaucgccugcgacguccucugcugcaccgccuccaucuggaacgucaccgccaucgcccucgaccgcuacugguccaucacccgccacauggaguacacccuccgcacccgcaagugcgucuccaacgucaugaucgcccucaccugggcccucuccgccgucaucucccucgccccccuccucuucggcuggggcgagaccuacuccgagggcuccgaggagugccaggucucccgcgagcccuccuacgccgucuucuccaccgucggcgccuucuaccucccccucugcgucguccucuucgucuacuggaagaucuacaaggccgccaaguuccgcgucggcucccgcaagaccaacuccgucucccccaucuccgaggccgucgaggucaaggacuccgccaagcagccccagauggucuucaccguccgccacgccaccgucaccuuccagcccgagggcgacaccuggcgcgagcagaaggagcagcgcgccgcccucauggucggcauccucaucggcgucuucguccucugcuggauccccuucuuccucaccgagcucaucuccccccucugcuccugcgacauccccgccaucuggaaguccaucuuccucuggcucggcuacuccaacuccuucuucaacccccucaucuacaccgccuucaacaagaacuacaacuccgccuucaagaacuucuucucccgccagcacuga

SEQ ID NO: 44421 - RNA, 1338 nt, Artificial Sequence
  derived and/or modified sequence opt2 from HTR7__Homo_sapiens__NP_000863
augauggacgucaacuccuccggccgccccgaccucuacggccaccuccgcuccuuccuccuccccgaggucggccgcggccuccccgaccucucccccgacggcggcgccgaccccgucgccggcuccugggccccccaccuccucuccgaggucaccgccucccccgcccccaccugggacgccccccccgacaacgccuccggcugcggcgagcagaucaacuacggccgcgucgagaaggucgucaucggcuccauccucacccucaucacccuccucaccaucgccggcaacugccucgucgucaucuccgucugcuucgucaagaagcuccgccagcccuccaacuaccucaucgucucccucgcccucgccgaccucuccgucgccgucgccgucaugcccuucgucuccgucaccgaccucaucggcggcaaguggaucuucggccacuucuucugcaacgucuucaucgccauggacgucaugugcugcaccgccuccaucaugacccucugcgucaucuccaucgaccgcuaccucggcaucacccgcccccucaccuaccccguccgccagaacggcaagugcauggccaagaugauccucuccgucuggcuccucuccgccuccaucacccuccccccccucuucggcugggcccagaacgucaacgacgacaaggucugccucaucucccaggacuucggcuacaccaucuacuccaccgccgucgccuucuacauccccauguccgucaugcucuucauguacuaccagaucuacaaggccgcccgcaaguccgccgccaagcacaaguuccccggcuucccccgcgucgagcccgacuccgucaucgcccucaacggcaucgucaagcuccagaaggaggucgaggagugcgccaaccucucccgccuccucaagcacgagcgcaagaacaucuccaucuucaagcgcgagcagaaggccgccaccacccucggcaucaucgucggcgccuucaccgucugcuggcuccccuucuuccuccucuccaccgcccgccccuucaucugcggcaccuccugcuccugcaucccccucugggucgagcgcaccuuccucuggcucggcuacgccaacucccucaucaaccccuucaucuacgccuucuucaaccgcgaccuccgcaccaccuaccgcucccuccuccagugccaguaccgcaacaucaaccgcaagcucuccgccgccggcaugcacgaggcccucaagcucgccgagcgccccgagcgccccgaguucguccuccagaacgccgacuacugccgcaagaagggccacgacuccuga

SEQ ID NO: 44422 - RNA, 1443 nt, Artificial Sequence
  derived and/or modified sequence opt2 from HTRA1__Homo_sapiens__NP_002766
augcagaucccccgcgccgcccuccucccccuccuccuccuccuccucgccgcccccgccuccgcccagcucucccgcgccggccgcuccgccccccucgccgccggcugccccgaccgcugcgagcccgcccgcugccccccccagcccgagcacugcgagggcggccgcgcccgcgacgccugcggcugcugcgaggucugcggcgcccccgagggcgccgccugcggccuccaggagggccccugcggcgagggccuccagugcgucguccccuucggcguccccgccuccgccaccguccgccgccgcgcccaggccggccucugcgucugcgccuccuccgagcccgucugcggcuccgacgccaacaccuacgccaaccucugccagcuccgcgccgccucccgccgcuccgagcgccuccaccgcccccccgucaucguccuccagcgcggcgccugcggccagggccaggaggaccccaacucccuccgccacaaguacaacuucaucgccgacgucgucgagaagaucgcccccgccgucguccacaucgagcucuuccgcaagcuccccuucuccaagcgcgagguccccgucgccuccggcuccggcuucaucgucuccgaggacggccucaucgucaccaacgcccacgucgucaccaacaagcaccgcgucaaggucgagcucaagaacggcgccaccuacgaggccaagaucaaggacgucgacgagaaggccgacaucgcccucaucaagaucgaccaccagggcaagcuccccguccuccuccucggccgcuccuccgagcuccgccccggcgaguucgucgucgccaucggcucccccuucucccuccagaacaccgucaccaccggcaucgucuccaccacccagcgcggcggcaaggagcucggccuccgcaacuccgacauggacuacauccagaccgacgccaucaucaacuacggcaacuccggcggcccccucgucaaccucgacggcgaggucaucggcaucaacacccucaaggucaccgccggcaucuccuucgccauccccuccgacaagaucaagaaguuccucaccgagucccacgaccgccaggccaagggcaaggccaucaccaagaagaaguacaucggcauccgcaugaugucccucaccuccuccaaggccaaggagcucaaggaccgccaccgcgacuuccccgacgucaucuccggcgccuacaucaucgaggucauccccgacacccccgccgaggccggcggccucaaggagaacgacgucaucaucuccaucaacggccaguccgucgucuccgccaacgacgucuccgacgucaucaagcgcgaguccacccucaacauggucguccgccgcggcaacgaggacaucaugaucaccgucauccccgaggagaucgaccccuga

SEQ ID NO: 44423 - RNA, 1377 nt, Artificial Sequence
  derived and/or modified sequence opt2 from HTRA2__Homo_sapiens__NP_037379
auggccgccccccgcgccggccgcggcgccggcuggucccuccgcgccuggcgcgcccucggcggcauccgcuggggccgccgcccccgccucacccccgaccuccgcgcccuccucaccuccggcaccuccgacccccgcgcccgcgucaccuacggcacccccucccucugggcccgccucuccgucggcgucaccgagccccgcgccugccucaccuccggcacccccggcccccgcgcccagcucaccgccgucacccccgacacccgcacccgcgaggccuccgagaacuccggcacccgcucccgcgccuggcucgccgucgcccucggcgccggcggcgccguccuccuccuccucuggggcggcggccgcggcccccccgccguccucgccgccguccccucccccccccccgccuccccccgcucccaguacaacuucaucgccgacgucgucgagaagaccgcccccgccgucgucuacaucgagauccucgaccgccaccccuuccucggccgcgagguccccaucuccaacggcuccggcuucgucgucgccgccgacggccucaucgucaccaacgcccacgucgucgccgaccgccgccgcguccgcguccgccuccucuccggcgacaccuacgaggccgucgucaccgccgucgaccccgucgccgacaucgccacccuccgcauccagaccaaggagccccuccccacccucccccucggccgcuccgccgacguccgccagggcgaguucgucgucgccaugggcucccccuucgcccuccagaacaccaucaccuccggcaucgucuccuccgcccagcgccccgcccgcgaccucggccucccccagaccaacgucgaguacauccagaccgacgccgccaucgacuucggcaacuccggcggcccccucgucaaccucgacggcgaggucaucggcgucaacaccaugaaggucaccgccggcaucuccuucgccauccccuccgaccgccuccgcgaguuccuccaccgcggcgagaagaagaacuccuccuccggcaucuccggcucccagcgccgcuacaucggcgucaugaugcucacccucucccccuccauccucgccgagcuccagcuccgcgagcccuccuuccccgacguccagcacggcguccucauccacaaggucauccucggcucccccgcccaccgcgccggccuccgccccggcgacgucauccucgccaucggcgagcagaugguccagaacgccgaggacgucuacgaggccguccgcacccagucccagcucgccguccagauccgccgcggccgcgagacccucacccucuacgucacccccgaggucaccgaguga

SEQ ID NO: 44424 - RNA, 1074 nt, Artificial Sequence
  derived and/or modified sequence opt2 from HTRA3__Homo_sapiens__NP_001284488
augcaggcccgcgcccuccuccucgccgcccucgccgcccucgcccucgcccgcgagccccccgccgcccccugccccgcccgcugcgacgucucccgcugccccuccccccgcugccccggcggcuacguccccgaccucugcaacugcugccucgucugcgccgccuccgagggcgagcccugcggcggcccccucgacucccccugcggcgagucccucgagugcguccgcggccucugccgcugccgcuggucccacgccgucugcggcaccgacggccacaccuacgccaacgucugcgcccuccaggccgccucccgccgcgcccuccagcucuccggcacccccguccgccagcuccagaagggcgccugcccccucggccuccaccagcucuccuccccccgcuacaaguucaacuucaucgccgacgucgucgagaagaucgcccccgccgucguccacaucgagcucuuccuccgccacccccucuucggccgcaacgucccccucuccuccggcuccggcuucaucauguccgaggccggccucaucaucaccaacgcccacgucgucuccuccaacuccgccgcccccggccgccagcagcucaagguccagcuccagaacggcgacuccuacgaggccaccaucaaggacaucgacaagaaguccgacaucgccaccaucaagauccaccccaagaagaagcuccccguccuccuccucggccacuccgccgaccuccgccccggcgaguucgucgucgccaucggcucccccuucgcccuccagaacaccgucaccaccggcaucgucuccaccgcccagcgcgagggccgcgagcucggccuccgcgacuccgacauggacuacauccagaccgacgccaucaucaacuacggcaacuccggcggcccccucgucaaccucgacggcgaggucaucggcaucaacacccucaaggucaccgccggcaucuccuucgccauccccuccgaccgcaucacccgcuuccucaccgaguuccaggacaagcagaucaaggcccccucccucgccguccacuga

SEQ ID NO: 44425 - RNA, 1431 nt, Artificial Sequence
  derived and/or modified sequence opt2 from HTRA4__Homo_sapiens__NP_710159
augauccgcccccagcuccgcaccgccggccucggccgcugccuccuccccggccuccuccuccuccucguccccguccucugggccggcgccgagaagcuccacacccagcccuccugccccgccgucugccagcccacccgcugccccgcccuccccaccugcgcccucggcaccacccccgucuucgaccucugccgcugcugccgcgucugccccgccgccgagcgcgaggucugcggcggcgcccagggccagcccugcgcccccggccuccagugccuccagccccuccgccccggcuuccccuccaccugcggcugccccacccucggcggcgccgucugcggcuccgaccgccgcaccuaccccuccaugugcgcccuccgcgccgagaaccgcgccgcccgccgccucggcaagguccccgccguccccguccaguggggcaacugcggcgacaccggcacccgcuccgccggcccccuccgccgcaacuacaacuucaucgccgccgucgucgagaaggucgcccccuccgucguccacguccagcucuggggccgccuccuccacggcucccgccucguccccgucuacuccggcuccggcuucaucgucuccgaggacggccucaucaucaccaacgcccacgucguccgcaaccagcaguggaucgaggucguccuccagaacggcgcccgcuacgaggccgucgucaaggacaucgaccucaagcucgaccucgccgucaucaagaucgaguccaacgccgagcuccccguccucaugcucggccgcuccuccgaccuccgcgccggcgaguucgucgucgcccucggcucccccuucucccuccagaacaccgccaccgccggcaucgucuccaccaagcagcgcggcggcaaggagcucggcaugaaggacuccgacauggacuacguccagaucgacgccaccaucaacuacggcaacuccggcggcccccucgucaaccucgacggcgacgucaucggcgucaacucccuccgcgucaccgacggcaucuccuucgccauccccuccgaccgcguccgccaguuccucgccgaguaccacgagcaccagaugaagggcaaggccuucuccaacaagaaguaccucggccuccagaugcucucccucaccgucccccucuccgaggagcucaagaugcacuaccccgacuuccccgacgucuccuccggcgucuacgucugcaaggucgucgagggcaccgccgcccaguccuccggccuccgcgaccacgacgucaucgucaacaucaacggcaagcccaucaccaccaccaccgacgucgucaaggcccucgacuccgacucccucuccauggccguccuccgcggcaaggacaaccuccuccucaccgucauccccgagaccaucaacuga

SEQ ID NO: 44426 - RNA, 9435 nt, Artificial Sequence
  derived and/or modified sequence opt2 from HTT__Homo_sapiens__NP_002102
auggccacccucgagaagcucaugaaggccuucgagucccucaaguccuuccagcagcagcagcagcagcagcagcagcagcagcagcagcagcagcagcagcagcagcagcagcagcagccccccccccccccccccccccccccccccccccagcucccccagccccccccccaggcccagccccuccucccccagccccagccccccccccccccccccccccccccccccggccccgccgucgccgaggagccccuccaccgccccaagaaggagcucuccgccaccaagaaggaccgcgucaaccacugccucaccaucugcgagaacaucgucgcccaguccguccgcaacucccccgaguuccagaagcuccucggcaucgccauggagcucuuccuccucugcuccgacgacgccgaguccgacguccgcauggucgccgacgagugccucaacaaggucaucaaggcccucauggacuccaaccucccccgccuccagcucgagcucuacaaggagaucaagaagaacggcgccccccgcucccuccgcgccgcccucuggcgcuucgccgagcucgcccaccucguccgcccccagaagugccgccccuaccucgucaaccuccuccccugccucacccgcaccuccaagcgccccgaggaguccguccaggagacccucgccgccgccguccccaagaucauggccuccuucggcaacuucgccaacgacaacgagaucaagguccuccucaaggccuucaucgccaaccucaaguccuccucccccaccauccgccgcaccgccgccggcuccgccgucuccaucugccagcacucccgccgcacccaguacuucuacuccuggcuccucaacguccuccucggccuccucguccccgucgaggacgagcacuccacccuccucauccucggcguccuccucacccuccgcuaccucgucccccuccuccagcagcaggucaaggacaccucccucaagggcuccuucggcgucacccgcaaggagauggaggucucccccuccgccgagcagcucguccaggucuacgagcucacccuccaccacacccagcaccaggaccacaacgucgucaccggcgcccucgagcuccuccagcagcucuuccgcacccccccccccgagcuccuccagacccucaccgccgucggcggcaucggccagcucaccgccgccaaggaggaguccggcggccgcucccgcuccggcuccaucgucgagcucaucgccggcggcggcuccuccugcucccccguccucucccgcaagcagaagggcaagguccuccucggcgaggaggaggcccucgaggacgacuccgagucccgcuccgacgucuccuccuccgcccucaccgccuccgucaaggacgagaucuccggcgagcucgccgccuccuccggcgucuccacccccggcuccgccggccacgacaucaucaccgagcagccccgcucccagcacacccuccaggccgacuccgucgaccucgccuccugcgaccucaccuccuccgccaccgacggcgacgaggaggacauccucucccacuccuccucccaggucuccgccguccccuccgaccccgccauggaccucaacgacggcacccaggccuccucccccaucuccgacuccucccagaccaccaccgagggccccgacuccgccgucacccccuccgacuccuccgagaucguccucgacggcaccgacaaccaguaccucggccuccagaucggccagccccaggacgaggacgaggaggccaccggcauccuccccgacgaggccuccgaggccuuccgcaacuccuccauggcccuccagcaggcccaccuccucaagaacaugucccacugccgccagcccuccgacuccuccgucgacaaguucguccuccgcgacgaggccaccgagcccggcgaccaggagaacaagcccugccgcaucaagggcgacaucggccaguccaccgacgacgacuccgccccccucguccacugcguccgccuccucuccgccuccuuccuccucaccggcggcaagaacguccucguccccgaccgcgacguccgcgucuccgucaaggcccucgcccucuccugcgucggcgccgccgucgcccuccaccccgaguccuucuucuccaagcucuacaaggucccccucgacaccaccgaguaccccgaggagcaguacgucuccgacauccucaacuacaucgaccacggcgacccccagguccgcggcgccaccgccauccucugcggcacccucaucugcuccauccucucccgcucccgcuuccacgucggcgacuggaugggcaccauccgcacccucaccggcaacaccuucucccucgccgacugcaucccccuccuccgcaagacccucaaggacgaguccuccgucaccugcaagcucgccugcaccgccguccgcaacugcgucaugucccucugcuccuccuccuacuccgagcucggccuccagcucaucaucgacguccucacccuccgcaacuccuccuacuggcucguccgcaccgagcuccucgagacccucgccgagaucgacuuccgccucgucuccuuccucgaggccaaggccgagaaccuccaccgcggcgcccaccacuacaccggccuccucaagcuccaggagcgcguccucaacaacgucgucauccaccuccucggcgacgaggacccccgcguccgccacgucgccgccgccucccucauccgccucguccccaagcucuucuacaagugcgaccagggccaggccgaccccgucgucgccgucgcccgcgaccaguccuccgucuaccucaagcuccucaugcacgagacccagccccccucccacuucuccgucuccaccaucacccgcaucuaccgcggcuacaaccuccuccccuccaucaccgacgucaccauggagaacaaccucucccgcgucaucgccgccgucucccacgagcucaucaccuccaccacccgcgcccucaccuucggcugcugcgaggcccucugccuccucuccaccgccuuccccgucugcaucuggucccucggcuggcacugcggcguccccccccucuccgccuccgacgagucccgcaaguccugcaccgucggcauggccaccaugauccucacccuccucuccuccgccugguucccccucgaccucuccgcccaccaggacgcccucauccucgccggcaaccuccucgccgccuccgcccccaagucccuccgcuccuccugggccuccgaggaggaggccaaccccgccgccaccaagcaggaggaggucuggcccgcccucggcgaccgcgcccucguccccauggucgagcagcucuucucccaccuccucaaggucaucaacaucugcgcccacguccucgacgacgucgcccccggccccgccaucaaggccgcccuccccucccucaccaacccccccucccucucccccauccgccgcaagggcaaggagaaggagcccggcgagcaggccuccgucccccucucccccaagaagggcuccgaggccuccgccgccucccgccaguccgacaccuccggccccgucaccaccuccaaguccuccucccucggcuccuucuaccaccuccccuccuaccucaagcuccacgacguccucaaggccacccacgccaacuacaaggucacccucgaccuccagaacuccaccgagaaguucggcggcuuccuccgcuccgcccucgacguccucucccagauccucgagcucgccacccuccaggacaucggcaagugcgucgaggagauccucggcuaccucaaguccugcuucucccgcgagcccaugauggccaccgucugcguccagcagcuccucaagacccucuucggcaccaaccucgccucccaguucgacggccucuccuccaaccccuccaagucccagggccgcgcccagcgccucggcuccuccuccguccgccccggccucuaccacuacugcuucauggcccccuacacccacuucacccaggcccucgccgacgccucccuccgcaacaugguccaggccgagcaggagaacgacaccuccggcugguucgacguccuccagaaggucuccacccagcucaagaccaaccucaccuccgucaccaagaaccgcgccgacaagaacgccauccacaaccacauccgccucuucgagccccucgucaucaaggcccucaagcaguacaccaccaccaccugcguccagcuccagaagcagguccucgaccuccucgcccagcucguccagcuccgcgucaacuacugccuccucgacuccgaccaggucuucaucggcuucguccucaagcaguucgaguacaucgaggucggccaguuccgcgaguccgaggccaucauccccaacaucuucuucuuccucguccuccucuccuacgagcgcuaccacuccaagcagaucaucggcauccccaagaucauccagcucugcgacggcaucauggccuccggccgcaaggccgucacccacgccauccccgcccuccagcccaucguccacgaccucuucguccuccgcggcaccaacaaggccgacgccggcaaggagcucgagacccagaaggaggucgucgucuccaugcuccuccgccucauccaguaccaccagguccucgagauguucauccucguccuccagcagugccacaaggagaacgaggacaaguggaagcgccucucccgccagaucgccgacaucauccuccccaugcucgccaagcagcagaugcacaucgacucccacgaggcccucggcguccucaacacccucuucgagauccucgcccccuccucccuccgccccgucgacaugcuccuccgcuccauguucgucacccccaacaccauggccuccgucuccaccguccagcucuggaucuccggcauccucgccauccuccgcguccucaucucccaguccaccgaggacaucguccucucccgcauccaggagcucuccuucucccccuaccucaucuccugcaccgucaucaaccgccuccgcgacggcgacuccaccuccacccucgaggagcacuccgagggcaagcagaucaagaaccuccccgaggagaccuucucccgcuuccuccuccagcucgucggcauccuccucgaggacaucgucaccaagcagcucaaggucgagauguccgagcagcagcacaccuucuacugccaggagcucggcacccuccucaugugccucauccacaucuucaaguccggcauguuccgccgcaucaccgccgccgccacccgccucuuccgcuccgacggcugcggcggcuccuucuacacccucgacucccucaaccuccgcgcccgcuccaugaucaccacccaccccgcccucguccuccucuggugccagauccuccuccucgucaaccacaccgacuaccgcuggugggccgagguccagcagacccccaagcgccacucccucuccuccaccaagcuccucuccccccagauguccggcgaggaggaggacuccgaccucgccgccaagcucggcaugugcaaccgcgagaucguccgccgcggcgcccucauccucuucugcgacuacgucugccagaaccuccacgacuccgagcaccucaccuggcucaucgucaaccacauccaggaccucaucucccucucccacgagccccccguccaggacuucaucuccgccguccaccgcaacuccgccgccuccggccucuucauccaggccauccagucccgcugcgagaaccucuccacccccaccaugcucaagaagacccuccagugccucgagggcauccaccucucccaguccggcgccguccucacccucuacgucgaccgccuccucugcacccccuuccgcguccucgcccgcauggucgacauccucgccugccgccgcgucgagaugcuccucgccgccaaccuccaguccuccauggcccagcuccccauggaggagcucaaccgcauccaggaguaccuccaguccuccggccucgcccagcgccaccagcgccucuacucccuccucgaccgcuuccgccucuccaccaugcaggacucccucucccccuccccccccgucuccucccacccccucgacggcgacggccacgucucccucgagaccgucucccccgacaaggacugguacguccaccucgucaagucccagugcuggacccgcuccgacuccgcccuccucgagggcgccgagcucgucaaccgcauccccgccgaggacaugaacgccuucaugaugaacuccgaguucaaccucucccuccucgcccccugccucucccucggcauguccgagaucuccggcggccagaaguccgcccucuucgaggccgcccgcgaggucacccucgcccgcgucuccggcaccguccagcagcuccccgccguccaccacgucuuccagcccgagcuccccgccgagcccgccgccuacugguccaagcucaacgaccucuucggcgacgccgcccucuaccagucccuccccacccucgcccgcgcccucgcccaguaccucgucgucgucuccaagcuccccucccaccuccaccucccccccgagaaggagaaggacaucgucaaguucgucgucgccacccucgaggcccucuccuggcaccucauccacgagcagaucccccucucccucgaccuccaggccggccucgacugcugcugccucgcccuccagcuccccggccucugguccgucgucuccuccaccgaguucgucacccacgccugcucccucaucuacugcguccacuucauccucgaggccgucgccguccagcccggcgagcagcuccucucccccgagcgccgcaccaacacccccaaggccaucuccgaggaggaggaggaggucgaccccaacacccagaaccccaaguacaucaccgccgccugcgagauggucgccgagauggucgagucccuccaguccguccucgcccucggccacaagcgcaacuccggcguccccgccuuccucaccccccuccuccgcaacaucaucaucucccucgcccgccucccccucgucaacuccuacacccgcguccccccccucgucuggaagcucggcuggucccccaagcccggcggcgacuucggcaccgccuuccccgagauccccgucgaguuccuccaggagaaggaggucuucaaggaguucaucuaccgcaucaacacccucggcuggaccucccgcacccaguucgaggagaccugggccacccuccucggcguccucgucacccagccccucgucauggagcaggaggaguccccccccgaggaggacaccgagcgcacccagaucaacguccucgccguccaggccaucaccucccucguccucuccgccaugaccguccccgucgccggcaaccccgccgucuccugccucgagcagcagccccgcaacaagccccucaaggcccucgacacccgcuucggccgcaagcucuccaucauccgcggcaucgucgagcaggagauccaggccauggucuccaagcgcgagaacaucgccacccaccaccucuaccaggccugggaccccguccccucccucucccccgccaccaccggcgcccucaucucccacgagaagcuccuccuccagaucaaccccgagcgcgagcucggcuccauguccuacaagcucggccaggucuccauccacuccgucuggcucggcaacuccaucaccccccuccgcgaggaggagugggacgaggaggaggaggaggaggccgacgcccccgcccccuccuccccccccaccucccccgucaacucccgcaagcaccgcgccggcgucgacauccacuccugcucccaguuccuccucgagcucuacucccgcuggauccuccccuccuccuccgcccgccgcacccccgccauccucaucuccgaggucguccgcucccuccucgucgucuccgaccucuucaccgagcgcaaccaguucgagcucauguacgucacccucaccgagcuccgccgcguccaccccuccgaggacgagauccucgcccaguaccucguccccgccaccugcaaggccgccgccguccucggcauggacaaggccgucgccgagcccgucucccgccuccucgaguccacccuccgcuccucccaccuccccucccgcgucggcgcccuccacggcguccucuacguccucgagugcgaccuccucgacgacaccgccaagcagcucauccccgucaucuccgacuaccuccucuccaaccucaagggcaucgcccacugcgucaacauccacucccagcagcacguccucgucaugugcgccaccgccuucuaccucaucgagaacuacccccucgacgucggccccgaguucuccgccuccaucauccagaugugcggcgucaugcucuccggcuccgaggaguccacccccuccaucaucuaccacugcgcccuccgcggccucgagcgccuccuccucuccgagcagcucucccgccucgacgccgagucccucgucaagcucuccgucgaccgcgucaacguccacuccccccaccgcgccauggccgcccucggccucaugcucaccugcauguacaccggcaaggagaaggucucccccggccgcaccuccgaccccaaccccgccgcccccgacuccgaguccgucaucgucgccauggagcgcgucuccguccucuucgaccgcauccgcaagggcuuccccugcgaggcccgcgucgucgcccgcauccucccccaguuccucgacgacuucuuccccccccaggacaucaugaacaaggucaucggcgaguuccucuccaaccagcagcccuacccccaguucauggccaccgucgucuacaaggucuuccagacccuccacuccaccggccaguccuccaugguccgcgacugggucaugcucucccucuccaacuucacccagcgcgcccccgucgccauggccaccuggucccucuccugcuucuucgucuccgccuccaccucccccugggucgccgccauccucccccacgucaucucccgcaugggcaagcucgagcaggucgacgucaaccucuucugccucgucgccaccgacuucuaccgccaccagaucgaggaggagcucgaccgccgcgccuuccaguccguccucgaggucgucgccgcccccggcucccccuaccaccgccuccucaccugccuccgcaacguccacaaggucaccaccugcuga

SEQ ID NO: 44427 - RNA, 2145 nt, Artificial Sequence
  derived and/or modified sequence opt2 from HUNK__Homo_sapiens__NP_055401
augcccgccgccgccggcgacggccuccucggcgagcccgccgcccccggcggcggcggcggcgccgaggacgccgcccgccccgccgccgccugcgagggcuccuuccuccccgccugggucuccggcgucccccgcgagcgccuccgcgacuuccagcaccacaagcgcgucggcaacuaccucaucggcucccgcaagcucggcgagggcuccuucgccaagguccgcgagggccuccacguccucaccggcgagaaggucgccaucaaggucaucgacaagaagcgcgccaagaaggacaccuacgucaccaagaaccuccgccgcgagggccagauccagcagaugauccgccaccccaacaucacccagcuccucgacauccucgagaccgagaacuccuacuaccucgucauggagcucugccccggcggcaaccucaugcacaagaucuacgagaagaagcgccucgaggaguccgaggcccgccgcuacauccgccagcucaucuccgccgucgagcaccuccaccgcgccggcgucguccaccgcgaccucaagaucgagaaccuccuccucgacgaggacaacaacaucaagcucaucgacuucggccucuccaacugcgccggcauccucggcuacuccgaccccuucuccacccagugcggcucccccgccuacgccgcccccgagcuccucgcccgcaagaaguacggccccaagaucgacgucugguccaucggcgucaacauguacgccaugcucaccggcacccuccccuucaccgucgagcccuucucccuccgcgcccucuaccagaagauggucgacaaggagaugaacccccuccccacccagcucuccaccggcgccaucuccuuccuccgcucccuccucgagcccgaccccgucaagcgccccaacauccagcaggcccucgccaaccgcuggcucaacgagaacuacaccggcaagguccccugcaacgucaccuaccccaaccgcaucucccucgaggaccucucccccuccgucguccuccacaugaccgagaagcucggcuacaagaacuccgacgucaucaacaccguccucuccaaccgcgccugccacauccucgccaucuacuuccuccucaacaagaagcucgagcgcuaccucuccggcaaguccgacauccaggacucccucugcuacaagacccgccucuaccagaucgagaaguaccgcgcccccaaggaguccuacgaggccucccucgacaccuggacccgcgaccucgaguuccacgccguccaggacaagaagcccaaggagcaggagaagcgcggcgacuuccuccaccgccccuucuccaagaagcucgacaagaaccuccccucccacaagcagcccuccggcucccucaugacccagauccagaacaccaaggcccuccucaaggaccgcaaggccuccaaguccuccuuccccgacaaggacuccuucggcugccgcaacaucuuccgcaagaccuccgacuccaacugcgucgccuccuccuccauggaguucauccccgucccccccccccgcaccccccgcaucgucaagaagcccgagccccaccagcccggccccggcuccaccggcaucccccacaaggaggacccccucaugcucgacaugguccgcuccuucgaguccgucgaccgcgacgaccacgucgagguccucucccccucccaccacuaccgcauccucaacucccccgucucccucgcccgccgcaacuccuccgagcgcacccucucccccggccuccccuccggcuccauguccccccuccacaccccccuccaccccacccucgucuccuucgcccacgaggacaagaacuccccccccaaggaggagggccucugcugccccccccccguccccuccaacggccccaugcagccccucggcucccccaacugcgucaagucccgcggccgcuuccccaugaugggcaucggccagaugcuccgcaagcgccaccagucccuccagcccuccgccgaccgcccccucgaggccucccuccccccccuccagccccucgcccccgucaaccucgccuucgacauggccgacggcgucaagacccagugcuga

SEQ ID NO: 44428 - RNA, 837 nt, Artificial Sequence
  derived and/or modified sequence opt2 from HUS1B__Homo_sapiens__NP_683762
augaaguuccgcgccaagaucaccggcaagggcugccucgagcucuucauccacgucuccggcaccgucgcccgccucgccaaggucugcguccuccgcguccgccccgacucccucugcuucggccccgccggcuccggcggccuccacgaggcccgccucuggugcgagguccgccagggcgccuuccagcaguuccgcauggagggcgucuccgaggaccucgacgagauccaccucgagcucaccgccgagcaccucucccgcgccgcccgcuccgccgccggcgccuccucccucaagcuccagcucacccacaagcgccgccccucccucaccgucgccgucgagcucgucuccucccucggccgcgcccgcuccgucguccacgaccuccccguccgcguccucccccgccgcgucuggcgcgacugccucccccccucccuccgcgccuccgacgccuccauccgccucccccgcuggcgcacccuccgcuccaucgucgagcgcauggccaacgucggcucccacguccucgucgaggccaaccucuccggccgcaugacccucuccaucgagaccgaggucgucuccauccaguccuacuucaagaaccucggcaaccccccccaguccgccgucggcguccccgagaaccgcgaccucgaguccaugguccagguccgcgucgacaaccgcaagcuccuccaguuccucgagggccagcagauccaccccaccaccgcccucugcaacaucugggacaacacccuccuccagcucguccucguccaggaggacgucucccuccaguacuucauccccgcccucuga

SEQ ID NO: 44429 - RNA, 843 nt, Artificial Sequence
  derived and/or modified sequence opt2 from HUS1__Homo_sapiens__NP_004498
augaaguuccgcgccaagaucgucgacggcgccugccucaaccacuucacccgcaucuccaacaugaucgccaagcucgccaagaccugcacccuccgcaucucccccgacaagcucaacuucauccucugcgacaagcucgccaacggcggcgucuccauguggugcgagcucgagcaggagaacuucuucaacgaguuccagauggagggcgucuccgccgagaacaacgagaucuaccucgagcucaccuccgagaaccucucccgcgcccucaagaccgcccagaacgcccgcgcccucaagaucaagcucaccaacaagcacuuccccugccucaccgucuccgucgagcuccucuccauguccuccuccucccgcaucgucacccacgacauccccaucaaggucaucccccgcaagcucuggaaggaccuccaggagcccgucguccccgaccccgacgucuccaucuaccuccccguccucaagaccaugaaguccgucgucgagaagaugaagaacaucuccaaccaccucgucaucgaggccaaccucgacggcgagcucaaccucaagaucgagaccgagcucgucugcgucaccacccacuucaaggaccucggcaaccccccccucgccuccgaguccacccacgaggaccgcaacgucgagcacauggccgagguccacaucgacauccgcaagcuccuccaguuccucgccggccagcaggucaaccccaccaaggcccucugcaacaucgucaacaacaagaugguccacuucgaccuccuccacgaggacgucucccuccaguacuucauccccgcccucuccuga

SEQ ID NO: 44430 - RNA, 13125 nt, Artificial Sequence
  derived and/or modified sequence opt2 from HUWE1__Homo_sapiens__XP_005262022
augaaggucgaccgcaccaagcucaagaagacccccaccgaggcccccgccgacugccgcgcccucaucgacaagcucaaggucugcaacgacgagcagcuccuccucgagcuccagcagaucaagaccuggaacaucggcaagugcgagcucuaccacugggucgaccuccucgaccgcuucgacggcauccucgccgacgccggccagaccgucgagaacauguccuggaugcucgucugcgaccgccccgagcgcgagcagcucaagaugcuccuccucgccguccucaacuucaccgcccuccucaucgaguacuccuucucccgccaccucuacuccuccaucgagcaccucaccacccuccucgccuccuccgacaugcaggucguccucgccguccucaaccuccucuacgucuucuccaagcgcuccaacuacaucacccgccucggcuccgacaagcgcaccccccuccucacccgccuccagcaccucgccgaguccuggggcggcaaggagaacggcuucggccucgccgagugcugccgcgaccuccacaugaugaaguacccccccuccgccaccacccuccacuucgaguucuacgccgaccccggcgccgaggucaagaucgagaagcgcaccaccuccaacacccuccacuacauccacaucgagcagcucgacaagaucuccgagucccccuccgagaucauggagucccucaccaagauguacuccauccccaaggacaagcagaugcuccucuucacccacauccgccucgcccacggcuucuccaaccaccgcaagcgccuccaggccguccaggcccgccuccacgccaucuccauccucgucuacuccaacgcccuccaggaguccgccaacuccauccucuacaacggccucaucgaggagcucgucgacguccuccagaucaccgacaagcagcucauggagaucaaggccgccucccuccgcacccucaccuccaucguccaccucgagcgcacccccaagcucuccuccaucaucgacugcaccggcaccgccuccuaccacggcuuccuccccguccucguccgcaacugcauccaggccaugaucgaccccuccauggaccccuacccccaccaguucgccaccgcccucuucuccuuccucuaccaccucgccuccuacgacgccggcggcgaggcccucgucuccugcggcaugauggaggcccuccucaaggucaucaaguuccucggcgacgagcaggaccagaucaccuucgucacccgcgccguccgcgucgucgaccucaucaccaaccucgacauggccgccuuccagucccacuccggccucuccaucuucaucuaccgccucgagcacgaggucgaccucugccgcaaggagugccccuucgucaucaagcccaagauccagcgccccaacaccacccaggagggcgaggagauggagaccgacauggacggcguccagugcaucccccagcgcgccgcccuccucaaguccaugcucaacuuccucaagaaggccauccaggaccccgccuucuccgacggcauccgccacgucauggacggcucccuccccaccucccucaagcacaucaucuccaacgccgaguacuacggccccucccucuuccuccucgccaccgaggucgucaccgucuucgucuuccaggagcccucccuccucuccucccuccaggacaacggccucaccgacgucaugcuccacgcccuccucaucaaggacguccccgccacccgcgagguccucggcucccuccccaacgucuucuccgcccucugccucaacgcccgcggccuccaguccuucguccagugccagcccuucgagcgccucuucaagguccuccucucccccgacuaccuccccgccaugcgccgccgccgcuccuccgacccccucggcgacaccgccuccaaccucggcuccgccgucgacgagcucaugcgccaccagcccacccucaagaccgacgccaccaccgccaucaucaagcuccucgaggagaucugcaaccucggccgcgaccccaaguacaucugccagaagcccuccauccagaaggccgacggcaccgccaccgccccccccccccgcuccaaccacgccgccgaggaggccuccuccgaggacgaggaggaggaggagguccaggccaugcaguccuucaacuccacccagcagaacgagaccgagcccaaccagcaggucgucggcaccgaggagcgcauccccaucccccucauggacuacauccucaacgucaugaaguucgucgaguccauccucuccaacaacaccaccgacgaccacugccaggaguucgucaaccagaagggccuccucccccucgucaccauccucggccuccccaaccuccccaucgacuuccccaccuccgccgccugccaggccgucgccggcgucugcaaguccauccucacccucucccacgagcccaagguccuccaggagggccuccuccagcucgacuccauccucuccucccucgagccccuccaccgccccaucgagucccccggcggcuccguccuccuccgcgagcucgccugcgccggcaacgucgccgacgccacccucuccgcccaggccaccccccuccuccacgcccucaccgccgcccacgccuacaucaugauguucguccacaccugccgcgucggccaguccgagauccgcuccaucuccgucaaccaguggggcucccagcucggccucuccguccucuccaagcucucccagcucuacugcucccucgucugggaguccaccguccuccucucccucugcacccccaacucccuccccuccggcugcgaguucggccaggccgacaugcagaagcucguccccaaggacgagaaggccggcaccacccagggcggcaagcgcuccgacggcgagcaggacggcgccgccggcuccauggacgccuccacccagggccuccucgagggcaucggccucgacggcgacacccucgcccccauggagaccgacgagcccaccgccuccgacuccaagggcaaguccaagaucacccccgccauggccgcccgcaucaagcagaucaagccccuccucuccgccuccucccgccucggccgcgcccucgccgagcucuucggccuccucgucaagcucugcgucggcucccccguccgccagcgccgcucccaccacgccgccuccaccaccaccgcccccacccccgccgcccgcuccaccgccuccgcccucaccaagcuccucaccaagggccucuccuggcagcccccccccuacacccccaccccccgcuuccgccucaccuucuucaucugcuccgucggcuucaccucccccaugcucuucgacgagcgcaaguaccccuaccaccucaugcuccagaaguuccucugcuccggcggccacaacgcccucuucgagaccuucaacugggcccucuccaugggcggcaagguccccgucuccgagggccucgagcacuccgaccuccccgacggcaccggcgaguuccucgacgccuggcucaugcucgucgagaagauggucaaccccaccaccguccucgaguccccccacucccuccccgccaagcuccccggcggcguccagaacuucccccaguucuccgcccuccgcuuccucgucgucacccagaaggccgccuucaccugcaucaagaaccucuggaaccgcaagccccucaaggucuacggcggccgcauggccgaguccaugcucgccauccucugccacauccuccgcggcgagcccgucauccgcgagcgccucuccaaggagaaggagggcucccgcggcgaggaggacaccggccaggaggagggcggcucccgccgcgagccccaggucaaccagcagcagcuccagcagcucauggacaugggcuucacccgcgagcacgccauggaggcccuccucaacaccuccaccauggagcaggccaccgaguaccuccucacccaccccccccccaucaugggcggcgucguccgcgaccucuccauguccgaggaggaccagaugaugcgcgccaucgccaugucccucggccaggacauccccauggaccagcgcgccgagucccccgaggaggucgccugccgcaaggaggaggaggagcgcaaggcccgcgagaagcaggaggaggaggaggccaagugccucgagaaguuccaggacgccgacccccucgagcaggacgagcuccacaccuucaccgacaccaugcuccccggcugcuuccaccuccucgacgagcuccccgacaccgucuaccgcgucugcgaccucaucaugaccgccaucaagcgcaacggcgccgacuaccgcgacaugauccucaagcaggucgucaaccaggucugggaggccgccgacguccucaucaaggccgcccucccccucaccaccuccgacaccaagaccgucuccgaguggaucucccagauggccacccucccccaggccuccaaccucgccacccgcauccuccuccucacccuccucuucgaggagcucaagcuccccugcgccugggucgucgaguccuccggcauccucaacguccucaucaagcuccucgaggucguccagcccugccuccaggccgccaaggagcagaaggagguccagacccccaaguggaucacccccguccuccuccucaucgacuucuacgagaagaccgccaucuccuccaagcgccgcgcccagaugaccaaguaccuccaguccaacuccaacaacuggcgcugguucgacgaccgcuccggccgcuggugcuccuacuccgccuccaacaacuccaccaucgacuccgccuggaaguccggcgagaccuccguccgcuucaccgccggccgccgccgcuacaccguccaguucaccaccaugguccaggucaacgaggagaccggcaaccgccgccccgucaugcucacccuccuccgcgucccccgccucaacaagaacuccaagaacuccaacggccaggagcucgagaagacccucgaggaguccaaggagauggacaucaagcgcaaggagaacaagggcaacgacaccccccucgcccucgaguccaccaacaccgagaaggagaccucccucgaggagaccaagaucggcgagauccucauccagggccucaccgaggacauggucaccguccucauccgcgccugcgucuccaugcucggcguccccgucgaccccgacacccuccacgccacccuccgccucugccuccgccucacccgcgaccacaaguacgccaugauguucgccgagcucaaguccacccgcaugauccucaaccucacccaguccuccggcuucaacggcuucaccccccucgucacccuccuccuccgccacaucaucgaggaccccugcacccuccgccacaccauggagaaggucguccgcuccgccgccaccuccggcgccggcuccaccaccuccggcgucgucuccggcucccucggcucccgcgagaucaacuacauccuccgcguccucggccccgccgccugccgcaaccccgacaucuucaccgaggucgccaacugcugcauccgcaucgcccuccccgccccccgcggcuccggcaccgccuccgacgacgaguucgagaaccuccgcaucaagggccccaacgccguccagcucgucaagaccaccccccucaagcccuccccccuccccgucauccccgacaccaucaaggaggucaucuacgacaugcucaacgcccucgccgccuaccacgcccccgaggaggccgacaaguccgaccccaagcccggcgucaugacccaggaggucggccagcuccuccaggacaugggcgacgacgucuaccagcaguaccgcucccucacccgccaguccuccgacuucgacacccaguccggcuucuccaucaacucccaggucuucgccgccgacggcgccuccaccgagaccuccgccuccggcaccucccagggcgaggccuccacccccgaggagucccgcgacggcaagaaggacaaggagggcgaccgcgccuccgaggagggcaagcagaagggcaagggcuccaagccccucaugcccaccuccaccauccuccgccuccucgccgagcucguccgcuccuacgucggcaucgccacccucaucgccaacuacuccuacaccgucggccaguccgagcucaucaaggaggacugcuccguccucgccuucguccucgaccaccuccucccccacacccagaacgccgaggacaaggacacccccgcccucgcccgccucuuccucgccucccucgccgccgccggcuccggcaccgacgcccaggucgcccucgucaacgaggucaaggccgcccucggccgcgcccucgccauggccgaguccaccgagaagcacgcccgccuccaggccgucaugugcaucaucuccaccaucauggaguccugccccuccaccuccuccuucuacuccuccgccaccgccaagacccagcacaacggcaugaacaacaucauccgccucuuccucaagaagggccucgucaacgaccucgcccgcgucccccacucccucgaccucuccucccccaacauggccaacaccgucaacgccgcccucaagccccucgagacccucucccgcaucgucaaccagcccuccucccucuucggcuccaaguccgccuccuccaagaacaaguccgagcaggacgcccagggcgccucccaggacuccuccuccaaccagcaggaccccggcgagcccggcgaggccgagguccaggaggaggaccacgacgucacccagaccgaggucgccgacggcgacaucauggacggcgaggccgagaccgacuccgucgucaucgccggccagcccgagguccucuccucccaggagaugcaggucgagaacgagcucgaggaccucaucgacgagcuccucgagcgcgacggcggcuccggcaacuccaccaucaucgucucccgcuccggcgaggacgagucccaggaggacguccucauggacgaggcccccuccaaccucucccaggccuccacccuccaggccaaccgcgaggacuccaugaacauccucgaccccgaggacgaggaggagcacacccaggaggaggacuccuccggcuccaacgaggacgaggacgacucccaggacgaggaggaggaggaggaggaggacgaggaggacgaccaggaggacgacgagggcgaggagggcgacgaggacgacgacgacgacggcuccgagauggagcucgacgaggacuaccccgacaugaacgccuccccccucguccgcuucgagcgcuucgaccgcgaggacgaccucaucaucgaguucgacaacauguucuccuccgccaccgacaucccccccucccccggcaacauccccaccacccacccccucaugguccgccacgccgaccacuccucccucacccucggcuccggcuccuccaccacccgccucacccagggcaucggccgcucccagcgcacccuccgccagcucaccgccaacaccggccacaccauccacguccacuaccccggcaaccgccagcccaaccccccccucauccuccagcgccuccucggccccuccgccgccgccgacauccuccagcucuccuccucccucccccuccagucccgcggccgcgcccgccuccucgucggcaacgacgacguccacaucaucgcccgcuccgacgacgagcuccucgacgacuucuuccacgaccaguccaccgccaccucccaggccggcacccucuccuccauccccaccgcccucacccgcuggaccgaggagugcaagguccucgacgccgaguccaugcacgacugcgucuccgucgucaaggucuccaucgucaaccaccucgaguuccuccgcgacgaggagcucgaggagcgccgcgagaagcgccgcaagcagcucgccgaggaggagaccaagaucaccgacaagggcaaggaggacaaggagaaccgcgaccaguccgcccagugcaccgccuccaaguccaacgacuccaccgagcagaaccucuccgacggcacccccaugcccgacuccuaccccaccacccccuccuccaccgacgccgccaccuccgaguccaaggagacccucggcacccuccaguccucccagcagcagcccacccuccccaccccccccgcccucggcgaggucccccaggagcuccagucccccgccggcgagggcggcuccuccacccagcuccucaugcccgucgagcccgaggagcucggccccacccgccccuccggcgaggccgagaccacccagauggagcucucccccgcccccaccaucaccucccucucccccgagcgcgccgaggacuccgacgcccucaccgccgucuccucccagcucgagggcucccccauggacaccuccucccucgccuccugcacccucgaggaggccgucggcgacaccuccgccgccggcuccuccgagcagccccgcgccggcuccuccacccccggcgacgccccccccgccgucgccgagguccagggccgcuccgacggcuccggcgaguccgcccagccccccgaggacuccuccccccccgccuccuccgaguccuccuccacccgcgacuccgccgucgccaucuccggcgccgacucccgcggcauccucgaggagccccuccccuccaccuccuccgaggaggaggacccccucgccggcaucucccuccccgagggcgucgaccccuccuuccucgccgcccuccccgacgacauccgccgcgagguccuccagaaccagcucggcauccgcccccccacccgcaccgcccccuccaccaacuccuccgcccccgccgucgucggcaaccccggcgucaccgaggucucccccgaguuccucgccgcccucccccccgccauccaggaggagguccucgcccagcagcgcgccgagcagcagcgccgcgagcucgcccagaacgccuccuccgacacccccauggaccccgucaccuucauccagacccuccccuccgaccuccgccgcuccguccucgaggacauggaggacuccguccucgccgucaugccccccgacaucgccgccgaggcccaggcccuccgccgcgagcaggaggcccgccagcgccagcucaugcacgagcgccucuucggccacuccuccaccuccgcccucuccgccauccuccgcucccccgccuucaccucccgccucuccggcaaccgcggcguccaguacacccgccucgccguccagcgcggcggcaccuuccagaugggcggcuccuccucccacaaccgccccuccggcuccaacgucgacacccuccuccgccuccgcggccgccuccuccucgaccacgaggcccucuccugccuccucguccuccucuucgucgacgagcccaagcucaacaccucccgccuccaccgcguccuccgcaaccucugcuaccacgcccagacccgccacugggucauccgcucccuccucuccauccuccagcgcuccuccgaguccgagcucugcaucgagacccccaagcucaccaccuccgaggagaagggcaagaaguccuccaaguccugcggcuccuccucccacgagaaccgcccccucgaccuccuccacaagauggaguccaaguccuccaaccagcucuccuggcucuccgucuccauggacgccgcccucggcugccgcaccaacaucuuccagauccagcgcuccggcggccgcaagcacaccgagaagcacgccuccggcggcuccaccguccacauccacccccaggccgcccccgucgucugccgccacguccucgacacccucauccagcucgccaaggucuuccccucccacuucacccagcagcgcaccaaggagaccaacugcgaguccgaccgcgagcgcggcaacaaggccugcucccccugcuccucccaguccuccuccuccggcaucugcaccgacuucugggaccuccucgucaagcucgacaacaugaacgucucccgcaagggcaagaacuccgucaaguccguccccgucuccgccggcggcgagggcgagaccucccccuacucccucgaggccuccccccucggccagcucaugaacaugcucucccaccccgucauccgccgcuccucccuccucaccgagaagcuccuccgccuccucucccucaucuccaucgcccuccccgagaacaaggucuccgaggcccaggccaacuccggcuccggcgccuccuccaccaccaccgccaccuccaccaccuccaccaccaccaccaccgccgccuccaccacccccaccccccccaccgcccccacccccgucaccuccgcccccgcccucgucgccgccaccgccaucuccaccaucgucgucgccgccuccaccaccgucaccacccccaccaccgccaccaccaccgucuccaucucccccaccaccaagggcuccaagucccccgccaaggucuccgacggcggcuccuccuccaccgacuucaagauggucuccuccggccucaccgagaaccagcuccagcucuccgucgagguccucaccucccacuccugcuccgaggagggccucgaggacgccgccaacguccuccuccagcucucccgcggcgacuccggcacccgcgacaccguccucaagcuccuccucaacggcgcccgccaccucggcuacacccucugcaagcagaucggcacccuccucgccgagcuccgcgaguacaaccucgagcagcagcgccgcgcccagugcgagacccucucccccgacggccuccccgaggagcagccccagaccaccaagcucaagggcaagaugcagucccgcuucgacauggccgagaacgucgucaucgucgccucccagaagcgcccccucggcggccgcgagcuccagcuccccuccauguccaugcucaccuccaagaccuccacccagaaguucuuccuccgcguccuccaggucaucauccagcuccgcgacgacacccgccgcgccaacaagaaggccaagcagaccggccgccucggcuccuccggccucggcuccgccuccuccauccaggccgccguccgccagcucgaggccgaggccgacgccaucauccagaugguccgcgagggccagcgcgcccgccgccagcagcaggccgccaccuccgaguccucccaguccgaggccuccguccgccgcgaggagucccccauggacgucgaccagcccucccccuccgcccaggacacccaguccaucgccuccgacggcaccccccagggcgagaaggagaaggaggagcgcccccccgagcucccccuccucuccgagcagcucucccucgacgagcucugggacaugcucggcgagugccucaaggagcucgaggagucccacgaccagcacgccguccucguccuccagcccgccgucgaggccuucuuccucguccacgccaccgagcgcgaguccaagccccccguccgcgacacccgcgagucccagcucgcccacaucaaggacgagccccccccccucucccccgccccccucacccccgccacccccuccucccucgaccccuucuucucccgcgagcccuccuccaugcacaucuccuccucccucccccccgacacccagaaguuccuccgcuucgccgagacccaccgcaccguccucaaccagauccuccgccaguccaccacccaccucgccgacggccccuucgccguccucgucgacuacauccgcguccucgacuucgacgucaagcgcaaguacuuccgccaggagcucgagcgccucgacgagggccuccgcaaggaggacauggccguccacguccgccgcgaccacgucuucgaggacuccuaccgcgagcuccaccgcaagucccccgaggagaugaagaaccgccucuacaucgucuucgagggcgaggagggccaggacgccggcggccuccuccgcgagugguacaugaucaucucccgcgagauguucaaccccauguacgcccucuuccgcaccucccccggcgaccgcgucaccuacaccaucaaccccuccucccacugcaaccccaaccaccucuccuacuucaaguucgucggccgcaucgucgccaaggccgucuacgacaaccgccuccucgagugcuacuucacccgcuccuucuacaagcacauccucggcaaguccguccgcuacaccgacauggaguccgaggacuaccacuucuaccagggccucgucuaccuccucgagaacgacgucuccacccucggcuacgaccucaccuucuccaccgagguccaggaguucggcgucugcgagguccgcgaccucaagcccaacggcgccaacauccucgucaccgaggagaacaagaaggaguacguccaccucgucugccagaugcgcaugaccggcgccauccgcaagcagcucgccgccuuccucgagggcuucuacgagaucauccccaagcgccucaucuccaucuucaccgagcaggagcucgagcuccucaucuccggccuccccaccaucgacaucgacgaccucaaguccaacaccgaguaccacaaguaccaguccaacuccauccagauccagugguucuggcgcgcccuccgcuccuucgaccaggccgaccgcgccaaguuccuccaguucgucaccggcaccuccaaggucccccuccagggcuucgccgcccucgagggcaugaacggcauccagaaguuccagauccaccgcgacgaccgcuccaccgaccgccuccccuccgcccacaccugcuucaaccagcucgaccuccccgccuacgaguccuucgagaagcuccgccacaugcuccuccucgccauccaggagugcuccgagggcuucggccucgccuga

SEQ ID NO: 44431 - RNA, 822 nt, Artificial Sequence
  derived and/or modified sequence opt2 from HVCN1__Homo_sapiens__XP_011537150
auggccaccugggacgagaaggccgucacccgccgcgccaaggucgcccccgccgagcgcauguccaaguuccuccgccacuucaccgucgucggcgacgacuaccacgccuggaacaucaacuacaagaagugggagaacgaggaggaggaggaggaggaggagcagcccccccccacccccgucuccggcgaggagggccgcgccgccgcccccgacgucgcccccgcccccggccccgccccccgcgccccccucgacuuccgcggcaugcuccgcaagcucuucuccucccaccgcuuccaggucaucaucaucugccucgucguccucgacgcccuccucguccucgccgagcucauccucgaccucaagaucauccagcccgacaagaacaacuacgccgccauggucuuccacuacauguccaucaccauccucgucuucuucaugauggagaucaucuucaagcucuucgucuuccgccucgaguucuuccaccacaaguucgagauccucgacgccgucgucgucgucgucuccuucauccucgacaucguccuccucuuccaggagcaccaguucgaggcccucggccuccucauccuccuccgccucuggcgcgucgcccgcaucaucaacggcaucaucaucuccgucaagacccgcuccgagcgccagcuccuccgccucaagcagaugaacguccagcucgccgccaagauccagcaccucgaguucuccugcuccgagaaggagcaggagaucgagcgccucaacaagcuccuccgccagcacggccuccucggcgaggucaacuga

SEQ ID NO: 44432 - RNA, 1308 nt, Artificial Sequence
  derived and/or modified sequence opt2 from HYAL1__Homo_sapiens__NP_149349
auggccgcccaccuccuccccaucugcgcccucuuccucacccuccucgacauggcccagggcuuccgcggcccccuccuccccaaccgccccuucaccaccgucuggaacgccaacacccaguggugccucgagcgccacggcgucgacgucgacgucuccgucuucgacgucgucgccaaccccggccagaccuuccgcggccccgacaugaccaucuucuacuccucccagcucggcaccuaccccuacuacacccccaccggcgagcccgucuucggcggccucccccagaacgccucccucaucgcccaccucgcccgcaccuuccaggacauccucgccgccauccccgcccccgacuucuccggccucgccgucaucgacugggaggccuggcgcccccgcugggccuucaacugggacaccaaggacaucuaccgccagcgcucccgcgcccucguccaggcccagcaccccgacuggcccgccccccaggucgaggccgucgcccaggaccaguuccagggcgccgcccgcgccuggauggccggcacccuccagcucggccgcgcccuccgcccccgcggccucuggggcuucuacggcuuccccgacugcuacaacuacgacuuccucucccccaacuacaccggccagugccccuccggcauccgcgcccagaacgaccagcucggcuggcucuggggccagucccgcgcccucuaccccuccaucuacaugcccgccguccucgagggcaccggcaagucccagauguacguccagcaccgcgucgccgaggccuuccgcgucgccgucgccgccggcgaccccaaccuccccguccuccccuacguccagaucuucuacgacaccaccaaccacuuccucccccucgacgagcucgagcacucccucggcgaguccgccgcccagggcgccgccggcgucguccucugggucuccugggagaacacccgcaccaaggaguccugccaggccaucaaggaguacauggacaccacccucggccccuucauccucaacgucaccuccggcgcccuccucugcucccaggcccucugcuccggccacggccgcugcguccgccgcaccucccaccccaaggcccuccuccuccucaaccccgccuccuucuccauccagcucacccccggcggcggcccccucucccuccgcggcgcccucucccucgaggaccaggcccagauggccgucgaguucaagugccgcugcuaccccggcuggcaggcccccuggugcgagcgcaaguccaugugguga

SEQ ID NO: 44433 - RNA, 1422 nt, Artificial Sequence
  derived and/or modified sequence opt2 from HYAL2__Homo_sapiens__XP_005265582
augcgcgccggccccggccccaccgucacccucgcccucguccucgccgucuccugggccauggagcucaagcccaccgccccccccaucuucaccggccgccccuucgucgucgccugggacguccccacccaggacugcggcccccgccucaaggucccccucgaccucaacgccuucgacguccaggccucccccaacgagggcuucgucaaccagaacaucaccaucuucuaccgcgaccgccucggccucuacccccgcuucgacuccgccggccgcuccguccacggcggcgucccccagaacgucucccucugggcccaccgcaagaugcuccagaagcgcgucgagcacuacauccgcacccaggaguccgccggccucgccgucaucgacugggaggacuggcgccccgucuggguccgcaacuggcaggacaaggacgucuaccgccgccucucccgccagcucgucgccucccgccaccccgacuggccccccgaccgcaucgucaagcaggcccaguacgaguucgaguucgccgcccagcaguucaugcucgagacccuccgcuacgucaaggccguccgcccccgccaccucuggggcuucuaccucuuccccgacugcuacaaccacgacuacguccagaacugggaguccuacaccggccgcugccccgacgucgaggucgcccgcaacgaccagcucgccuggcucugggccgaguccaccgcccucuuccccuccgucuaccucgacgagacccucgccuccucccgccacggccgcaacuucgucuccuuccgcguccaggaggcccuccgcgucgcccgcacccaccacgccaaccacgcccuccccgucuacgucuucacccgccccaccuacucccgccgccucaccggccucuccgagauggaccucaucuccaccaucggcgaguccgccgcccucggcgccgccggcgucauccucuggggcgacgccggcuacaccaccuccaccgagaccugccaguaccucaaggacuaccucacccgccuccucguccccuacgucgucaacgucuccugggccacccaguacugcucccgcgcccagugccacggccacggccgcugcguccgccgcaaccccuccgccuccaccuuccuccaccucuccaccaacuccuuccgccucguccccggccacgcccccggcgagccccagcuccgccccgucggcgagcucuccugggccgacaucgaccaccuccagacccacuuccgcugccagugcuaccucggcugguccggcgagcagugccagugggaccaccgccaggccgccggcggcgccuccgaggccugggccggcucccaccucaccucccuccucgcccucgccgcccucgccuucaccuggacccucuga

SEQ ID NO: 44434 - RNA, 1164 nt, Artificial Sequence
  derived and/or modified sequence opt2 from HYAL3__Homo_sapiens__NP_001186959
augaccacccagcucggccccgcccucguccucggcgucgcccucugccucggcugcggccagccccucccccagguccccgagcgccccuucuccguccucuggaacguccccuccgcccacugcgaggcccgcuucggcguccaccucccccucaacgcccucggcaucaucgccaaccgcggccagcacuuccacggccagaacaugaccaucuucuacaagaaccagcucggccucuaccccuacuucggcccccgcggcaccgcccacaacggcggcaucccccaggcccucccccucgaccgccaccucgcccucgccgccuaccagauccaccacucccuccgccccggcuucgccggccccgccguccucgacugggaggaguggugcccccucugggccggcaacuggggccgccgccgcgccuaccaggccgccuccugggccugggcccagcaggucuuccccgaccucgacccccaggagcagcucuacaaggccuacaccggcuucgagcaggccgcccgcgcccucauggaggacacccuccgcgucgcccaggcccuccgcccccacggccucuggggcuucuaccacuaccccgccugcggcaacggcuggcacuccauggccuccaacuacaccggccgcugccacgccgccacccucgcccgcaacacccagcuccacuggcucugggccgccuccuccgcccucuuccccuccaucuaccuccccccccgccucccccccgcccaccaccaggccuucguccgccaccgccucgaggaggccuuccgcgucgcccucgucggccaccgccacccccuccccguccucgccuacguccgccucacccaccgccgcuccggccgcuuccucucccaggaggagugcuggcaccuccacgacuaccucgucgacacccucggccccuacgucaucaacgucacccgcgccgccauggccugcucccaccagcgcugccacggccacggccgcugcgcccgccgcgaccccggccagauggaggccuuccuccaccucuggcccgacggcucccucggcgacuggaaguccuucuccugccacugcuacuggggcugggccggccccaccugccaggagccccgccccggccccaaggaggccgucuga

SEQ ID NO: 44435 - RNA, 1446 nt, Artificial Sequence
  derived and/or modified sequence opt2 from HYAL4__Homo_sapiens__XP_011514292
augaagguccucuccgagggccagcucaagcucugcgucguccagcccguccaccucaccuccuggcuccucaucuucuucauccucaaguccaucuccugccucaagcccgcccgccuccccaucuaccagcgcaagcccuucaucgccgccuggaacgcccccaccgaccagugccucaucaaguacaaccuccgccucaaccucaagauguuccccgucaucggcuccccccucgccaaggcccgcggccagaacgucaccaucuucuacgucaaccgccucggcuacuaccccugguacaccucccagggcguccccaucaacggcggccucccccagaacaucucccuccagguccaccucgagaaggccgaccaggacaucaacuacuacauccccgccgaggacuucuccggccucgccgucaucgacugggaguacuggcgcccccagugggcccgcaacuggaacuccaaggacgucuaccgccagaagucccgcaagcucaucuccgacaugggcaagaacgucuccgccaccgacaucgaguaccucgccaaggucaccuucgaggaguccgccaaggccuucaugaaggagaccaucaagcucggcaucaagucccgccccaagggccucuggggcuacuaccucuaccccgacugccacaacuacaacgucuacgcccccaacuacuccggcuccugccccgaggacgagguccuccgcaacaacgagcucuccuggcucuggaacuccuccgccgcccucuaccccuccaucggcgucuggaagucccucggcgacuccgagaacauccuccgcuucuccaaguuccgcguccacgaguccaugcgcaucuccaccaugaccucccacgacuacgcccuccccgucuucgucuacacccgccucggcuaccgcgacgagccccucuucuuccucuccaagcaggaccucgucuccaccaucggcgaguccgccgcccucggcgccgccggcaucgucaucuggggcgacaugaaccucaccgccuccaaggccaacugcaccaaggucaagcaguucgucuccuccgaccucggcuccuacaucgccaacgucacccgcgccgccgaggucugcucccuccaccucugccgcaacaacggccgcugcauccgcaagauguggaacgcccccuccuaccuccaccucaaccccgccuccuaccacaucgaggccuccgaggacggcgaguucaccgucaagggcaaggccuccgacaccgaccucgccgucauggccgacaccuucuccugccacugcuaccagggcuacgagggcgccgacugccgcgagaucaagaccgccgacggcugcuccggcgucucccccucccccggcucccucaugacccucugccuccuccuccucgccuccuaccgcuccauccagcucuga

SEQ ID NO: 44436 - RNA, 2853 nt, Artificial Sequence
  derived and/or modified sequence opt2 from HYDIN__Homo_sapiens__NP_001185471
auggaguccgccggcggcuucaagcucggcauggagccccucuccggcggcggcgucugcgagaagaagaagcuccucaagaugaccucccgccgccucgaggaguccaugggcgccguccagaugggccucgucaacauguucaagggcuuccaguccaagguccuccccccccucucccccaaggucgucaccgaggaggaggucaaccgcaugcucacccccuccgaguuccucaaggagaugucccucaccaccgagcagcgccucgccaagacccgccucaugugccgcccccagaucaucgagcuccucgacaugggcgagaccacccaccagaaguucuccggcaucgaccucgaccaggcccucuuccagcccuuccccuccgagaucaucuuccagaacuacacccccugcgaggucuacgaggucccccucauccuccgcaacaacgacaagaucccccgccucgucaaggucgucgaggaguccucccccuacuucaaggucaucucccccaaggacaucggccacaaggucgcccccggcguccccuccaucuuccgcauccucuucacccccgaggagaacaaggacuacgcccacacccucaccugcgucaccgagcgcgagaaguucaucguccccaucaaggcccgcggcgcccgcgccauccucgacuuccccgacaagcucaacuucuccaccugccccgucaaguacuccacccagaagauccuccucguccgcaacaucggcaacaagaacgccgucuuccacaucaagaccugccgccccuucuccaucgagcccgccaucggcacccucaacgucggcgaguccaugcagcucgaggucgaguucgagccccaguccgucggcgaccacuccggccgccucaucgucugcuacgacaccggcgagaaggucuucgucucccucuacggcgccgccaucgacaugaacauccgccucgacaagaacucccucaccaucgagaagaccuacaucucccucgccaaccagcgcaccaucaccauccacaaccgcuccaacaucaucgcccacuuccucuggaaggucuucgccacccagcaggaggaggaccgcgagaaguaccgcgccugcgacgaccucaucaaggaggagaaggacgagaccgacgaguucuucgaggagugcaucaccgacccccuccuccgcgagcaccucuccguccucucccgcaccuucgccaaccagcgccgccucguccagggcgacuccaagcucuucuucaacaacgucuucaccgucgagccccucgagggcgacgucuggcccaacuccuccgccgagaucaccgucuacuucaacccccucgaggccaagcucuaccagcagaccaucuacugcgacauccucggccgcgagauccgccucccccuccgcaucaagggcgagggcaugggccccaagauccacuucaacuucgagcuccucgacaucggcaaggucuucaccggcuccgcccacugcuacgaggccauccucuacaacaagggcuccaucgacgcccucuucaacaugaccccccccaccuccgcccucggcgccugcuucgucuucucccccaaggagggcaucaucgagcccuccggcguccaggccauccagaucuccuucuccuccaccauccucggcaacuucgaggaggaguuccucgucaacgucaacggcucccccgagcccgucaagcucaccauccgcggcugcgucaucggccccaccuuccacuucaacguccccgcccuccacuucggcgacgucuccuucggcuucccccacacccucaucugcucccucaacaacaccucccucauccccaugaccuacaagcuccgcauccccggcgacggccucggccacaaguccaucuccuacugcgagcagcacgucgacuacaagcgccccuccuggaccaaggaggagaucuccuccaugaagcccaaggaguucaccaucucccccgacugcggcaccauccgcccccagggcuucgccgccauccgcgucacccucugcuccaacaccguccagaaguacgagcucgcccucgucgucgacgucgagggcaucggcgaggagguccucgcccuccucaucaccgcccgcugcgucguccccgcccuccaccucgucaacaccgaggucgacuucggccacugcuuccucaaguaccccuacgagaagacccuccagcucgccaaccaggacgaccuccccggcuucuacgagguccagccccaggucugcgaggagguccccaccguccucuucuccucccccacccccuccggcgucaucucccccuccuccaccauccacaucccccucguccucgagacccaggucaccggcgagcaccgcuccaccgucuacaucuccaucuucggcucccaggaccccccccucgucugccaccucaaguccgccggcgagggccccgucaucuacguccaccccaaccaggucgacuucggcaacaucuacguccucaaggacuccucccgcauccucaaccucugcaaccaguccuucauccccgccuucuuccaggcccacauggcccacaagaagucccucuggaccaucgagcccaacgagggcauggucccccccgagaccgacguccagcucgcccucaccgccaaccucaacgacacccucaccuucaaggacugcgucauccucgacaucgagaacuccuccaccuaccgcauccccguccaggccuccggcaccggcuccaccaucgucuccgacaagcccuucgcccccgagcucaaccucggcgcccacuuccgcuga

SEQ ID NO: 44437 - RNA, 1122 nt, Artificial Sequence
  derived and/or modified sequence opt2 from HYKK__Homo_sapiens__NP_001013641
auguccuccggcaacuaccagcaguccgaggcccucuccaagcccaccuucuccgaggagcaggccuccgcccucgucgaguccgucuucggccucaaggucuccaagguccgcccccuccccuccuacgacgaccagaacuuccacgucuacgucuccaagaccaaggacggccccaccgaguacguccucaagaucuccaacaccaaggccuccaagaaccccgaccucaucgagguccagaaccacaucaucauguuccucaaggccgccggcuuccccaccgccuccgucugccacaccaagggcgacaacaccgccucccucgucuccgucgacuccggcuccgagaucaaguccuaccucguccgccuccucaccuaccuccccggccgccccaucgccgagcuccccgucuccccccagcuccucuacgagaucggcaagcucgccgccaagcucgacaagacccuccagcgcuuccaccaccccaagcucuccucccuccaccgcgagaacuucaucuggaaccucaagaacgucccccuccucgagaaguaccucuacgcccucggccagaaccgcaaccgcgagaucgucgagcacgucauccaccucuucaaggaggaggucaugaccaagcucucccacuuccgcgagugcaucaaccacggcgaccucaacgaccacaacauccucaucgaguccuccaaguccgccuccggcaacgccgaguaccaggucuccggcauccucgacuucggcgacauguccuacggcuacuacgucuucgaggucgccaucaccaucauguacaugaugaucgaguccaagucccccauccaggucggcggccacguccucgccggcuucgaguccaucaccccccucaccgccgucgagaagggcgcccucuuccuccucgucugcucccgcuucugccagucccucgucauggccgccuacuccugccagcucuaccccgagaacaaggacuaccucauggucaccgccaagaccggcuggaagcaccuccagcagauguucgacaugggccagaaggccgucgaggagaucugguucgagaccgccaaguccuacgaguccggcaucuccauguga

SEQ ID NO: 44438 - RNA, 900 nt, Artificial Sequence
  derived and/or modified sequence opt2 from HYLS1__Homo_sapiens__NP_659451
auggaggagcuccuccccgacggccagaucugggccaacauggaccccgaggagcgcaugcucgccgccgccaccgccuucacccacaucugcgccggccagggcgagggcgacguccgccgcgaggcccaguccauccaguacgaccccuacuccaaggccuccgucgcccccggcaagcgccccgcccuccccguccagcuccaguacccccacgucgaguccaacguccccuccgagaccgucuccgaggccucccagcgccuccgcaagcccgucaugaagcgcaagguccuccgccgcaagcccgacggcgagguccucgucaccgacgaguccaucaucuccgaguccgaguccggcaccgagaacgaccaggaccucugggaccuccgccagcgccucaugaacguccaguuccaggaggacaaggaguccuccuucgacgucucccagaaguucaaccucccccacgaguaccagggcaucucccaggaccagcucaucugcucccuccagcgcgagggcaugggcucccccgccuacgagcaggaccucaucgucgccucccgccccaaguccuucauccuccccaagcucgaccagcucucccgcaaccgcggcaagaccgaccgcgucgcccgcuacuucgaguacaagcgcgacugggacuccauccgccuccccggcgaggaccaccgcaaggagcuccgcuggggcguccgcgagcagaugcucugccgcgccgagccccaguccaagccccagcacaucuacguccccaacaacuaccucguccccaccgagaagaagcgcuccgcccuccgcuggggcguccgcugcgaccucgccaacggcgucaucccccgcaagcuccccuucccccucucccccuccuga

SEQ ID NO: 44439 - RNA, 3000 nt, Artificial Sequence
  derived and/or modified sequence opt2 from HYOU1__Homo_sapiens__NP_001124463
auggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucuga

SEQ ID NO: 44440 - RNA, 354 nt, Artificial Sequence
  derived and/or modified sequence opt2 from HYPM__Homo_sapiens__NP_036406
auguccgagaagaagaacugcaagaacuccuccaccaacaacaaccagacccaggaccccucccgcaacgagcuccaggucccccgcuccuucgucgaccgcgucguccaggacgagcgcgacguccagucccaguccuccuccaccaucaacacccuccucacccuccucgacugccucgccgacuacaucauggagcgcgucggccucgaggccuccaacaacggcuccaugcgcaacaccucccaggaccgcgagcgcgaggucgacaacaaccgcgagccccacuccgccgaguccgacgucacccgcuuccucuucgacgagaugcccaagucccgcaagaacgacuga

SEQ ID NO: 44441 - RNA, 270 nt, Artificial Sequence
  derived and/or modified sequence opt2 from IAPP__Homo_sapiens__NP_000406
augggcauccucaagcuccaggucuuccucaucguccucuccgucgcccucaaccaccucaaggccacccccaucgagucccaccaggucgagaagcgcaagugcaacaccgccaccugcgccacccagcgccucgccaacuuccucguccacuccuccaacaacuucggcgccauccucuccuccaccaacgucggcuccaacaccuacggcaagcgcaacgccgucgagguccucaagcgcgagccccucaacuaccucccccucuga

SEQ ID NO: 44442 - RNA, 3039 nt, Artificial Sequence
  derived and/or modified sequence opt2 from IARS2__Homo_sapiens__NP_060530
augcgcuggggccuccgcccccgcggccccggcgccgccgcccucgccaccgcccgcucccucuggggcaccccccgccuccccugcucccccggcuggcagggcgccaccaagcgccuccucguccgcuccgucuccggcgccuccaaccaccagcccaacuccaacuccggccgcuaccgcgacaccguccuccucccccagaccuccuuccccaugaagcuccucggccgccagcagcccgacaccgagcucgagauccagcagaagugcggcuucuccgagcucuacuccuggcagcgcgagcgcaaggucaagaccgaguucugccuccacgacggcccccccuacgccaacggcgacccccacgucggccacgcccucaacaagauccucaaggacaucgccaaccgcuuccacaugaugaacggcuccaagauccacuucguccccggcugggacugccacggccuccccaucgagaucaagguccucuccgagcucggccgcgaggcccagaaccucuccgccauggagauccgcaagaaggcccgcuccuucgccaaggccgccaucgagaagcagaaguccgccuucauccgcuggggcaucauggccgacuggaacaacugcuacuacaccuucgacggcaaguacgaggccaagcagcuccgcaccuucuaccagauguacgacaagggccucgucuaccgcuccuacaagcccgucuucuggucccccuccucccgcaccgcccucgccgaggccgagcucgaguacaaccccgagcacgucucccgcuccaucuacgucaaguucccccuccucaagcccucccccaagcucgccucccucaucgacggcuccucccccgucuccauccucgucuggaccacccagcccuggaccauccccgccaacgaggccgucugcuacaugcccgaguccaaguacgccgucgucaagugcuccaaguccggcgaccucuacguccucgccgccgacaaggucgccuccgucgccuccacccucgagaccaccuucgagaccaucuccacccucuccggcgucgaccucgagaacggcaccugcucccacccccucauccccgacaaggccuccccccuccuccccgccaaccacgucaccauggccaagggcaccggccucguccacaccgcccccgcccacggcauggaggacuacggcgucgccucccagcacaaccuccccauggacugccucgucgacgaggacggcgucuucaccgacgucgccggccccgagcuccagaacaaggccguccucgaggagggcaccgacgucgucaucaagaugcuccagaccgccaagaaccuccucaaggaggagaagcucguccacuccuaccccuacgacuggcgcaccaagaagcccgucgucauccgcgccuccaagcagugguucaucaacaucaccgacaucaagaccgccgccaaggagcuccucaagaaggucaaguucauccccggcuccgcccucaacggcauggucgagaugauggaccgccgccccuacuggugcaucucccgccagcgcgucuggggcguccccauccccgucuuccaccacaagaccaaggacgaguaccucaucaacucccagaccaccgagcacaucgucaagcucgucgagcagcacggcuccgacaucugguggacccucccccccgagcagcuccuccccaaggagguccucuccgaggucggcggccccgacgcccucgaguacguccccggccaggacauccucgacaucugguucgacuccggcaccuccugguccuacguccuccccggccccgaccagcgcgccgaccucuaccucgagggcaaggaccagcucggcggcugguuccaguccucccuccucaccuccgucgccgcccgcaagcgcgcccccuacaagaccgucaucguccacggcuucacccucggcgagaagggcgagaagauguccaagucccucggcaacgucauccaccccgacgucgucgucaacggcggccaggaccaguccaaggagccccccuacggcgccgacguccuccgcuggugggucgccgacuccaacgucuucaccgaggucgccaucggccccuccguccucaacgccgcccgcgacgacaucuccaagcuccgcaacacccuccgcuuccuccucggcaacgucgccgacuucaaccccgagaccgacuccauccccgucaacgacauguacgucaucgaccaguacaugcuccaccuccuccaggaccucgccaacaagaucaccgagcucuacaagcaguacgacuucggcaaggucguccgccuccuccgcaccuucuacacccgcgagcucuccaacuucuacuucuccaucaucaaggaccgccucuacugcgagaaggagaacgaccccaagcgccgcuccugccagaccgcccucgucgagauccucgacgucaucguccgcuccuucgcccccauccucccccaccucgccgaggaggucuuccagcacauccccuacaucaaggagcccaaguccgucuuccgcaccggcuggaucuccaccuccuccaucuggaagaagcccggccucgaggaggccgucgaguccgccugcgccaugcgcgacuccuuccucggcuccauccccggcaagaacgccgccgaguacaaggucaucaccgucaucgagcccggccuccucuucgagaucaucgagaugcuccaguccgaggagaccuccuccaccucccagcucaacgagcucaugauggccuccgaguccacccuccucgcccaggagccccgcgagaugaccgccgacgucaucgagcucaagggcaaguuccucaucaaccucgagggcggcgacauccgcgaggaguccuccuacaaggucaucgucaugcccaccaccaaggagaagugcccccgcugcuggaaguacaccgccgaguccuccgacacccucugcccccgcugcgccgaggucgucuccggcaaguga

SEQ ID NO: 44443 - RNA, 3789 nt, Artificial Sequence
  derived and/or modified sequence opt2 from IARS__Homo_sapiens__NP_038203
augcuccagcagguccccgagaacaucaacuuccccgccgaggaggagaagauccucgaguucuggaccgaguucaacugcuuccaggagugccucaagcaguccaagcacaagcccaaguucaccuucuacgacggcccccccuucgccaccggccucccccacuacggccacauccucgccggcaccaucaaggacaucgucacccgcuacgcccaccaguccggcuuccacgucgaccgccgcuucggcugggacugccacggccuccccgucgaguacgagaucgacaagacccucggcauccgcggccccgaggacgucgccaagaugggcaucaccgaguacaacaaccagugccgcgccaucgucaugcgcuacuccgccgaguggaaguccaccgucucccgccucggccgcuggaucgacuucgacaacgacuacaagacccucuacccccaguucauggaguccgucuggugggucuucaagcagcucuacgacaagggccucgucuaccgcggcgucaaggucaugcccuucuccaccgccugcaacaccccccucuccaacuucgagucccaccagaacuacaaggacguccaggaccccuccgucuucgucaccuucccccucgaggaggacgagaccgucucccucgucgccuggaccaccacccccuggacccuccccuccaaccucgccgucugcgucaaccccgagaugcaguacgucaagaucaaggacgucgcccgcggccgccuccucauccucauggaggcccgccucuccgcccucuacaagcucgaguccgacuacgagauccucgagcgcuuccccggcgccuaccucaagggcaagaaguaccgcccccucuucgacuacuuccucaagugcaaggagaacggcgccuucaccguccucgucgacaacuacgucaaggaggaggagggcaccggcgucguccaccaggcccccuacuucggcgccgaggacuaccgcgucugcauggacuucaacaucauccgcaaggacucccuccccgucugccccgucgacgccuccggcugcuucaccaccgaggucaccgacuucgccggccaguacgucaaggacgccgacaaguccaucauccgcacccucaaggagcagggccgccuccucgucgccaccaccuucacccacuccuaccccuucugcuggcgcuccgacaccccccucaucuacaaggccguccccuccugguucguccgcgucgagaacauggucgaccagcuccuccgcaacaacgaccucugcuacuggguccccgagcucguccgcgagaagcgcuucggcaacuggcucaaggacgcccgcgacuggaccaucucccgcaaccgcuacuggggcacccccaucccccucugggucuccgacgacuucgaggaggucgucugcaucggcuccgucgccgagcucgaggagcucuccggcgccaagaucuccgaccuccaccgcgaguccgucgaccaccucaccauccccucccgcugcggcaagggcucccuccaccgcaucuccgaggucuucgacugcugguucgaguccggcuccaugcccuacgcccagguccacuaccccuucgagaacaagcgcgaguucgaggacgccuuccccgccgacuucaucgccgagggcaucgaccagacccgcggcugguucuacacccuccucguccucgccaccgcccucuucggccagccccccuucaagaacgucaucgucaacggccucguccucgccuccgacggccagaagauguccaagcgcaagaagaacuaccccgaccccgucuccaucauccagaaguacggcgccgacgcccuccgccucuaccucaucaacucccccgucguccgcgccgagaaccuccgcuucaaggaggagggcguccgcgacguccucaaggacguccuccuccccugguacaacgccuaccgcuuccucauccagaacguccuccgccuccagaaggaggaggagaucgaguuccucuacaacgagaacaccguccgcgagucccccaacaucaccgaccgcuggauccucuccuucaugcagucccucaucggcuucuucgagaccgagauggccgccuaccgccucuacaccgucgucccccgccucgucaaguucgucgacauccucaccaacugguacguccgcaugaaccgccgccgccucaagggcgagaacggcauggaggacugcgucauggcccucgagacccucuucuccguccuccucucccucugccgccucauggcccccuacacccccuuccucaccgagcucauguaccagaaccucaagguccucaucgaccccgucuccguccaggacaaggacacccucuccauccacuaccucaugcucccccgcguccgcgaggagcucaucgacaagaagaccgaguccgccgucucccagaugcaguccgucaucgagcucggccgcgucauccgcgaccgcaagaccauccccaucaaguacccccucaaggagaucgucgucauccaccaggaccccgaggcccucaaggacaucaagucccucgagaaguacaucaucgaggagcucaacguccgcaaggucacccucuccaccgacaagaacaaguacggcauccgccuccgcgccgagcccgaccacaugguccucggcaagcgccucaagggcgccuucaaggccgucaugaccuccaucaagcagcucuccuccgaggagcucgagcaguuccagaagaccggcaccaucgucgucgagggccacgagcuccacgacgaggacauccgccucauguacaccuucgaccaggccaccggcggcaccgcccaguucgaggcccacuccgacgcccaggcccucguccuccucgacgucacccccgaccaguccauggucgacgagggcauggcccgcgaggucaucaaccgcauccagaagcuccgcaagaagugcaaccucguccccaccgacgagaucaccgucuacuacaaggccaaguccgagggcaccuaccucaacuccgucaucgagucccacaccgaguucaucuucaccaccaucaaggccccccucaagcccuaccccgucucccccuccgacaagguccucauccaggagaagacccagcucaagggcuccgagcucgagaucacccucacccgcggcuccucccuccccggccccgccugcgccuacgucaaccucaacaucugcgccaacggcuccgagcagggcggcguccuccuccucgagaaccccaagggcgacaaccgccucgaccuccucaagcucaaguccgucgucaccuccaucuucggcgucaagaacaccgagcucgccgucuuccacgacgagaccgagauccagaaccagaccgaccuccucucccucuccggcaagacccucugcgucaccgccggcuccgcccccucccucaucaacuccuccuccacccuccucugccaguacaucaaccuccagcuccucaacgccaagccccaggagugccucaugggcaccgucggcacccuccuccucgagaacccccucggccagaacggccucacccaccagggccuccucuacgaggccgccaaggucuucggccuccgcucccgcaagcucaagcucuuccucaacgagacccagacccaggagaucaccgaggacauccccgucaagacccucaacaugaagaccgucuacgucuccguccuccccaccaccgccgacuucuga

SEQ ID NO: 44444 - RNA, 1071 nt, Artificial Sequence
  derived and/or modified sequence opt2 from IBA57__Homo_sapiens__NP_001010867
auggccaccgccgcccuccuccgcggcgccacccccggccgcggcggccccgucuggcgcuggcgccuccgcgccgccccccgcugccgccucgcccacuccuccugcucccccggcggcgaccccaccgccggcgccgccugggccugcuuccgccucgacggccgcacccuccuccgcguccgcggccccgacgccgcccccuuccuccucggccuccucaccaacgagcucccccuccccucccccgccgccgccggcgccccccccgccgcccgcgccggcuacgcccacuuccucaacguccagggccgcacccucuacgacgucauccucuacggccuccaggagcacuccgaggucuccggcuuccuccucgagugcgacuccuccguccagggcgcccuccagaagcaccucgcccucuaccgcauccgccgcaaggucaccgucgagccccaccccgagcuccgcgucugggccguccuccccuccucccccgaggccugcggcgccgccucccuccaggagcgcgccggcgccgccgccauccucauccgcgacccccgcaccgcccgcaugggcuggcgccuccucacccaggacgagggccccgcccucguccccggcggccgccucggcgaccucugggacuaccaccagcaccgcuaccuccagggcguccccgagggcguccgcgaccucccccccggcgucgcccucccccucgaguccaaccucgccuucaugaacggcgucuccuucaccaagggcugcuacaucggccaggagcucaccgcccgcacccaccacaugggcgucauccgcaagcgccucuuccccguccgcuuccucgacccccuccccaccuccggcaucacccccggcgccaccguccucaccgccuccggccagaccgucggcaaguuccgcgccggccagggcaacgucggccucgcccuccucugguccgagaagaucaagggcccccuccacauccgcgccuccgagggcgcccaggucgcccucgccgccuccguccccgacugguggcccaccgucuccaaguga

SEQ ID NO: 44445 - RNA, 954 nt, Artificial Sequence
  derived and/or modified sequence opt2 from IBSP__Homo_sapiens__NP_004958
augaagaccgcccucauccuccucuccauccucggcauggccugcgccuucuccaugaagaaccuccaccgccgcgucaagaucgaggacuccgaggagaacggcgucuucaaguaccgcccccgcuacuaccucuacaagcacgccuacuucuacccccaccucaagcgcuuccccguccagggcuccuccgacuccuccgaggagaacggcgacgacuccuccgaggaggaggaggaggaggaggagaccuccaacgagggcgagaacaacgaggaguccaacgaggacgaggacuccgaggccgagaacaccacccucuccgccaccacccucggcuacggcgaggacgccacccccggcaccggcuacaccggccucgccgccauccagcuccccaagaaggccggcgacaucaccaacaaggccaccaaggagaaggaguccgacgaggaggaggaggaggaggaggagggcaacgagaacgaggaguccgaggccgaggucgacgagaacgagcagggcaucaacggcaccuccaccaacuccaccgaggccgagaacggcaacggcuccuccggcggcgacaacggcgaggagggcgaggaggaguccgucaccggcgccaacgccgaggacaccaccgagaccggccgccagggcaagggcaccuccaagaccaccaccucccccaacggcggcuucgagcccaccacccccccccaggucuaccgcaccaccuccccccccuucggcaagaccaccaccgucgaguacgagggcgaguacgaguacaccggcgccaacgaguacgacaacggcuacgagaucuacgaguccgagaacggcgagccccgcggcgacaacuaccgcgccuacgaggacgaguacuccuacuucaagggccagggcuacgacggcuacgacggccagaacuacuaccaccaccaguga

SEQ ID NO: 44446 - RNA, 4062 nt, Artificial Sequence
  derived and/or modified sequence opt2 from IBTK__Homo_sapiens__NP_056340
auguccucccccaugcccgacugcaccuccaagugccgcucccucaagcacgcccucgacguccucuccgucgucaccaagggcuccgagaaccagaucaaggccuuccucuccucccacugcuacaacgccgccaccaucaaggacgucuucggccgcaacgcccuccaccucgucuccuccugcggcaagaagggcguccucgacuggcucauccagaagggcgucgaccuccucgucaaggacaaggaguccggcuggaccgcccuccaccgcuccaucuucuacggccacaucgacugcgucuggucccuccucaagcacggcgucucccucuacauccaggacaaggagggccucuccgcccucgaccucgucaugaaggaccgccccacccacgucgucuucaagaacaccgaccccaccgacgucuacaccuggggcgacaacaccaacuucacccucggccacggcucccagaacuccaagcaccaccccgagcucgucgaccucuucucccgcuccggcaucuacaucaagcaggucguccucugcaaguuccacuccgucuuccucucccagaagggccaggucuacaccugcggccacggccccggcggccgccucggccacggcgacgagcagaccugccucgucccccgccucgucgagggccucaacggccacaacugcucccaggucgccgccgccaaggaccacaccgucguccucaccgaggacggcugcgucuacaccuucggccucaacaucuuccaccagcucggcaucauccccccccccuccuccugcaacgucccccgccagauccaggccaaguaccucaagggccgcaccaucaucggcgucgccgccggccgcuuccacaccguccucuggacccgcgaggccgucuacaccaugggccucaacggcggccagcucggcugccuccucgaccccaacggcgagaagugcgucaccgccccccgccaggucuccgcccuccaccacaaggacaucgcccucucccucgucgccgccuccgacggcgccaccgucugcgucaccacccgcggcgacaucuaccuccucgccgacuaccagugcaagaagauggccuccaagcagcucaaccucaagaagguccucgucuccggcggccacauggaguacaaggucgaccccgagcaccucaaggagaacggcggccagaagaucugcauccucgccauggacggcgccggccgcgucuucugcuggcgcuccgucaacuccucccucaagcagugccgcugggccuacccccgccaggucuucaucuccgacaucgcccucaaccgcaacgagauccucuucgucacccaggacggcgagggcuuccgcggccgcugguucgaggagaagcgcaaguccuccgagaagaaggagauccucuccaaccuccacaacuccuccuccgacgucuccuacgucuccgacaucaacuccgucuacgagcgcauccgccucgagaagcucaccuucgcccaccgcgccgucuccgucuccaccgaccccuccggcugcaacuucgccauccuccaguccgaccccaagaccucccucuacgagauccccgccgucuccuccuccuccuucuucgaggaguucggcaagcuccuccgcgaggccgacgagauggacuccauccacgacgucaccuuccaggucggcaaccgccucuuccccgcccacaaguacauccucgccguccacuccgacuucuuccagaagcucuuccucuccgacggcaacaccuccgaguucaccgacaucuaccagaaggacgaggacuccgccggcugccaccucuucgucgucgagaagguccaccccgacauguucgaguaccuccuccaguucaucuacaccgacaccugcgacuuccucacccacggcuucaagccccgcauccaccucaacaagaaccccgaggaguaccagggcacccucaacucccaccucaacaaggucaacuuccacgaggacgacaaccagaaguccgccuucgaggucuacaaguccaaccaggcccagaccgucuccgagcgccagaaguccaagcccaaguccugcaagaagggcaagaacauccgcgaggacgaccccguccgcaugcuccagaccgucgccaagaaguucgacuucuccaaccucuccucccgccucgacggcguccgcuucgagaacgagaagaucaacgucaucgccaagaacaccggcaacaagcucaagcucucccagaagaagugcuccuuccucugcgacgucaccaugaaguccgucgacggcaaggaguuccccugccacaagugcguccucugcgcccgccucgaguacuuccacuccaugcucuccuccuccuggaucgaggccuccuccugcgccgcccucgagaugcccauccacuccgacauccucaaggucauccucgacuaccucuacaccgacgaggccgucgucaucaaggagucccagaacgucgacuucaucugcuccguccucgucgucgccgaccagcuccucaucacccgccucaaggagaucugcgaggucgcccucaccgagaagcucacccucaagaacgccgccaugcuccucgaguucgccgccauguacuccgccaagcagcucaagcucuccugccuccaguucaucggccucaacauggccgcccuccucgaggcccgcucccucgacguccucuccgacggcguccucaaggaccucuccgaguucuaccgcaagaugauccccgccauggaccgccgcgucaucacccccuaccaggacggccccgacaucuccuaccucgaggucgaggacggcgacaucuuccucaaggaggagaucaacauggagcagaaccacuccgagaccauguucaagaaggccaagaccaaggccaagaagaagccccgcaagcgcuccgacuccuccggcggcuacaaccucuccgacaucauccagucccccuccuccaccggccuccucaaguccggcaagaccaacuccgucgagucccuccccgagcuccucaccuccgacuccgagggcuccuacgccggcgucggcuccccccgcgaccuccagucccccgacuucaccaccggcuuccacuccgacaagaucgaggccaaggucaagcccuacgucaacggcaccucccccgucuacucccgcgaggaccucaagcccugggagaagucccccauccucaagaucuccgccccccagcccauccccuccaaccgcaucgacaccaccuccuccgccuccugggucgccggcuccuucucccccgucuccccccccgucgucgaccuccgcaccaucauggagaucgaggagucccgccagaagugcggcgccacccccaagucccaccucggcaagaccgucucccacggcgucaagcucucccagaagcagcgcaagaugaucgcccucaccaccaaggagaacaacuccggcaugaacuccauggagaccguccucuucacccccuccaaggcccccaagcccgucaacgccugggccuccucccuccacuccgucuccuccaaguccuuccgcgacuuccuccucgaggagaagaaguccgucaccucccacuccuccggcgaccacgucaagaaggucuccuucaagggcaucgagaacucccaggcccccaagaucguccgcugcuccacccacggcacccccggccccgagggcaaccacaucuccgaccucccccuccucgacucccccaaccccuggcucuccuccuccgucaccgcccccuccauggucgcccccgucaccuucgccuccaucgucgaggaggagcuccagcaggaggccgcccucauccgcucccgcgagaagccccucgcccucauccagaucgaggagcacgccauccaggaccuccucgucuucuacgaggccuucggcaaccccgaggaguucgucaucgucgagcgcaccccccagggcccccucgccguccccauguggaacaagcacggcugcuga

SEQ ID NO: 44447 - RNA, 1449 nt, Artificial Sequence
  derived and/or modified sequence opt2 from ICA1__Homo_sapiens__NP_001263407
auguccggccacaagugcuaccccugggaccuccaggaccgcuacgcccaggacaaguccgucgucaacaagaugcagcagaaguacugggagaccaagcaggccuucaucaaggccaccggcaagaaggaggacgagcacgucgucgccuccgacgccgaccucgacgccaagcucgagcucuuccacuccauccagcgcaccugccucgaccucuccaaggccaucguccucuaccagaagcgcaucugcuuccucucccaggaggagaacgagcucggcaaguuccuccgcucccagggcuuccaggacaagacccgcgccggcaagaugaugcaggccaccggcaaggcccucugcuucuccucccagcagcgccucgcccuccgcaacccccucugccgcuuccaccaggaggucgagaccuuccgccaccgcgccaucuccgacaccuggcucaccgucaaccgcauggagcagugccgcaccgaguaccgcggcgcccuccucuggaugaaggacgucucccaggagcucgaccccgaccucuacaagcagauggagaaguuccgcaagguccagacccagguccgccucgccaagaagaacuucgacaagcucaagauggacgucugccagaaggucgaccuccucggcgccucccgcugcaaccuccucucccacaugcucgccaccuaccagaccacccuccuccacuucugggagaagaccucccacaccauggccgccauccacgaguccuucaagggcuaccagcccuacgaguucaccacccucaagucccuccaggaccccaugaagaagcucgucgagaaggaggagaagaagaagaucaaccagcaggaguccaccgacgccgccguccaggagcccucccagcucaucucccucgaggaggagaaccagcgcaaggaguccuccuccuucaagaccgaggacggcaaguccauccucuccgcccucgacaagggcuccacccacaccgccugcuccggccccaucgacgagcuccucgacaugaaguccgaggagggcgccugccucggccccgucgccggcacccccgagcccgagggcgccgacaaggacgaccuccuccuccucuccgagaucuucaacgccuccucccucgaggagggcgaguucuccaaggagugggccgccgucuucggcgacggccaggucaaggagcccguccccaccauggcccucggcgagcccgaccccaaggcccagaccggcuccggcuuccuccccucccagcuccucgaccagaacaugaaggaccuccaggccucccuccaggagcccgccaaggccgccuccgaccucaccgccugguucucccucuucgccgaccucgacccccucuccaaccccgacgccgucggcaagaccgacaaggagcacgagcuccucaacgccuga

SEQ ID NO: 44448 - RNA, 1599 nt, Artificial Sequence
  derived and/or modified sequence opt2 from ICAM1__Homo_sapiens__NP_000192
auggcccccuccuccccccgccccgcccuccccgcccuccucguccuccucggcgcccucuuccccggccccggcaacgcccagaccuccgucucccccuccaaggucauccucccccgcggcggcuccguccucgucaccugcuccaccuccugcgaccagcccaagcuccucggcaucgagaccccccuccccaagaaggagcuccuccuccccggcaacaaccgcaaggucuacgagcucuccaacguccaggaggacucccagcccaugugcuacuccaacugccccgacggccaguccaccgccaagaccuuccucaccgucuacuggacccccgagcgcgucgagcucgccccccuccccuccuggcagcccgucggcaagaaccucacccuccgcugccaggucgagggcggcgccccccgcgccaaccucaccgucguccuccuccgcggcgagaaggagcucaagcgcgagcccgccgucggcgagcccgccgaggucaccaccaccguccucguccgccgcgaccaccacggcgccaacuucuccugccgcaccgagcucgaccuccgcccccagggccucgagcucuucgagaacaccuccgcccccuaccagcuccagaccuucguccuccccgccacccccccccagcucgucuccccccgcguccucgaggucgacacccagggcaccgucgucugcucccucgacggccucuuccccgucuccgaggcccagguccaccucgcccucggcgaccagcgccucaaccccaccgucaccuacggcaacgacuccuucuccgccaaggccuccgucuccgucaccgccgaggacgagggcacccagcgccucaccugcgccgucauccucggcaaccagucccaggagacccuccagaccgucaccaucuacuccuuccccgcccccaacgucauccucaccaagcccgaggucuccgagggcaccgaggucaccgucaagugcgaggcccacccccgcgccaaggucacccucaacggcguccccgcccagccccucggcccccgcgcccagcuccuccucaaggccacccccgaggacaacggccgcuccuucuccugcuccgccacccucgaggucgccggccagcucauccacaagaaccagacccgcgagcuccgcguccucuacggcccccgccucgacgagcgcgacugccccggcaacuggaccuggcccgagaacucccagcagacccccaugugccaggccuggggcaacccccuccccgagcucaagugccucaaggacggcaccuucccccuccccaucggcgaguccgucaccgucacccgcgaccucgagggcaccuaccucugccgcgcccgcuccacccagggcgaggucacccgcaaggucaccgucaacguccucuccccccgcuacgagaucgucaucaucaccgucgucgccgccgccgucaucaugggcaccgccggccucuccaccuaccucuacaaccgccagcgcaagaucaagaaguaccgccuccagcaggcccagaagggcacccccaugaagcccaacacccaggccaccccccccuga

SEQ ID NO: 44449 - RNA, 828 nt, Artificial Sequence
  derived and/or modified sequence opt2 from ICAM2__Homo_sapiens__NP_001093259
auguccuccuucggcuaccgcacccucaccgucgcccucuucacccucaucugcugccccggcuccgacgagaaggucuucgagguccacguccgccccaagaagcucgccgucgagcccaagggcucccucgaggucaacugcuccaccaccugcaaccagcccgaggucggcggccucgagaccucccucgacaagauccuccucgacgagcaggcccaguggaagcacuaccucgucuccaacaucucccacgacaccguccuccagugccacuucaccugcuccggcaagcaggaguccaugaacuccaacgucuccgucuaccagcccccccgccaggucauccucacccuccagcccacccucgucgccgucggcaaguccuucaccaucgagugccgcguccccaccgucgagccccucgacucccucacccucuuccucuuccgcggcaacgagacccuccacuacgagaccuucggcaaggccgcccccgccccccaggaggccaccgccaccuucaacuccaccgccgaccgcgaggacggccaccgcaacuucuccugccucgccguccucgaccucaugucccgcggcggcaacaucuuccacaagcacuccgcccccaagaugcucgagaucuacgagcccgucuccgacucccagauggucaucaucgucaccgucgucuccguccuccucucccucuucgucaccuccguccuccucugcuucaucuucggccagcaccuccgccagcagcgcaugggcaccuacggcguccgcgccgccuggcgccgccucccccaggccuuccgccccuga

SEQ ID NO: 44450 - RNA, 1644 nt, Artificial Sequence
  derived and/or modified sequence opt2 from ICAM3__Homo_sapiens__NP_002153
auggccaccaugguccccuccguccucuggccccgcgccugcuggacccuccucgucugcugccuccucacccccggcguccagggccaggaguuccuccuccgcgucgagccccagaaccccguccucuccgccggcggcucccucuucgucaacugcuccaccgacugccccuccuccgagaagaucgcccucgagaccucccucuccaaggagcucgucgccuccggcaugggcugggccgccuucaaccucuccaacgucaccggcaacucccgcauccucugcuccgucuacugcaacggcucccagaucaccggcuccuccaacaucaccgucuaccgccuccccgagcgcgucgagcucgccccccucccccccuggcagcccgucggccagaacuucacccuccgcugccaggucgaggacggcuccccccgcaccucccucaccgucguccuccuccgcugggaggaggagcucucccgccagcccgccgucgaggagcccgccgaggucaccgccaccguccucgccucccgcgacgaccacggcgcccccuucuccugccgcaccgagcucgacaugcagccccagggccucggccucuucgucaacaccuccgccccccgccagcuccgcaccuucguccuccccgucacccccccccgccucgucgccccccgcuuccucgaggucgagaccuccuggcccgucgacugcacccucgacggccucuuccccgccuccgaggcccaggucuaccucgcccucggcgaccagaugcucaacgccaccgucaugaaccacggcgacacccucaccgccaccgccaccgccaccgcccgcgccgaccaggagggcgcccgcgagaucgucugcaacgucacccucggcggcgagcgccgcgaggcccgcgagaaccucaccgucuucuccuuccucggccccaucgucaaccucuccgagcccaccgcccacgagggcuccaccgucaccgucuccugcauggccggcgcccgcguccaggucacccucgacggcguccccgccgccgcccccggccagcccgcccagcuccagcucaacgccaccgaguccgacgacggccgcuccuucuucugcuccgccacccucgaggucgacggcgaguuccuccaccgcaacuccuccguccagcuccgcguccucuacggccccaagaucgaccgcgccaccugcccccagcaccucaaguggaaggacaagacccgccacguccuccagugccaggcccgcggcaaccccuaccccgagcuccgcugccucaaggagggcuccucccgcgagguccccgucggcauccccuucuucgucaacgucacccacaacggcaccuaccagugccaggccuccuccucccgcggcaaguacacccucgucgucgucauggacaucgaggccggcuccucccacuucguccccgucuucgucgccguccuccucacccucggcgucgucaccaucguccucgcccucauguacgucuuccgcgagcaccagcgcuccggcuccuaccacguccgcgaggaguccaccuaccucccccucaccuccaugcagcccaccgaggccaugggcgaggagcccucccgcgccgaguga

SEQ ID NO: 44451 - RNA, 819 nt, Artificial Sequence
  derived and/or modified sequence opt2 from ICAM4__Homo_sapiens__NP_001034221
augggcucccucuucccccucucccuccucuucuuccucgccgccgccuaccccggcgucggcuccgcccucggccgccgcaccaagcgcgcccagucccccaagggcuccccccucgcccccuccggcaccuccguccccuucuggguccgcaugucccccgaguucgucgccguccagcccggcaaguccguccagcucaacugcuccaacuccugcccccagccccagaacuccucccuccgcaccccccuccgccagggcaagacccuccgcggccccggcugggucuccuaccagcuccucgacguccgcgccugguccucccucgcccacugccucgucaccugcgccggcaagacccgcugggccaccucccgcaucaccgccuacuccguccccggcggccuccucggcggcgaccccgaggccuggaagcccggccaccucuuccgcaagcccggcgcccuccaccgccccggcuccggccagcgcgaccucgaccuccgcgucugcugcuggaccccccgccuccucgccgcccgcgaccucccccgcgccccccagucccgccgccccggcggcccccagcagcucggcacccacuacaccgacgcccgccucgagccccgcgcccacuccuucggccuccgcuuccaccgcugccccugccgcgaccccccccacugcggccgcugcguccccaugcagguccccuccuacgagguccccggcgucaagggcgacguccucugccgccucuccgagaagaagcgcaacaugaagcaguccggcgagauggccauccacggcggcuga

SEQ ID NO: 44452 - RNA, 2775 nt, Artificial Sequence
  derived and/or modified sequence opt2 from ICAM5__Homo_sapiens__NP_003250
augcccggccccucccccggccuccgccgcgcccuccucggccucugggccgcccucggccucggccucuucggccucuccgccgucucccaggagcccuucugggccgaccuccagccccgcgucgccuucgucgagcgcggcggcucccucuggcucaacugcuccaccaacugcccccgccccgagcgcggcggccucgagaccucccuccgccgcaacggcacccagcgcggccuccgcuggcucgcccgccagcucgucgacauccgcgagcccgagacccagcccgucugcuucuuccgcugcgcccgccgcacccuccaggcccgcggccucauccgcaccuuccagcgccccgaccgcgucgagcucaugccccucccccccuggcagcccgucggcgagaacuucacccucuccugccgcguccccggcgccggcccccgcgccucccucacccucacccuccuccgcggcgcccaggagcucauccgccgcuccuucgccggcgagcccccccgcgcccgcggcgccguccucaccgccaccguccucgcccgccgcgaggaccacggcgccaacuucuccugccgcgccgagcucgaccuccgcccccacggccucggccucuucgagaacuccuccgccccccgcgagcuccgcaccuucucccucucccccgacgccccccgccucgccgccccccgccuccucgaggucggcuccgagcgccccgucuccugcacccucgacggccucuuccccgccuccgaggcccgcgucuaccucgcccucggcgaccagaaccucucccccgacgucacccucgagggcgacgccuucgucgccaccgccaccgccaccgccuccgccgagcaggagggcgcccgccagcucgucugcaacgucacccucggcggcgagaaccgcgagacccgcgagaacgucaccaucuacuccuuccccgccccccuccucacccucuccgagcccuccgucuccgagggccagauggucaccgucaccugcgccgccggcgcccaggcccucgucacccucgagggcguccccgccgccguccccggccagcccgcccagcuccagcucaacgccaccgagaacgacgaccgccgcuccuucuucugcgacgccacccucgacgucgacggcgagacccucaucaagaaccgcuccgccgagcuccgcguccucuacgccccccgccucgacgacuccgacugcccccgcuccuggaccuggcccgagggccccgagcagacccuccgcugcgaggcccgcggcaaccccgagcccuccguccacugcgcccgcuccgacggcggcgccguccucgcccucggccuccucggccccgucacccgcgcccucuccggcaccuaccgcugcaaggccgccaacgaccagggcgaggccgucaaggacgucacccucaccgucgaguacgcccccgcccucgacuccgucggcugccccgagcgcaucaccuggcucgagggcaccgaggccucccucuccugcgucgcccacggcguccccccccccgacgucaucugcguccgcuccggcgagcucggcgccgucaucgagggccuccuccgcgucgcccgcgagcacgccggcaccuaccgcugcgaggccaccaacccccgcggcuccgccgccaagaacgucgccgucaccgucgaguacggcccccgcuucgaggagcccuccugccccuccaacuggaccugggucgagggcuccggccgccucuucuccugcgaggucgacggcaagccccagcccuccgucaagugcgucggcuccggcggcgccaccgagggcguccuccucccccucgccccccccgaccccuccccccgcgccccccgcaucccccgcguccucgcccccggcaucuacgucugcaacgccaccaaccgccacggcuccgucgccaagaccgucgucgucuccgccgaguccccccccgagauggacgaguccaccugccccucccaccagaccuggcucgagggcgccgaggccuccgcccucgccugcgccgcccgcggccgccccucccccggcguccgcugcucccgcgagggcauccccuggcccgagcagcagcgcgucucccgcgaggacgccggcaccuaccacugcgucgccaccaacgcccacggcaccgacucccgcaccgucaccgucggcgucgaguaccgccccgucgucgccgagcucgccgccuccccccccggcggcguccgccccggcggcaacuucacccucaccugccgcgccgaggccuggccccccgcccagaucuccuggcgcgccccccccggcgcccucaacaucggccucuccuccaacaacuccacccucuccgucgccggcgccaugggcucccacggcggcgaguacgagugcgccgccaccaacgcccacggccgccacgcccgccgcaucaccguccgcgucgccggccccuggcucugggucgccgucggcggcgccgccggcggcgccgcccuccucgccgccggcgccggccucgccuucuacguccaguccaccgccugcaagaagggcgaguacaacguccaggaggccgaguccuccggcgaggccgucugccucaacggcgccggcggcggcgccggcggcgccgccggcgccgagggcggccccgaggccgccggcggcgccgccgagucccccgccgagggcgaggucuucgccauccagcucaccuccgccuga

SEQ ID NO: 44453 - RNA, 6801 nt, Artificial Sequence
  derived and/or modified sequence opt2 from ICE1__Homo_sapiens__NP_056140
augaugcccggcgagacccacuccgccgcccccggcaccgccgccgaccucucccgcugccagggcugcgccucccuccagcagaaccucaacgaguacgucgaggcccucaucacccucaagcagaagaucaucaacaccgacaaccuccucaccgaguaccagaagaagugcgacgagcuccaguucgcccgccgcgagaacuccaaccuccaccaccaggucgaggagaugcuccagaagaucuccccccuccagaagugccaggaggagcucggcucccucaaggccgagcucgaggagaagaaguccucccucaagcucuaccaggacacccaccaggaguacgcccgcgucaaggaggagugccucaaguccgacgcccagaagaagaagcucgaggccaaggucaagaagcuccaggaggccgccgucaagcagacccaggacuucaagcagcuccgcaacgagaagaagauccucgagaaggaguucaagaagacccaggagcgccucgacgaguucuccaagcagaagaacgagaaggagcuccgccacaucggcacccagaucuccuccgacuccuacggcuccaucgacaagcgcaaggucaagcuccuccucaaggagcucuggcucugcgucaacaccacccaccgccuccccggcgagggcucccgcugcguccccgagaagcccgccaaggccaucaccuccucccgcguccccggcgaggacggcacccucccccccacccagggcuccccccuccgcaccuccaacguccagaccugccucaccaagcucuccauggagaucaaggaggacuuccucugccagaacgucgagaagcaguccuccuccggcaccaacugcuccuccgaccacgucuucaacgagaacggcaaccucgagguccucguccagucccaccgcgacggcggcuccaccgaguucgucgaccacgaccacuucuucgacgaggaccuccaggccgccaucgacuucuucaagcucccccccccccuccucucccccguccccucccccccccccauguccuccccccaccccggcucccuccccuccuccuucgcccccgagaccuacuucggcgaguacaccgacuccuccgacaacgacuccguccagcuccgcaacuccgccgagugcgucuccgaggacgacaccaccgagucccagaacuacuucggcucccuccgcaagaacaagggcuccggcaccugggaggagaagcccaagucccacgaggccauccaggcccucaacaccugggaggucaacaaggucaccaccuccggccucgagaccuucaccgccacccuccgcgaguccuccgccacccacucccucgucggcgagaagcacuggaccaccgccucccgcuccauguccgaccgcaagcgcgacauccuccacgagaccaagacccagauggagguccgcgagauggacaaguccguccagaccgagaagaccauccacaagcucacccgcggccucugcaucgagcgccucuccgccucccccgcccaggagaaggaggccgcccccggcaaguccgagcucugcuccuccccccucggcaagcgcccccucaacgagcucauggaguccgagggcaagaccguccucuccaagaugaugggcucccccaaguccgaguucaccaaguggacccgcaucaacgagaucaccuccgagcccgaccgcaucaccgucuccggccacuuccaccgccucucccgcgagcucgagaaggagaaggaggacacccagggcuucacccucggcgagucccccgaguccgaggacgacgacuccggcgacggcauggacgucgccggccucgacaucgagaccuccuucuccuccuccuccacccucgucgcccucuccgucggcuccaacccccaguccuccuccggccucgacugcggcaacgacaccgacaucaccaccaaggucuucuccaccgagccccaccacuccgagcacaagcuccagaccaagacccucaacacccuccaccuccaguccgagccccccgagugcuccaucggcggcaacaaccucgagaacucccucugcgcccucucccccgagcucggcgccuccaacuucaacgaccagaaguccuccggcaucgaguacaccaaggucgucaagggccucaccaagauccacucccucccccgcuccgucuucaugaaggccaccaaggacggccagugcgagucccaggacccccgcaucgagcucacccucaacaagcccgacuucaccucccucaucggcucccaggccgcccucaucaaguccggccucggcuucgucaaguccaccuccuggcaccacuccgaccuccuccgcaagggcggcgaggagucccuccgcgccaaguccgagcacgagcagaagaccucccaccagcuccagaaggccaugcccuuccuccagaaccgcggccccacccccaagcccgaccuccuccgcgagaacaacaaccccgucgaguucaagaccaccgccuccguccuccccaaccaggucuccgucaucaccaagcagacccgccccgagaagguccaguccgccaagcucgagcaccuccgcccccaccgcgucgagcccacccucgucaccgagaacuccggcaacaagaccggcauguccaccgucgccaagugcgacggcgagcgcgacgacaccacccagaacaucaccgaggucgccgccgucaaguccaucucccccgaggucuccgccucccgccgcaagcucgacuucaacucccccggcggcuccucccccgucgagaacuccgacugcuccaccaacucccgccucuccuucucccccgagaacauccucauccagaaccaggacaucguccgcgaggccgccguccagggcgacggccagaagcagcgccagccccaggccaccgaccucgacuccuccggcacccacggcuccgagaugcuccccgccaccgaggucaccgucuccggcggcuucuccgucgaggagaccuccugcggcgacaccggccgcuccggcggcgaggcccucgccgucgccaacgacuccaccuccaccccccagaacgccaacggccucuggaagcucaaguccaccacccccggcggcgcccuccccgagugcuucggcaccaccgacaccaccuucuccuccgccuucugccgcaagcacggcgagacccaggacaccucccaguccucccuccccggcacccuccacugcuacaccggcauccgcgagggcggcgacgacaccgaggucgaguccgaggccuucuccugcuccgagggcuccgagcagcaggacgcccccgacgacucccagaagaaccucggcgacaccgacgccgccgucgccgagguccgccccucccucgaggucggcuaccucaccuccgcccuccaggacuucaacaucuccaccuucuccgagcucgaccgccucuccaccuccgaggucgucauguuccucgaguccugccagcucggcgacuacuccuccggcgacuccgucuccgagugcuccuccaagggcacccucuccaaggagaugaacaaggagcucaaggccuccgagaucggcgagaaguaccgcaagcagcccugcgaggaggagacccucggcaccugcgaggaguggaucgaguccgaggaggacgacuacucccucaagaacaccucccagcucacccagugcucccucgagacccucuccgagguccucaccaagauccgccaggagcuccagaccaacuccgaggacugcaacggcaaggacaccggcucccuccuccuccucaacgucaacaacaacaugaccaccgagaaccucaaggagaagucccccuuccgcgagaccaccggcuccuccucccacgccuccgagcccaccccccaggccgccgcccucgacaccgagggcuccucccccaucuccggcaugccccagaacgagaacccccagucccgccccgaggcccgcuccgacgccggccgccagaccgacggcggcgaggaggaccuccccgagcccgucgagcccuccgcccucugcuccgacuccgucauggagcccuccaucgagcaguccuccaacugcgaggccgagaccaccuuccagugccagaucgccaccgucaccuccgaggucaucaacguccucaucaacaaggaccagaaccucgucaucgagaagggcgacaacuggaccaucaucuccggcgucgccguccucccccacgucgaccaggucacccucugcgacauccccggcgacauccccaucucccaggaccagggcgagcucgaggccggcugcauccccgucaccuccgccgagaagucccccgaggccucccacaccggccccgccuuccaggaggcccccugcggcaacaaccucuccugcccccaggaggacgucuccuccuccggccaguccaccaacuucgacaagucccgccuccgcaaccgccccgucaagcccuccaucuggaucuccucccagaucuacgaccagaacuucgagacccagaucgucgccuccgaccacaccuacuacaacuccaagcucgagcccuccggcaagaacaagaaccgcuccaagaucuccaacaaggaccaguccaacaagcccgucaagaccuccgccuccucccgcgucgagacccaccaguccgaggucgcccaguccuucuccggcgagaaggccaacaccaagacccagcgcucccagacccagaccauccucgccaacgccgacaccuccacccccaccgacugcucccccgacacccucuccaagauccgccaggaggucggccccccccuccccccccuccucgccccccucaucgccacccccccccgcaccucccagccccucuccccccucaucuccuccuccucccccuccucccccgccucccccgucggccaggucucccccuuccgcgagacccccgucccccccgccaugucccccuggcccgaggacccccgccgcgccuccccccccgaccccucccccucccccuccgccgccuccgccuccgagcgcgucguccccuccccccuccaguucugcgccgccacccccaagcacgcccuccccguccccggccgccucccccccugcgccuccggccacgccgccgucggcggcccccaggagaacuccgucaagauccucgacaccauguaccccgagcucuccgcccgcgcccgcacccucaacauccucaagggcaacauccagcucacccgcggcccccccgccgacugcaagaaccuccccggccccgccuccgccaugaucggcuucaagaccaucaccuccgccgccaccgccuucgucaagaccggcuccuccuccggcggcgacugcaaccaggacaagucccgcgaccucggcacccagcaggacuccuccggcaagcgcacccucuccaccuccacccuccgcuccgccaagcgccuccgccucgacaccggcucccccgagcccgagacccgcggcgucaccgccgagggcauccacaagaaccuccccggcaaccucccccccgccgaggucgccaccaccaacgaggagcgcuccugcuccucccccgccgucuccgccgucucccagcucccccucucccccaaggagaccgucgagucccacgacaaggccaucgccaacgcccucaagaagaucgccgaguucuccuucgaccuccuccccgucauccgcucccacgucuacgucggcaacaucuccaagaagcccgucaugcgcgaccaggagaaggaggucgucuacgaguucuccaccaccaagaagcaccucgccgagugccuccuccacuccauccucuccgagcucaagauccagaagaucuccauggaccacaacuacauccacgcccucugccgcgucuacgucggcaucugccgccagcucggcgaccucgagcgcgcccgccucuucugcuacucccuccucaaggaggacuuccccgaguccgagaagcucacccucuucaucgccaacauguggcacgacaucuuccucucccaguccgucaucaacaaggccaugcagcucgucgcccgccagcgcgccaagggcgagguccucaacugccuccgcgccuuccucaacugggagaagaacgcccccgucgacgucggcuucauggucuccaagcuccuccucaccauccagcucugccccaagaccgaguuccagcccuccgagaaguucggcgaggaccucuccgacaacaccugggaguacaucuucgccaucgaccuccucugcugccaccagaaguggaucuggacccacgacaacaucaucuccaaggagcucuggcccgucauggacaaguggaucaaguaccgcaagggccacgccaacaucgccuacacccccgacaucaucaucgccuccauccuccgccucaucggccgccucggccagcucggccucaaggagggcuuccccuccgccgucaagaacaucuccuccgucaucggcauguucauccagcacgcccacgacgaggacauccccuggggcauccagcucgccgccgucuacgcccucugcgaccucucccccuccaaccccgccgagaucuccaagauccucgaggccuggcgccgcgaggccuccaaguccguccccuccgccaucgucuccugccucgaggaggucuccgcccucuccaccgaggagcucggcuga

SEQ ID NO: 44454 - RNA, 1152 nt, Artificial Sequence
  derived and/or modified sequence opt2 from ICE2__Homo_sapiens__NP_001263314
auguccuccaagauggucaucuccgagcccggccucaacugggacaucucccccaagaacggccucaagaccuucuucucccgcgagaacuacaaggaccacuccauggcccccucccucaaggagcuccgcguccucuccaaccgccgcaucggcgagaaccucaacgccuccgccuccuccgucgagaacgagcccgccgucuccuccgccacccaggccaaggagaaggucaagaccaccaucggcaugguccuccuccccaagccccgcguccccuacccccgcuucucccgcuucucccagcgcgagcagcgcuccuacgucgaccuccucgucaaguacgccaagauccccgccaacuccaaggccgucggcaucaacaagaacgacuaccuccaguaccucgacaugaagaagcacgucaacgaggaggucaccgaguuccucaaguuccuccagaacuccgccaagaagugcgcccaggacuacaacaugcucuccgacgacgcccgccucuucaccgagaagauccuccgcgccugcaucgagcaggucaagaaguacuccgaguucuacacccuccacgaggucaccucccucaugggcuucuuccccuuccgcgucgagaugggccucaagcucgagaagacccuccucgcccucggcuccgucaaguacgucaagaccgucuuccccuccaugcccaucaagcuccagcucuccaaggacgacaucgccaccaucgagaccuccgagcagaccgccgaggccaugcacuacgacaucuccaaggaccccaacgccgagaagcucgucucccgcuaccacccccagaucgcccucaccucccagucccucuucacccuccucaacaaccacggccccaccuacaaggagcagugggagauccccgucugcauccaggucauccccgucgccggcuccaagcccgucaaggucaucuacaucaacuccccccucccccagaagaagaugaccaugcgcgagcgcaaccagaucuuccacgaggucccccucaaguucaugauguccaagaacaccuccguccccgucuccgccgucuucauggacaagcccgaggaguucaucuccgagauggacgucugcaacgccuucuucuuccccuga

SEQ ID NO: 44455 - RNA, 1899 nt, Artificial Sequence
  derived and/or modified sequence opt2 from ICK__Homo_sapiens__NP_057597
augaaccgcuacaccaccauccgccagcucggcgacggcaccuacggcuccguccuccucggccgcuccaucgaguccggcgagcucaucgccaucaagaagaugaagcgcaaguucuacuccugggaggagugcaugaaccuccgcgaggucaagucccucaagaagcucaaccacgccaacgucgucaagcucaaggaggucauccgcgagaacgaccaccucuacuucaucuucgaguacaugaaggagaaccucuaccagcucaucaaggagcgcaacaagcucuuccccgaguccgccauccgcaacaucauguaccagauccuccagggccucgccuucauccacaagcacggcuucuuccaccgcgaccucaagcccgagaaccuccucugcaugggccccgagcucgucaagaucgccgacuucggccucgcccgcgagauccgcuccaagccccccuacaccgacuacgucuccacccgcugguaccgcgcccccgagguccuccuccgcuccaccaacuacuccucccccaucgacgucugggccgucggcugcaucauggccgaggucuacacccuccgcccccucuuccccggcgccuccgagaucgacaccaucuucaagaucugccagguccucggcacccccaagaagaccgacuggcccgagggcuaccagcucuccuccgccaugaacuuccgcuggccccagugcguccccaacaaccucaagacccucauccccaacgccuccuccgaggccguccagcuccuccgcgacaugcuccagugggaccccaagaagcgccccaccgccucccaggcccuccgcuaccccuacuuccaggucggccacccccucggcuccaccacccagaaccuccaggacuccgagaagccccagaagggcauccucgagaaggccggccccccccccuacaucaagcccgucccccccgcccagccccccgccaagccccacacccgcaucuccucccgccagcaccaggccucccagcccccccuccaccucaccuaccccuacaaggccgaggucucccgcaccgaccaccccucccaccuccaggaggacaagcccuccccccuccucuuccccucccuccacaacaagcacccccaguccaagaucaccgccggccucgagcacaagaacggcgagaucaagcccaagucccgccgccgcuggggccucaucucccgcuccaccaaggacuccgacgacugggccgaccucgacgaccucgacuucucccccucccucucccgcaucgaccucaagaacaagaagcgccaguccgacgacacccucugccgcuucgaguccguccucgaccucaagcccuccgagcccgucggcaccggcaacuccgcccccacccagaccuccuaccagcgccgcgacacccccacccuccgcuccgccgccaagcagcacuaccucaagcacucccgcuaccuccccggcaucuccauccgcaacggcauccucuccaaccccggcaaggaguucaucccccccaaccccugguccuccuccggccucuccggcaaguccuccggcaccauguccgucaucuccaaggucaacuccgucggcuccuccuccaccuccuccuccggccucaccggcaacuacguccccuccuuccucaagaaggagaucggcuccgccaugcagcgcguccaccucgcccccauccccgaccccucccccggcuacuccucccucaaggccaugcgcccccaccccggccgccccuucuuccacacccagccccgcuccacccccggccucaucccccgcccccccgccgcccagcccguccacggccgcaccgacugggccuccaaguacgccucccgccgcuga

SEQ ID NO: 44456 - RNA, 567 nt, Artificial Sequence
  derived and/or modified sequence opt2 from ICMT__Homo_sapiens__XP_011539442
augugcucccucucccucuuccacuacuccgaguaccucgucaccgccgucaacaaccccaagucccucucccucgacuccuuccuccucaaccacucccucgaguacaccgucgccgcccucuccuccuggcucgaguucacccucgagaacaucuucuggcccgagcucaagcagaucaccuggcucuccgucaccggccuccucauggucgucuucggcgagugccuccgcaaggccgccauguucaccgccggcuccaacuucaaccacgucguccagaacgagaaguccgacacccacacccucgucaccuccggcgucuacgccugguuccgccaccccuccuacgucggcugguucuacugguccaucggcacccaggucaugcucugcaaccccaucugcggcgucuccuacgcccucaccgucuggcgcuucuuccgcgaccgcaccgaggaggaggagaucucccucauccacuucuucggcgaggaguaccucgaguacaagaagcgcguccccaccggccuccccuucaucaagggcgucaaggucgaccucuga

SEQ ID NO: 44457 - RNA, 600 nt, Artificial Sequence
  derived and/or modified sequence opt2 from ICOS__Homo_sapiens__NP_036224
augaaguccggccucugguacuucuuccucuucugccuccgcaucaagguccucaccggcgagaucaacggcuccgccaacuacgagauguucaucuuccacaacggcggcguccagauccucugcaaguaccccgacaucguccagcaguucaagaugcagcuccucaagggcggccagauccucugcgaccucaccaagaccaagggcuccggcaacaccgucuccaucaagucccucaaguucugccacucccagcucuccaacaacuccgucuccuucuuccucuacaaccucgaccacucccacgccaacuacuacuucugcaaccucuccaucuucgaccccccccccuucaaggucacccucaccggcggcuaccuccacaucuacgagucccagcucugcugccagcucaaguucuggcuccccaucggcugcgccgccuucgucgucgucugcauccucggcugcauccucaucugcuggcucaccaagaagaaguacuccuccuccguccacgaccccaacggcgaguacauguucaugcgcgccgucaacaccgccaagaagucccgccucaccgacgucacccucuga

SEQ ID NO: 44458 - RNA, 930 nt, Artificial Sequence
  derived and/or modified sequence opt2 from ICOSLG__Homo_sapiens__NP_001269979
augcgccucggcucccccggccuccucuuccuccucuucuccucccuccgcgccgacacccaggagaaggagguccgcgccauggucggcuccgacgucgagcucuccugcgccugccccgagggcucccgcuucgaccucaacgacgucuacgucuacuggcagaccuccgaguccaagaccgucgucaccuaccacaucccccagaacuccucccucgagaacgucgacucccgcuaccgcaaccgcgcccucaugucccccgccggcaugcuccgcggcgacuucucccuccgccucuucaacgucaccccccaggacgagcagaaguuccacugccucguccucucccagucccucggcuuccaggagguccucuccgucgaggucacccuccacgucgccgccaacuucuccguccccgucgucuccgccccccacucccccucccaggacgagcucaccuucaccugcaccuccaucaacggcuacccccgccccaacgucuacuggaucaacaagaccgacaacucccuccucgaccaggcccuccagaacgacaccgucuuccucaacaugcgcggccucuacgacgucgucuccguccuccgcaucgcccgcacccccuccgucaacaucggcugcugcaucgagaacguccuccuccagcagaaccucaccgucggcucccagaccggcaacgacaucggcgagcgcgacaagaucaccgagaaccccgucuccaccggcgagaagaacgccgccaccugguccauccucgccguccucugccuccucgucgucgucgccgucgccaucggcugggucugccgcgaccgcugccuccagcacuccuacgccggcgccugggccgucucccccgagaccgagcucaccgaguccuggaaccuccuccuccuccucuccuga

SEQ ID NO: 44459 - RNA, 468 nt, Artificial Sequence
  derived and/or modified sequence opt2 from ID1__Homo_sapiens__NP_002156
augaaggucgccuccggcuccaccgccaccgccgccgccggccccuccugcgcccucaaggccggcaagaccgccuccggcgccggcgaggucguccgcugccucuccgagcaguccgucgccaucucccgcugcgccggcggcgccggcgcccgccuccccgcccuccucgacgagcagcaggucaacguccuccucuacgacaugaacggcugcuacucccgccucaaggagcucguccccacccucccccagaaccgcaaggucuccaaggucgagauccuccagcacgucaucgacuacauccgcgaccuccagcucgagcucaacuccgaguccgaggucggcacccccggcggccgcggccuccccguccgcgccccccucuccacccucaacggcgagaucuccgcccucaccgccgaggccgccugcguccccgccgacgaccgcauccucugccgcuga

SEQ ID NO: 44460 - RNA, 405 nt, Artificial Sequence
  derived and/or modified sequence opt2 from ID2__Homo_sapiens__NP_002157
augaaggccuucucccccguccgcuccguccgcaagaacucccucuccgaccacucccucggcaucucccgcuccaagacccccgucgacgaccccaugucccuccucuacaacaugaacgacugcuacuccaagcucaaggagcucguccccuccaucccccagaacaagaaggucuccaagauggagauccuccagcacgucaucgacuacauccucgaccuccagaucgcccucgacucccaccccaccaucgucucccuccaccaccagcgccccggccagaaccaggccucccgcaccccccucaccacccucaacaccgacaucuccauccucucccuccaggccuccgaguuccccuccgagcucauguccaacgacuccaaggcccucugcggcuga

SEQ ID NO: 44461 - RNA, 486 nt, Artificial Sequence
  derived and/or modified sequence opt2 from ID4__Homo_sapiens__NP_001537
augaaggccgucucccccguccgccccuccggccgcaaggcccccuccggcugcggcggcggcgagcucgcccuccgcugccucgccgagcacggccacucccucggcggcuccgccgccgccgccgccgccgccgccgccgcccgcugcaaggccgccgaggccgccgccgacgagcccgcccucugccuccagugcgacaugaacgacugcuacucccgccuccgccgccucguccccaccaucccccccaacaagaaggucuccaaggucgagauccuccagcacgucaucgacuacauccucgaccuccagcucgcccucgagacccaccccgcccuccuccgccagccccccccccccgcccccccccaccaccccgccggcaccugccccgccgcccccccccgcaccccccucaccgcccucaacaccgaccccgccggcgccgucaacaagcagggcgacuccauccucugccgcuga

SEQ ID NO: 44462 - RNA, 1395 nt, Artificial Sequence
  derived and/or modified sequence opt2 from IDE__Homo_sapiens__NP_001159418
auguccaagcucugguucaagcaggacgacaaguucuuccuccccaaggccugccucaacuucgaguucuucucccccuucgccuacgucgacccccuccacugcaacauggccuaccucuaccucgagcuccucaaggacucccucaacgaguacgccuacgccgccgagcucgccggccucuccuacgaccuccagaacaccaucuacggcauguaccucuccgucaagggcuacaacgacaagcagcccauccuccucaagaagaucaucgagaagauggccaccuucgagaucgacgagaagcgcuucgagaucaucaaggaggccuacaugcgcucccucaacaacuuccgcgccgagcagccccaccagcacgccauguacuaccuccgccuccucaugaccgaggucgccuggaccaaggacgagcucaaggaggcccucgacgacgucacccucccccgccucaaggccuucaucccccagcuccucucccgccuccacaucgaggcccuccuccacggcaacaucaccaagcaggccgcccucggcaucaugcagauggucgaggacacccucaucgagcacgcccacaccaagccccuccuccccucccagcucguccgcuaccgcgagguccagcuccccgaccgcggcugguucgucuaccagcagcgcaacgagguccacaacaacugcggcaucgagaucuacuaccagaccgacaugcaguccaccuccgagaacauguuccucgagcucuucugccagaucaucuccgagcccugcuucaacacccuccgcaccaaggagcagcucggcuacaucgucuucuccggcccccgccgcgccaacggcauccagggccuccgcuucaucauccaguccgagaagcccccccacuaccucgagucccgcgucgaggccuuccucaucaccauggagaaguccaucgaggacaugaccgaggaggccuuccagaagcacauccaggcccucgccauccgccgccucgacaagcccaagaagcucuccgccgagugcgccaaguacuggggcgagaucaucucccagcaguacaacuucgaccgcgacaacaccgaggucgccuaccucaagacccucaccaaggaggacaucaucaaguucuacaaggagaugcucgccgucgacgccccccgccgccacaaggucuccguccacguccucgcccgcgagauggacuccugccccgucgucggcgaguuccccugccagaacgacaucaaccucucccaggcccccgcccucccccagcccgaggucauccagaacaugaccgaguucaagcgcggccucccccucuucccccucgucaagccccacaucaacuucauggccgccaagcucuga

SEQ ID NO: 44463 - RNA, 1245 nt, Artificial Sequence
  derived and/or modified sequence opt2 from IDH1__Homo_sapiens__NP_001269315
auguccaagaagaucuccggcggcuccgucgucgagaugcagggcgacgagaugacccgcaucaucugggagcucaucaaggagaagcucaucuuccccuacgucgagcucgaccuccacuccuacgaccucggcaucgagaaccgcgacgccaccaacgaccaggucaccaaggacgccgccgaggccaucaagaagcacaacgucggcgucaagugcgccaccaucacccccgacgagaagcgcgucgaggaguucaagcucaagcagauguggaagucccccaacggcaccauccgcaacauccucggcggcaccgucuuccgcgaggccaucaucugcaagaacaucccccgccucgucuccggcugggucaagcccaucaucaucggccgccacgccuacggcgaccaguaccgcgccaccgacuucgucguccccggccccggcaaggucgagaucaccuacacccccuccgacggcacccagaaggucaccuaccucguccacaacuucgaggagggcggcggcgucgccaugggcauguacaaccaggacaaguccaucgaggacuucgcccacuccuccuuccagauggcccucuccaagggcuggccccucuaccucuccaccaagaacaccauccucaagaaguacgacggccgcuucaaggacaucuuccaggagaucuacgacaagcaguacaagucccaguucgaggcccagaagaucugguacgagcaccgccucaucgacgacauggucgcccaggccaugaaguccgagggcggcuucaucugggccugcaagaacuacgacggcgacguccaguccgacuccgucgcccagggcuacggcucccucggcaugaugaccuccguccucgucugccccgacggcaagaccgucgaggccgaggccgcccacggcaccgucacccgccacuaccgcauguaccagaagggccaggagaccuccaccaaccccaucgccuccaucuucgccuggacccgcggccucgcccaccgcgccaagcucgacaacaacaaggagcucgccuucuucgccaacgcccucgaggaggucuccaucgagaccaucgaggccggcuucaugaccaaggaccucgccgccugcaucaagggccuccccaacguccagcgcuccgacuaccucaacaccuucgaguucauggacaagcucggcgagaaccucaagaucaagcucgcccaggccaagcucuga

SEQ ID NO: 44464 - RNA, 1203 nt, Artificial Sequence
  derived and/or modified sequence opt2 from IDH2__Homo_sapiens__NP_001276839
auggacggcgacgagaugacccgcaucaucuggcaguucaucaaggagaagcucauccucccccacgucgacauccagcucaaguacuucgaccucggccuccccaaccgcgaccagaccgacgaccaggucaccaucgacuccgcccucgccacccagaaguacuccgucgccgucaagugcgccaccaucacccccgacgaggcccgcgucgaggaguucaagcucaagaagauguggaagucccccaacggcaccauccgcaacauccucggcggcaccgucuuccgcgagcccaucaucugcaagaacaucccccgccucguccccggcuggaccaagcccaucaccaucggccgccacgcccacggcgaccaguacaaggccaccgacuucgucgccgaccgcgccggcaccuucaagauggucuucacccccaaggacggcuccggcgucaaggagugggaggucuacaacuuccccgccggcggcgucggcaugggcauguacaacaccgacgaguccaucuccggcuucgcccacuccugcuuccaguacgccauccagaagaaguggccccucuacauguccaccaagaacaccauccucaaggccuacgacggccgcuucaaggacaucuuccaggagaucuucgacaagcacuacaagaccgacuucgacaagaacaagaucugguacgagcaccgccucaucgacgacauggucgcccagguccucaaguccuccggcggcuucgucugggccugcaagaacuacgacggcgacguccaguccgacauccucgcccagggcuucggcucccucggccucaugaccuccguccucgucugccccgacggcaagaccaucgaggccgaggccgcccacggcaccgucacccgccacuaccgcgagcaccagaagggccgccccaccuccaccaaccccaucgccuccaucuucgccuggacccgcggccucgagcaccgcggcaagcucgacggcaaccaggaccucauccgcuucgcccagaugcucgagaaggucugcgucgagaccgucgaguccggcgccaugaccaaggaccucgccggcugcauccacggccucuccaacgucaagcucaacgagcacuuccucaacaccaccgacuuccucgacaccaucaaguccaaccucgaccgcgcccucggccgccaguga

SEQ ID NO: 44465 - RNA, 1131 nt, Artificial Sequence
  derived and/or modified sequence opt2 from IDH3B__Homo_sapiens__NP_001245313
auggccgcccucuccggcguccgcuggcucacccgcgcccucgucuccgccggcaaccccggcgccuggcgcggccucuccaccuccgccgccgcccacgccgccucccgcucccaggccgaggacguccgcgucgagggcuccuuccccgucaccaugcuccccggcgacggcgucggccccgagcucaugcacgccgucaaggaggucuucaaggccgccgccguccccgucgaguuccaggagcaccaccucuccgagguccagaacauggccuccgaggagaagcucgagcagguccucuccuccaugaaggagaacaaggucgccaucaucggcaagauccacacccccauggaguacaagggcgagcucgccuccuacgacaugcgccuccgccgcaagcucgaccucuucgccaacgucguccacgucaagucccuccccggcuacaugacccgccacaacaaccucgaccucgucaucauccgcgagcagaccgagggcgaguacuccucccucgagcacgaguccgcccgcggcgucaucgagugccucaagaucgucacccgcgccaagucccagcgcaucgccaaguucgccuucgacuacgccaccaagaagggccgcggcaaggucaccgccguccacaaggccaacaucaugaagcucggcgacggccucuuccuccagugcugcgaggaggucgccgagcucuaccccaagaucaaguucgagaccaugaucaucgacaacugcugcaugcagcucguccagaaccccuaccaguucgacguccucgucaugcccaaccucuacggcaacaucaucgacaaccucgccgccggccucgucggcggcgccggcgucguccccggcgaguccuacuccgccgaguacgccgucuucgagaccggcgcccgccaccccuucgcccaggccgucggccgcaacaucgccaaccccaccgccaugcuccucuccgccuccaacaugcuccgccaccucaaccucgaguaccacuccuccaugaucgccgacgccgucaagaaggucaucaaggucggcaagauccccuccgccguccccuccuuccuccuccacccccuccccuucuccugggccaucuga

SEQ ID NO: 44466 - RNA, 564 nt, Artificial Sequence
  derived and/or modified sequence opt2 from IDNK__Homo_sapiens__NP_001001551
auggccgcccccggcgcccuccucgucaugggcgucuccggcuccggcaaguccaccgucggcgcccuccucgccuccgagcucggcuggaaguucuacgacgccgacgacuaccaccccgaggagaaccgccgcaagaugggcaagggcaucccccucaacgaccaggaccgcauccccuggcucugcaaccuccacgacauccuccuccgcgacgucgccuccggccagcgcgucguccucgccugcuccgcccucaagaagaccuaccgcgacauccucacccagggcaaggacggcgucgcccucaagugcgaggaguccggcaaggaggccaagcaggccgagaugcagcuccucgucguccaccucuccggcuccuucgaggucaucuccggccgccuccucaagcgcgagggccacuucaugccccccgagcuccuccagucccaguucgagacccucgagccccccgccgcccccgagaacuucauccagaucuccgucgacaagaacgucuccgagaucaucgccaccaucauggagacccucaagaugaaguga

SEQ ID NO: 44467 - RNA, 1212 nt, Artificial Sequence
  derived and/or modified sequence opt2 from IDO1__Homo_sapiens__NP_002155
auggcccacgccauggagaacuccuggaccaucuccaaggaguaccacaucgacgaggaggucggcuucgcccuccccaacccccaggagaaccuccccgacuucuacaacgacuggauguucaucgccaagcaccuccccgaccucaucgaguccggccagcuccgcgagcgcgucgagaagcucaacaugcucuccaucgaccaccucaccgaccacaagucccagcgccucgcccgccucguccucggcugcaucaccauggccuacgucuggggcaagggccacggcgacguccgcaagguccucccccgcaacaucgccguccccuacugccagcucuccaagaagcucgagcucccccccauccucgucuacgccgacugcguccucgccaacuggaagaagaaggaccccaacaagccccucaccuacgagaacauggacguccucuucuccuuccgcgacggcgacugcuccaagggcuucuuccucgucucccuccucgucgagaucgccgccgccuccgccaucaaggucauccccaccgucuucaaggccaugcagaugcaggagcgcgacacccuccucaaggcccuccucgagaucgccuccugccucgagaaggcccuccaggucuuccaccagauccacgaccacgucaaccccaaggccuucuucuccguccuccgcaucuaccucuccggcuggaagggcaacccccagcucuccgacggccucgucuacgagggcuucugggaggaccccaaggaguucgccggcggcuccgccggccaguccuccgucuuccagugcuucgacguccuccucggcauccagcagaccgccggcggcggccacgccgcccaguuccuccaggacaugcgccgcuacaugccccccgcccaccgcaacuuccucugcucccucgaguccaaccccuccguccgcgaguucguccucuccaagggcgacgccggccuccgcgaggccuacgacgccugcgucaaggcccucgucucccuccgcuccuaccaccuccagaucgucaccaaguacauccucauccccgccucccagcagcccaaggagaacaagaccuccgaggaccccuccaagcucgaggccaagggcaccggcggcaccgaccucaugaacuuccucaagaccguccgcuccaccaccgagaagucccuccucaaggagggcuga

SEQ ID NO: 44468 - RNA, 1263 nt, Artificial Sequence
  derived and/or modified sequence opt2 from IDO2__Homo_sapiens__NP_919270
augcuccacuuccacuacuacgacaccuccaacaagaucauggagccccaccgccccaacgucaagaccgccgucccccucucccucgaguccuaccacaucuccgaggaguacggcuuccuccuccccgacucccucaaggagcuccccgaccacuaccgccccuggauggagaucgccaacaagcucccccagcucaucgacgcccaccagcuccaggcccacgucgacaagaugccccuccucuccugccaguuccucaagggccaccgcgagcagcgccucgcccaccucguccucuccuuccucaccaugggcuacgucuggcaggagggcgaggcccagcccgccgagguccucccccgcaaccucgcccuccccuucgucgaggucucccgcaaccucggccucccccccauccucguccacuccgaccucguccucaccaacuggaccaagaaggaccccgacggcuuccucgagaucggcaaccucgagaccaucaucuccuuccccggcggcgagucccuccacggcuucauccucgucaccgcccucgucgagaaggaggccguccccggcaucaaggcccucguccaggccaccaacgccauccuccagcccaaccaggaggcccuccuccaggcccuccagcgccuccgccucuccauccaggacaucaccaagacccucggccagaugcacgacuacgucgaccccgacaucuucuacgccggcauccgcaucuuccucuccggcuggaaggacaaccccgccaugcccgccggccucauguacgagggcgucucccaggagccccucaaguacuccggcggcuccgccgcccaguccaccguccuccacgccuucgacgaguuccucggcauccgccacuccaaggaguccggcgacuuccucuaccgcaugcgcgacuacaugccccccucccacaaggccuucaucgaggacauccacuccgcccccucccuccgcgacuacauccucuccuccggccaggaccaccuccucaccgccuacaaccagugcguccaggcccucgccgagcuccgcuccuaccacaucaccauggucaccaaguaccucaucaccgccgccgccaaggccaagcacggcaagcccaaccaccuccccggccccccccaggcccucaaggaccgcggcaccggcggcaccgccgucauguccuuccucaaguccguccgcgacaagacccucgaguccauccuccacccccgcggcuga

SEQ ID NO: 44469 - RNA, 1653 nt, Artificial Sequence
  derived and/or modified sequence opt2 from IDS__Homo_sapiens__NP_000193
augccccccccccgcaccggccgcggccuccucuggcucggccucguccucuccuccgucugcgucgcccucggcuccgagacccaggccaacuccaccaccgacgcccucaacguccuccucaucaucgucgacgaccuccgccccucccucggcugcuacggcgacaagcucguccgcucccccaacaucgaccagcucgccucccacucccuccucuuccagaacgccuucgcccagcaggccgucugcgcccccucccgcgucuccuuccucaccggccgccgccccgacaccacccgccucuacgacuucaacuccuacuggcgcguccacgccggcaacuucuccaccaucccccaguacuucaaggagaacggcuacgucaccauguccgucggcaaggucuuccaccccggcaucuccuccaaccacaccgacgacucccccuacuccugguccuucccccccuaccaccccuccuccgagaaguacgagaacaccaagaccugccgcggccccgacggcgagcuccacgccaaccuccucugccccgucgacguccucgacguccccgagggcacccuccccgacaagcaguccaccgagcaggccauccagcuccucgagaagaugaagaccuccgccucccccuucuuccucgccgucggcuaccacaagccccacauccccuuccgcuaccccaaggaguuccagaagcucuacccccucgagaacaucacccucgcccccgaccccgagguccccgacggccucccccccgucgccuacaaccccuggauggacauccgccagcgcgaggacguccaggcccucaacaucuccguccccuacggccccauccccgucgacuuccagcgcaagauccgccaguccuacuucgccuccgucuccuaccucgacacccaggucggccgccuccucuccgcccucgacgaccuccagcucgccaacuccaccaucaucgccuucaccuccgaccacggcugggcccucggcgagcacggcgagugggccaaguacuccaacuucgacgucgccacccacgucccccucaucuucuacguccccggccgcaccgccucccuccccgaggccggcgagaagcucuuccccuaccucgaccccuucgacuccgccucccagcucauggagcccggccgccaguccauggaccucgucgagcucgucucccucuuccccacccucgccggccucgccggccuccagguccccccccgcugccccguccccuccuuccacgucgagcucugccgcgagggcaagaaccuccucaagcacuuccgcuuccgcgaccucgaggaggaccccuaccuccccggcaacccccgcgagcucaucgccuacucccaguacccccgccccuccgacaucccccaguggaacuccgacaagcccucccucaaggacaucaagaucaugggcuacuccauccgcaccaucgacuaccgcuacaccgucugggucggcuucaaccccgacgaguuccucgccaacuucuccgacauccacgccggcgagcucuacuucgucgacuccgacccccuccaggaccacaacauguacaacgacucccagggcggcgaccucuuccagcuccucaugcccuga

SEQ ID NO: 44470 - RNA, 1962 nt, Artificial Sequence
  derived and/or modified sequence opt2 from IDUA__Homo_sapiens__NP_000194
augcgcccccuccgcccccgcgccgcccuccucgcccuccucgccucccuccucgccgccccccccgucgcccccgccgaggccccccaccucguccacgucgacgccgcccgcgcccucuggccccuccgccgcuucuggcgcuccaccggcuucugccccccccucccccacucccaggccgaccaguacguccucuccugggaccagcagcucaaccucgccuacgucggcgccgucccccaccgcggcaucaagcagguccgcacccacuggcuccucgagcucgucaccacccgcggcuccaccggccgcggccucuccuacaacuucacccaccucgacggcuaccucgaccuccuccgcgagaaccagcuccuccccggcuucgagcucaugggcuccgccuccggccacuucaccgacuucgaggacaagcagcaggucuucgaguggaaggaccucgucuccucccucgcccgccgcuacaucggccgcuacggccucgcccacgucuccaaguggaacuucgagaccuggaacgagcccgaccaccacgacuucgacaacgucuccaugaccaugcagggcuuccucaacuacuacgacgccugcuccgagggccuccgcgccgccucccccgcccuccgccucggcggccccggcgacuccuuccacacccccccccgcuccccccucuccuggggccuccuccgccacugccacgacggcaccaacuucuucaccggcgaggccggcguccgccucgacuacaucucccuccaccgcaagggcgcccgcuccuccaucuccauccucgagcaggagaaggucgucgcccagcagauccgccagcucuuccccaaguucgccgacacccccaucuacaacgacgaggccgacccccucgucggcuggucccucccccagcccuggcgcgccgacgucaccuacgccgccauggucgucaaggucaucgcccagcaccagaaccuccuccucgccaacaccaccuccgccuuccccuacgcccuccucuccaacgacaacgccuuccucuccuaccacccccaccccuucgcccagcgcacccucaccgcccgcuuccaggucaacaacacccgccccccccacguccagcuccuccgcaagcccguccucaccgccaugggccuccucgcccuccucgacgaggagcagcucugggccgaggucucccaggccggcaccguccucgacuccaaccacaccgucggcguccucgccuccgcccaccgcccccagggccccgccgacgccuggcgcgccgccguccucaucuacgccuccgacgacacccgcgcccaccccaaccgcuccgucgccgucacccuccgccuccgcggcgucccccccggccccggccucgucuacgucacccgcuaccucgacaacggccucugcucccccgacggcgaguggcgccgccucggccgccccgucuuccccaccgccgagcaguuccgccgcaugcgcgccgccgaggaccccgucgccgccgccccccgcccccuccccgccggcggccgccucacccuccgccccgcccuccgccuccccucccuccuccucguccacgucugcgcccgccccgagaagccccccggccaggucacccgccuccgcgcccucccccucacccagggccagcucguccucgucugguccgacgagcacgucggcuccaagugccucuggaccuacgagauccaguucucccaggacggcaaggccuacacccccgucucccgcaagcccuccaccuucaaccucuucgucuucucccccgacaccggcgccgucuccggcuccuaccgcguccgcgcccucgacuacugggcccgccccggccccuucuccgaccccguccccuaccucgagguccccgucccccgcggcccccccucccccggcaaccccuga

SEQ ID NO: 44471 - RNA, 672 nt, Artificial Sequence
  derived and/or modified sequence opt2 from IER2__Homo_sapiens__NP_004898
auggagguccagaaggaggcccagcgcaucaugacccucuccgucuggaagauguaccacucccgcaugcagcgcggcggccuccgccuccaccgcucccuccagcucucccucgucaugcgcuccgcccgcgagcucuaccucuccgccaaggucgaggcccucgagcccgaggucucccuccccgccgcccuccccuccgacccccgccuccaccccccccgcgaggccgaguccaccgccgagaccgccacccccgacggcgagcaccccuuccccgagcccauggacacccaggaggcccccaccgccgaggagaccuccgccugcugcgccccccgccccgccaaggucucccgcaagcgccgcuccuccucccucuccgacggcggcgacgccggccucguccccuccaagaaggcccgccucgaggagaaggaggaggaggagggcgccuccuccgaggucgccgaccgccuccagcccccccccgcccaggccgagggcgccuuccccaaccucgcccgcguccuccagcgccgcuucuccggccuccucaacugcucccccgccgccccccccaccgccccccccgccugcgaggccaagcccgccugccgccccgccgacuccaugcucaacguccucguccgcgccgucgucgccuucuga

SEQ ID NO: 44472 - RNA, 471 nt, Artificial Sequence
  derived and/or modified sequence opt2 from IER3__Homo_sapiens__NP_003888
augugccacucccgcuccugccaccccaccaugaccauccuccaggcccccacccccgcccccuccaccauccccggcccccgccgcggcuccggccccgagaucuucaccuucgacccccuccccgagcccgccgccgcccccgccggccgccccuccgccucccgcggccaccgcaagcgcucccgccgcguccucuacccccgcgucguccgccgccagcuccccgucgaggagcccaaccccgccaagcgccuccucuuccuccuccucaccaucgucuucugccagauccucauggccgaggagggcguccccgccccccucccccccgaggacgcccccaacgccgccucccucgcccccacccccgucuccgccguccucgagcccuucaaccucaccuccgagcccuccgacuacgcccucgaccucuccaccuuccuccagcagcaccccgccgccuucuga

SEQ ID NO: 44473 - RNA, 249 nt, Artificial Sequence
  derived and/or modified sequence opt2 from IER3IP1__Homo_sapiens__NP_057181
auggccuucacccucuacucccuccuccaggccgcccuccucugcgucaacgccaucgccguccuccacgaggagcgcuuccucaagaacaucggcuggggcaccgaccagggcaucggcggcuucggcgaggagcccggcaucaagucccagcucaugaaccucauccgcuccguccgcaccgucaugcgcgucccccucaucaucgucaacuccaucgccaucguccuccuccuccucuucggcuga

SEQ ID NO: 44474 - RNA, 984 nt, Artificial Sequence
  derived and/or modified sequence opt2 from IER5__Homo_sapiens__NP_057629
auggaguucaagcucgaggcccaccgcaucgucuccaucucccucggcaagaucuacaacucccgcguccagcgcggcggcaucaagcuccacaagaaccuccucgucucccucguccuccgcuccgcccgccaggucuaccucuccgaccccugccccggccucuaccucgccggccccgccggcacccccgccccccccccccagcagcagcccggcgagcccgccgccggcccccccgccggcuggggcgagccccccccccccgccgcccgcgccuccuggcccgagaccgagccccagcccgagcgcuccuccgucuccgacgccccccgcgucggcgacgagguccccgucgccaccgucaccggcgucggcgacgucuuccagggcggcgaggccgacgccaccgaggccgccuggucccgcgucgagggcccccgccaggccgccgcccgcgaggccgagggcaccgccggcggcuggggcgucuuccccgaggucucccgcgccgcccgccgccccugcggcugcccccucggcggcgaggacccccccggcacccccgccgccaccccccgcgccgccugcugcugcgccccccagcccgccgaggacgagccccccgccccccccgccgucugcccccgcaagcgcugcgccgccggcgucggcggcggccccgccggcugccccgcccccggcuccaccccccucaagaagccccgccgcaaccucgagcagccccccuccggcggcgaggacgacgacgccgaggagauggagaccggcaacgucgccaaccucaucuccaucuucggcuccuccuucuccggccuccuccgcaagucccccggcggcggccgcgaggaggaggagggcgaggaguccggccccgaggccgccgagcccggccagaucugcugcgacaagcccguccuccgcgacaugaaccccugguccaccgccaucgucgccuucuga

SEQ ID NO: 44475 - RNA, 1692 nt, Artificial Sequence
  derived and/or modified sequence opt2 from IFFO1__Homo_sapiens__NP_001034759
augaacccccucuucggccccaaccucuuccuccuccagcaggagcagcagggccucgccggcccccucggcgacucccucggcggcgaccacuucgccggcggcggcgaccucccccccgccccccucucccccgccggccccgccgccuacuccccccccggccccggccccgccccccccgccgccauggcccuccgcaacgaccucggcuccaacaucaacguccucaagacccucaaccuccgcuuccgcugcuuccucgccaagguccacgagcucgagcgccgcaaccgccuccucgagaagcagcuccagcaggcccucgaggagggcaagcagggccgccgcggccucggccgccgcgaccaggccguccagaccggcuucgucucccccauccgcccccucggccuccagcucggcgcccgccccgccgccgucugcucccccuccgcccgcguccucggcucccccgcccgcucccccgccggcccccucgcccccuccgccgccucccucuccuccuccuccaccuccaccuccaccaccuacuccuccuccgcccgcuucaugcccggcaccaucugguccuucucccacgcccgccgccucggccccggccucgagcccacccucguccagggccccggccucuccuggguccaccccgacggcgucggcguccagaucgacaccaucacccccgagauccgcgcccucuacaacguccucgccaaggucaagcgcgagcgcgacgaguacaagcgccgcugggaggaggaguacaccguccgcauccagcuccaggaccgcgucaacgagcuccaggaggaggcccaggaggccgacgccugccaggaggagcucgcccucaaggucgagcagcucaaggccgagcucgucgucuucaagggccucauguccaacaaccucuccgagcucgacaccaagauccaggagaaggccaugaaggucgacauggacaucugccgccgcaucgacaucaccgccaagcucugcgacgucgcccagcagcgcaacugcgaggacaugauccagauguuccagaagaagcucguccccuccaugggcggccgcaagcgcgagcgcaaggccgccgucgaggaggacaccucccucuccgaguccgagggcccccgccagcccgacggcgacgaggaggaguccaccgcccucuccaucaacgaggagaugcagcgcaugcucaaccagcuccgcgaguacgacuucgaggacgacugcgacucccucaccugggaggagaccgaggagacccuccuccucugggaggacuucuccggcuacgccauggccgccgccgaggcccagggcgagcagcaggaggacucccucgagaaggucaucaaggacaccgagucccucuucaagacccgcgagaaggaguaccaggagaccaucgaccagaucgagcucgagcucgccaccgccaagaacgacaugaaccgccaccuccacgaguacauggagaugugcuccaugaagcgcggccucgacguccagauggagaccugccgccgccucaucacccaguccggcgaccgcaagucccccgccuucaccgccgucccccucuccgaccccccccccccccccuccgaggccgaggacuccgaccgcgacgucuccuccgacuccuccaugcgcuga

SEQ ID NO: 44476 - RNA, 1413 nt, Artificial Sequence
  derived and/or modified sequence opt2 from IFFO2__Homo_sapiens__XP_011538932
auggucaacucccuccucuucggcgagauggcccucgccuucggcugcccccccggcggcggcggcggcggcugccccggcggcggcggcggcggcggcggcgccggccccggccccucccccgucaccgccgcccuccgcgacgaccucggcuccaacauccaccuccucaagggccucaacguccgcuuccgcugcuuccucgccaagguccacgagcucgagcgccgcaaccgccuccucgagaagcagcucgagcagcagcaguccgagcgcgagcgccgccuccgcuacaagaccuucucccgcgagcaggccguccagaccggccccgagcuccuccgcccccccgcccccggcggcggccacggccucuccuccggcgccgccgccggcgccaacgccaacgccgucgcccucggcggccucccccccggcggcggcucccacccccagcacuacggccgccuccccggcaccaucugguccuacacccagguccgccgcaccggcggcggcggcgucgagaccguccagggccccggcgucuccuggguccaccccgacggcgucggcguccagaucgacaccaucacccccgagauccgcgcccucuacaacguccucgccaaggucaagcgcgagcgcgacgaguacaagcgccgcugggaggaggagcucgccaagcgcaugaaccuccagaccauggucgacacccuccaggaggccgcccaggaggccgacgccauccaggaggagaugaacgagaagaucgagcgccucaaggccgagcucgucgucuucaagggccucauguccgacgucguccccaagaagaaggagcgcaaggucgccuccgacgacgacaucuccgagcaggacggcgaggucaaccgcuucuccgacgacgaggucggcuccaugaacaucaccgacgagaugaagcgcauguucaaccagcuccgcgagaccuucgacuucgacgacgacugcgacucccucaccugggaggagaacgaggacacccuccuccucugggaggacuucaccaacugcaaccccaccaucgaccuccagggcgagcaggaggagaaccucggcaaccucauccacgagaccgaguccuucuucaagacccgcgacaaggaguaccaggagaccaucggccagaucgagcucgagcucgccaccgccaaguccgacaugaaccgccaccuccacgaguacauggagaugugcuccaugaagcgcggccucgacguccagauggagaccugccgccgccucaucaagggcuccgccgaccgcaacucccccucccccuccuccgucgccuccuccgacuccggcuccaccgacgagauccaggacgaguucgagcgcgaggccgacgucgagcccauggucuccuga

SEQ ID NO: 44477 - RNA, 2190 nt, Artificial Sequence
  derived and/or modified sequence opt2 from IFI16__Homo_sapiens__NP_001193496
augggcaagaaguacaagaacaucguccuccucaagggccucgaggucaucaacgacuaccacuuccgcauggucaagucccuccucuccaacgaccucaagcucaaccucaagaugcgcgaggaguacgacaagauccagaucgccgaccucauggaggagaaguuccgcggcgacgccggccucggcaagcucaucaagaucuucgaggacauccccacccucgaggaccucgccgagacccucaagaaggagaagcucaaggucaagggccccgcccucucccgcaagcgcaagaaggaggucgacgccaccucccccgcccccuccaccuccuccaccgucaagaccgagggcgccgaggccacccccggcgcccagaaccccaagaccgucgccaagugccaggucaccccccgccgcaacguccuccagaagcgccccgucaucgucaagguccucuccaccaccaagcccuucgaguacgagacccccgagauggagaagaagaucauguuccacgccaccgucgccacccagacccaguucuuccacgucaagguccucaacaccucccucaaggagaaguucaacggcaagaagaucaucaucaucuccgacuaccucgaguacgacucccuccucgaggucaacgaggaguccaccgucuccgaggccggccccaaccagaccuucgagguccccaacaagaucaucaaccgcgccaaggagacccucaagaucgacauccuccacaagcaggccuccggcaacaucgucuacggcgucuucaugcuccacaagaagaccgucaaccagaagaccaccaucuacgagauccaggacgaccgcggcaagauggacgucgucggcaccggccagugccacaacauccccugcgaggagggcgacaagcuccagcucuucugcuuccgccuccgcaagaagaaccagauguccaagcucaucuccgagaugcacuccuucauccagaucaagaagaagaccaacccccgcaacaacgaccccaaguccaugaagcucccccaggagcagcgccagcuccccuaccccuccgaggccuccaccaccuuccccgagucccaccuccgcaccccccagaugccccccaccacccccuccuccuccuucuucaccaagaaguccgaggacaccaucuccaagaugaacgacuucaugcgcaugcagauccucaaggagggcucccacuuccccggccccuucaugaccuccaucggccccgccgagucccacccccacaccccccagaugccccccuccacccccuccuccuccuuccucaccaccaaguccgaggacaccaucuccaagaugaacgacuucaugcgcaugcagauccucaaggagggcucccacuuccccggccccuucaugaccuccaucggccccgccgagucccacccccacaccccccagaugccccccuccacccccuccuccuccuuccucaccacccucaagccccgccucaagaccgagcccgaggaggucuccaucgaggacuccgcccaguccgaccucaaggaggucaugguccucaacgccaccgaguccuucgucuacgagcccaaggagcagaagaagauguuccacgccaccgucgccaccgagaacgaggucuuccgcgucaaggucuucaacaucgaccucaaggagaaguucacccccaagaagaucaucgccaucgccaacuacgucugccgcaacggcuuccucgaggucuaccccuucacccucgucgccgacgucaacgccgaccgcaacauggagauccccaagggccucauccgcuccgccuccgucacccccaagaucaaccagcucugcucccagaccaagggcuccuucgucaacggcgucuucgagguccacaagaagaacguccgcggcgaguucaccuacuacgagauccaggacaacaccggcaagauggaggucgucguccacggccgccucaccaccaucaacugcgaggagggcgacaagcucaagcucaccugcuucgagcucgcccccaaguccggcaacaccggcgagcuccgcuccgucauccacucccacaucaaggucaucaagacccgcaagaacaagaaggacauccucaaccccgacuccuccauggagaccucccccgacuucuucuucuga

SEQ ID NO: 44478 - RNA, 369 nt, Artificial Sequence
  derived and/or modified sequence opt2 from IFI27__Homo_sapiens__NP_001275885
auggaggccuccgcccucaccuccuccgccgucaccuccgucgccaaggucguccgcgucgccuccggcuccgccgucguccucccccucgcccgcaucgccaccgucgucaucggcggcgucgucgccauggccgccguccccaugguccucuccgccaugggcuucaccgccgccggcaucgccuccuccuccaucgccgccaagaugauguccgccgccgccaucgccaacggcggcggcgucgccuccggcucccucgucgccacccuccagucccucggcgccaccggccucuccggccucaccaaguucauccucggcuccaucggcuccgccaucgccgccgucaucgcccgcuucuacuga

SEQ ID NO: 44479 - RNA, 753 nt, Artificial Sequence
  derived and/or modified sequence opt2 from IFI30__Homo_sapiens__NP_006323
augacccucuccccccuccuccucuuccuccccccccuccuccuccuccucgacguccccaccgccgccguccaggccuccccccuccaggcccucgacuucuucggcaacggcccccccgucaacuacaagaccggcaaccucuaccuccgcggcccccucaagaaguccaacgccccccucgucaacgucacccucuacuacgaggcccucugcggcggcugccgcgccuuccucauccgcgagcucuuccccaccuggcuccucgucauggagauccucaacgucacccucguccccuacggcaacgcccaggagcagaacgucuccggccgcugggaguucaagugccagcacggcgaggaggagugcaaguucaacaaggucgaggccugcguccucgacgagcucgacauggagcucgccuuccucaccaucgucugcauggaggaguucgaggacauggagcgcucccucccccucugccuccagcucuacgcccccggccucucccccgacaccaucauggagugcgccaugggcgaccgcggcaugcagcucaugcacgccaacgcccagcgcaccgacgcccuccagcccccccacgaguacguccccugggucaccgucaacggcaagccccucgaggaccagacccagcuccucacccucgucugccagcucuaccagggcaagaagcccgacgucugccccuccuccaccuccucccuccgcuccgucugcuucaaguga

SEQ ID NO: 44480 - RNA, 867 nt, Artificial Sequence
  derived and/or modified sequence opt2 from IFI35__Homo_sapiens__NP_005524
auguccgccccccucgacgccgcccuccacgcccuccaggaggagcaggcccgccucaagaugcgccucugggaccuccagcagcuccgcaaggagcucggcgacucccccaaggacaagguccccuucuccguccccaagaucccccucgucuuccgcggccacacccagcaggaccccgagguccccaagucccucgucuccaaccuccgcauccacugcccccuccucgccggcuccgcccucaucaccuucgacgaccccaaggucgccgagcagguccuccagcagaaggagcacaccaucaacauggaggagugccgccuccgcguccagguccagccccucgagcuccccauggucaccaccauccaggucaugauguccucccagcucuccggccgccgcguccucgucaccggcuuccccgccucccuccgccucuccgaggaggagcuccucgacaagcucgagaucuucuucggcaagacccgcaacggcggcggcgacgucgacguccgcgagcuccuccccggcuccgucaugcucggcuucgcccgcgacggcgucgcccagcgccucugccagaucggccaguucaccgucccccucggcggccagcaggucccccuccgcgucucccccuacgucaacggcgagauccagaaggccgagauccgcucccagcccgucccccgcuccguccucguccucaacauccccgacauccucgacggccccgagcuccacgacguccucgagauccacuuccagaagcccacccgcggcggcggcgaggucgaggcccucaccgucgucccccagggccagcagggccucgccgucuucaccuccgaguccggcuga

SEQ ID NO: 44481 - RNA, 1374 nt, Artificial Sequence
  derived and/or modified sequence opt2 from IFI44__Homo_sapiens__XP_011538818
auggccgucaccacccgccucaccuggcuccacgagaagauccuccagaaccacuucggcggcaagcgccucucccuccucuacaagggcuccguccacggcuuccgcaacggcguccuccucgaccgcugcugcaaccagggccccacccucaccgucaucuacuccgaggaccacaucaucggcgccuacgccgaggaguccuaccaggagggcaaguacgccuccaucauccucuucgcccuccaggacaccaagaucuccgaguggaagcucggccucugcacccccgagacccucuucugcugcgacgucaccaaguacaacucccccaccaacuuccagaucgacggccgcaaccgcaaggucaucauggaccucaagaccauggagaaccucggccucgcccagaacugcaccaucuccauccaggacuacgaggucuuccgcugcgaggacucccucgacgagcgcaagaucaagggcgucaucgagcuccgcaagucccuccucuccgcccuccgcaccuacgagcccuacggcucccucguccagcagauccgcauccuccuccucggccccaucggcgccggcaaguccuccuucuucaacuccguccgcuccgucuuccagggccacgucacccaccaggcccucgucggcaccaacaccaccggcaucuccgagaaguaccgcaccuacuccauccgcgacggcaaggacggcaaguaccuccccuucauccucugcgacucccucggccucuccgagaaggagggcggccucugccgcgacgacaucuucuacauccucaacggcaacauccgcgaccgcuaccaguucaaccccauggaguccaucaagcucaaccaccacgacuacaucgacucccccucccucaaggaccgcauccacugcgucgccuucgucuucgacgccuccuccauccaguacuucuccucccagaugaucgucaagaucaagcgcauccgccgcgagcucgucaacgccggcgucguccacgucgcccuccucacccacgucgacuccauggaccucaucaccaagggcgaccucaucgagaucgagcgcugcgagcccguccgcuccaagcucgaggagguccagcgcaagcucggcuucgcccucuccgacaucuccgucgucuccaacuacuccuccgagugggagcucgaccccgucaaggacguccucauccucuccgcccuccgccgcaugcucugggccgccgacgacuuccucgaggaccuccccuucgagcagaucggccgcugguucggcggcgucgaggccuggaagcgcuccggcaaccuccgcgaggagaucaucaacugcgcccagggcaagaaguga

SEQ ID NO: 44482 - RNA, 3078 nt, Artificial Sequence
  derived and/or modified sequence opt2 from IFIH1__Homo_sapiens__NP_071451
auguccaacggcuacuccaccgacgagaacuuccgcuaccucaucuccugcuuccgcgcccgcgucaagauguacauccaggucgagcccguccucgacuaccucaccuuccuccccgccgaggucaaggagcagauccagcgcaccgucgccaccuccggcaacaugcaggccgucgagcuccuccucuccacccucgagaagggcgucuggcaccucggcuggacccgcgaguucgucgaggcccuccgccgcaccggcuccccccucgccgcccgcuacaugaaccccgagcucaccgaccuccccucccccuccuucgagaacgcccacgacgaguaccuccagcuccucaaccuccuccagcccacccucgucgacaagcuccucguccgcgacguccucgacaagugcauggaggaggagcuccucaccaucgaggaccgcaaccgcaucgccgccgccgagaacaacggcaacgaguccggcguccgcgagcuccucaagcgcaucguccagaaggagaacugguucuccgccuuccucaacguccuccgccagaccggcaacaacgagcucguccaggagcucaccggcuccgacugcuccgaguccaacgccgagaucgagaaccucucccaggucgacggcccccaggucgaggagcagcuccucuccaccaccguccagcccaaccucgagaaggaggucuggggcauggagaacaacuccuccgaguccuccuucgccgacuccuccgucgucuccgaguccgacaccucccucgccgagggcuccgucuccugccucgacgagucccucggccacaacuccaacaugggcuccgacuccggcaccaugggcuccgacuccgacgaggagaacgucgccgcccgcgccucccccgagcccgagcuccagcuccgccccuaccagauggaggucgcccagcccgcccucgagggcaagaacaucaucaucugccuccccaccggcuccggcaagacccgcgucgccgucuacaucgccaaggaccaccucgacaagaagaagaaggccuccgagcccggcaaggucaucguccucgucaacaagguccuccucgucgagcagcucuuccgcaaggaguuccagcccuuccucaagaagugguaccgcgucaucggccucuccggcgacacccagcucaagaucuccuuccccgaggucgucaaguccugcgacaucaucaucuccaccgcccagauccucgagaacucccuccucaaccucgagaacggcgaggacgccggcguccagcucuccgacuucucccucaucaucaucgacgagugccaccacaccaacaaggaggccgucuacaacaacaucaugcgccacuaccucaugcagaagcucaagaacaaccgccucaagaaggagaacaagcccgucaucccccucccccagauccucggccucaccgccucccccggcgucggcggcgccaccaagcaggccaaggccgaggagcacauccucaagcucugcgccaaccucgacgccuucaccaucaagaccgucaaggagaaccucgaccagcucaagaaccagauccaggagcccugcaagaaguucgccaucgccgacgccacccgcgaggaccccuucaaggagaagcuccucgagaucaugacccgcauccagaccuacugccagaugucccccauguccgacuucggcacccagcccuacgagcagugggccauccagauggagaagaaggccgccaaggagggcaaccgcaaggagcgcgucugcgccgagcaccuccgcaaguacaacgaggcccuccagaucaacgacaccauccgcaugaucgacgccuacacccaccucgagaccuucuacaacgaggagaaggacaagaaguucgccgucaucgaggacgacuccgacgagggcggcgacgacgaguacugcgacggcgacgaggacgaggacgaccucaagaagccccucaagcucgacgagaccgaccgcuuccucaugacccucuucuucgagaacaacaagaugcucaagcgccucgccgagaaccccgaguacgagaacgagaagcucaccaagcuccgcaacaccaucauggagcaguacacccgcaccgaggaguccgcccgcggcaucaucuucaccaagacccgccaguccgccuacgcccucucccaguggaucaccgagaacgagaaguucgccgaggucggcgucaaggcccaccaccucaucggcgccggccacuccuccgaguucaagcccaugacccagaacgagcagaaggaggucaucuccaaguuccgcaccggcaagaucaaccuccucaucgccaccaccgucgccgaggagggccucgacaucaaggagugcaacaucgucauccgcuacggccucgucaccaacgagaucgccaugguccaggcccgcggccgcgcccgcgccgacgaguccaccuacguccucgucgcccacuccggcuccggcgucaucgagcacgagaccgucaacgacuuccgcgagaagaugauguacaaggccauccacugcguccagaacaugaagcccgaggaguacgcccacaagauccucgagcuccagaugcaguccaucauggagaagaagaugaagaccaagcgcaacaucgccaagcacuacaagaacaaccccucccucaucaccuuccucugcaagaacugcuccguccucgccugcuccggcgaggacauccacgucaucgagaagaugcaccacgucaacaugacccccgaguucaaggagcucuacaucguccgcgagaacaaggcccuccagaagaagugcgccgacuaccagaucaacggcgagaucaucugcaagugcggccaggccuggggcaccaugaugguccacaagggccucgaccuccccugccucaagauccgcaacuucgucgucgucuucaagaacaacuccaccaagaagcaguacaagaagugggucgagcuccccaucaccuuccccaaccucgacuacuccgagugcugccucuucuccgacgaggacuga

SEQ ID NO: 44483 - RNA, 1344 nt, Artificial Sequence
  derived and/or modified sequence opt2 from IFIT1__Homo_sapiens__NP_001257858
augcccgaccucgagaaccgcguccucgaccagaucgaguuccucgacaccaaguacuccgucggcauccacaaccuccucgccuacgucaagcaccucaagggccagaacgaggaggcccucaagucccucaaggaggccgagaaccucaugcaggaggagcacgacaaccaggccaacguccgcucccucgucaccuggggcaacuucgccuggauguacuaccacaugggccgccucgccgaggcccagaccuaccucgacaaggucgagaacaucugcaagaagcucuccaaccccuuccgcuaccgcauggagugccccgagaucgacugcgaggagggcugggcccuccucaagugcggcggcaagaacuacgagcgcgccaaggccugcuucgagaagguccucgaggucgaccccgagaaccccgaguccuccgccggcuacgccaucuccgccuaccgccucgacggcuucaagcucgccaccaagaaccacaagcccuucucccuccucccccuccgccaggccguccgccucaaccccgacaacggcuacaucaagguccuccucgcccucaagcuccaggacgagggccaggaggccgagggcgagaaguacaucgaggaggcccucgccaacauguccucccagaccuacgucuuccgcuacgccgccaaguucuaccgccgcaagggcuccgucgacaaggcccucgagcuccucaagaaggcccuccaggagacccccaccuccguccuccuccaccaccagaucggccucugcuacaaggcccagaugauccagaucaaggaggccaccaagggccagccccgcggccagaaccgcgagaagcucgacaagaugauccgcuccgccaucuuccacuucgaguccgccgucgagaagaagcccaccuucgaggucgcccaccucgaccucgcccgcauguacaucgaggccggcaaccaccgcaaggccgaggagaacuuccagaagcuccucugcaugaagcccgucgucgaggagaccaugcaggacauccacuuccacuacggccgcuuccaggaguuccagaagaaguccgacgucaacgccaucauccacuaccucaaggccaucaagaucgagcaggccucccucacccgcgacaaguccaucaacucccucaagaagcucguccuccgcaagcuccgccgcaaggcccucgaccucgagucccucucccuccucggcuucgucuacaagcucgagggcaacaugaacgaggcccucgaguacuacgagcgcgcccuccgccucgccgccgacuucgagaacuccguccgccagggccccuga

SEQ ID NO: 44484 - RNA, 1419 nt, Artificial Sequence
  derived and/or modified sequence opt2 from IFIT2__Homo_sapiens__NP_001538
auguccgagaacaacaagaacucccucgaguccucccuccgccagcucaagugccacuucaccuggaaccucauggagggcgagaacucccucgacgacuucgaggacaaggucuucuaccgcaccgaguuccagaaccgcgaguucaaggccaccaugugcaaccuccucgccuaccucaagcaccucaagggccagaacgaggccgcccucgagugccuccgcaaggccgaggagcucauccagcaggagcacgccgaccaggccgagauccgcucccucgucaccuggggcaacuacgccugggucuacuaccacaugggccgccucuccgacguccagaucuacgucgacaaggucaagcacgucugcgagaaguucuccucccccuaccgcaucgagucccccgagcucgacugcgaggagggcuggacccgccucaagugcggcggcaaccagaacgagcgcgccaaggucugcuucgagaaggcccucgagaagaagcccaagaaccccgaguucaccuccggccucgccaucgccuccuaccgccucgacaacuggccccccucccagaacgccaucgacccccuccgccaggccauccgccucaaccccgacaaccaguaccucaagguccuccucgcccucaagcuccacaagaugcgcgaggagggcgaggaggagggcgagggcgagaagcucgucgaggaggcccucgagaaggcccccggcgucaccgacguccuccgcuccgccgccaaguucuaccgccgcaaggacgagcccgacaaggccaucgagcuccucaagaaggcccucgaguacauccccaacaacgccuaccuccacugccagaucggcugcugcuaccgcgccaaggucuuccaggucaugaaccuccgcgagaacggcauguacggcaagcgcaagcuccucgagcucaucggccacgccgucgcccaccucaagaaggccgacgaggccaacgacaaccucuuccgcgucugcuccauccucgccucccuccacgcccucgccgaccaguacgaggacgccgaguacuacuuccagaaggaguucuccaaggagcucacccccgucgccaagcagcuccuccaccuccgcuacggcaacuuccagcucuaccagaugaagugcgaggacaaggccauccaccacuucaucgagggcgucaagaucaaccagaagucccgcgagaaggagaagaugaaggacaagcuccagaagaucgccaagaugcgccucuccaagaacggcgccgacuccgaggcccuccacguccucgccuuccuccaggagcucaacgagaagaugcagcaggccgacgaggacuccgagcgcggccucgaguccggcucccucauccccuccgccuccuccuggaacggcgaguga

SEQ ID NO: 44485 - RNA, 1317 nt, Artificial Sequence
  derived and/or modified sequence opt2 from IFIT3__Homo_sapiens__NP_001276687
auguacaaccuccucgccuacaucaagcaccucgacggcaacaacgaggccgcccucgagugccuccgccaggccgaggagcucauccagcaggagcacgccgaccaggccgagauccgcucccucgucaccuggggcaacuacgccugggucuacuaccaccucggccgccucuccgacgcccagaucuacgucgacaaggucaagcagaccugcaagaaguucuccaaccccuacuccaucgaguacuccgagcucgacugcgaggagggcuggacccagcucaagugcggccgcaacgagcgcgccaaggucugcuucgagaaggcccucgaggagaagcccaacaaccccgaguucuccuccggccucgccaucgccauguaccaccucgacaaccaccccgagaagcaguucuccaccgacguccucaagcaggccaucgagcucucccccgacaaccaguacgucaagguccuccucggccucaagcuccagaagaugaacaaggaggccgagggcgagcaguucgucgaggaggcccucgagaagucccccugccagaccgacguccuccgcuccgccgccaaguucuaccgccgcaagggcgaccucgacaaggccaucgagcucuuccagcgcguccucgaguccacccccaacaacggcuaccucuaccaccagaucggcugcugcuacaaggccaagguccgccagaugcagaacaccggcgaguccgaggccuccggcaacaaggagaugaucgaggcccucaagcaguacgccauggacuacuccaacaaggcccucgagaagggccucaacccccucaacgccuacuccgaccucgccgaguuccucgagaccgagugcuaccagacccccuucaacaaggagguccccgacgccgagaagcagcagucccaccagcgcuacugcaaccuccagaaguacaacggcaaguccgaggacaccgccguccagcacggccucgagggccucuccaucuccaagaaguccaccgacaaggaggagaucaaggaccagccccagaacgucuccgagaaccuccucccccagaacgcccccaacuacugguaccuccagggccucauccacaagcagaacggcgaccuccuccaggccgccaagugcuacgagaaggagcucggccgccuccuccgcgacgcccccuccggcaucggcuccaucuuccucuccgccuccgagcucgaggacggcuccgaggagaugggccagggcgccgucuccuccuccccccgcgagcuccucuccaacuccgagcagcucaacuga

SEQ ID NO: 44486 - RNA, 1449 nt, Artificial Sequence
  derived and/or modified sequence opt2 from IFIT5__Homo_sapiens__NP_036552
auguccgagauccgcaaggacacccucaaggccauccuccucgagcucgagugccacuucaccuggaaccuccucaaggaggacaucgaccucuucgaggucgaggacaccaucggccagcagcucgaguuccucaccaccaagucccgccucgcccucuacaaccuccucgccuacgucaagcaccucaagggccagaacaaggacgcccucgagugccucgagcaggccgaggagaucauccagcaggagcacuccgacaaggaggagguccgcucccucgucaccuggggcaacuacgccugggucuacuaccacauggaccagcucgaggaggcccagaaguacaccggcaagaucggcaacgucugcaagaagcucuccucccccuccaacuacaagcucgagugccccgagaccgacugcgagaagggcugggcccuccucaaguucggcggcaaguacuaccagaaggccaaggccgccuucgagaaggcccucgaggucgagcccgacaaccccgaguucaacaucggcuacgccaucaccgucuaccgccucgacgacuccgaccgcgagggcuccgucaaguccuucucccucggcccccuccgcaaggccgucacccucaaccccgacaacuccuacaucaaggucuuccucgcccucaagcuccaggacguccacgccgaggccgagggcgagaaguacaucgaggagauccucgaccagaucuccucccagcccuacguccuccgcuacgccgccaaguucuaccgccgcaagaacuccuggaacaaggcccucgagcuccucaagaaggcccucgaggucacccccaccuccuccuuccuccaccaccagaugggccucugcuaccgcgcccagaugauccagaucaagaaggccacccacaaccgccccaagggcaaggacaagcucaaggucgacgagcucaucuccuccgccaucuuccacuucaaggccgccauggagcgcgacuccauguucgccuucgccuacaccgaccucgccaacauguacgccgagggcggccaguacuccaacgccgaggacaucuuccgcaaggcccuccgccucgagaacaucaccgacgaccacaagcaccagauccacuaccacuacggccgcuuccaggaguuccaccgcaaguccgagaacaccgccauccaccacuaccucgaggcccucaaggucaaggaccgcuccccccuccgcaccaagcucaccuccgcccucaagaagcucuccaccaagcgccucugccacaacgcccucgacguccagucccucuccgcccucggcuucgucuacaagcucgagggcgagaagcgccaggccgccgaguacuacgagaaggcccagaagaucgaccccgagaacgccgaguuccucaccgcccucugcgagcuccgccucuccaucuga

SEQ ID NO: 44487 - RNA, 378 nt, Artificial Sequence
  derived and/or modified sequence opt2 from IFITM1__Homo_sapiens__NP_003632
augcacaaggaggagcacgaggucgccguccucggcgccccccccuccaccauccucccccgcuccaccgucaucaacauccacuccgagaccuccguccccgaccacgucgucuggucccucuucaacacccucuuccucaacuggugcugccucggcuucaucgccuucgccuacuccgucaagucccgcgaccgcaagauggucggcgacgucaccggcgcccaggccuacgccuccaccgccaagugccucaacaucugggcccucauccucggcauccucaugaccaucggcuucauccuccuccucgucuucggcuccgucaccgucuaccacaucaugcuccagaucauccaggagaagcgcggcuacuga

SEQ ID NO: 44488 - RNA, 399 nt, Artificial Sequence
  derived and/or modified sequence opt2 from IFITM2__Homo_sapiens__NP_006426
augaaccacaucguccagaccuucucccccgucaacuccggccagccccccaacuacgagaugcucaaggaggagcaggaggucgccaugcucggcgucccccacaaccccgccccccccauguccaccgucauccacauccgcuccgagaccuccguccccgaccacgucgucuggucccucuucaacacccucuucaugaacaccugcugccucggcuucaucgccuucgccuacuccgucaagucccgcgaccgcaagauggucggcgacgucaccggcgcccaggccuacgccuccaccgccaagugccucaacaucugggcccucauccucggcaucuucaugaccauccuccucaucaucauccccguccucgucguccaggcccagcgcuga

SEQ ID NO: 44489 - RNA, 402 nt, Artificial Sequence
  derived and/or modified sequence opt2 from IFITM3__Homo_sapiens__NP_066362
augaaccacaccguccagaccuucuucucccccgucaacuccggccagccccccaacuacgagaugcucaaggaggagcacgaggucgccguccucggcgccccccacaaccccgccccccccaccuccaccgucauccacauccgcuccgagaccuccguccccgaccacgucgucuggucccucuucaacacccucuucaugaaccccugcugccucggcuucaucgccuucgccuacuccgucaagucccgcgaccgcaagauggucggcgacgucaccggcgcccaggccuacgccuccaccgccaagugccucaacaucugggcccucauccucggcauccucaugaccauccuccucaucgucauccccguccucaucuuccaggccuacggcuga

SEQ ID NO: 44490 - RNA, 399 nt, Artificial Sequence
  derived and/or modified sequence opt2 from IFITM5__Homo_sapiens__NP_001020466
auggacaccgccuacccccgcgaggacacccgcgcccccacccccuccaaggccggcgcccacaccgcccucacccucggcgccccccacccccccccccgcgaccaccucaucugguccgucuucuccacccucuaccucaaccucugcugccucggcuuccucgcccucgccuacuccaucaaggcccgcgaccagaaggucgucggcgaccucgaggccgcccgccgcuucggcuccaaggccaagugcuacaacauccucgccgccauguggacccucguccccccccuccuccuccucggccucgucgucaccggcgcccuccaccucgcccgccucgccaaggacuccgccgccuucuucuccaccaaguucgacgacgccgacuacgacuga

SEQ ID NO: 44491 - RNA, 570 nt, Artificial Sequence
  derived and/or modified sequence opt2 from IFNA10__Homo_sapiens__NP_002162
auggcccucuccuucucccuccucauggccguccucguccucuccuacaaguccaucugcucccucggcugcgaccucccccagacccacucccucggcaaccgccgcgcccucauccuccucggccagaugggccgcaucucccccuucuccugccucaaggaccgccacgacuuccgcaucccccaggaggaguucgacggcaaccaguuccagaaggcccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuccauccucgccguccgcaaguacuuccagcgcaucacccucuaccucaucgagcgcaaguacucccccugcgccugggaggucguccgcgccgagaucaugcgcucccucuccuucuccaccaaccuccagaagcgccuccgccgcaaggacuga

SEQ ID NO: 44492 - RNA, 573 nt, Artificial Sequence
  derived and/or modified sequence opt2 from IFNA13__Homo_sapiens__NP_008831
augauggccucccccuucgcccuccucauggcccucgucguccucuccugcaaguccuccugcucccucggcugcgaccuccccgagacccacucccucgacaaccgccgcacccucaugcuccucgcccagaugucccgcaucucccccuccuccugccucauggaccgccacgacuucggcuucccccaggaggaguucgacggcaaccaguuccagaaggcccccgccaucuccguccuccacgagcucauccagcagaucuucaaccucuucaccaccaaggacuccuccgccgccugggacgaggaccuccucgacaaguucugcaccgagcucuaccagcagcucaacgaccucgaggccugcgucaugcaggaggagcgcgucggcgagaccccccucaugaacgccgacuccauccucgccgucaagaaguacuuccgccgcaucacccucuaccucaccgagaagaaguacucccccugcgccugggaggucguccgcgccgagaucaugcgcucccucucccucuccaccaaccuccaggagcgccuccgccgcaaggaguga

SEQ ID NO: 44493 - RNA, 570 nt, Artificial Sequence
  derived and/or modified sequence opt2 from IFNA14__Homo_sapiens__NP_002163
auggcccuccccuucgcccucaugauggcccucgucguccucuccugcaaguccuccugcucccucggcugcaaccucucccagacccacucccucaacaaccgccgcacccucaugcucauggcccagaugcgccgcaucucccccuucuccugccucaaggaccgccacgacuucgaguucccccaggaggaguucgacggcaaccaguuccagaaggcccaggccaucuccguccuccacgagaugaugcagcagaccuucaaccucuucuccaccaagaacuccuccgccgccugggacgagacccuccucgagaaguucuacaucgagcucuuccagcagaugaacgaccucgaggccugcgucauccaggaggucggcgucgaggagaccccccucaugaacgaggacuccauccucgccgucaagaaguacuuccagcgcaucacccucuaccucauggagaagaaguacucccccugcgccugggaggucguccgcgccgagaucaugcgcucccucuccuucuccaccaaccuccagaagcgccuccgccgcaaggacuga

SEQ ID NO: 44494 - RNA, 570 nt, Artificial Sequence
  derived and/or modified sequence opt2 from IFNA16__Homo_sapiens__NP_002164
auggcccucuccuucucccuccucauggccguccucguccucuccuacaaguccaucugcucccucggcugcgaccucccccagacccacucccucggcaaccgccgcgcccucauccuccucgcccagaugggccgcaucucccacuucuccugccucaaggaccgcuacgacuucggcuucccccaggaggucuucgacggcaaccaguuccagaaggcccaggccaucuccgccuuccacgagaugauccagcagaccuucaaccucuucuccaccaaggacuccuccgccgccugggacgagacccuccucgacaaguucuacaucgagcucuuccagcagcucaacgaccucgaggccugcgucacccaggaggucggcgucgaggagaucgcccucaugaacgaggacuccauccucgccguccgcaaguacuuccagcgcaucacccucuaccucaugggcaagaaguacucccccugcgccugggaggucguccgcgccgagaucaugcgcuccuucuccuucuccaccaaccuccagaagggccuccgccgcaaggacuga

SEQ ID NO: 44495 - RNA, 570 nt, Artificial Sequence
  derived and/or modified sequence opt2 from IFNA17__Homo_sapiens__NP_067091
auggcccucuccuucucccuccucauggccguccucguccucuccuacaaguccaucugcucccucggcugcgaccucccccagacccacucccucggcaaccgccgcgcccucauccuccucgcccagaugggccgcaucucccccuucuccugccucaaggaccgccacgacuucggccucccccaggaggaguucgacggcaaccaguuccagaagacccaggccaucuccguccuccacgagaugauccagcagaccuucaaccucuucuccaccgaggacuccuccgccgccugggagcagucccuccucgagaaguucuccaccgagcucuaccagcagcucaacaaccucgaggccugcgucauccaggaggucggcauggaggagaccccccucaugaacgaggacuccauccucgccguccgcaaguacuuccagcgcaucacccucuaccucaccgagaagaaguacucccccugcgccugggaggucguccgcgccgagaucaugcgcucccucuccuucuccaccaaccuccagaagauccuccgccgcaaggacuga

SEQ ID NO: 44496 - RNA, 570 nt, Artificial Sequence
  derived and/or modified sequence opt2 from IFNA1__Homo_sapiens__NP_076918
auggccucccccuucgcccuccucaugguccucgucguccucuccugcaaguccuccugcucccucggcugcgaccuccccgagacccacucccucgacaaccgccgcacccucaugcuccucgcccagaugucccgcaucucccccuccuccugccucauggaccgccacgacuucggcuucccccaggaggaguucgacggcaaccaguuccagaaggcccccgccaucuccguccuccacgagcucauccagcagaucuucaaccucuucaccaccaaggacuccuccgccgccugggacgaggaccuccucgacaaguucugcaccgagcucuaccagcagcucaacgaccucgaggccugcgucaugcaggaggagcgcgucggcgagaccccccucaugaacgccgacuccauccucgccgucaagaaguacuuccgccgcaucacccucuaccucaccgagaagaaguacucccccugcgccugggaggucguccgcgccgagaucaugcgcucccucucccucuccaccaaccuccaggagcgccuccgccgcaaggaguga

SEQ ID NO: 44497 - RNA, 570 nt, Artificial Sequence
  derived and/or modified sequence opt2 from IFNA21__Homo_sapiens__NP_002166
auggcccucuccuucucccuccucauggccguccucguccucuccuacaaguccaucugcucccucggcugcgaccucccccagacccacucccucggcaaccgccgcgcccucauccuccucgcccagaugggccgcaucucccccuucuccugccucaaggaccgccacgacuucggcuucccccaggaggaguucgacggcaaccaguuccagaaggcccaggccaucuccguccuccacgagaugauccagcagaccuucaaccucuucuccaccaaggacuccuccgccaccugggagcagucccuccucgagaaguucuccaccgagcucaaccagcagcucaacgaccucgaggccugcgucauccaggaggucggcgucgaggagaccccccucaugaacgucgacuccauccucgccgucaagaaguacuuccagcgcaucacccucuaccucaccgagaagaaguacucccccugcgccugggaggucguccgcgccgagaucaugcgcuccuucucccucuccaagaucuuccaggagcgccuccgccgcaaggaguga

SEQ ID NO: 44498 - RNA, 567 nt, Artificial Sequence
  derived and/or modified sequence opt2 from IFNA2__Homo_sapiens__NP_000596
auggcccucaccuucgcccuccucgucgcccuccucguccucuccugcaaguccuccugcuccgucggcugcgaccucccccagacccacucccucggcucccgccgcacccucaugcuccucgcccagaugcgccgcaucucccucuucuccugccucaaggaccgccacgacuucggcuucccccaggaggaguucggcaaccaguuccagaaggccgagaccauccccguccuccacgagaugauccagcagaucuucaaccucuucuccaccaaggacuccuccgccgccugggacgagacccuccucgacaaguucuacaccgagcucuaccagcagcucaacgaccucgaggccugcgucauccagggcgucggcgucaccgagaccccccucaugaaggaggacuccauccucgccguccgcaaguacuuccagcgcaucacccucuaccucaaggagaagaaguacucccccugcgccugggaggucguccgcgccgagaucaugcgcuccuucucccucuccaccaaccuccaggagucccuccgcuccaaggaguga

SEQ ID NO: 44499 - RNA, 570 nt, Artificial Sequence
  derived and/or modified sequence opt2 from IFNA4__Homo_sapiens__NP_066546
auggcccucuccuucucccuccucauggccguccucguccucuccuacaaguccaucugcucccucggcugcgaccucccccagacccacucccucggcaaccgccgcgcccucauccuccucgcccagaugggccgcaucucccacuucuccugccucaaggaccgccacgacuucggcuuccccgaggaggaguucgacggccaccaguuccagaaggcccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuccauccucgccguccgcaaguacuuccagcgcaucacccucuaccucaccgagaagaaguacucccccugcgccugggaggucguccgcgccgagaucaugcgcucccucuccuucuccaccaaccuccagaagcgccuccgccgcaaggacuga

SEQ ID NO: 44500 - RNA, 570 nt, Artificial Sequence
  derived and/or modified sequence opt2 from IFNA5__Homo_sapiens__NP_002160
auggcccuccccuucguccuccucauggcccucgucguccucaacugcaaguccaucugcucccucggcugcgaccucccccagacccacucccucuccaaccgccgcacccucaugaucauggcccagaugggccgcaucucccccuucuccugccucaaggaccgccacgacuucggcuucccccaggaggaguucgacggcaaccaguuccagaaggcccaggccaucuccguccuccacgagaugauccagcagaccuucaaccucuucuccaccaaggacuccuccgccaccugggacgagacccuccucgacaaguucuacaccgagcucuaccagcagcucaacgaccucgaggccugcaugaugcaggaggucggcgucgaggacaccccccucaugaacgucgacuccauccucaccguccgcaaguacuuccagcgcaucacccucuaccucaccgagaagaaguacucccccugcgccugggaggucguccgcgccgagaucaugcgcuccuucucccucuccgccaaccuccaggagcgccuccgccgcaaggaguga

SEQ ID NO: 44501 - RNA, 570 nt, Artificial Sequence
  derived and/or modified sequence opt2 from IFNA6__Homo_sapiens__NP_066282
auggcccuccccuucgcccuccucauggcccucgucguccucuccugcaaguccuccugcucccucgacugcgaccucccccagacccacucccucggccaccgccgcaccaugaugcuccucgcccagaugcgccgcaucucccucuucuccugccucaaggaccgccacgacuuccgcuucccccaggaggaguucgacggcaaccaguuccagaaggccgaggccaucuccguccuccacgaggucauccagcagaccuucaaccucuucuccaccaaggacuccuccgucgccugggacgagcgccuccucgacaagcucuacaccgagcucuaccagcagcucaacgaccucgaggccugcgucaugcaggaggucugggucggcggcaccccccucaugaacgaggacuccauccucgccguccgcaaguacuuccagcgcaucacccucuaccucaccgagaagaaguacucccccugcgccugggaggucguccgcgccgagaucaugcgcuccuucuccuccucccgcaaccuccaggagcgccuccgccgcaaggaguga

SEQ ID NO: 44502 - RNA, 570 nt, Artificial Sequence
  derived and/or modified sequence opt2 from IFNA7__Homo_sapiens__NP_066401
auggcccgcuccuucucccuccucauggucguccucguccucuccuacaaguccaucugcucccucggcugcgaccucccccagacccacucccuccgcaaccgccgcgcccucauccuccucgcccagaugggccgcaucucccccuucuccugccucaaggaccgccacgaguuccgcuuccccgaggaggaguucgacggccaccaguuccagaagacccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuucauccucgccguccgcaaguacuuccagcgcaucacccucuaccucauggagaagaaguacucccccugcgccugggaggucguccgcgccgagaucaugcgcuccuucuccuucuccaccaaccucaagaagggccuccgccgcaaggacuga

SEQ ID NO: 44503 - RNA, 570 nt, Artificial Sequence
  derived and/or modified sequence opt2 from IFNA8__Homo_sapiens__NP_002161
auggcccucaccuucuaccuccucgucgcccucgucguccucuccuacaaguccuucuccucccucggcugcgaccucccccagacccacucccucggcaaccgccgcgcccucauccuccucgcccagaugcgccgcaucucccccuucuccugccucaaggaccgccacgacuucgaguucccccaggaggaguucgacgacaagcaguuccagaaggcccaggccaucuccguccuccacgagaugauccagcagaccuucaaccucuucuccaccaaggacuccuccgccgcccucgacgagacccuccucgacgaguucuacaucgagcucgaccagcagcucaacgaccucgaguccugcgucaugcaggaggucggcgucaucgaguccccccucauguacgaggacuccauccucgccguccgcaaguacuuccagcgcaucacccucuaccucaccgagaagaaguacuccuccugcgccugggaggucguccgcgccgagaucaugcgcuccuucucccucuccaucaaccuccagaagcgccucaaguccaaggaguga

SEQ ID NO: 44504 - RNA, 1674 nt, Artificial Sequence
  derived and/or modified sequence opt2 from IFNAR1__Homo_sapiens__NP_000620
augauggucguccuccucggcgccaccacccucguccucgucgccgucgcccccuggguccucuccgccgccgccggcggcaagaaccucaaguccccccagaaggucgaggucgacaucaucgacgacaacuucauccuccgcuggaaccgcuccgacgaguccgucggcaacgucaccuucuccuucgacuaccagaagaccggcauggacaacuggaucaagcucuccggcugccagaacaucaccuccaccaagugcaacuucuccucccucaagcucaacgucuacgaggagaucaagcuccgcauccgcgccgagaaggagaacaccuccuccugguacgaggucgacuccuucacccccuuccgcaaggcccagaucggcccccccgagguccaccucgaggccgaggacaaggccaucgucauccacaucucccccggcaccaaggacuccgucaugugggcccucgacggccucuccuucaccuacucccucgucaucuggaagaacuccuccggcgucgaggagcgcaucgagaacaucuacucccgccacaagaucuacaagcucucccccgagaccaccuacugccucaaggucaaggccgcccuccucaccuccuggaagaucggcgucuacucccccguccacugcaucaagaccaccgucgagaacgagcuccccccccccgagaacaucgaggucuccguccagaaccagaacuacguccucaagugggacuacaccuacgccaacaugaccuuccagguccaguggcuccacgccuuccucaagcgcaaccccggcaaccaccucuacaaguggaagcagauccccgacugcgagaacgucaagaccacccagugcgucuucccccagaacgucuuccagaagggcaucuaccuccuccgcguccaggccuccgacggcaacaacaccuccuucugguccgaggagaucaaguucgacaccgagauccaggccuuccuccucccccccgucuucaacauccgcucccucuccgacuccuuccacaucuacaucggcgcccccaagcaguccggcaacacccccgucauccaggacuacccccucaucuacgagaucaucuucugggagaacaccuccaacgccgagcgcaagaucaucgagaagaagaccgacgucaccguccccaaccucaagccccucaccgucuacugcgucaaggcccgcgcccacaccauggacgagaagcucaacaaguccuccgucuucuccgacgccgucugcgagaagaccaagcccggcaacaccuccaagaucuggcucaucgucggcaucugcaucgcccucuucgcccuccccuucgucaucuacgccgccaaggucuuccuccgcugcaucaacuacgucuucuuccccucccucaagcccuccuccuccaucgacgaguacuucuccgagcagccccucaagaaccuccuccucuccaccuccgaggagcagaucgagaagugcuucaucaucgagaacaucuccaccaucgccaccgucgaggagaccaaccagaccgacgaggaccacaagaaguacuccucccagaccucccaggacuccggcaacuacuccaacgaggacgaguccgaguccaagaccuccgaggagcuccagcaggacuucgucuga

SEQ ID NO: 44505 - RNA, 996 nt, Artificial Sequence
  derived and/or modified sequence opt2 from IFNAR2__Homo_sapiens__NP_997467
augcuccucucccagaacgccuucaucuuccgcucccucaaccucguccucauggucuacaucucccucgucuucggcaucuccuacgacucccccgacuacaccgacgaguccugcaccuucaagaucucccuccgcaacuuccgcuccauccucuccugggagcucaagaaccacuccaucguccccacccacuacacccuccucuacaccaucauguccaagcccgaggaccucaaggucgucaagaacugcgccaacaccacccgcuccuucugcgaccucaccgacgaguggcgcuccacccacgaggccuacgucaccguccucgagggcuucuccggcaacaccacccucuucuccugcucccacaacuucuggcucgccaucgacauguccuucgagccccccgaguucgagaucgucggcuucaccaaccacaucaacgucauggucaaguuccccuccaucgucgaggaggagcuccaguucgaccucucccucgucaucgaggagcaguccgagggcaucgucaagaagcacaagcccgagaucaagggcaacauguccggcaacuucaccuacaucaucgacaagcucauccccaacaccaacuacugcgucuccgucuaccucgagcacuccgacgagcaggccgucaucaaguccccccucaagugcacccuccucccccccggccaggaguccgaguccgccgaguccgccaagaucggcggcaucaucaccgucuuccucaucgcccucguccucaccuccaccaucgucacccucaaguggaucggcuacaucugccuccgcaacucccuccccaagguccuccgccagggccucgccaagggcuggaacgccgucgccauccaccgcugcucccacaacgcccuccaguccgagacccccgagcucaagcaguccuccugccucuccuuccccuccuccugggacuacaagcgcgccucccucugccccuccgacuga

SEQ ID NO: 44506 - RNA, 564 nt, Artificial Sequence
  derived and/or modified sequence opt2 from IFNB1__Homo_sapiens__NP_002167
augaccaacaagugccuccuccagaucgcccuccuccucugcuucuccaccaccgcccucuccauguccuacaaccuccucggcuuccuccagcgcuccuccaacuuccagugccagaagcuccucuggcagcucaacggccgccucgaguacugccucaaggaccgcaugaacuucgacauccccgaggagaucaagcagcuccagcaguuccagaaggaggacgccgcccucaccaucuacgagaugcuccagaacaucuucgccaucuuccgccaggacuccuccuccaccggcuggaacgagaccaucgucgagaaccuccucgccaacgucuaccaccagaucaaccaccucaagaccguccucgaggagaagcucgagaaggaggacuucacccgcggcaagcucauguccucccuccaccucaagcgcuacuacggccgcauccuccacuaccucaaggccaaggaguacucccacugcgccuggaccaucguccgcgucgagauccuccgcaacuucuacuucaucaaccgccucaccggcuaccuccgcaacuga

SEQ ID NO: 44507 - RNA, 627 nt, Artificial Sequence
  derived and/or modified sequence opt2 from IFNE__Homo_sapiens__NP_795372
augaucaucaagcacuucuucggcaccguccucguccuccucgccuccaccaccaucuucucccucgaccucaagcucaucaucuuccagcagcgccaggucaaccaggagucccucaagcuccucaacaagcuccagacccucuccauccagcagugccucccccaccgcaagaacuuccuccucccccagaagucccucuccccccagcaguaccagaagggccacacccucgccauccuccacgagaugcuccagcagaucuucucccucuuccgcgccaacaucucccucgacggcugggaggagaaccacaccgagaaguuccucauccagcuccaccagcagcucgaguaccucgaggcccucaugggccucgaggccgagaagcucuccggcacccucggcuccgacaaccuccgccuccaggucaagauguacuuccgccgcauccacgacuaccucgagaaccaggacuacuccaccugcgccugggccaucguccaggucgagaucucccgcugccucuucuucgucuucucccucaccgagaagcucuccaagcagggccgcccccucaacgacaugaagcaggagcucaccaccgaguuccgcuccccccgcuga

SEQ ID NO: 44508 - RNA, 501 nt, Artificial Sequence
  derived and/or modified sequence opt2 from IFNG__Homo_sapiens__NP_000610
augaaguacaccuccuacauccucgccuuccagcucugcaucguccucggcucccucggcugcuacugccaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgcucccagaugcucuuccgcggccgccgcgccucccaguga

SEQ ID NO: 44509 - RNA, 1470 nt, Artificial Sequence
  derived and/or modified sequence opt2 from IFNGR1__Homo_sapiens__NP_000407
auggcccuccucuuccuccucccccucgucaugcagggcgucucccgcgccgagaugggcaccgccgaccucggccccuccuccguccccacccccaccaacgucaccaucgaguccuacaacaugaaccccaucgucuacugggaguaccagaucaugccccagguccccgucuucaccgucgaggucaagaacuacggcgucaagaacuccgaguggaucgacgccugcaucaacaucucccaccacuacugcaacaucuccgaccacgucggcgaccccuccaacucccucuggguccgcgucaaggcccgcgucggccagaaggaguccgccuacgccaaguccgaggaguucgccgucugccgcgacggcaagaucggcccccccaagcucgacauccgcaaggaggagaagcagaucaugaucgacaucuuccaccccuccgucuucgucaacggcgacgagcaggaggucgacuacgaccccgagaccaccugcuacauccgcgucuacaacgucuacguccgcaugaacggcuccgagauccaguacaagauccucacccagaaggaggacgacugcgacgagauccagugccagcucgccauccccgucuccucccucaacucccaguacugcgucuccgccgagggcguccuccacgucuggggcgucaccaccgagaaguccaaggaggucugcaucaccaucuucaacuccuccaucaagggcucccucuggauccccgucgucgccgcccuccuccucuuccucguccucucccucgucuucaucugcuucuacaucaagaagaucaacccccucaaggagaaguccaucauccuccccaagucccucaucuccgucguccgcuccgccacccucgagaccaagcccgaguccaaguacgucucccucaucaccuccuaccagcccuucucccucgagaaggaggucgucugcgaggagccccucucccccgccaccguccccggcaugcacaccgaggacaaccccggcaaggucgagcacaccgaggagcucuccuccaucaccgaggucgucaccaccgaggagaacauccccgacgucguccccggcucccaccucacccccaucgagcgcgaguccuccuccccccucuccuccaaccaguccgagcccggcuccaucgcccucaacuccuaccacucccgcaacugcuccgaguccgaccacucccgcaacggcuucgacaccgacuccuccugccucgagucccacuccucccucuccgacuccgaguucccccccaacaacaagggcgagaucaagaccgagggccaggagcucaucaccgucaucaaggcccccaccuccuucggcuacgacaagccccacguccucgucgaccuccucgucgacgacuccggcaaggagucccucaucggcuaccgccccaccgaggacuccaaggaguucuccuga

SEQ ID NO: 44510 - RNA, 1014 nt, Artificial Sequence
  derived and/or modified sequence opt2 from IFNGR2__Homo_sapiens__NP_005525
augcgccccacccuccucuggucccuccuccuccuccucggcgucuucgccgccgccgccgccgccccccccgacccccucucccagcuccccgccccccagcaccccaagauccgccucuacaacgccgagcagguccucuccugggagcccgucgcccucuccaacuccacccgccccgucgucuaccagguccaguucaaguacaccgacuccaagugguucaccgccgacaucauguccaucggcgucaacugcacccagaucaccgccaccgagugcgacuucaccgccgccucccccuccgccggcuuccccauggacuucaacgucacccuccgccuccgcgccgagcucggcgcccuccacuccgccugggucaccaugcccugguuccagcacuaccgcaacgucaccgucggcccccccgagaacaucgaggucacccccggcgagggcucccucaucauccgcuucuccucccccuucgacaucgccgacaccuccaccgccuucuucugcuacuacguccacuacugggagaagggcggcauccagcaggucaagggccccuuccgcuccaacuccaucucccucgacaaccucaagcccucccgcgucuacugccuccagguccaggcccagcuccucuggaacaaguccaacaucuuccgcgucggccaccucuccaacaucuccugcuacgagaccauggccgacgccuccaccgagcuccagcaggucauccucaucuccgucggcaccuucucccuccucuccguccucgccggcgccugcuucuuccucguccucaaguaccgcggccucaucaaguacugguuccacaccccccccuccaucccccuccagaucgaggaguaccucaaggaccccacccagcccauccucgaggcccucgacaaggacuccucccccaaggacgacgucugggacuccgucuccaucaucuccuuccccgagaaggagcaggaggacguccuccagacccucuga

SEQ ID NO: 44511 - RNA, 624 nt, Artificial Sequence
  derived and/or modified sequence opt2 from IFNK__Homo_sapiens__NP_064509
auguccaccaagcccgacaugauccagaagugccucuggcucgagauccucaugggcaucuucaucgccggcacccucucccucgacugcaaccuccucaacguccaccuccgccgcgucaccuggcagaaccuccgccaccucuccuccauguccaacuccuuccccgucgagugccuccgcgagaacaucgccuucgagcucccccaggaguuccuccaguacacccagcccaugaagcgcgacaucaagaaggccuucuacgagaugucccuccaggccuucaacaucuucucccagcacaccuucaaguacuggaaggagcgccaccucaagcagauccagaucggccucgaccagcaggccgaguaccucaaccagugccucgaggaggacaagaacgagaacgaggacaugaaggagaugaaggagaacgagaugaagcccuccgaggcccgcgucccccagcucuccucccucgagcuccgccgcuacuuccaccgcaucgacaacuuccucaaggagaagaaguacuccgacugcgccugggagaucguccgcgucgagauccgccgcugccucuacuacuucuacaaguucaccgcccucuuccgccgcaaguga

SEQ ID NO: 44512 - RNA, 603 nt, Artificial Sequence
  derived and/or modified sequence opt2 from IFNL1__Homo_sapiens__NP_742152
auggccgccgccuggaccgucguccucgucacccucguccucggccucgccgucgccggccccguccccaccuccaagcccaccaccaccggcaagggcugccacaucggccgcuucaagucccucuccccccaggagcucgccuccuucaagaaggcccgcgacgcccucgaggagucccucaagcucaagaacugguccugcuccucccccgucuuccccggcaacugggaccuccgccuccuccagguccgcgagcgccccgucgcccucgaggccgagcucgcccucacccucaagguccucgaggccgccgccggccccgcccucgaggacguccucgaccagccccuccacacccuccaccacauccucucccagcuccaggccugcauccagccccagcccaccgccggcccccgcccccgcggccgccuccaccacuggcuccaccgccuccaggaggcccccaagaaggaguccgccggcugccucgaggccuccgucaccuucaaccucuuccgccuccucacccgcgaccucaaguacgucgccgacggcaaccucugccuccgcaccuccacccaccccgaguccaccuga

SEQ ID NO: 44513 - RNA, 603 nt, Artificial Sequence
  derived and/or modified sequence opt2 from IFNL2__Homo_sapiens__XP_011525058
augaagcucgacaugaccggcgacugcacccccguccucguccucauggccgccguccucaccgucaccggcgccguccccgucgcccgccuccacggcgcccuccccgacgcccgcggcugccacaucgcccaguucaagucccucuccccccaggagcuccaggccuucaagcgcgccaaggacgcccucgaggagucccuccuccucaaggacugccgcugccacucccgccucuucccccgcaccugggaccuccgccagcuccagguccgcgagcgccccauggcccucgaggccgagcucgcccucacccucaagguccucgaggccaccgccgacaccgaccccgcccucgucgacguccucgaccagccccuccacacccuccaccacauccucucccaguuccgcgccugcauccagccccagcccaccgccggcccccgcacccgcggccgccuccaccacuggcucuaccgccuccaggaggcccccaagaaggagucccccggcugccucgaggccuccgucaccuucaaccucuuccgccuccucacccgcgaccucaacugcgucgccuccggcgaccucugcgucuga

SEQ ID NO: 44514 - RNA, 591 nt, Artificial Sequence
  derived and/or modified sequence opt2 from IFNL3__Homo_sapiens__NP_742151
augaccggcgacugcaugcccguccucguccucauggccgccguccucaccgucaccggcgccguccccgucgcccgccuccgcggcgcccuccccgacgcccgcggcugccacaucgcccaguucaagucccucuccccccaggagcuccaggccuucaagcgcgccaaggacgcccucgaggagucccuccuccucaaggacugcaagugccgcucccgccucuucccccgcaccugggaccuccgccagcuccagguccgcgagcgccccgucgcccucgaggccgagcucgcccucacccucaagguccucgaggccaccgccgacaccgaccccgcccucggcgacguccucgaccagccccuccacacccuccaccacauccucucccagcuccgcgccugcauccagccccagcccaccgccggcccccgcacccgcggccgccuccaccacuggcuccaccgccuccaggaggcccccaagaaggagucccccggcugccucgaggccuccgucaccuucaaccucuuccgccuccucacccgcgaccucaacugcgucgccuccggcgaccucugcgucuga

SEQ ID NO: 44515 - RNA, 588 nt, Artificial Sequence
  derived and/or modified sequence opt2 from IFNW1__Homo_sapiens__NP_002168
auggcccuccucuucccccuccucgccgcccucgucaugaccuccuacucccccgucggcucccucggcugcgaccucccccagaaccacggccuccucucccgcaacacccucguccuccuccaccagaugcgccgcaucucccccuuccucugccucaaggaccgccgcgacuuccgcuucccccaggagauggucaagggcucccagcuccagaaggcccacgucauguccguccuccacgagaugcuccagcagaucuucucccucuuccacaccgagcgcuccuccgccgccuggaacaugacccuccucgaccagcuccacaccggccuccaccagcagcuccagcaccucgagaccugccuccuccaggucgucggcgagggcgaguccgccggcgccaucuccucccccgcccucacccuccgccgcuacuuccagggcauccgcgucuaccucaaggagaagaaguacuccgacugcgccugggaggucguccgcauggagaucaugaagucccucuuccucuccaccaacaugcaggagcgccuccgcuccaaggaccgcgaccucggcuccuccuga

SEQ ID NO: 44516 - RNA, 1356 nt, Artificial Sequence
  derived and/or modified sequence opt2 from IFRD1__Homo_sapiens__NP_001007246
augcccaagaacaagaagcgcaacaccccccaccgcggcuccuccgccggcggcggcggcuccggcgccgccgccgccaccgccgccaccgccggcggccagcaccgcaacguccagcccuucuccgacgaggacgccuccaucgagaccaugucccacugcuccggcuacuccgaccccuccuccuucgccgaggacggccccgagguccucgacgaggagggcacccaggaggaccucgaguacaagcucaagggccucaucgaccucacccucgacaaguccgccaagacccgccaggccgcccucgagggcaucaagaacgcccucgccuccaagaugcucuacgaguucauccucgagcgccgcaugacccucaccgacuccaucgagcgcugccucaagaagggcaaguccgacgagcagcgcgccgccgccgcccucgccuccguccucugcauccagcucggccccggcaucgaguccgaggagauccucaagacccucggccccauccucaagaagaucaucugcgacggcuccgccuccaugcaggcccgccagaccugcgccaccugcuucggcgucugcugcuucaucgccaccgacgacaucaccgagcucuacuccacccucgagugccucgagaacaucuucaccaaguccuaccucaaggagaaggacaccaccgucaucugcuccacccccaacaccguccuccacaucuccucccuccucgccuggacccuccuccucaccaucugccccaucaacgaggucaagaagaagcucgagaugcacuuccacaagcuccccucccuccucuccugcgacgacgucaacaugcgcaucgccgccggcgagucccucgcccuccucuucgagcucgcccgcggcaucgaguccgacuucuucuacgaggacauggagucccucacccagaugcuccgcgcccucgccaccgacggcaacaagcaccgcgccaaggucgacaagcgcaagcagcgcuccgucuuccgcgacguccuccgcgccgucgaggagcgcgacuuccccaccgagaccaucaaguucggccccgagcgcauguacaucgacugcugggucaagaagcacaccuacgacaccuucaaggagguccucggcuccggcaugcaguaccaccuccaguccaacgaguuccuccgcaacgucuucgagcucggcccccccgucaugcucgacgccgccacccucaagaccaugaagaucucccgcuucgagcgccaccucuacaacuccgccgccuucaaggcccgcaccaaggcccgcuccaagugccgcgacaagcgcgccgacgucggcgaguucuucuga

SEQ ID NO: 44517 - RNA, 3099 nt, Artificial Sequence
  derived and/or modified sequence opt2 from IFT122__Homo_sapiens__NP_001267475
auguucaacggcaucaucuccauccgcaacaagaacggcgaggagaaggucaagaucgagcgccccggcggcucccucucccccaucugguccaucugcuggaaccccucccgcgaggagcgcaacgacauccucgccgucgccgacuggggccagaaggucuccuucuaccagcucuccggcaagcagaucggcaaggaccgcgcccucaacuucgaccccugcugcaucuccuacuucaccaagggcgaguacauccuccucggcggcuccgacaagcaggucucccucuucaccaaggacggcguccgccucggcaccgucggcgagcagaacuccugggucuggaccugccaggccaagcccgacuccaacuacgucgucgucggcugccaggacggcaccaucuccuucuaccagcucaucuucuccaccguccacggccucuacaaggaccgcuacgccuaccgcgacuccaugaccgacgucaucguccagcaccucaucaccgagcagaagguccgcaucaagugcaaggagcucgucaagaagaucgccaucuaccgcaaccgccucgccauccagcuccccgagaagauccucaucuacgagcucuacuccgaggaccucuccgacaugcacuaccgcgucaaggagaagaucaucaagaaguucgagugcaaccuccucgucgucugcgccaaccacaucauccucugccaggagaagcgccuccagugccucuccuucuccggcgucaaggagcgcgaguggcagauggagucccucauccgcuacaucaaggucaucggcggcccccccggccgcgagggccuccucgucggccucaagaacggccagauccucaagaucuucgucgacaaccucuucgccaucguccuccucaagcaggccaccgccguccgcugccucgacauguccgccucccgcaagaagcucgccgucgucgacgagaacgacaccugccucgucuacgacaucgacaccaaggagcuccucuuccaggagcccaacgccaacuccgucgccuggaacacccagugcgaggacaugcucugcuucuccggcggcggcuaccucaacaucaaggccuccaccuuccccguccaccgccagaagcuccagggcuucgucgucggcuacaacggcuccaagaucuucugccuccacgucuucuccaucuccgccgucgaggucccccaguccgcccccauguaccaguaccucgaccgcaagcucuucaaggaggccuaccagaucgccugccucggcgucaccgacaccgacuggcgcgagcucgccauggaggcccucgagggccucgacuucgagaccgccaagaaggccuucauccgcguccaggaccuccgcuaccucgagcucaucuccuccaucgaggagcgcaagaagcgcggcgagaccaacaacgaccucuuccucgccgacgucuucuccuaccagggcaaguuccacgaggccgccaagcucuacaagcgcuccggccacgagaaccucgcccucgagauguacaccgaccucugcauguucgaguacgccaaggacuuccucggcuccggcgaccccaaggagaccaagaugcucaucaccaagcaggccgacugggcccgcaacaucaaggagcccaaggccgccgucgagauguacaucuccgccggcgagcacgucaaggccaucgagaucugcggcgaccacggcugggucgacaugcucaucgacaucgcccgcaagcucgacaaggccgagcgcgagccccuccuccucugcgccaccuaccucaagaagcucgacucccccggcuacgccgccgagaccuaccucaagaugggcgaccucaagucccucguccagcuccacgucgagacccagcgcugggacgaggccuucgcccucggcgagaagcaccccgaguucaaggacgacaucuacaugcccuacgcccaguggcucgccgagaacgaccgcuucgaggaggcccagaaggccuuccacaaggccggccgccagcgcgaggccguccagguccucgagcagcucaccaacaacgccgucgccgagucccgcuucaacgacgccgccuacuacuacuggaugcucuccaugcagugccucgacaucgcccaggaccccgcccagaaggacaccaugcucggcaaguucuaccacuuccagcgccucgccgagcucuaccacggcuaccacgccauccaccgccacaccgaggaccccuucuccguccaccgccccgagacccucuucaacaucucccgcuuccuccuccacucccuccccaaggacacccccuccggcaucuccaaggucaagauccucuucacccucgccaagcaguccaaggcccucggcgccuaccgccucgcccgccacgccuacgacaagcuccgcggccucuacauccccgcccgcuuccagaaguccaucgagcucggcacccucaccauccgcgccaagcccuuccacgacuccgaggagcucgucccccucugcuaccgcugcuccaccaacaacccccuccucaacaaccucggcaacgucugcaucaacugccgccagcccuucaucuucuccgccuccuccuacgacguccuccaccucgucgaguucuaccucgaggagggcaucaccgacgaggaggccaucucccucaucgaccucgagguccuccgccccaagcgcgacgaccgccagcucgagaucgccaacaacuccucccagauccuccgccucgucgagaccaaggacuccaucggcgacgaggaccccuucaccgccaagcucuccuucgagcagggcggcuccgaguucguccccgucgucgucucccgccucguccuccgcuccaugucccgccgcgacguccucaucaagcgcuggccccccccccuccgcuggcaguacuuccgcucccuccuccccgacgccuccaucaccaugugccccuccugcuuccagauguuccacuccgaggacuacgagcuccucguccuccagcacggcugcugccccuacugccgccgcugcaaggacgaccccggccccuga

SEQ ID NO: 44518 - RNA, 4389 nt, Artificial Sequence
  derived and/or modified sequence opt2 from IFT140__Homo_sapiens__NP_055529
auggcccucuacuacgaccaccagaucgaggcccccgacgccgccggcucccccuccuucaucuccuggcaccccguccaccccuuccucgccgucgccuacaucuccaccaccuccaccggcuccgucgacaucuaccucgagcagggcgagugcguccccgacacccacgucgagcgccccuuccgcgucgccucccucugcuggcaccccacccgccucguccucgccgucggcugggagaccggcgaggucaccgucuucaacaagcaggacaaggagcagcacaccaugccccucacccacaccgccgacaucaccguccuccgcuggucccccuccggcaacugccuccucuccggcgaccgccucggcguccuccuccucuggcgccucgaccagcgcggccgcguccagggcaccccccuccucaagcacgaguacggcaagcaccucacccacugcaucuuccgccuccccccccccggcgaggaccucguccagcucgccaaggccgccgucuccggcgacgagaaggcccucgacauguucaacuggaagaaguccuccuccggcucccuccucaagaugggcucccacgagggccuccucuucuucgucucccucauggacggcaccguccacuacgucgacgagaagggcaagaccacccaggucgucuccgccgacuccaccauccagaugcucuucuacauggagaagcgcgaggcccucgucgucgucaccgagaaccuccgccucucccucuacaccgucccccccgagggcaaggccgaggaggucaugaaggucaagcucuccggcaagaccggccgccgcgccgacaucgcccucaucgagggcucccuccucgucauggccgucggcgaggccgcccuccgcuucugggacaucgagcgcggcgagaacuacauccucucccccgacgagaaguucggcuucgagaagggcgagaacaugaacugcgucugcuacugcaaggucaagggccuccucgccgccggcaccgaccgcggccgcgucgccauguggcgcaagguccccgacuuccucggcucccccggcgccgagggcaaggaccgcugggcccuccagacccccaccgagcuccagggcaacaucacccagauccaguggggcucccgcaagaaccuccucgccgucaacuccgucaucuccgucgccauccucuccgagcgcgccauguccucccacuuccaccagcaggucgccgccaugcaggucucccccucccuccucaacgucugcuuccucuccaccggcgucgcccacucccuccgcaccgacaugcacaucuccggcgucuucgccaccaaggacgccgucgccgucuggaacggccgccaggucgccaucuucgagcucuccggcgccgccauccgcuccgccggcaccuuccucugcgagacccccguccucgccaugcacgaggagaacgucuacaccgucgaguccaaccgcguccagguccgcaccuggcagggcaccgucaagcagcuccuccucuucuccgagaccgagggcaaccccugcuuccucgacaucugcggcaacuuccucgucgucggcaccgaccucgcccacuucaaguccuucgaccucucccgccgcgaggccaaggcccacugcuccugccgcucccucgccgagcucguccccggcgucggcggcaucgccucccuccgcugcuccuccuccggcuccaccaucuccauccuccccuccaaggccgacaacucccccgacuccaagaucugcuucuacgacgucgagauggacaccgucaccgucuucgacuucaagaccggccagaucgaccgccgcgagacccucuccuucaacgagcaggagaccaacaagucccaccucuucgucgacgagggccucaagaacuacguccccgucaaccacuucugggaccaguccgagccccgccucuucgucugcgaggccguccaggagaccccccgcucccagccccaguccgccaacggccagccccaggacggccgcgccggccccgccgccgacguccucauccucuccuucuucaucuccgaggagcacggcuuccuccuccacgaguccuucccccgccccgccaccucccacucccuccucggcauggagguccccuacuacuacuucacccgcaagcccgaggaggccgaccgcgaggacgaggucgagcccggcugccaccacaucccccagauggucucccgccgcccccuccgcgacuucgucggccucgaggacugcgacaaggccacccgcgacgccaugcuccacuucuccuucuucgucaccaucggcgacauggacgaggccuucaaguccaucaagcucaucaaguccgaggccgucugggagaacauggcccgcaugugcgucaagacccagcgccucgacgucgccaaggucugccucggcaacaugggccacgcccgcggcgcccgcgcccuccgcgaggccgagcaggagcccgagcucgaggcccgcgucgccguccucgccacccagcucggcaugcucgaggacgccgagcagcucuaccgcaagugcaagcgccacgaccuccucaacaaguucuaccaggccgccggccgcuggcaggaggcccuccaggucgccgagcaccacgaccgcguccaccuccgcuccaccuaccaccgcuacgccggccaccucgaggccuccgccgacugcucccgcgcccucuccuacuacgagaaguccgacacccaccgcuucgaggucccccgcaugcucuccgaggaccuccccucccucgagcucuacgucaacaagaugaaggacaagacccucuggcgcuggugggcccaguaccucgagucccagggcgagauggacgccgcccuccacuacuacgagcucgcccgcgaccacuucucccucguccgcauccacugcuuccagggcaacguccagaaggccgcccagaucgccaacgagaccggcaaccucgccgccuccuaccaccucgcccgccaguacgagucccaggaggaggucggccaggccguccacuucuacacccgcgcccaggccuucaagaacgccauccgccucugcaaggagaacggccucgacgaccagcucaugaaccucgcccuccucuccucccccgaggacaugaucgaggccgcccgcuacuacgaggagaagggcguccagauggaccgcgccgucaugcucuaccacaaggccggccacuucuccaaggcccucgagcucgccuucgccacccagcaguucgucgcccuccagcucaucgccgaggaccucgacgagaccuccgaccccgcccuccucgcccgcugcuccgacuucuucaucgagcacucccaguacgagcgcgccgucgagcuccuccucgccgcccgcaaguaccaggaggcccuccagcucugccucggccagaacauguccaucaccgaggagauggccgagaagaugaccgucgccaaggacuccuccgaccuccccgaggagucccgccgcgagcuccucgagcagaucgccgacugcugcaugcgccagggcuccuaccaccucgccaccaagaaguacacccaggccggcaacaagcucaaggccaugcgcgcccuccucaaguccggcgacaccgagaagaucaccuucuucgccuccgucucccgccagaaggagaucuacaucauggccgccaacuaccuccagucccucgacuggcgcaaggagcccgagaucaugaagaacaucaucggcuucuacaccaagggccgcgcccucgaccuccucgccggcuucuacgacgccugcgcccaggucgagaucgacgaguaccagaacuacgacaaggcccacggcgcccucaccgaggccuacaagugccucgccaaggccaaggccaaguccccccucgaccaggagacccgccucgcccagcuccagucccgcauggcccucgucaagcgcuucauccaggcccgccgcaccuacaccgaggaccccaaggaguccaucaagcagugcgagcuccuccucgaggagcccgaccucgacuccaccauccgcaucggcgacgucuacggcuuccucgucgagcacuacguccgcaaggaggaguaccagaccgccuaccgcuuccucgaggagaugcgccgccgccucccccucgccaacauguccuacuacgucuccccccaggccgucgacgccguccaccgcggccucggccucccccucccccgcaccguccccgagcagguccgccacaacuccauggaggacgcccgcgagcucgacgaggaggucgucgaggaggccgacgacgaccccuga

SEQ ID NO: 44519 - RNA, 5250 nt, Artificial Sequence
  derived and/or modified sequence opt2 from IFT172__Homo_sapiens__NP_056477
augcaccucaagcaccuccgcacccuccucuccccccaggacggcgccgccaaggucaccugcauggccuggucccagaacaacgccaaguucgccgucugcaccgucgaccgcgucguccuccucuacgacgagcacggcgagcgccgcgacaaguucuccaccaagcccgccgacaugaaguacggccgcaaguccuacauggucaagggcauggccuucucccccgacuccaccaagaucgccaucggccagaccgacaacaucaucuacgucuacaagaucggcgaggacuggggcgacaagaaggucaucugcaacaaguucauccagaccuccgccgucaccugccuccaguggcccgccgaguacaucaucgucuucggccucgccgagggcaagguccgccucgccaacaccaagaccaacaaguccuccaccaucuacggcaccgaguccuacgucgucucccucaccaccaacugcuccggcaagggcauccucuccggccacgccgacggcaccaucguccgcuacuucuucgacgacgagggcuccggcgagucccagggcaagcucgucaaccaccccugcccccccuacgcccucgccugggccaccaacuccaucgucgccgccggcugcgaccgcaagaucgucgccuacggcaaggagggccacaugcuccagaccuucgacuacucccgcgacccccaggagcgcgaguucaccaccgccgucuccucccccggcggccaguccgucguccucggcuccuacgaccgccuccgcgucuucaacuggaucccccgccgcuccaucugggaggaggccaagcccaaggagaucaccaaccucuacaccaucaccgcccucgccuggaagcgcgacggcucccgccucugcgucggcacccucugcggcggcgucgagcaguucgacugcugccuccgccgcuccaucuacaagaacaaguucgagcucaccuacgucggccccucccaggucaucgucaagaaccucuccuccggcacccgcgucguccucaagucccacuacggcuacgaggucgaggaggucaagauccucggcaaggagcgcuaccucgucgcccacaccuccgagacccuccuccucggcgaccucaacaccaaccgccucuccgagaucgccuggcagggcuccggcggcaacgagaaguacuucuucgagaacgagaacgucugcaugaucuucaacgccggcgagcucacccucgucgaguacggcaacaacgacacccucggcuccguccgcaccgaguucaugaacccccaccucaucuccguccgcaucaacgagcgcugccagcgcggcaccgaggacaacaagaagcucgccuaccucaucgacaucaagaccaucgccaucgucgaccucaucggcggcuacaacaucggcaccgucucccacgagucccgcgucgacuggcucgagcucaacgagaccggccacaagcuccucuuccgcgaccgcaagcuccgccuccaccucuacgacaucgaguccugcuccaagaccaugauccucaacuucugcuccuacaugcaguggguccccggcuccgacguccucgucgcccagaaccgcaacucccucugcgucugguacaacaucgaggcccccgagcgcgucaccauguucaccauccgcggcgacgucaucggccucgagcgcggcggcggcaagaccgaggucauggucauggagggcgucaccaccgucgccuacacccucgacgagggccucaucgaguucggcaccgccaucgacgacggcaacuacauccgcgccaccgccuuccucgagacccucgagaugacccccgagaccgaggccauguggaagacccucuccaagcucgcccucgaggcccgccagcuccacaucgccgagcgcugcuucuccgcccucggccaggucgccaaggcccgcuuccuccacgagaccaacgagaucgccgaccaggucucccgcgaguacggcggcgagggcaccgacuucuaccagguccgcgcccgccucgccaugcucgagaagaacuacaagcucgccgagaugaucuuccucgagcagaacgccgucgaggaggccaugggcauguaccaggagcuccaccgcugggacgagugcaucgccgucgccgaggccaagggccaccccgcccucgagaagcuccgccgcuccuacuaccaguggcucauggacacccagcaggaggagcgcgccggcgagcuccaggagucccagggcgacggccucgccgccaucucccucuaccucaaggccggccuccccgccaaggccgcccgccucguccucacccgcgaggagcuccucgccaacaccgagcucgucgagcacaucaccgccgcccucaucaagggcgagcucuacgagcgcgccggcgaccucuucgagaagauccacaacccccagaaggcccucgagugcuaccgcaagggcaacgccuucaugaaggccgucgagcucgcccgccucgccuuccccgucgaggucgucaagcucgaggaggccuggggcgaccaccucguccagcagaagcagcucgacgccgccaucaaccacuacaucgaggcccgcugcuccaucaaggccaucgaggccgcccucggcgcccgccaguggaagaaggccaucuacauccucgaccuccaggaccgcaacaccgccuccaaguacuacccccucgucgcccagcacuacgccucccuccaggaguacgagaucgccgaggagcucuacaccaagggcgaccgcaccaaggacgccaucgacauguacacccaggccggccgcugggagcaggcccacaagcucgccaugaagugcaugcgccccgaggacgucuccguccucuacaucacccaggcccaggagauggagaagcagggcaaguaccgcgaggccgagcgccucuacgucaccguccaggagcccgaccucgccaucaccauguacaagaagcacaagcucuacgacgacaugauccgccucgucggcaagcaccaccccgaccuccucuccgacacccaccuccaccucggcaaggagcucgaggccgagggccgccuccaggaggccgaguaccacuaccucgaggcccaggaguggaaggccaccgucaacauguaccgcgccuccggccucugggaggaggccuaccgcgucgcccgcacccagggcggcgccaacgcccacaagcacgucgccuaccucugggccaagucccucggcggcgaggccgccguccgccuccucaacaagcucggccuccucgaggccgccgucgaccacgccgccgacaacugcuccuucgaguucgccuucgagcucucccgccucgcccucaagcacaagacccccgagguccaccucaaguacgccauguuccucgaggacgagggcaaguucgaggaggccgaggccgaguucauccgcgccggcaagcccaaggaggccguccucauguucguccacaaccaggacugggaggccgcccagcgcgucgccgaggcccacgaccccgacuccgucgccgagguccucgucggccaggcccgcggcgcccucgaggagaaggacuuccagaaggccgagggccuccuccuccgcgcccagcgccccggccucgcccucaacuacuacaaggaggccggccucugguccgacgcccuccgcaucugcaaggacuacguccccucccagcucgaggcccuccaggaggaguacgagcgcgaggccaccaagaagggcgcccgcggcgucgagggcuucgucgagcaggcccgccacugggagcaggccggcgaguacucccgcgccgucgacugcuaccucaagguccgcgacuccggcaacuccggccucgccgagaagugcuggaugaaggccgccgagcucuccaucaaguuccuccccccccagcgcaacauggaggucguccucgccgucggcccccagcucaucggcaucggcaagcacuccgccgccgccgagcucuaccucaaccucgaccucgucaaggaggccaucgacgccuucaucgagggcgaggaguggaacaaggccaagcgcgucgccaaggagcucgacccccgcuacgaggacuacgucgaccagcacuacaaggaguuccucaagaaccagggcaaggucgacucccucgucggcgucgacgucaucgccgcccucgaccucuacgucgagcagggccagugggacaagugcaucgagaccgccaccaagcagaacuacaagauccuccacaaguacgucgcccucuacgccacccaccucauccgcgagggcuccuccgcccaggcccucgcccucuacguccagcacggcgcccccgccaacccccagaacuucaacaucuacaagcgcaucuucaccgacauggucuccucccccggcaccaacugcgccgaggccuaccacuccugggccgaccuccgcgacguccucuucaaccucugcgagaaccucgucaaguccuccgaggccaacucccccgcccacgaggaguucaagaccaugcuccucaucgcccacuacuacgccacccgcuccgccgcccaguccgucaagcagcucgagaccgucgccgcccgccucuccgucucccuccuccgccacacccagcuccuccccgucgacaaggccuucuacgaggccggcaucgccgccaaggccgucggcugggacaacauggccuucaucuuccucaaccgcuuccucgaccucaccgacgccaucgaggagggcacccucgacggccucgaccacuccgacuuccaggacaccgacauccccuucgaggucccccuccccgccaagcagcacguccccgaggccgagcgcgaggagguccgcgacuggguccucaccgucuccauggaccagcgccucgagcagguccucccccgcgacgagcgcggcgccuacgaggccucccucgucgccgccuccaccggcguccgcgcccuccccugccucaucaccggcuaccccauccuccgcaacaagaucgaguucaagcgccccggcaaggccgccaacaaggacaacuggaacaaguuccucauggccaucaagaccucccacucccccgucugccaggacguccucaaguucaucucccaguggugcggcggccuccccuccaccuccuucuccuuccaguga

SEQ ID NO: 44520 - RNA, 561 nt, Artificial Sequence
  derived and/or modified sequence opt2 from IFT27__Homo_sapiens__NP_001171172
auggucaagcucgccgccaagugcauccucgccggcgaccccgccgucggcaagaccgcccucgcccagaucuuccgcuccgacggcgcccacuuccagaaguccuacacccucaccaccggcauggaccucgucgucaagaccguccccguccccgacaccggcgacuccgucgagcucuucaucuucgacuccgccggcaaggagcucuucuccgagaugcucgacaagcucugggagucccccaacguccucugccucgucuacgacgucaccaacgaggaguccuucaacaacugcuccaaguggcucgagaaggcccgcucccaggcccccggcaucucccuccccggcguccucgucggcaacaagaccgaccucgccggccgccgcgccgucgacuccgccgaggcccgcgccugggcccucggccagggccucgagugcuucgagaccuccgucaaggagauggagaacuucgaggcccccuuccacugccucgccaagcaguuccaccagcucuaccgcgagaaggucgaggucuuccgcgcccucgccuga

SEQ ID NO: 44521 - RNA, 627 nt, Artificial Sequence
  derived and/or modified sequence opt2 from IFT43__Homo_sapiens__NP_001096034
auggaggaccuccucgaccucgacgaggagcuccgcuacucccucgccaccucccgcgccaagaugggccgccgcgcccagcaggaguccgcccaggccgagaaccaccucaacggcaagaacuccucccucacccucaccggcgagaccuccuccgccaagcucccccgcugccgccagggcggcugggccggcgacuccgucaaggccuccaaguuccgccgcaaggccuccgaggagaucgaggacuuccgccuccgcccccagucccucaacggcuccgacuacggcggcgacauccccaucauccccgaccucgaggagguccaggaggaggacuucguccuccaggucgccgccccccccuccauccagaucaagcgcgucaugaccuaccgcgaccucgacaacgaccucaugaaguacuccgccauccagacccucgacggcgagaucgaccucaagcuccucaccaagguccucgcccccgagcacgagguccgcgaggacgacgucggcugggacugggaccaccucuucaccgaggucuccuccgagguccucaccgagugggacccccuccagaccgagaaggaggaccccgccggccaggcccgccacaccuga

SEQ ID NO: 44522 - RNA, 1290 nt, Artificial Sequence
  derived and/or modified sequence opt2 from IFT57__Homo_sapiens__NP_060480
augaccgccgcccucgccgucgucaccaccuccggccucgaggacggcgucccccgcucccgcggcgagggcaccggcgaggucguccucgagcgcggccccggcgccgccuaccacauguucgucgucauggaggaccucgucgagaagcucaagcuccuccgcuacgaggaggaguuccuccgcaaguccaaccucaaggcccccucccgccacuacuucgcccuccccaccaaccccggcgagcaguucuacauguucugcacccucgccgccuggcucaucaacaaggccggccgccccuucgagcagccccaggaguacgacgaccccaacgccaccaucuccaacauccucuccgagcuccgcuccuucggccgcaccgccgacuucccccccuccaagcucaaguccggcuacggcgagcacgucugcuacguccucgacugcuucgccgaggaggcccucaaguacaucggcuucaccuggaagcgccccaucuaccccgucgaggagcucgaggaggaguccgucgccgaggacgacgccgagcucacccucaacaaggucgacgaggaguucgucgaggaggagaccgacaacgaggagaacuucaucgaccucaacguccucaaggcccagaccuaccaccucgacaugaacgagaccgccaagcaggaggacauccucgaguccaccaccgacgccgccgaguggucccucgaggucgagcgcguccucccccagcucaaggucaccauccgcaccgacaacaaggacuggcgcauccacgucgaccagaugcaccagcaccgcuccggcaucgaguccgcccucaaggagaccaagggcuuccucgacaagcuccacaacgagaucacccgcacccucgagaagaucuccucccgcgagaaguacaucaacaaccagcucgagaaccucguccaggaguaccgcgccgcccaggcccagcucuccgaggccaaggagcgcuaccagcagggcaacggcggcgucaccgagcgcacccgccuccucuccgaggucauggaggagcucgagaaggucaagcaggagauggaggagaagggcuccuccaugaccgacggcgccccccucgucaagaucaagcagucccucaccaagcucaagcaggagaccgucgagauggacauccgcaucggcaucgucgagcacacccuccuccaguccaagcucaaggagaaguccaacaugacccgcaacaugcacgccaccgucauccccgagcccgccaccggcuucuacuga

SEQ ID NO: 44523 - RNA, 1803 nt, Artificial Sequence
  derived and/or modified sequence opt2 from IFT74__Homo_sapiens__NP_001092693
auggccuccaaccacaaguccuccgccgcccgccccgucucccgcggcggcgucggccucaccggccgcccccccuccggcauccgcccccucuccggcaacauccgcgucgccaccgccaugccccccggcaccgcccgccccggcucccgcggcugccccaucggcaccggcggcguccucuccucccagaucaaggucgcccaccgccccgucacccagcagggccucaccggcaugaagaccggcaccaagggcccccagcgccagauccucgacaaguccuacuaccucggccuccuccgcuccaagaucuccgagcucaccaccgaggucaacaagcuccagaagggcaucgagauguacaaccaggagaacuccgucuaccucuccuacgagaagcgcgccgagacccucgccgucgagaucaaggagcuccagggccagcucgccgacuacaacaugcucgucgacaagcucaacaccaacaccgagauggaggaggucaugaacgacuacaacaugcucaaggcccagaacgaccgcgagacccagucccucgacgucaucuucaccgagcgccaggccaaggagaagcagauccgcuccgucgaggaggagaucgagcaggagaagcaggccaccgacgacaucaucaagaacauguccuucgagaaccaggucaaguaccucgagaugaagaccaccaacgagaagcuccuccaggagcucgacacccuccagcagcagcucgacucccagaacaugaagaaggagucccucgaggccgagaucgcccacucccaggucaagcaggaggccguccuccuccacgagaagcucuacgagcucgagucccaccgcgaccagaugaucgccgaggacaaguccaucggcucccccauggaggagcgcgagaagcuccucaagcagaucaaggacgacaaccaggagaucgccuccauggagcgccagcucaccgacaccaaggagaagaucaaccaguucaucgaggagauccgccagcucgacauggaccucgaggagcaccagggcgagaugaaccagaaguacaaggagcucaagaagcgcgaggagcacauggacaccuucaucgagaccuucgaggagaccaagaaccaggagcucaagcgcaaggcccagaucgaggccaacaucgucgcccuccucgagcacugcucccgcaacaucaaccgcaucgagcagaucuccuccaucaccaaccaggagcucaagaugaugcaggacgaccucaacuucaaguccaccgagguccagaagucccaguccaccgcccagaaccucaccuccgacauccagcgccuccagcucgaccuccagaagauggagcuccucgaguccaagaugaccgaggagcagcacucccucaaguccaagaucaagcagaugaccaccgaccucgagaucuacaacgaccuccccgcccucaaguccuccggcgaggagaagaucaagaagcuccaccaggagcgcaugauccucuccacccaccgcaacgccuucaagaagaucauggagaagcagaacaucgaguacgaggcccucaagacccagcuccaggagaacgagacccacucccagcucaccaaccucgagcgcaaguggcagcaccucgagcagaacaacuucgccaugaaggaguucaucgccaccaagucccaggaguccgacuaccagcccaucaagaagaacgucaccaagcagaucgccgaguacaacaagaccaucgucgacgcccuccacuccaccuccggcaacuga

SEQ ID NO: 44524 - RNA, 1923 nt, Artificial Sequence
  derived and/or modified sequence opt2 from IFT80__Homo_sapiens__NP_001177171
augcuccgcuccacccucgcccagcagggcacccccgucuacuccgucgccuggggccccgacuccgagaagguccucuacaccgccggcaagcagcucaucaucaagccccuccagcccaacgccaagguccuccaguggaaggcccacgacggcaucauccucaaggucgacuggaacuccgucaacgaccucauccucuccgccggcgaggacugcaaguacaaggucugggacuccuacggccgcccccucuacaacucccagccccacgagcaccccaucaccuccgucgccugggcccccgacggcgagcucuucgccgucggcuccuuccacacccuccgccucugcgacaagaccggcugguccuacgcccucgagaagcccaacaccggcuccaucuucaacaucgccugguccaucgacggcacccagaucgccggcgccugcggcaacggccacgucgucuucgcccacgucgucgagcagcacugggaguggaagaacuuccaggucacccucaccaagcgccgcgccaugcagguccgcaacguccucaacgacgccgucgaccuccucgaguuccgcgaccgcgucaucaaggccucccucaacuacgcccaccucgucgucuccaccucccuccagugcuacgucuucuccaccaagaacuggaacacccccaucaucuucgaccucaaggagggcaccgucucccucauccuccaggccgagcgccacuuccuccucgucgacggcuccuccaucuaccucuacuccuacgagggccgcuucaucuccucccccaaguuccccggcaugcgcaccgacauccucaacgcccagaccgucucccucuccaacgacaccaucgccauccgcgacaaggccgacgagaagaucaucuuccucuucgaggccuccaccggcaagccccucggcgacggcaaguuccucucccacaagaacgagauccucgagaucgcccucgaccagaagggccucaccaacgaccgcaagaucgccuucaucgacaagaaccgcgaccucugcaucaccuccgucaagcgcuucggcaaggaggagcagaucaucaagcucggcaccaugguccacacccucgccuggaacgacaccugcaacauccucugcggccuccaggacacccgcuucaucgucugguacuaccccaacaccgucuacgucgaccgcgacauccuccccaagacccucuacgagcgcgacgccuccgaguucuccaagaacccccacaucgucuccuucgucggcaaccaggucaccauccgccgcgccgacggcucccucguccacaucuccaucacccccuaccccgccauccuccacgaguacgucuccuccuccaagugggaggacgccguccgccucugccgcuucgucaaggagcagaccaugugggccugccucgccgccauggccgucgccaaccgcgacaugaccaccgccgagaucgccuacgccgccaucggcgagaucgacaagguccaguacaucaacuccaucaagaaccuccccuccaaggaguccaagauggcccacauccuccucuucuccggcaacauccaggaggccgagaucguccuccuccaggccggccucgucuaccaggccauccagaucaacaucaaccucuacaacugggagcgcgcccucgagcucgccgucaaguacaagacccacgucgacaccguccucgccuaccgccagaaguuccucgagaccuucggcaagcaggagaccaacaagcgcuaccuccacuacgccgagggccuccagaucgacugggagaagaucaaggccaagaucgagauggagaucaccaaggagcgcgagcaguccuccuccucccaguccuccaaguccaucggccucaagcccuga

SEQ ID NO: 44525 - RNA, 2646 nt, Artificial Sequence
  derived and/or modified sequence opt2 from IFT88__Homo_sapiens__XP_005266603
augaaggucgaguccggcaugaagaucaagguccacaacaacgccgaguccgagaccgccgucggcuuccucgaggucgaccagggcugccccaucuucggcuuccccggcccccaccgcaagaagaacugccucggcccccacaugaaguucaccaacaccaagguccagaugaugcagaacguccaccucgcccccgagaccgacgaggacgaccucuacuccggcuacaacgacuacaaccccaucuacgacaucgaggagcucgagaacgacgccgccuuccagcaggccguccgcaccucccacggccgccgcccccccaucaccgccaagaucuccuccaccgccgucacccgccccaucgccaccggcuacggcuccaagaccucccucgccuccuccaucggccgccccaugaccggcgccauccaggacggcgucacccgccccaugaccgccguccgcgccgccggcuucaccaaggccgcccuccgcggcuccgccuucgacccccucucccagucccgcggccccgccuccccccucgaggccaagaagaaggacucccccgaggagaagaucaagcagcucgagaaggaggucaacgagcucgucgaggaguccugcaucgccaacuccugcggcgaccucaagcucgcccucgagaaggccaaggacgccggccgcaaggagcgcguccucguccgccagcgcgagcaggucaccacccccgagaacaucaaccucgaccucaccuacuccguccucuucaaccucgccucccaguacuccgucaacgagauguacgccgaggcccucaacaccuaccaggucaucgucaagaacaagauguucuccaacgccggcauccucaagaugaacaugggcaacaucuaccucaagcagcgcaacuacuccaaggccaucaaguucuaccgcauggcccucgaccagguccccuccgucaacaagcagaugcgcaucaagaucaugcagaacaucggcgucaccuucauccaggccggccaguacuccgacgccaucaacuccuacgagcacaucauguccauggcccccaaccucaaggccggcuacaaccucaccaucugcuacuucgccaucggcgaccgcgagaagaugaagaaggccuuccagaagcucaucaccgucccccucgagaucgacgaggacaaguacaucucccccuccgacgacccccacaccaaccucgucaccgaggccaucaagaacgaccaccuccgccagauggagcgcgagcgcaaggccauggccgagaaguacaucaugaccuccgccaagcucaucgcccccgucaucgagaccuccuucgccgccggcuacgacuggugcgucgaggucgucaaggccucccaguacgucgagcucgccaacgaccucgagaucaacaaggccgucaccuaccuccgccagaaggacuacaaccaggccgucgagauccucaagguccucgagaagaaggacucccgcgucaaguccgccgccgccaccaaccucuccgcccucuacuacaugggcaaggacuucgcccaggccuccuccuacgccgacaucgccgucaacuccgaccgcuacaaccccgccgcccucaccaacaagggcaacaccgucuucgccaacggcgacuacgagaaggccgccgaguucuacaaggaggcccuccgcaacgacuccuccugcaccgaggcccucuacaacaucggccucaccuacgagaagcucaaccgccucgacgaggcccucgacugcuuccucaagcuccacgccauccuccgcaacuccgccgagguccucuaccagaucgccaacaucuacgagcucauggagaaccccucccaggccaucgaguggcucaugcaggucgucuccgucauccccaccgacccccagguccucuccaagcucggcgagcucuacgaccgcgagggcgacaagucccaggccuuccaguacuacuacgaguccuaccgcuacuuccccugcaacaucgaggucaucgaguggcucggcgccuacuacaucgacacccaguucugggagaaggccauccaguacuucgagcgcgccucccucauccagcccacccaggucaaguggcagcucauggucgccuccugcuuccgccgcuccggcaacuaccagaaggcccucgacaccuacaaggacacccaccgcaaguuccccgagaacgucgagugccuccgcuuccucguccgccucugcaccgaccucggccucaaggacgcccaggaguacgcccgcaagcucaagcgccucgagaagaugaaggagauccgcgagcagcgcaucaaguccggccgcgacggcuccggcggcucccgcggcaagcgcgagggcuccgccuccggcgacuccggccagaacuacuccgccuccuccaagggcgagcgccucuccgcccgccuccgcgcccuccccggcaccaacgagcccuacgaguccuccuccaacaaggagaucgacgccuccuacgucgacccccucggcccccagaucgagcgccccaagaccgccgccaagaagcgcaucgacgaggacgacuucgccgacgaggagcucggcgacgaccuccuccccgaguga

SEQ ID NO: 44526 - RNA, 1020 nt, Artificial Sequence
  derived and/or modified sequence opt2 from IGBP1__Homo_sapiens__NP_001542
auggccgccgaggacgagcuccagcucccccgccuccccgagcucuucgagaccggccgccagcuccucgacgaggucgaggucgccaccgagcccgccggcucccgcaucguccaggagaaggucuucaagggccucgaccuccucgagaaggccgccgagaugcucucccagcucgaccucuucucccgcaacgaggaccucgaggagaucgccuccaccgaccucaaguaccuccucguccccgccuuccagggcgcccucaccaugaagcaggucaaccccuccaagcgccucgaccaccuccagcgcgcccgcgagcacuucaucaacuaccucacccagugccacugcuaccacgucgccgaguucgagcuccccaagaccaugaacaacuccgccgagaaccacaccgccaacuccuccauggccuaccccucccucgucgccauggccucccagcgccaggccaagauccagcgcuacaagcagaagaaggagcucgagcaccgccucuccgccaugaaguccgccgucgaguccggccaggccgacgacgagcgcguccgcgaguacuaccuccuccaccuccagcgcuggaucgacaucucccucgaggagaucgaguccaucgaccaggagaucaagauccuccgcgagcgcgacuccucccgcgaggccuccaccuccaacuccucccgccaggagcgcccccccgucaagcccuucauccucacccgcaacauggcccaggccaaggucuucggcgccggcuaccccucccuccccaccaugaccgucuccgacugguacgagcagcaccgcaaguacggcgcccuccccgaccagggcaucgccaaggccgcccccgaggaguuccgcaaggccgcccagcagcaggaggagcaggaggagaaggaggaggaggacgacgagcagacccuccaccgcgcccgcgagugggacgacuggaaggacacccacccccgcggcuacggcaaccgccagaacaugggcuga

SEQ ID NO: 44527 - RNA, 2445 nt, Artificial Sequence
  derived and/or modified sequence opt2 from IGDCC3__Homo_sapiens__NP_004875
auggccguccagcgcgccgccuccccccgccgcccccccgccccccucuggccccgccuccuccucccccuccuccuccuccuccuccccgcccccuccgagggccucggccacuccgccgagcucgccuucgccgucgagcccuccgacgacgucgccguccccggccagcccaucguccucgacugccgcgucgagggcaccccccccguccgcaucaccuggcgcaagaacggcgucgagcuccccgaguccacccacuccacccuccucgccaacggcucccucaugauccgccacuuccgccucgagcccggcggcucccccuccgacgagggcgacuacgagugcgucgcccagaaccgcuucggccucgucgucucccgcaaggcccgcauccaggccgccaccauguccgacuuccacguccacccccaggccaccgucggcgaggagggcggcgucgcccgcuuccagugccagauccacggccuccccaagccccucaucaccugggagaagaaccgcguccccaucgacaccgacaacgagcgcuacacccuccuccccaagggcguccuccagaucaccggccuccgcgccgaggacggcggcaucuuccacugcgucgccuccaacaucgccuccauccgcaucucccacggcgcccgccucaccgucuccggcuccggcuccggcgccuacaaggagcccgccauccucgucggccccgagaaccucacccucaccguccaccagaccgccguccucgagugcgucgccaccggcaacccccgccccaucgucuccuggucccgccucgacggccgccccaucggcgucgagggcauccagguccucggcaccggcaaccucaucaucuccgacgucaccguccagcacuccggcgucuacgucugcgccgccaaccgccccggcacccgcguccgccgcaccgcccagggccgccucgucguccaggcccccgccgaguucguccagcacccccaguccaucucccgccccgccggcaccaccgccauguucaccugccaggcccagggcgagccccccccccacgucaccuggcucaagaacggccagguccucggccccggcggccacguccgccucaagaacaacaacuccacccucaccaucuccggcaucggccccgaggacgaggccaucuaccagugcgucgccgagaacuccgccggcuccucccaggccuccgcccgccucaccguccucugggccgagggccuccccggccccccccgcaacguccgcgccgucuccgucuccuccaccgagguccgcgucuccugguccgagccccucgccaacaccaaggagaucaucggcuacguccuccacauccgcaaggccgccgacccccccgagcucgaguaccaggaggccgucuccaaguccaccuuccagcaccucgucuccgaccucgagcccuccaccgccuacuccuucuacaucaaggccuacaccccccgcggcgccuccuccgccuccguccccacccucgccuccacccucggcgaggcccccgccccccccccccucuccguccgcguccucggcuccuccucccuccagcuccucugggagcccuggccccgccucgcccagcacgagggcggcuucaagcucuucuaccgccccgccuccaagaccuccuucaccggccccauccuccuccccggcaccgucuccuccuacaaccucucccagcucgaccccaccgccgucuacgaggucaagcuccucgccuacaaccagcacggcgacggcaacgccaccguccgcuucgucucccuccgcggcgccuccgagcgcaccgcccucuccccccccugcgacugccgcaaggaggaggccgccaaccagaccuccaccaccggcaucgucaucggcauccacaucggcgucaccugcaucaucuucugcguccucuuccuccucuucggccagcgcggccgcguccuccucugcaaggacgucgagaaccagcucucccccccccagggcccccgcucccagcgcgaccccggcauccucgcccucaacggcgcccgccgcggccagcgcggccagcucggccgcgacgagaagcgcgucgacaugaaggagcucgagcagcucuucccccccgccuccgccgccggccagcccgacccccgccccacccaggaccccgccgcccccgcccccugcgaggagacccagcucuccguccucccccuccagggcugcggccucauggagggcaagaccaccgaggccaagaccaccgaggccaccgcccccugcgccggccucgccgccgccccccccccccccgacggcggccccggccuccucuccgagggccaggccucccgccccgccgccgcccgcgucacccagcccgcccacuccgagcaguga

SEQ ID NO: 44528 - RNA, 462 nt, Artificial Sequence
  derived and/or modified sequence opt2 from IGF1__Homo_sapiens__NP_000609
augggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcauguga

SEQ ID NO: 44529 - RNA, 4104 nt, Artificial Sequence
  derived and/or modified sequence opt2 from IGF1R__Homo_sapiens__NP_000866
augaaguccggcuccggcggcggcucccccaccucccucuggggccuccucuuccucuccgccgcccucucccucuggcccaccuccggcgagaucugcggccccggcaucgacauccgcaacgacuaccagcagcucaagcgccucgagaacugcaccgucaucgagggcuaccuccacauccuccucaucuccaaggccgaggacuaccgcuccuaccgcuuccccaagcucaccgucaucaccgaguaccuccuccucuuccgcgucgccggccucgagucccucggcgaccucuuccccaaccucaccgucauccgcggcuggaagcucuucuacaacuacgcccucgucaucuucgagaugaccaaccucaaggacaucggccucuacaaccuccgcaacaucacccgcggcgccauccgcaucgagaagaacgccgaccucugcuaccucuccaccgucgacuggucccucauccucgacgccgucuccaacaacuacaucgucggcaacaagccccccaaggagugcggcgaccucugccccggcaccauggaggagaagcccaugugcgagaagaccaccaucaacaacgaguacaacuaccgcugcuggaccaccaaccgcugccagaagaugugccccuccaccugcggcaagcgcgccugcaccgagaacaacgagugcugccaccccgagugccucggcuccugcuccgcccccgacaacgacaccgccugcgucgccugccgccacuacuacuacgccggcgucugcguccccgccugcccccccaacaccuaccgcuucgagggcuggcgcugcgucgaccgcgacuucugcgccaacauccucuccgccgaguccuccgacuccgagggcuucgucauccacgacggcgagugcaugcaggagugccccuccggcuucauccgcaacggcucccaguccauguacugcauccccugcgagggccccugccccaaggucugcgaggaggagaagaagaccaagaccaucgacuccgucaccuccgcccagaugcuccagggcugcaccaucuucaagggcaaccuccucaucaacauccgccgcggcaacaacaucgccuccgagcucgagaacuucaugggccucaucgaggucgucaccggcuacgucaagauccgccacucccacgcccucgucucccucuccuuccucaagaaccuccgccucauccucggcgaggagcagcucgagggcaacuacuccuucuacguccucgacaaccagaaccuccagcagcucugggacugggaccaccgcaaccucaccaucaaggccggcaagauguacuucgccuucaaccccaagcucugcgucuccgagaucuaccgcauggaggaggucaccggcaccaagggccgccaguccaagggcgacaucaacacccgcaacaacggcgagcgcgccuccugcgaguccgacguccuccacuucaccuccaccaccaccuccaagaaccgcaucaucaucaccuggcaccgcuaccgcccccccgacuaccgcgaccucaucuccuucaccgucuacuacaaggaggcccccuucaagaacgucaccgaguacgacggccaggacgccugcggcuccaacuccuggaacauggucgacgucgaccucccccccaacaaggacgucgagcccggcauccuccuccacggccucaagcccuggacccaguacgccgucuacgucaaggccgucacccucaccauggucgagaacgaccacauccgcggcgccaaguccgagauccucuacauccgcaccaacgccuccguccccuccaucccccucgacguccucuccgccuccaacuccuccucccagcucaucgucaaguggaacccccccucccuccccaacggcaaccucuccuacuacaucguccgcuggcagcgccagccccaggacggcuaccucuaccgccacaacuacugcuccaaggacaagauccccauccgcaaguacgccgacggcaccaucgacaucgaggaggucaccgagaaccccaagaccgaggucugcggcggcgagaagggccccugcugcgccugccccaagaccgaggccgagaagcaggccgagaaggaggaggccgaguaccgcaaggucuucgagaacuuccuccacaacuccaucuucgucccccgccccgagcgcaagcgccgcgacgucaugcaggucgccaacaccaccauguccucccgcucccgcaacaccaccgccgccgacaccuacaacaucaccgaccccgaggagcucgagaccgaguaccccuucuucgagucccgcgucgacaacaaggagcgcaccgucaucuccaaccuccgccccuucacccucuaccgcaucgacauccacuccugcaaccacgaggccgagaagcucggcugcuccgccuccaacuucgucuucgcccgcaccaugcccgccgagggcgccgacgacauccccggccccgucaccugggagccccgccccgagaacuccaucuuccucaaguggcccgagcccgagaaccccaacggccucauccucauguacgagaucaaguacggcucccaggucgaggaccagcgcgagugcgucucccgccaggaguaccgcaaguacggcggcgccaagcucaaccgccucaaccccggcaacuacaccgcccgcauccaggccaccucccucuccggcaacggcuccuggaccgaccccgucuucuucuacguccaggccaagaccggcuacgagaacuucauccaccucaucaucgcccuccccgucgccguccuccucaucgucggcggccucgucaucaugcucuacgucuuccaccgcaagcgcaacaacucccgccucggcaacggcguccucuacgccuccgucaaccccgaguacuucuccgccgccgacgucuacguccccgacgagugggaggucgcccgcgagaagaucaccaugucccgcgagcucggccagggcuccuucggcauggucuacgagggcgucgccaagggcgucgucaaggacgagcccgagacccgcgucgccaucaagaccgucaacgaggccgccuccaugcgcgagcgcaucgaguuccucaacgaggccuccgucaugaaggaguucaacugccaccacgucguccgccuccucggcgucgucucccagggccagcccacccucgucaucauggagcucaugacccgcggcgaccucaaguccuaccuccgcucccuccgccccgagauggagaacaaccccguccucgccccccccucccucuccaagaugauccagauggccggcgagaucgccgacggcauggccuaccucaacgccaacaaguucguccaccgcgaccucgccgcccgcaacugcauggucgccgaggacuucaccgucaagaucggcgacuucggcaugacccgcgacaucuacgagaccgacuacuaccgcaagggcggcaagggccuccuccccguccgcuggaugucccccgagucccucaaggacggcgucuucaccaccuacuccgacgucugguccuucggcgucguccucugggagaucgccacccucgccgagcagcccuaccagggccucuccaacgagcagguccuccgcuucgucauggagggcggccuccucgacaagcccgacaacugccccgacaugcucuucgagcucaugcgcaugugcuggcaguacaaccccaagaugcgccccuccuuccucgagaucaucuccuccaucaaggaggagauggagcccggcuuccgcgaggucuccuucuacuacuccgaggagaacaagcuccccgagcccgaggagcucgaccucgagcccgagaacauggaguccgucccccucgaccccuccgccuccuccuccucccucccccuccccgaccgccacuccggccacaaggccgagaacggccccggccccggcguccucguccuccgcgccuccuucgacgagcgccagcccuacgcccacaugaacggcggccgcaagaacgagcgcgcccucccccucccccaguccuccaccugcuga

SEQ ID NO: 44530 - RNA, 1317 nt, Artificial Sequence
  derived and/or modified sequence opt2 from IGF2BP1__Homo_sapiens__NP_001153895
augaacaagcucuacaucggcaaccucaacgaguccgucacccccgccgaccucgagaaggucuucgccgagcacaagaucuccuacuccggccaguuccucgucaaguccggcuacgccuucgucgacugccccgacgagcacugggccaugaaggccaucgagaccuucuccggcaaggucgagcuccagggcaagcgccucgagaucgagcacuccguccccaagaagcagcgcucccgcaagauccagauccgcaacauccccccccagcuccgcugggagguccucgacucccuccucgcccaguacggcaccgucgagaacugcgagcaggucaacaccgaguccgagaccgccgucgucaacgucaccuacuccaaccgcgagcagacccgccaggccgacgaggucccccucaagauccucgcccacaacaacuucgucggccgccucaucggcaaggagggccgcaaccucaagaaggucgagcaggacaccgagaccaagaucaccaucuccucccuccaggaccucacccucuacaaccccgagcgcaccaucaccgucaagggcgccaucgagaacugcugccgcgccgagcaggagaucaugaagaagguccgcgaggccuacgagaacgacgucgccgccaugucccuccagucccaccucauccccggccucaaccucgccgccgucggccucuuccccgccuccuccuccgccgucccccccccccccuccuccgucaccggcgccgcccccuacuccuccuucaugcaggcccccgagcaggagaugguccaggucuucauccccgcccaggccgucggcgccaucaucggcaagaagggccagcacaucaagcagcucucccgcuucgccuccgccuccaucaagaucgccccccccgagacccccgacuccaagguccgcauggucaucaucaccggcccccccgaggcccaguucaaggcccagggccgcaucuacggcaagcucaaggaggagaacuucuucggccccaaggaggaggucaagcucgagacccacauccgcguccccgccuccgccgccggccgcgucaucggcaagggcggcaagaccgucaacgagcuccagaaccucaccgccgccgaggucgucgucccccgcgaccagacccccgacgagaacgaccaggucaucgucaagaucaucggccacuucuacgccucccagauggcccagcgcaagauccgcgacauccucgcccaggucaagcagcagcaccagaagggccaguccaaccaggcccaggcccgccgcaaguga

SEQ ID NO: 44531 - RNA, 1671 nt, Artificial Sequence
  derived and/or modified sequence opt2 from IGF2BP2__Homo_sapiens__NP_001007226
augaugaacaagcucuacaucggcaaccucucccccgccgucaccgccgacgaccuccgccagcucuucggcgaccgcaagcucccccucgccggccagguccuccucaaguccggcuacgccuucgucgacuaccccgaccagaacugggccauccgcgccaucgagacccucuccggcaaggucgagcuccacggcaagaucauggaggucgacuacuccgucuccaagaagcuccgcucccgcaagauccagauccgcaacauccccccccaccuccagugggagguccucgacggccuccucgcccaguacggcaccgucgagaacgucgagcaggucaacaccgacaccgagaccgccgucgucaacgucaccuacgccacccgcgaggaggccaagaucgccauggagaagcucuccggccaccaguucgagaacuacuccuucaagaucuccuacauccccgacgaggaggucuccucccccucccccccccagcgcgcccagcgcggcgaccacuccucccgcgagcagggccacgcccccggcggcaccucccaggcccgccagaucgacuucccccuccgcauccucguccccacccaguucgucggcgccaucaucggcaaggagggccucaccaucaagaacaucaccaagcagacccagucccgcgucgacauccaccgcaaggagaacuccggcgccgccgagaagcccgucaccauccacgccacccccgagggcaccuccgaggccugccgcaugauccucgagaucaugcagaaggaggccgacgagaccaagcucgccgaggagaucccccucaagauccucgcccacaacggccucgucggccgccucaucggcaaggagggccgcaaccucaagaagaucgagcacgagaccggcaccaagaucaccaucuccucccuccaggaccucuccaucuacaaccccgagcgcaccaucaccgucaagggcaccgucgaggccugcgccuccgccgagaucgagaucaugaagaagcuccgcgaggccuucgagaacgacaugcucgccgucaacacccacuccggcuacuucuccucccucuacccccaccaccaguucggccccuucccccaccaccacuccuaccccgagcaggagaucgucaaccucuucauccccacccaggccgucggcgccaucaucggcaagaagggcgcccacaucaagcagcucgcccgcuucgccggcgccuccaucaagaucgcccccgccgagggccccgacgucuccgagcgcauggucaucaucaccggcccccccgaggcccaguucaaggcccagggccgcaucuucggcaagcucaaggaggagaacuucuucaaccccaaggaggaggucaagcucgaggcccacauccgcguccccuccuccaccgccggccgcgucaucggcaagggcggcaagaccgucaacgagcuccagaaccucaccuccgccgaggucaucgucccccgcgaccagacccccgacgagaacgaggaggucaucguccgcaucaucggccacuucuucgccucccagaccgcccagcgcaagauccgcgagaucguccagcaggucaagcagcaggagcagaaguacccccagggcgucgccucccagcgcuccaaguga

SEQ ID NO: 44532 - RNA, 1740 nt, Artificial Sequence
  derived and/or modified sequence opt2 from IGF2BP3__Homo_sapiens__NP_006538
augaacaagcucuacaucggcaaccucuccgagaacgccgcccccuccgaccucgaguccaucuucaaggacgccaagauccccgucuccggccccuuccucgucaagaccggcuacgccuucgucgacugccccgacgaguccugggcccucaaggccaucgaggcccucuccggcaagaucgagcuccacggcaagcccaucgaggucgagcacuccguccccaagcgccagcgcauccgcaagcuccagauccgcaacauccccccccaccuccagugggagguccucgacucccuccucguccaguacggcgucgucgaguccugcgagcaggucaacaccgacuccgagaccgccgucgucaacgucaccuacuccuccaaggaccaggcccgccaggcccucgacaagcucaacggcuuccagcucgagaacuucacccucaaggucgccuacauccccgacgagauggccgcccagcagaacccccuccagcagccccgcggccgccgcggccucggccagcgcggcuccucccgccagggcucccccggcuccgucuccaagcagaagcccugcgaccucccccuccgccuccucguccccacccaguucgucggcgccaucaucggcaaggagggcgccaccauccgcaacaucaccaagcagacccaguccaagaucgacguccaccgcaaggagaacgccggcgccgccgagaaguccaucaccauccucuccacccccgagggcaccuccgccgccugcaaguccauccucgagaucaugcacaaggaggcccaggacaucaaguucaccgaggagaucccccucaagauccucgcccacaacaacuucgucggccgccucaucggcaaggagggccgcaaccucaagaagaucgagcaggacaccgacaccaagaucaccaucuccccccuccaggagcucacccucuacaaccccgagcgcaccaucaccgucaagggcaacgucgagaccugcgccaaggccgaggaggagaucaugaagaagauccgcgaguccuacgagaacgacaucgccuccaugaaccuccaggcccaccucauccccggccucaaccucaacgcccucggccucuucccccccaccuccggcaugcccccccccaccuccggcccccccuccgccaugaccccccccuacccccaguucgagcaguccgagaccgagaccguccaccucuucauccccgcccucuccgucggcgccaucaucggcaagcagggccagcacaucaagcagcucucccgcuucgccggcgccuccaucaagaucgcccccgccgaggcccccgacgccaagguccgcauggucaucaucaccggcccccccgaggcccaguucaaggcccagggccgcaucuacggcaagaucaaggaggagaacuucgucucccccaaggaggaggucaagcucgaggcccacauccgcguccccuccuucgccgccggccgcgucaucggcaagggcggcaagaccgucaacgagcuccagaaccucuccuccgccgaggucgucgucccccgcgaccagacccccgacgagaacgaccaggucgucgucaagaucaccggccacuucuacgccugccaggucgcccagcgcaagauccaggagauccucacccaggucaagcagcaccagcagcagaaggcccuccaguccggccccccccagucccgccgcaaguga

SEQ ID NO: 44533 - RNA, 711 nt, Artificial Sequence
  derived and/or modified sequence opt2 from IGF2__Homo_sapiens__NP_001121070
auggucucccccgacccccagaucaucgucgucgcccccgagaccgagcucgccuccaugcagguccagcgcaccgaggacggcgucaccaucauccagaucuucugggucggccgcaagggcgagcuccuccgccgcacccccgucuccuccgccaugcagacccccaugggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaaguga

SEQ ID NO: 44534 - RNA, 7476 nt, Artificial Sequence
  derived and/or modified sequence opt2 from IGF2R__Homo_sapiens__NP_000867
augggcgccgccgccggccgcuccccccaccucggccccgcccccgcccgccgcccccagcgcucccuccuccuccuccagcuccuccuccucgucgccgcccccggcuccacccaggcccaggccgcccccuuccccgagcucugcuccuacaccugggaggccgucgacaccaagaacaacguccucuacaagaucaacaucugcggcuccgucgacaucguccagugcggccccuccuccgccgucugcaugcacgaccucaagacccgcaccuaccacuccgucggcgacuccguccuccgcuccgccacccgcucccuccucgaguucaacaccaccgucuccugcgaccagcagggcaccaaccaccgcguccaguccuccaucgccuuccucugcggcaagacccucggcacccccgaguucgucaccgccaccgagugcguccacuacuucgaguggcgcaccaccgccgccugcaagaaggacaucuucaaggccaacaaggagguccccugcuacgucuucgacgaggagcuccgcaagcacgaccucaacccccucaucaagcucuccggcgccuaccucgucgacgacuccgaccccgacaccucccucuucaucaacgucugccgcgacaucgacacccuccgcgaccccggcucccagcuccgcgccugcccccccggcaccgccgccugccucguccgcggccaccaggccuucgacgucggccagccccgcgacggccucaagcucguccgcaaggaccgccucguccucuccuacguccgcgaggaggccggcaagcucgacuucugcgacggccacucccccgccgucaccaucaccuucgucugccccuccgagcgccgcgagggcaccauccccaagcucaccgccaaguccaacugccgcuacgagaucgaguggaucaccgaguacgccugccaccgcgacuaccucgaguccaagaccugcucccucuccggcgagcagcaggacgucuccaucgaccucaccccccucgcccaguccggcggcuccuccuacaucuccgacggcaaggaguaccucuucuaccucaacgucugcggcgagaccgagauccaguucugcaacaagaagcaggccgccgucugccaggucaagaaguccgacaccucccaggucaaggccgccggccgcuaccacaaccagacccuccgcuacuccgacggcgaccucacccucaucuacuucggcggcgacgagugcuccuccggcuuccagcgcauguccgucaucaacuucgagugcaacaagaccgccggcaacgacggcaagggcacccccgucuucaccggcgaggucgacugcaccuacuucuucaccugggacaccgaguacgccugcgucaaggagaaggaggaccuccucugcggcgccaccgacggcaagaagcgcuacgaccucuccgcccucguccgccacgccgagcccgagcagaacugggaggccgucgacggcucccagaccgagaccgagaagaagcacuucuucaucaacaucugccaccgcguccuccaggagggcaaggcccgcggcugccccgaggacgccgccgucugcgccgucgacaagaacggcuccaagaaccucggcaaguucaucuccucccccaugaaggagaagggcaacauccagcucuccuacuccgacggcgacgacugcggccacggcaagaagaucaagaccaacaucacccucgucugcaagcccggcgaccucgaguccgcccccguccuccgcaccuccggcgagggcggcugcuucuacgaguucgaguggcacaccgccgccgccugcguccucuccaagaccgagggcgagaacugcaccgucuucgacucccaggccggcuucuccuucgaccucuccccccucaccaagaagaacggcgccuacaaggucgagaccaagaaguacgacuucuacaucaacgucugcggccccgucuccgucucccccugccagcccgacuccggcgccugccaggucgccaaguccgacgagaagaccuggaaccucggccucuccaacgccaagcucuccuacuacgacggcaugauccagcucaacuaccgcggcggcacccccuacaacaacgagcgccacaccccccgcgccacccucaucaccuuccucugcgaccgcgacgccggcgucggcuuccccgaguaccaggaggaggacaacuccaccuacaacuuccgcugguacaccuccuacgccugccccgaggagccccucgagugcgucgucaccgaccccuccacccucgagcaguacgaccucuccucccucgccaaguccgagggcggccucggcggcaacugguacgccauggacaacuccggcgagcacgucaccuggcgcaaguacuacaucaacgucugccgcccccucaaccccguccccggcugcaaccgcuacgccuccgccugccagaugaaguacgagaaggaccagggcuccuucaccgaggucgucuccaucuccaaccucggcauggccaagaccggccccgucgucgaggacuccggcucccuccuccucgaguacgucaacggcuccgccugcaccaccuccgacggccgccagaccaccuacaccacccgcauccaccucgucugcucccgcggccgccucaacucccaccccaucuucucccucaacugggagugcgucgucuccuuccucuggaacaccgaggccgccugccccauccagaccaccaccgacaccgaccaggccugcuccauccgcgaccccaacuccggcuucgucuucaaccucaacccccucaacuccucccagggcuacaacgucuccggcaucggcaagaucuucauguucaacgucugcggcaccaugcccgucugcggcaccauccucggcaagcccgccuccggcugcgaggccgagacccagaccgaggagcucaagaacuggaagcccgcccgccccgucggcaucgagaagucccuccagcucuccaccgagggcuucaucacccucaccuacaagggcccccucuccgccaagggcaccgccgacgccuucaucguccgcuucgucugcaacgacgacgucuacuccggcccccucaaguuccuccaccaggacaucgacuccggccagggcauccgcaacaccuacuucgaguucgagaccgcccucgccugcguccccucccccgucgacugccaggucaccgaccucgccggcaacgaguacgaccucaccggccucuccaccguccgcaagcccuggaccgccgucgacaccuccgucgacggccgcaagcgcaccuucuaccucuccgucugcaacccccuccccuacauccccggcugccagggcuccgccgucggcuccugccucgucuccgagggcaacuccuggaaccucggcgucguccagauguccccccaggccgccgccaacggcucccucuccaucauguacgucaacggcgacaagugcggcaaccagcgcuucuccacccgcaucaccuucgagugcgcccagaucuccggcucccccgccuuccagcuccaggacggcugcgaguacgucuucaucuggcgcaccgucgaggccugccccgucguccgcgucgagggcgacaacugcgaggucaaggacccccgccacggcaaccucuacgaccucaagccccucggccucaacgacaccaucgucuccgccggcgaguacaccuacuacuuccgcgucugcggcaagcucuccuccgacgucugccccaccuccgacaaguccaaggucgucuccuccugccaggagaagcgcgagccccagggcuuccacaaggucgccggccuccucacccagaagcucaccuacgagaacggccuccucaagaugaacuucaccggcggcgacaccugccacaaggucuaccagcgcuccaccgccaucuucuucuacugcgaccgcggcacccagcgccccgucuuccucaaggagaccuccgacugcuccuaccucuucgaguggcgcacccaguacgccugcccccccuucgaccucaccgagugcuccuucaaggacggcgccggcaacuccuucgaccucuccucccucucccgcuacuccgacaacugggaggccaucaccggcaccggcgaccccgagcacuaccucaucaacgucugcaagucccucgccccccaggccggcaccgagcccugcccccccgaggccgccgccugccuccucggcggcuccaagcccgucaaccucggccgcguccgcgacggcccccaguggcgcgacggcaucaucguccucaaguacgucgacggcgaccucugccccgacggcauccgcaagaaguccaccaccauccgcuucaccugcuccgagucccaggucaacucccgccccauguucaucuccgccgucgaggacugcgaguacaccuucgccuggcccaccgccaccgccugccccaugaaguccaacgagcacgacgacugccaggucaccaaccccuccaccggccaccucuucgaccucuccucccucuccggccgcgccggcuucaccgccgccuacuccgagaagggccucgucuacauguccaucugcggcgagaacgagaacugcccccccggcgucggcgccugcuucggccagacccgcaucuccgucggcaaggccaacaagcgccuccgcuacgucgaccagguccuccagcucgucuacaaggacggcucccccugccccuccaaguccggccucuccuacaaguccgucaucuccuucgucugccgccccgaggccggccccaccaaccgccccaugcucaucucccucgacaagcagaccugcacccucuucuucuccuggcacaccccccucgccugcgagcaggccaccgagugcuccguccgcaacggcuccuccaucgucgaccucuccccccucauccaccgcaccggcggcuacgaggccuacgacgaguccgaggacgacgccuccgacaccaaccccgacuucuacaucaacaucugccagccccucaaccccaugcacggcguccccugccccgccggcgccgccgucugcaagguccccaucgacggcccccccaucgacaucggccgcgucgccggcccccccauccucaaccccaucgccaacgagaucuaccucaacuucgaguccuccacccccugccucgccgacaagcacuucaacuacaccucccucaucgccuuccacugcaagcgcggcgucuccaugggcacccccaagcuccuccgcaccuccgagugcgacuucgucuucgagugggagacccccgucgucugccccgacgagguccgcauggacggcugcacccucaccgacgagcagcuccucuacuccuucaaccucuccucccucuccaccuccaccuucaaggucacccgcgacucccgcaccuacuccgucggcgucugcaccuucgccgucggccccgagcagggcggcugcaaggacggcggcgucugccuccucuccggcaccaagggcgccuccuucggccgccuccaguccaugaagcucgacuaccgccaccaggacgaggccgucguccucuccuacgucaacggcgaccgcugcccccccgagaccgacgacggcguccccugcgucuuccccuucaucuucaacggcaaguccuacgaggagugcaucaucgagucccgcgccaagcucuggugcuccaccaccgccgacuacgaccgcgaccacgaguggggcuucugccgccacuccaacuccuaccgcaccuccuccaucaucuucaagugcgacgaggacgaggacaucggccgcccccaggucuucuccgagguccgcggcugcgacgucaccuucgaguggaagaccaaggucgucugcccccccaagaagcucgagugcaaguucguccagaagcacaagaccuacgaccuccgccuccucuccucccucaccggcuccuggucccucguccacaacggcgucuccuacuacaucaaccucugccagaagaucuacaagggcccccucggcugcuccgagcgcgccuccaucugccgccgcaccaccaccggcgacguccagguccucggccucguccacacccagaagcucggcgucaucggcgacaaggucgucgucaccuacuccaagggcuaccccugcggcggcaacaagaccgccuccuccgucaucgagcucaccugcaccaagaccgucggccgccccgccuucaagcgcuucgacaucgacuccugcaccuacuacuucuccugggacucccgcgccgccugcgccgucaagccccaggagguccagauggucaacggcaccaucaccaaccccaucaacggcaaguccuucucccucggcgacaucuacuucaagcucuuccgcgccuccggcgacaugcgcaccaacggcgacaacuaccucuacgagauccagcucuccuccaucaccuccucccgcaaccccgccugcuccggcgccaacaucugccaggucaagcccaacgaccagcacuucucccgcaaggucggcaccuccgacaagaccaaguacuaccuccaggacggcgaccucgacgucgucuucgccuccuccuccaagugcggcaaggacaagaccaaguccgucuccuccaccaucuucuuccacugcgacccccucgucgaggacggcauccccgaguucucccacgagaccgccgacugccaguaccucuucuccugguacaccuccgccgucugcccccucggcgucggcuucgacuccgagaaccccggcgacgacggccagaugcacaagggccucuccgagcgcucccaggccgucggcgccguccucucccuccuccucgucgcccucaccugcugccuccucgcccuccuccucuacaagaaggagcgccgcgagaccgucaucuccaagcucaccaccugcugccgccgcuccuccaacgucuccuacaaguacuccaaggucaacaaggaggaggagaccgacgagaacgagaccgaguggcucauggaggagauccagcucccccccccccgccagggcaaggagggccaggagaacggccacaucaccaccaaguccgucaaggcccucuccucccuccacggcgacgaccaggacuccgaggacgagguccucaccauccccgaggucaagguccacuccggccgcggcgccggcgccgaguccucccaccccguccgcaacgcccaguccaacgcccuccaggagcgcgaggacgaccgcgucggccucguccgcggcgagaaggcccgcaagggcaaguccuccuccgcccagcagaagaccgucuccuccaccaagcucgucuccuuccacgacgacuccgacgaggaccuccuccacaucuga

SEQ ID NO: 44535 - RNA, 1932 nt, Artificial Sequence
  derived and/or modified sequence opt2 from IGFALS__Homo_sapiens__NP_001139478
auggcccuccgcaaggccggcgaccucgagccccaguucacccccgagcgccgcuuccgccucugcugguaccaggcccacuccggccgcgcccuccucggcccccccccccaggccuccccccccgccggcggccucgcccucgcccuccuccuccucuccugggucgcccucggcccccgcucccucgagggcgccgaccccggcacccccggcgaggccgagggccccgccugccccgccgccugcgucugcuccuacgacgacgacgccgacgagcucuccgucuucugcuccucccgcaaccucacccgccuccccgacggcguccccggcggcacccaggcccucuggcucgacggcaacaaccucuccuccgucccccccgccgccuuccagaaccucuccucccucggcuuccucaaccuccagggcggccagcucggcucccucgagccccaggcccuccucggccucgagaaccucugccaccuccaccucgagcgcaaccagcuccgcucccucgcccucggcaccuucgcccacacccccgcccucgccucccucggccucuccaacaaccgccucucccgccucgaggacggccucuucgagggccucggcucccucugggaccucaaccucggcuggaacucccucgccguccuccccgacgccgccuuccgcggccucggcucccuccgcgagcucguccucgccggcaaccgccucgccuaccuccagcccgcccucuucuccggccucgccgagcuccgcgagcucgaccucucccgcaacgcccuccgcgccaucaaggccaacgucuucguccagcucccccgccuccagaagcucuaccucgaccgcaaccucaucgccgccgucgcccccggcgccuuccucggccucaaggcccuccgcuggcucgaccucucccacaaccgcgucgccggccuccucgaggacaccuuccccggccuccucggccuccgcguccuccgccucucccacaacgccaucgccucccuccgcccccgcaccuucaaggaccuccacuuccucgaggagcuccagcucggccacaaccgcauccgccagcucgccgagcgcuccuucgagggccucggccagcucgagguccucacccucgaccacaaccagcuccaggaggucaaggccggcgccuuccucggccucaccaacgucgccgucaugaaccucuccggcaacugccuccgcaaccuccccgagcaggucuuccgcggccucggcaagcuccacucccuccaccucgagggcuccugccucggccgcauccgcccccacaccuucaccggccucuccggccuccgccgccucuuccucaaggacaacggccucgucggcaucgaggagcagucccucuggggccucgccgagcuccucgagcucgaccucaccuccaaccagcucacccaccucccccaccgccucuuccagggccucggcaagcucgaguaccuccuccucucccgcaaccgccucgccgagcuccccgccgacgcccucggcccccuccagcgcgccuucuggcucgacgucucccacaaccgccucgaggcccuccccaacucccuccucgccccccucggccgccuccgcuaccucucccuccgcaacaacucccuccgcaccuucaccccccagccccccggccucgagcgccucuggcucgagggcaaccccugggacugcggcugcccccucaaggcccuccgcgacuucgcccuccagaaccccuccgccgucccccgcuucguccaggccaucugcgagggcgacgacugccagccccccgccuacaccuacaacaacaucaccugcgccuccccccccgaggucgucggccucgaccuccgcgaccucuccgaggcccacuucgcccccugcuga

SEQ ID NO: 44536 - RNA, 780 nt, Artificial Sequence
  derived and/or modified sequence opt2 from IGFBP1__Homo_sapiens__NP_000587
auguccgagguccccgucgcccgcgucuggcucguccuccuccuccucaccguccaggucggcgucaccgccggcgcccccuggcagugcgcccccugcuccgccgagaagcucgcccucugcccccccgucuccgccuccugcuccgaggucacccgcuccgccggcugcggcugcugccccaugugcgcccucccccucggcgccgccugcggcgucgccaccgcccgcugcgcccgcggccucuccugccgcgcccuccccggcgagcagcagccccuccacgcccucacccgcggccagggcgccugcguccaggaguccgacgccuccgccccccacgccgccgaggccggcucccccgagucccccgaguccaccgagaucaccgaggaggagcuccucgacaacuuccaccucauggcccccuccgaggaggaccacuccauccucugggacgccaucuccaccuacgacggcuccaaggcccuccacgucaccaacaucaagaaguggaaggagcccugccgcaucgagcucuaccgcgucgucgagucccucgccaaggcccaggagaccuccggcgaggagaucuccaaguucuaccuccccaacugcaacaagaacggcuucuaccacucccgccagugcgagaccuccauggacggcgaggccggccucugcuggugcgucuaccccuggaacggcaagcgcauccccggcucccccgagauccgcggcgaccccaacugccagaucuacuucaacguccagaacuga

SEQ ID NO: 44537 - RNA, 987 nt, Artificial Sequence
  derived and/or modified sequence opt2 from IGFBP2__Homo_sapiens__NP_000588
augcucccccgcgucggcugccccgcccucccccuccccccccccccccuccucccccuccucccccuccuccuccuccuccucggcgccuccggcggcggcggcggcgcccgcgccgagguccucuuccgcugcccccccugcacccccgagcgccucgccgccugcggccccccccccgucgccccccccgccgccgucgccgccgucgccggcggcgcccgcaugcccugcgccgagcucguccgcgagcccggcugcggcugcugcuccgucugcgcccgccucgagggcgaggccugcggcgucuacaccccccgcugcggccagggccuccgcugcuacccccaccccggcuccgagcucccccuccaggcccucgucaugggcgagggcaccugcgagaagcgccgcgacgccgaguacggcgccucccccgagcaggucgccgacaacggcgacgaccacuccgagggcggccucgucgagaaccacgucgacuccaccaugaacaugcucggcggcggcggcuccgccggccgcaagccccucaaguccggcaugaaggagcucgccgucuuccgcgagaaggucaccgagcagcaccgccagaugggcaagggcggcaagcaccaccucggccucgaggagcccaagaagcuccgccccccccccgcccgcacccccugccagcaggagcucgaccagguccucgagcgcaucuccaccaugcgccuccccgacgagcgcggcccccucgagcaccucuacucccuccacauccccaacugcgacaagcacggccucuacaaccucaagcagugcaagaugucccucaacggccagcgcggcgagugcuggugcgucaaccccaacaccggcaagcucauccagggcgcccccaccauccgcggcgaccccgagugccaccucuucuacaacgagcagcaggaggcccgcggcguccacacccagcgcaugcaguga

SEQ ID NO: 44538 - RNA, 876 nt, Artificial Sequence
  derived and/or modified sequence opt2 from IGFBP3__Homo_sapiens__NP_000589
augcagcgcgcccgccccacccucugggccgccgcccucacccuccucguccuccuccgcggcccccccgucgcccgcgccggcgccuccuccgccggccucggccccgucguccgcugcgagcccugcgacgcccgcgcccucgcccagugcgcccccccccccgccgucugcgccgagcucguccgcgagcccggcugcggcugcugccucaccugcgcccucuccgagggccagcccugcggcaucuacaccgagcgcugcggcuccggccuccgcugccagcccucccccgacgaggcccgcccccuccaggcccuccucgacggccgcggccucugcgucaacgccuccgccgucucccgccuccgcgccuaccuccuccccgccccccccgcccccggcaacgccuccgaguccgaggaggaccgcuccgccggcuccgucgagucccccuccgucuccuccacccaccgcgucuccgaccccaaguuccacccccuccacuccaagaucaucaucaucaagaagggccacgccaaggacucccagcgcuacaaggucgacuacgagucccaguccaccgacacccagaacuucuccuccgaguccaagcgcgagaccgaguacggccccugccgccgcgagauggaggacacccucaaccaccucaaguuccucaacguccucuccccccgcggcguccacauccccaacugcgacaagaagggcuucuacaagaagaagcagugccgccccuccaagggccgcaagcgcggcuucugcuggugcgucgacaaguacggccagccccuccccggcuacaccaccaagggcaaggaggacguccacugcuacuccaugcaguccaaguga

SEQ ID NO: 44539 - RNA, 777 nt, Artificial Sequence
  derived and/or modified sequence opt2 from IGFBP4__Homo_sapiens__NP_001543
augcucccccucugccucgucgccgcccuccuccucgccgccggccccggccccucccucggcgacgaggccauccacugcccccccugcuccgaggagaagcucgcccgcugccgcccccccgucggcugcgaggagcucguccgcgagcccggcugcggcugcugcgccaccugcgcccucggccucggcaugcccugcggcgucuacaccccccgcugcggcuccggccuccgcugcuaccccccccgcggcgucgagaagccccuccacacccucaugcacggccagggcgucugcauggagcucgccgagaucgaggccauccaggagucccuccagcccuccgacaaggacgagggcgaccaccccaacaacuccuucucccccugcuccgcccacgaccgccgcugccuccagaagcacuucgccaagauccgcgaccgcuccaccuccggcggcaagaugaaggucaacggcgccccccgcgaggacgcccgccccgucccccagggcuccugccaguccgagcuccaccgcgcccucgagcgccucgccgccucccagucccgcacccacgaggaccucuacaucauccccauccccaacugcgaccgcaacggcaacuuccaccccaagcagugccaccccgcccucgacggccagcgcggcaagugcuggugcgucgaccgcaagaccggcgucaagcuccccggcggccucgagcccaagggcgagcucgacugccaccagcucgccgacuccuuccgcgaguga

SEQ ID NO: 44540 - RNA, 819 nt, Artificial Sequence
  derived and/or modified sequence opt2 from IGFBP5__Homo_sapiens__NP_000590
augguccuccucaccgccguccuccuccuccucgccgccuacgccggccccgcccagucccucggcuccuucguccacugcgagcccugcgacgagaaggcccucuccaugugcccccccuccccccucggcugcgagcucgucaaggagcccggcugcggcugcugcaugaccugcgcccucgccgagggccaguccugcggcgucuacaccgagcgcugcgcccagggccuccgcugccucccccgccaggacgaggagaagccccuccacgcccuccuccacggccgcggcgucugccucaacgagaaguccuaccgcgagcaggucaagaucgagcgcgacucccgcgagcacgaggagcccaccaccuccgagauggccgaggagaccuacucccccaagaucuuccgccccaagcacacccgcaucuccgagcucaaggccgaggccgucaagaaggaccgccgcaagaagcucacccaguccaaguucgucggcggcgccgagaacaccgcccacccccgcaucaucuccgcccccgagaugcgccaggaguccgagcagggccccugccgccgccacauggaggccucccuccaggagcucaaggccuccccccgcauggucccccgcgccgucuaccuccccaacugcgaccgcaagggcuucuacaagcgcaagcagugcaagcccucccgcggccgcaagcgcggcaucugcuggugcgucgacaaguacggcaugaagcuccccggcauggaguacgucgacggcgacuuccagugccacaccuucgacuccuccaacgucgaguga

SEQ ID NO: 44541 - RNA, 723 nt, Artificial Sequence
  derived and/or modified sequence opt2 from IGFBP6__Homo_sapiens__NP_002169
augaccccccaccgccuccuccccccccuccuccuccuccucgcccuccuccucgccgccucccccggcggcgcccucgcccgcugccccggcugcggccagggcguccaggccggcugccccggcggcugcgucgaggaggaggacggcggcucccccgccgagggcugcgccgaggccgagggcugccuccgccgcgagggccaggagugcggcgucuacacccccaacugcgcccccggccuccagugccacccccccaaggacgacgaggccccccuccgcgcccuccuccucggccgcggccgcugccuccccgcccgcgcccccgccgucgccgaggagaaccccaaggaguccaagccccaggccggcaccgcccgcccccaggacgucaaccgccgcgaccagcagcgcaaccccggcaccuccaccacccccucccagcccaacuccgccggcguccaggacaccgagaugggccccugccgccgccaccucgacuccguccuccagcagcuccagaccgaggucuaccgcggcgcccagacccucuacguccccaacugcgaccaccgcggcuucuaccgcaagcgccagugccgcuccucccagggccagcgccgcggccccugcuggugcgucgaccgcaugggcaagucccuccccggcucccccgacggcaacggcuccuccuccugccccaccggcuccuccggcuga

SEQ ID NO: 44542 - RNA, 840 nt, Artificial Sequence
  derived and/or modified sequence opt2 from IGFBP7__Homo_sapiens__NP_001240764
auggagcgccccucccuccgcgcccuccuccucggcgccgccggccuccuccuccuccuccucccccucuccuccuccuccuccuccgacaccugcggccccugcgagcccgccuccugccccccccuccccccccucggcugccuccucggcgagacccgcgacgccugcggcugcugccccaugugcgcccgcggcgagggcgagcccugcggcggcggcggcgccggccgcggcuacugcgcccccggcauggagugcgucaagucccgcaagcgccgcaagggcaaggccggcgccgccgccggcggccccggcgucuccggcgucugcgucugcaagucccgcuaccccgucugcggcuccgacggcaccaccuaccccuccggcugccagcuccgcgccgccucccagcgcgccgagucccgcggcgagaaggccaucacccaggucuccaagggcaccugcgagcagggccccuccaucgucaccccccccaaggacaucuggaacgucaccggcgcccaggucuaccucuccugcgaggucaucggcauccccacccccguccucaucuggaacaaggucaagcgcggccacuacggcguccagcgcaccgagcuccuccccggcgaccgcgacaaccucgccauccagacccgcggcggccccgagaagcacgaggucaccggcuggguccucgucuccccccucuccaaggaggacgccggcgaguacgagugccacgccuccaacucccagggccaggccuccgccuccgccaagaucaccgucgucgacgcccuccacgagauccccgucaagaagggcacccaguga

SEQ ID NO: 44543 - RNA, 837 nt, Artificial Sequence
  derived and/or modified sequence opt2 from IGFBPL1__Homo_sapiens__NP_001007564
augccccgccucucccuccuccucccccuccuccuccuccuccuccucccccuccuccccccccucucccccucccucggcauccgcgacgucggcggccgccgccccaagugcggccccugccgccccgagggcugccccgcccccgcccccugccccgcccccggcaucuccgcccucgacgagugcggcugcugcgcccgcugccucggcgccgagggcgccuccugcggcggccgcgccggcggccgcugcggccccggccucgucugcgccucccaggccgccggcgccgcccccgagggcaccggccucugcgucugcgcccagcgcggcaccgucugcggcuccgacggccgcuccuaccccuccgucugcgcccuccgccuccgcgcccgccacaccccccgcgcccaccccggccaccuccacaaggcccgcgacggccccugcgaguucgcccccgucgucgucguccccccccgcuccguccacaacgucaccggcgcccaggucggccucuccugcgagguccgcgccguccccacccccgucaucaccuggcgcaaggucaccaagucccccgagggcacccaggcccucgaggagcuccccggcgaccacgucaacaucgccguccagguccgcggcggccccuccgaccacgaggccaccgccuggauccucaucaacccccuccgcaaggaggacgagggcgucuaccagugccacgccgccaacauggucggcgaggccgagucccacuccaccgucaccguccucgaccucuccaaguaccgcuccuuccacuuccccgcccccgacgaccgcauguga

SEQ ID NO: 44544 - RNA, 333 nt, Artificial Sequence
  derived and/or modified sequence opt2 from IGFL1__Homo_sapiens__NP_940943
auggccccccgcggcugcaucgucgccgucuucgccaucuucugcaucucccgccuccucugcucccacggcgcccccgucgcccccaugacccccuaccucaugcucugccagccccacaagcgcugcggcgacaaguucuacgacccccuccagcacugcugcuacgacgacgccgucgucccccucgcccgcacccagaccugcggcaacugcaccuuccgcgucugcuucgagcagugcugccccuggaccuucauggucaagcucaucaaccagaacugcgacuccgcccgcaccuccgacgaccgccucugccgcuccgucuccuga

SEQ ID NO: 44545 - RNA, 1068 nt, Artificial Sequence
  derived and/or modified sequence opt2 from IGFLR1__Homo_sapiens__NP_078936
augggccccggccgcugccuccucaccgcccuccuccuccucgcccucgcccccccccccgaggccucccaguacugcggccgccucgaguacuggaaccccgacaacaagugcugcuccuccugccuccagcgcuucggccccccccccugccccgacuacgaguuccgcgagaacugcggccucaacgaccacggcgacuucgucaccccccccuuccgcaagugcuccuccggccagugcaaccccgacggcgccgagcucugcucccccugcggcggcggcgccgucacccccacccccgccgccggcggcggccgcacccccuggcgcugccgcgagcgccccguccccgccaagggccacugcccccucacccccggcaaccccggcgcccccuccucccaggagcgcuccucccccgccuccuccaucgccuggcgcacccccgagcccgucccccagcaggccuggcccaacuuccucccccucgucguccucguccuccuccucacccucgccgucaucgccauccuccucuucauccuccucuggcaccucugcuggcccaaggagaaggccgaccccuaccccuaccccggccucgucugcggcguccccaacacccacacccccuccuccucccaccucuccucccccggcgcccucgagaccggcgacaccuggaaggaggccucccuccucccccuccucucccgcgagcucuccucccucgccucccagccccucucccgccuccucgacgagcucgagguccucgaggagcucaucguccuccucgaccccgagcccggccccggcggcggcauggcccacggcaccacccgccaccucgccgcccgcuacggccuccccgccgccugguccaccuucgccuacucccuccgccccucccgcuccccccuccgcgcccucaucgagauggucgucgcccgcgagcccuccgccucccucggccagcucggcacccaccucgcccagcucggccgcgccgacgcccuccgcguccucuccaagcucggcuccuccggcgucugcugggccuga

SEQ ID NO: 44546 - RNA, 2982 nt, Artificial Sequence
  derived and/or modified sequence opt2 from IGHMBP2__Homo_sapiens__NP_002171
auggccuccgccgccgucgaguccuucgucaccaagcagcucgaccuccucgagcucgagcgcgacgccgaggucgaggagcgccgcuccuggcaggagaacaucucccucaaggagcuccagucccgcggcgucugccuccucaagcuccaggucuccucccagcgcaccggccucuacggccgccuccucgucaccuucgagccccgccgcuacggcuccgccgccgcccuccccuccaacuccuucaccuccggcgacaucgucggccucuacgacgccgccaacgagggcucccagcucgccaccggcauccucacccgcgucacccagaaguccgucaccgucgccuucgacgagucccacgacuuccagcucucccucgaccgcgagaacuccuaccgccuccucaagcucgccaacgacgucaccuaccgccgccucaagaaggcccucaucgcccucaagaaguaccacuccggccccgccuccucccucaucgagguccucuucggccgcuccgcccccucccccgccuccgagauccacccccucaccuucuucaacaccugccucgacaccucccagaaggaggccguccucuucgcccucucccagaaggagcucgccaucauccacggcccccccggcaccggcaagaccaccaccgucgucgagaucauccuccaggccgucaagcagggccucaagguccucugcugcgcccccuccaacaucgccgucgacaaccucgucgagcgccucgcccucugcaagcagcgcauccuccgccucggccaccccgcccgccuccucgaguccauccagcagcacucccucgacgccguccucgcccgcuccgacuccgcccagaucgucgccgacauccgcaaggacaucgaccaggucuucgucaagaacaagaagacccaggacaagcgcgagaaguccaacuuccgcaacgagaucaagcuccuccgcaaggagcucaaggagcgcgaggaggccgccaugcucgagucccucaccuccgccaacgucguccucgccaccaacaccggcgccuccgccgacggcccccucaagcuccuccccgaguccuacuucgacgucgucgucaucgacgagugcgcccaggcccucgaggccuccugcuggaucccccuccucaaggcccgcaagugcauccucgccggcgaccacaagcagcucccccccaccaccgucucccacaaggccgcccucgccggccucucccucucccucauggagcgccucgccgaggaguacggcgcccgcgucguccgcacccucaccguccaguaccgcaugcaccaggccaucaugcgcugggccuccgacaccauguaccucggccagcucaccgcccacuccuccgucgcccgccaccuccuccgcgaccuccccggcgucgccgccaccgaggagaccggcgucccccuccuccucgucgacaccgccggcugcggccucuucgagcucgaggaggaggacgagcaguccaagggcaaccccggcgagguccgccucgucucccuccacauccaggcccucgucgacgccggcguccccgcccgcgacaucgccgucgucucccccuacaaccuccaggucgaccuccuccgccagucccucguccaccgccaccccgagcucgagaucaaguccgucgacggcuuccagggccgcgagaaggaggccgucauccucuccuucguccgcuccaaccgcaagggcgaggucggcuuccucgccgaggaccgccgcaucaacgucgccgucacccgcgcccgccgccacgucgccgucaucugcgacucccgcaccgucaacaaccacgccuuccucaagacccucgucgaguacuucacccagcacggcgagguccgcaccgccuucgaguaccucgacgacaucguccccgagaacuacucccacgagaacucccagggcuccucccacgccgccaccaagccccagggccccgccaccuccacccgcaccggcucccagcgccaggagggcggccaggaggccgccgcccccgcccgccagggccgcaagaagcccgccggcaagucccucgccuccgaggcccccucccagcccucccucaacggcggcucccccgagggcgucgagucccaggacggcgucgaccacuuccgcgccaugaucgucgaguucauggccuccaagaagaugcagcucgaguucccccccucccucaacucccacgaccgccuccgcguccaccagaucgccgaggagcacggccuccgccacgacuccuccggcgagggcaagcgccgcuucaucaccgucuccaagcgcgccccccgcccccgcgccgcccucggcccccccgccggcaccggcggccccgccccccuccagcccgucccccccacccccgcccagaccgagcagcccccccgcgagcagcgcggccccgaccagcccgaccuccgcacccuccaccucgagcgccuccagcgcguccgcuccgcccagggccagcccgccuccaaggagcagcaggccuccggccagcagaagcuccccgagaagaagaagaagaaggccaagggccaccccgccaccgaccuccccaccgaggaggacuucgaggcccucgucuccgccgccgucaaggccgacaacaccugcggcuucgccaagugcaccgccggcgucaccacccucggccaguucugccagcucugcucccgccgcuacugccucucccaccaccuccccgagauccacggcugcggcgagcgcgcccgcgcccacgcccgccagcgcaucucccgcgagggcguccucuacgccggcuccggcaccaagaacggcucccucgaccccgccaagcgcgcccagcuccagcgccgccucgacaagaagcucuccgagcucuccaaccagcgcaccucccgccgcaaggagcgcggcaccuga

SEQ ID NO: 44547 - RNA, 480 nt, Artificial Sequence
  derived and/or modified sequence opt2 from IGJ__Homo_sapiens__NP_653247
augaagaaccaccuccucuucuggggcguccucgccgucuucaucaaggccguccacgucaaggcccaggaggacgagcgcaucguccucgucgacaacaagugcaagugcgcccgcaucaccucccgcaucauccgcuccuccgaggaccccaacgaggacaucgucgagcgcaacauccgcaucaucgucccccucaacaaccgcgagaacaucuccgaccccaccuccccccuccgcacccgcuucgucuaccaccucuccgaccucugcaagaagugcgaccccaccgaggucgagcucgacaaccagaucgucaccgccacccaguccaacaucugcgacgaggacuccgccaccgagaccugcuacaccuacgaccgcaacaagugcuacaccgccgucgucccccucgucuacggcggcgagaccaagauggucgagaccgcccucacccccgacgccugcuaccccgacuga

SEQ ID NO: 44548 - RNA, 642 nt, Artificial Sequence
  derived and/or modified sequence opt2 from IGLL1__Homo_sapiens__NP_064455
augcgccccggcaccggccagggcggccucgaggcccccggcgagcccggccccaaccuccgccagcgcuggccccuccuccuccucggccucgccgucgucacccacggccuccuccgccccaccgccgccucccagucccgcgcccucggccccggcgcccccggcggcuccucccgcuccucccuccgcucccgcuggggccgcuuccuccuccagcgcggcuccuggaccggcccccgcugcuggccccgcggcuuccaguccaagcacaacuccgucacccacgucuucggcuccggcacccagcucaccguccucucccagcccaaggccacccccuccgucacccucuucccccccuccuccgaggagcuccaggccaacaaggccacccucgucugccucaugaacgacuucuaccccggcauccucaccgucaccuggaaggccgacggcacccccaucacccagggcgucgagaugaccacccccuccaagcaguccaacaacaaguacgccgccuccuccuaccucucccucacccccgagcaguggcgcucccgccgcuccuacuccugccaggucaugcacgagggcuccaccgucgagaagaccgucgcccccgccgagugcuccuga

SEQ ID NO: 44549 - RNA, 7872 nt, Artificial Sequence
  derived and/or modified sequence opt2 from IGSF10__Homo_sapiens__NP_849144
augaaggucaagggccgcggcaucaccugccuccucgucuccuucgccgucaucugccucgucgccacccccggcggcaaggccugcccccgccgcugcgccugcuacaugcccaccgagguccacugcaccuuccgcuaccucaccuccauccccgacuccaucccccccaacgucgagcgcaucaaccucggcuacaacucccucguccgccucauggagaccgacuucuccggccucaccaagcucgagcuccucaugcuccacuccaacggcauccacaccauccccgacaagaccuucuccgaccuccaggcccuccagguccucaagauguccuacaacaagguccgcaagcuccagaaggacaccuucuacggccuccgcucccucacccgccuccacauggaccacaacaacaucgaguucaucaaccccgaggucuucuacggccucaacuuccuccgccucguccaccucgagggcaaccagcucaccaagcuccaccccgacaccuucgucucccucuccuaccuccagaucuucaagaucuccuucaucaaguuccucuaccucuccgacaacuuccucaccucccucccccaggagauggucuccuacaugcccgaccucgacucccucuaccuccacggcaaccccuggaccugcgacugccaccucaaguggcucuccgacuggauccaggagaagcccgacgucaucaagugcaagaaggaccgcucccccuccuccgcccagcagugcccccucugcaugaacccccgcaccuccaagggcaagccccucgccauggucuccgccgccgccuuccagugcgccaagcccaccaucgacuccucccucaaguccaagucccucaccauccucgaggacuccuccuccgccuucaucuccccccagggcuucauggcccccuucggcucccucacccucaacaugaccgaccaguccggcaacgaggccaacauggucugcuccauccagaagcccucccgcaccucccccaucgccuucaccgaggagaacgacuacaucguccucaacaccuccuucuccaccuuccucgucugcaacaucgacuacggccacauccagcccgucuggcagauccucgcccucuacuccgacuccccccucauccucgagcgcucccaccuccucuccgagaccccccagcucuacuacaaguacaagcaggucgcccccaagcccgaggacaucuucaccaacaucgaggccgaccuccgcgccgaccccuccuggcucaugcaggaccagaucucccuccagcucaaccgcaccgccaccaccuucuccacccuccagauccaguacuccuccgacgcccagaucacccucccccgcgccgagaugcgccccgucaagcacaaguggaccaugaucucccgcgacaacaacaccaagcucgagcacaccguccucgucggcggcaccgucggccucaacugccccggccagggcgaccccaccccccacgucgacuggcuccucgccgacggcuccaagguccgcgcccccuacgucuccgaggacggccgcauccucaucgacaaguccggcaagcucgagcuccagauggccgacuccuucgacaccggcgucuaccacugcaucuccuccaacuacgacgacgccgacauccucaccuaccgcaucaccgucgucgagccccucgucgaggccuaccaggagaacggcauccaccacaccgucuucaucggcgagacccucgaccuccccugccacuccaccggcauccccgacgccuccaucuccugggucauccccggcaacaacguccucuaccaguccucccgcgacaagaagguccucaacaacggcacccuccgcauccuccaggucacccccaaggaccagggcuacuaccgcugcgucgccgccaaccccuccggcgucgacuuccucaucuuccaggucuccgucaagaugaagggccagcgcccccucgagcacgacggcgagaccgagggcuccggccucgacgaguccaaccccaucgcccaccucaaggagccccccggcgcccagcuccgcaccuccgcccucauggaggccgaggucggcaagcacaccuccuccaccuccaagcgccacaacuaccgcgagcucacccuccagcgccgcggcgacuccacccaccgccgcuuccgcgagaaccgccgccacuucccccccuccgcccgccgcaucgacccccagcacugggccgcccuccucgagaaggccaagaagaacgccaugcccgacaagcgcgagaacaccaccgucucccccccccccgucgucacccagcuccccaacauccccggcgaggaggacgacuccuccggcaugcucgcccuccacgaggaguucaugguccccgccaccaaggcccucaaccuccccgcccgcaccgucaccgccgacucccgcaccaucuccgacucccccaugaccaacaucaacuacggcaccgaguucucccccgucgucaacucccagauccucccccccgaggagcccaccgacuucaagcucuccaccgccaucaagaccaccgccauguccaagaacaucaaccccaccauguccucccagauccagggcaccaccaaccagcacuccuccaccgucuucccccuccuccucggcgccaccgaguuccaggacuccgaccagaugggccgcggccgcgagcacuuccagucccgcccccccaucaccguccgcaccaugaucaaggacgucaacgucaagaugcucuccuccaccaccaacaagcuccuccucgaguccgucaacaccaccaacucccaccagaccuccguccgcgaggucuccgagccccgccacaaccacuucuacucccacaccacccagauccucuccaccuccaccuuccccuccgacccccacaccgccgcccacucccaguuccccaucccccgcaacuccaccgucaacaucccccucuuccgccgcuucggccgccagcgcaagaucggcggccgcggccgcaucaucucccccuaccgcacccccguccuccgccgccaccgcuacuccaucuuccgcuccaccacccgcggcuccuccgagaaguccaccaccgccuucuccgccaccguccucaacgucaccugccucuccugccucccccgcgagcgccucaccaccgccaccgccgcccucuccuuccccuccgccgcccccaucaccuuccccaaggccgacaucgcccgcguccccuccgaggaguccaccacccucguccagaacccccuccuccuccucgagaacaagcccuccgucgagaagaccacccccaccaucaaguacuuccgcaccgagaucucccaggucacccccaccggcgccgucaugaccuacgcccccaccuccauccccauggagaagacccacaaggucaacgccuccuacccccgcgucuccuccaccaacgaggccaagcgcgacuccgucaucaccuccucccucuccggcgccaucaccaagccccccaugaccaucaucgccaucacccgcuucucccgccgcaagauccccuggcagcagaacuucgucaacaaccacaaccccaagggccgccuccgcaaccagcacaaggucucccuccagaaguccaccgccgucaugcuccccaagaccucccccgcccucccccgcgacaaggucucccccuuccacuucaccacccucuccaccuccgucaugcagauccccuccaacacccucaccaccgcccaccacaccaccaccaagacccacaaccccggcucccuccccaccaagaaggagcuccccuuccccccccucaaccccaugcuccccuccaucaucuccaaggacuccuccaccaaguccaucaucuccacccagaccgccauccccgccaccacccccaccuuccccgccuccgucaucaccuacgagacccagaccgagcgcucccgcgcccagaccauccagcgcgagcaggagccccagaagaagaaccgcaccgaccccaacaucucccccgaccaguccuccggcuucaccacccccaccgccaugaccccccccguccucaccaccgccgagaccuccgucaagcccuccgucuccgccuucacccacuccccccccgagaacaccaccggcaucuccuccaccaucuccuuccacucccgcacccucaaccucaccgacgucaucgaggagcucgcccaggccuccacccagacccucaaguccaccaucgccuccgagaccacccucuccuccaagucccaccaguccaccaccacccgcaaggccaucauccgccacuccaccaucccccccuuccucuccuccuccgccacccucaugcccguccccaucuccccccccuucacccagcgcgccgucaccgacaacgucgccacccccaucuccggccucaugaccaacaccgucgucaagcuccacgaguccucccgccacaacgccaagccccagcagcucgucgccgaggucgccaccucccccaagguccaccccaacgccaaguucaccaucggcaccacccacuucaucuacuccaaccuccuccacuccacccccaugcccgcccucaccaccgucaagucccagaacuccaagcucacccccucccccugggccgagaaccaguucuggcacaagcccuacuccgagaucgccgagaagggcaagaagcccgaggucuccaugcucgccaccaccggccucuccgaggccaccacccucgucuccgacugggacggccagaagaacaccaagaaguccgacuucgacaagaagcccguccaggaggccaccaccuccaagcuccuccccuucgacucccucucccgcuacaucuucgagaagccccgcaucgucggcggcaaggccgccuccuucaccauccccgccaacuccgacgccuuccuccccugcgaggccgucggcaacccccuccccaccauccacuggacccgcguccccuccggccucgaccucuccaagcgcaagcagaacucccgcguccagguccuccccaacggcacccucuccauccagcgcgucgagauccaggaccgcggccaguaccucugcuccgccuccaaccucuucggcaccgaccaccuccacgucacccucuccgucgucuccuaccccccccgcauccucgagcgccgcaccaaggagaucaccguccacuccggcuccaccgucgagcucaagugccgcgccgagggccgccccucccccaccgucaccuggauccucgccaaccagaccgucgucuccgaguccucccagggcucccgccaggccgucgucaccgucgacggcacccucguccuccacaaccucuccaucuacgaccgcggcuucuacaagugcgucgccuccaaccccggcggccaggacucccuccucgucaagauccaggucaucgccgccccccccgucauccucgagcagcgccgccaggucaucgucggcaccuggggcgagucccucaagcuccccugcaccgccaagggcaccccccagcccuccgucuacuggguccucuccgacggcaccgaggucaagccccuccaguucaccaacuccaagcucuuccucuucuccaacggcacccucuacauccgcaaccucgccuccuccgaccgcggcaccuacgagugcaucgccaccuccuccaccggcuccgagcgccgcgucgucaugcucaccauggaggagcgcgucaccuccccccgcaucgaggccgccucccagaagcgcaccgaggucaacuucggcgacaagcuccuccucaacugcuccgccaccggcgagcccaagccccagaucauguggcgccuccccuccaaggccgucgucgaccagcagcaccgcgucggcuccuggauccacgucuaccccaacggcucccucuucaucggcuccgucaccgagaaggacuccggcgucuaccucugcgucgcccgcaacaagaugggcgacgaccucauccucaugcacgucucccuccgccucaagcccgccaagaucgaccacaagcaguacuuccgcaagcagguccuccacggcaaggacuuccaggucgacugcaaggccuccggcucccccguccccgagaucuccuggucccuccccgacggcaccaugaucaacaacgccaugcaggccgacgacuccggccaccgcacccgccgcuacacccucuucaacaacggcacccucuacuucaacaaggucggcgucgccgaggagggcgacuacaccugcuacgcccagaacacccucggcaaggacgagaugaagguccaccucaccgucaucaccgccgccccccgcauccgccaguccaacaagaccaacaagcgcaucaaggccggcgacaccgccguccucgacugcgaggucaccggcgaccccaagcccaagaucuucuggcuccuccccuccaacgacaugaucuccuucuccaucgaccgcuacaccuuccacgccaacggcucccucaccaucaacaaggucaagcuccucgacuccggcgaguacgucugcgucgcccgcaaccccuccggcgacgacaccaagauguacaagcucgacgucgucuccaagcccccccucaucaacggccucuacaccaaccgcaccgucaucaaggccaccgccguccgccacuccaagaagcacuucgacugccgcgccgagggcacccccucccccgaggucauguggaucaugcccgacaacaucuuccucaccgcccccuacuacggcucccgcaucaccguccacaagaacggcacccucgagauccgcaacguccgccucuccgacuccgccgacuucaucugcgucgcccgcaacgagggcggcgaguccguccucgucguccagcucgagguccucgagaugcuccgccgccccaccuuccgcaaccccuucaacgagaagaucgucgcccagcucggcaaguccaccgcccucaacugcuccgucgacggcaaccccccccccgagaucaucuggauccuccccaacggcacccgcuucuccaacggcccccaguccuaccaguaccucaucgccuccaacggcuccuucaucaucuccaagaccacccgcgaggacgccggcaaguaccgcugcgccgcccgcaacaaggucggcuacaucgagaagcucgucauccucgagaucggccagaagcccgucauccucaccuacgcccccggcaccgucaagggcaucuccggcgagucccucucccuccacugcgucuccgacggcauccccaagcccaacaucaaguggaccaugcccuccggcuacgucgucgaccgcccccagaucaacggcaaguacauccuccacgacaacggcacccucgucaucaaggaggccaccgccuacgaccgcggcaacuacaucugcaaggcccagaacuccgucggccacacccucaucaccguccccgucaugaucgucgccuaccccccccgcaucaccaaccgccccccccgcuccaucgucacccgcaccggcgccgccuuccagcuccacugcgucgcccucggcguccccaagcccgagaucaccugggagaugcccgaccacucccuccucuccaccgccuccaaggagcgcacccacggcuccgagcagcuccaccuccagggcacccucgucauccagaacccccagaccuccgacuccggcaucuacaagugcaccgccaagaacccccucggcuccgacuacgccgccaccuacauccaggucaucuga

SEQ ID NO: 44550 - RNA, 1296 nt, Artificial Sequence
  derived and/or modified sequence opt2 from IGSF11__Homo_sapiens__NP_001015887
augaccucccagcgcuccccccucgccccccuccuccuccucucccuccacggcgucgccgccucccucgaggucuccgagucccccggcuccauccaggucgcccgcggccagcccgccguccuccccugcaccuucaccaccuccgccgcccucaucaaccucaacgucaucuggauggucaccccccucuccaacgccaaccagcccgagcaggucauccucuaccagggcggccagauguucgacggcgccccccgcuuccacggccgcgucggcuucaccggcaccaugcccgccaccaacgucuccaucuucaucaacaacacccagcucuccgacaccggcaccuaccagugccucgucaacaaccuccccgacaucggcggccgcaacaucggcgucaccggccucaccguccucgucccccccuccgccccccacugccagauccagggcucccaggacaucggcuccgacgucauccuccucugcuccuccgaggagggcaucccccgccccaccuaccucugggagaagcucgacaacacccucaagcucccccccaccgccacccaggaccagguccagggcaccgucaccauccgcaacaucuccgcccucuccuccggccucuaccagugcgucgccuccaacgccaucggcaccuccaccugccuccucgaccuccaggucaucuccccccagccccgcaacaucggccucaucgccggcgccaucggcaccggcgccgucaucaucaucuucugcaucgcccucauccucggcgccuucuucuacuggcgcuccaagaacaaggaggaggaggaggaggagauccccaacgagauccgcgaggacgaccucccccccaagugcuccuccgccaaggccuuccacaccgagaucuccuccuccgacaacaacacccucaccuccuccaacgccuacaacucccgcuacugguccaacaaccccaagguccaccgcaacaccgaguccgucucccacuucuccgaccucggccaguccuucuccuuccacuccggcaacgccaacauccccuccaucuacgccaacggcacccaccucguccccggccagcacaagacccucgucgucaccgccaaccgcggcuccuccccccaggucaugucccgcuccaacggcuccgucucccgcaagccccgccccccccacacccacuccuacaccaucucccacgccacccucgagcgcaucggcgccguccccgucaugguccccgcccagucccgcgccggcucccucgucuga

SEQ ID NO: 44551 - RNA, 4026 nt, Artificial Sequence
  derived and/or modified sequence opt2 from IGSF1__Homo_sapiens__NP_001164432
augacccucgaccgccccggcgagggcgccaccaugcucaagaccuucaccguccuccucuucugcauccgcaugucccucggcaugaccuccaucgucauggacccccagcccgagcucuggaucgaguccaacuacccccaggcccccugggagaacaucacccucuggugccgcucccccucccgcaucuccuccaaguuccuccuccucaaggacaagacccagaugaccuggauccgccccucccacaagaccuuccaggucuccuuccucaucggcgcccucaccgaguccaacgccggccucuaccgcugcugcuacuggaaggagaccggcugguccaagcccuccaagguccucgagcucgaggcccccggccagcuccccaagcccaucuucuggauccaggccgagacccccgcccuccccggcugcaacgucaacauccucugccacggcuggcuccaggaccucgucuucaugcucuucaaggagggcuacgccgagcccgucgacuaccagguccccaccggcaccauggccaucuucuccaucgacaaccucacccccgaggacgagggcgucuacaucugccgcacccacauccagaugcuccccacccucugguccgagcccuccaacccccucaagcucgucgucgccggccucuaccccaagcccacccucaccgcccaccccggccccaucauggcccccggcgagucccucaaccuccgcugccagggccccaucuacggcaugaccuucgcccucaugcgcgucgaggaccucgagaaguccuucuaccacaagaagaccaucaagaacgaggccaacuucuucuuccagucccucaagauccaggacaccggccacuaccucugcuucuacuacgacgccuccuaccgcggcucccuccucuccgacguccucaagaucugggucaccgacaccuuccccaagaccuggcuccucgcccgccccuccgccgucguccagaugggccagaacgucucccuccgcugccgcggccccgucgacggcgucggccucgcccucuacaagaagggcgaggacaagccccuccaguuccucgacgccaccuccaucgacgacaacaccuccuucuuccucaacaacgucaccuacuccgacaccggcaucuacuccugccacuaccuccucaccuggaagaccuccauccgcaugcccucccacaacaccgucgagcucauggucgucgacaagccccccaagcccucccucuccgccuggcccuccaccgucuucaagcucggcaaggccaucacccuccagugccgcgucucccaccccguccucgaguucucccucgagugggaggagcgcgagaccuuccagaaguucuccgucaacggcgacuucaucaucuccaacgucgacggcaagggcaccggcaccuacuccugcuccuaccgcgucgagacccaccccaacaucuggucccaccgcuccgagccccucaagcucaugggccccgccggcuaccucaccuggaacuacguccucaacgaggccauccgccucucccucaucaugcagcucgucgcccuccuccucgucguccucuggauccgcuggaagugccgccgccuccgcauccgcgaggccuggcuccucggcaccgcccagggcgucaccaugcucuucaucgucaccgcccuccucugcugcgccaucuccuucgccggccucugcaacggcguccucaucgaggagaccgagaucgucaugcccacccccaagcccgagcucugggccgagaccaacuucccccucgcccccuggaagaaccucacccucuggugccgcucccccuccggcuccaccaaggaguucguccuccucaaggacggcaccggcuggaucgccacccgccccgccuccgagcagguccgcgccgccuucccccucggcgcccucacccagucccacaccggcuccuaccacugccacuccugggaggagauggccgucuccgagcccuccgaggcccucgagcucgucggcaccgacauccuccccaagcccgucaucuccgccucccccaccauccgcggccaggagcuccagcuccgcugcaagggcuggcucgccggcaugggcuucgcccucuacaaggagggcgagcaggagcccguccagcagcucggcgccgucggccgcgaggccuucuucaccauccagcgcauggaggacaaggacgagggcaacuacuccugccgcacccacaccgagaagcgccccuucaagugguccgagcccuccgagccccucgagcucgucaucaaggagauguaccccaagcccuucuucaagaccugggccucccccgucgucacccccggcgcccgcgucaccuucaacugcuccaccccccaccagcacauguccuucauccucuacaaggacggcuccgagaucgccuccuccgaccgcuccugggccucccccggcgccuccgccgcccacuuccucaucaucuccgucggcaucggcgacggcggcaacuacuccugccgcuacuacgacuucuccaucugguccgagcccuccgaccccgucgagcucgucgucaccgaguucuaccccaagcccacccuccucgcccagcccggccccgucgucuuccccggcaaguccgucauccuccgcugccagggcaccuuccagggcaugcgcuucgcccuccuccaggagggcgcccacgucccccuccaguuccgcuccgucuccggcaacuccgccgacuuccuccuccacaccgucggcgccgaggacuccggcaacuacuccugcaucuacuacgagaccaccauguccaaccgcggcuccuaccucuccaugccccucaugaucugggucaccgacaccuuccccaagcccuggcucuucgccgagcccuccuccgucguccccaugggccagaacgucacccucuggugccgcggccccguccacggcgucggcuacauccuccacaaggagggcgaggccaccuccaugcagcucuggggcuccaccuccaacgacggcgccuuccccaucaccaacaucuccggcaccuccaugggccgcuacuccugcugcuaccaccccgacuggaccuccuccaucaagauccagcccuccaacacccucgagcuccucgucaccggccuccuccccaagcccucccuccucgcccagcccggccccauggucgcccccggcgagaacaugacccuccagugccagggcgagcuccccgacuccaccuucguccuccucaaggagggcgcccaggagccccucgagcagcagcgccccuccggcuaccgcgccgacuucuggaugcccgccguccgcggcgaggacuccggcaucuacuccugcgucuacuaccucgacuccacccccuucgccgccuccaaccacuccgacucccucgagaucugggucaccgacaagccccccaagcccucccucuccgccuggcccuccaccauguucaagcucggcaaggacaucacccuccagugccgcggcccccuccccggcgucgaguucguccucgagcacgacggcgaggaggccccccagcaguucuccgaggacggcgacuucgucaucaacaacgucgagggcaagggcaucggcaacuacuccugcuccuaccgccuccaggccuaccccgacaucugguccgagcccuccgacccccucgagcucgucggcgccgccggccccgucgcccaggagugcaccgucggcaacaucguccgcuccucccucaucgucgucgucgucgucgcccucggcgucguccucgccaucgaguggaagaaguggccccgccuccgcacccgcggcuccgagaccgacggccgcgaccagaccaucgcccucgaggagugcaaccaggagggcgagcccggcacccccgccaacucccccuccuccaccucccagcgcaucuccgucgagcuccccguccccaucuga

SEQ ID NO: 44552 - RNA, 1224 nt, Artificial Sequence
  derived and/or modified sequence opt2 from IGSF5__Homo_sapiens__NP_001073913
augggccagaaggagcgcuccaccgccgacacccuccccgaccucgaggaguggaaguccgccgccggccuccgcugguggcagaccgccgucgucgacggcuccggcuccggcaacgaggucaucgagggcccccagaacgcccgcguccucaagggcucccaggcccgcuucaacugcaccgucucccagggcuggaagcucaucaugugggcccucuccgacauggucguccucuccguccgccccauggagcccaucaucaccaacgaccgcuucaccucccagcgcuacgaccagggcggcaacuucaccuccgagaugaucauccacaacgucgagcccuccgacuccggcaacauccgcugcucccuccagaacucccgccuccacggcuccgccuaccucaccguccaggucaugggcgagcucuucauccccuccgucaaccucgucgucgccgagaacgagcccugcgaggucaccugccuccccucccacuggacccgccuccccgacaucuccugggagcucggccuccucgucucccacuccuccuacuacuucguccccgagcccuccgaccuccaguccgccgucuccauccucgcccucaccccccaguccaacggcacccucaccugcgucgccaccuggaagucccucaaggcccgcaaguccgccaccgucaaccucaccgucauccgcugcccccaggacaccggcggcggcaucaacauccccggcguccucuccucccuccccucccucggcuucucccuccccaccuggggcaaggucggccucggccucgccggcaccaugcuccucacccccaccugcacccucaccauccgcugcugcugcugccgccgccgcugcugcggcugcaacugcugcugccgcugcugcuucugcugccgccgcaagcgcggcuuccgcauccaguuccagaagaaguccgagaaggagaagaccaacaaggagaccgagaccgaguccggcaacgagaacuccggcuacaacuccgacgagcagaagaccaccgacaccgccucccucccccccaaguccugcgaguccuccgaccccgagcagcgcaacuccuccugcggccccccccaccagcgcgccgaccagcgccccccccgccccgccucccacccccaggccuccuucaaccucgccucccccgagaaggucuccaacaccaccgucgucuga

SEQ ID NO: 44553 - RNA, 726 nt, Artificial Sequence
  derived and/or modified sequence opt2 from IGSF6__Homo_sapiens__NP_005840
augggcaccgccucccgcuccaacaucgcccgccaccuccagaccaaccucauccucuucugcgucggcgccgucggcgccugcacccucuccgucacccagcccugguaccucgaggucgacuacacccacgaggccgucaccaucaagugcaccuucuccgccaccggcugccccuccgagcagcccaccugccucugguuccgcuacggcgcccaccagcccgagaaccucugccucgacggcugcaaguccgaggccgacaaguucaccguccgcgaggcccucaaggagaaccaggucucccucaccgucaaccgcgucaccuccaacgacuccgccaucuacaucugcggcaucgccuuccccuccguccccgaggcccgcgccaagcagaccggcggcggcaccacccucgucguccgcgagaucaagcuccucuccaaggagcuccgcuccuuccucaccgcccucgucucccuccucuccgucuacgucaccggcgucugcgucgccuucauccuccucuccaaguccaaguccaacccccuccgcaacaaggagaucaaggaggacucccagaagaagaaguccgcccgccgcaucuuccaggagaucgcccaggagcucuaccacaagcgccacgucgagaccaaccagcaguccgagaaggacaacaacaccuacgagaaccgccgcguccucuccaacuacgagcgccccuga

SEQ ID NO: 44554 - RNA, 1842 nt, Artificial Sequence
  derived and/or modified sequence opt2 from IGSF8__Homo_sapiens__NP_001193594
augggcgcccuccgccccacccuccucccccccucccucccccuccuccuccuccucaugcucggcaugggcugcugggcccgcgagguccucguccccgagggcccccucuaccgcgucgccggcaccgccgucuccaucuccugcaacgucaccggcuacgagggccccgcccagcagaacuucgagugguuccucuaccgccccgaggcccccgacaccgcccucggcaucgucuccaccaaggacacccaguucuccuacgccgucuucaagucccgcgucgucgccggcgagguccagguccagcgccuccagggcgacgccgucguccucaagaucgcccgccuccaggcccaggacgccggcaucuacgagugccacacccccuccaccgacacccgcuaccucggcuccuacuccggcaaggucgagcuccgcguccuccccgacguccuccaggucuccgccgccccccccggcccccgcggccgccaggcccccaccucccccccccgcaugaccguccacgagggccaggagcucgcccucggcugccucgcccgcaccuccacccagaagcacacccaccucgccgucuccuucggccgcuccguccccgaggcccccgucggccgcuccacccuccaggaggucgucggcauccgcuccgaccucgccgucgaggccggcgcccccuacgccgagcgccucgccgccggcgagcuccgccucggcaaggagggcaccgaccgcuaccgcauggucgucggcggcgcccaggccggcgacgccggcaccuaccacugcaccgccgccgaguggauccaggaccccgacggcuccugggcccagaucgccgagaagcgcgccguccucgcccacgucgacguccagacccucuccucccagcucgccgucaccgucggccccggcgagcgccgcaucggccccggcgagccccucgagcuccucugcaacgucuccggcgcccucccccccgccggccgccacgccgccuacuccgucggcugggagauggcccccgccggcgcccccggccccggccgccucgucgcccagcucgacaccgagggcgucggcucccucggccccggcuacgagggccgccacaucgccauggagaaggucgccucccgcaccuaccgccuccgccucgaggccgcccgccccggcgacgccggcaccuaccgcugccucgccaaggccuacguccgcggcuccggcacccgccuccgcgaggccgccuccgcccgcucccgcccccuccccguccacguccgcgaggagggcgucguccucgaggccgucgccuggcucgccggcggcaccgucuaccgcggcgagaccgccucccuccucugcaacaucuccguccgcggcggcccccccggccuccgccucgccgccuccuggugggucgagcgccccgaggacggcgagcucuccuccguccccgcccagcucgucggcggcgucggccaggacggcgucgccgagcucggcguccgccccggcggcggccccgucuccgucgagcucgucggcccccgcucccaccgccuccgccuccacucccucggccccgaggacgagggcgucuaccacugcgcccccuccgccuggguccagcacgccgacuacuccugguaccaggccggcuccgcccgcuccggccccgucaccgucuaccccuacaugcacgcccucgacacccucuucgucccccuccucgucggcaccggcgucgcccucgucaccggcgccaccguccucggcaccaucaccugcugcuucaugaagcgccuccgcaagcgcuga

SEQ ID NO: 44555 - RNA, 1236 nt, Artificial Sequence
  derived and/or modified sequence opt2 from IHH__Homo_sapiens__NP_002172
augucccccgcccgccuccgcccccgccuccacuucugccucguccuccuccuccuccucgucguccccgccgccuggggcugcggccccggccgcgucgucggcucccgccgccgccccccccgcaagcucgucccccucgccuacaagcaguucucccccaacguccccgagaagacccucggcgccuccggccgcuacgagggcaagaucgcccgcuccuccgagcgcuucaaggagcucacccccaacuacaaccccgacaucaucuucaaggacgaggagaacaccggcgccgaccgccucaugacccagcgcugcaaggaccgccucaacucccucgccaucuccgucaugaaccaguggcccggcgucaagcuccgcgucaccgagggcugggacgaggacggccaccacuccgaggagucccuccacuacgagggccgcgccgucgacaucaccaccuccgaccgcgaccgcaacaaguacggccuccucgcccgccucgccgucgaggccggcuucgacugggucuacuacgaguccaaggcccacguccacugcuccgucaaguccgagcacuccgccgccgccaagaccggcggcugcuuccccgccggcgcccagguccgccucgaguccggcgcccgcgucgcccucuccgccguccgccccggcgaccgcguccucgccaugggcgaggacggcucccccaccuucuccgacguccucaucuuccucgaccgcgagccccaccgccuccgcgccuuccaggucaucgagacccaggaccccccccgccgccucgcccucacccccgcccaccuccucuucaccgccgacaaccacaccgagcccgccgcccgcuuccgcgccaccuucgccucccacguccagcccggccaguacguccucgucgccggcguccccggccuccagcccgcccgcgucgccgccgucuccacccacgucgcccucggcgccuacgccccccucaccaagcacggcacccucgucgucgaggacgucgucgccuccugcuucgccgccgucgccgaccaccaccucgcccagcucgccuucuggccccuccgccucuuccacucccucgccuggggcuccuggacccccggcgagggcguccacugguacccccagcuccucuaccgccucggccgccuccuccucgaggagggcuccuuccacccccucggcauguccggcgccggcuccuga

SEQ ID NO: 44556 - RNA, 3999 nt, Artificial Sequence
  derived and/or modified sequence opt2 from IKBKAP__Homo_sapiens__NP_003631
augcgcaaccucaagcucuuccgcacccucgaguuccgcgacauccagggccccggcaacccccagugcuucucccuccgcaccgagcagggcaccguccucaucggcuccgagcacggccucaucgaggucgaccccgucucccgcgaggucaagaacgaggucucccucgucgccgagggcuuccuccccgaggacggcuccggccgcaucgucggcguccaggaccuccucgaccaggaguccgucugcgucgccaccgccuccggcgacgucauccucugcucccucuccacccagcagcucgagugcgucggcuccgucgccuccggcaucuccgucauguccuggucccccgaccaggagcucguccuccucgccaccggccagcagacccucaucaugaugaccaaggacuucgagcccauccucgagcagcagauccaccaggacgacuucggcgaguccaaguucaucaccgucggcuggggccgcaaggagacccaguuccacggcuccgagggccgccaggccgccuuccagaugcagaugcacgaguccgcccuccccugggacgaccaccgcccccaggucaccuggcgcggcgacggccaguucuucgccgucuccgucgucugccccgagaccggcgcccgcaagguccgcgucuggaaccgcgaguucgcccuccaguccaccuccgagcccgucgccggccucggccccgcccucgccuggaagcccuccggcucccucaucgccuccacccaggacaagcccaaccagcaggacaucgucuucuucgagaagaacggccuccuccacggccacuucacccuccccuuccucaaggacgaggucaaggucaacgaccuccucuggaacgccgacuccuccguccucgccgucuggcucgaggaccuccagcgcgaggaguccuccauccccaagaccugcguccagcucuggaccgucggcaacuaccacugguaccucaagcagucccucuccuucuccaccugcggcaaguccaagaucgucucccucaugugggaccccgucacccccuaccgccuccacguccucugccagggcuggcacuaccucgccuacgacuggcacuggaccaccgaccgcuccgucggcgacaacuccuccgaccucuccaacgucgccgucaucgacggcaaccgcguccucgucaccgucuuccgccagaccgucguccccccccccaugugcaccuaccagcuccucuucccccaccccgucaaccaggucaccuuccucgcccacccccagaaguccaacgaccucgccguccucgacgccuccaaccagaucuccgucuacaagugcggcgacugccccuccgccgaccccaccgucaagcucggcgccgucggcggcuccggcuucaaggucugccuccgcaccccccaccucgagaagcgcuacaagauccaguucgagaacaacgaggaccaggacgucaacccccucaagcucggccuccucaccuggaucgaggaggacgucuuccucgccgucucccacuccgaguucuccccccgcuccgucauccaccaccucaccgccgccuccuccgagauggacgaggagcacggccagcucaacgucuccuccuccgccgccgucgacggcgucaucaucucccucugcugcaacuccaagaccaaguccgucguccuccagcucgccgacggccagaucuucaaguaccucugggagucccccucccucgccaucaagcccuggaagaacuccggcggcuuccccguccgcuuccccuaccccugcacccagaccgagcucgccaugaucggcgaggaggagugcguccucggccucaccgaccgcugccgcuucuucaucaacgacaucgaggucgccuccaacaucaccuccuucgccgucuacgacgaguuccuccuccucaccacccacucccacaccugccagugcuucugccuccgcgacgccuccuucaagacccuccaggccggccucuccuccaaccacgucucccacggcgagguccuccgcaaggucgagcgcggcucccgcaucgucaccgucgucccccaggacaccaagcucguccuccagaugccccgcggcaaccucgaggucguccaccaccgcgcccucguccucgcccagauccgcaaguggcucgacaagcucauguucaaggaggccuucgagugcaugcgcaagcuccgcaucaaccucaaccucaucuacgaccacaaccccaaggucuuccucggcaacgucgagaccuucaucaagcagaucgacuccgucaaccacaucaaccucuucuucaccgagcucaaggaggaggacgucaccaagaccauguaccccgcccccgucaccuccuccgucuaccucucccgcgaccccgacggcaacaagaucgaccucgucugcgacgccaugcgcgccgucauggaguccaucaacccccacaaguacugccucuccauccucaccucccacgucaagaagaccacccccgagcucgagaucguccuccagaagguccacgagcuccagggcaacgcccccuccgaccccgacgccgucuccgccgaggaggcccucaaguaccuccuccaccucgucgacgucaacgagcucuacgaccacucccucggcaccuacgacuucgaccucguccucauggucgccgagaagucccagaaggaccccaaggaguaccuccccuuccucaacacccucaagaagauggagaccaacuaccagcgcuucaccaucgacaaguaccucaagcgcuacgagaaggccaucggccaccucuccaagugcggccccgaguacuuccccgagugccucaaccucaucaaggacaagaaccucuacaacgaggcccucaagcucuacucccccuccucccagcaguaccaggacaucuccaucgccuacggcgagcaccucaugcaggagcacauguacgagcccgccggccucauguucgcccgcugcggcgcccacgagaaggcccucuccgccuuccucaccugcggcaacuggaagcaggcccucugcgucgccgcccagcucaacuucaccaaggaccagcucgucggccucggccgcacccucgccggcaagcucgucgagcagcgcaagcacaucgacgccgccaugguccucgaggagugcgcccaggacuacgaggaggccguccuccuccuccucgagggcgccgccugggaggaggcccuccgccucgucuacaaguacaaccgccucgacaucaucgagaccaacgucaagcccuccauccucgaggcccagaagaacuacauggccuuccucgacucccagaccgccaccuucucccgccacaagaagcgccuccucgucguccgcgagcucaaggagcaggcccagcaggccggccucgacgacgaggucccccacggccaggaguccgaccucuucuccgagaccuccuccgucgucuccggcuccgagauguccggcaaguacucccacuccaacucccgcaucuccgcccgcuccuccaagaaccgccgcaaggccgagcgcaagaagcacucccucaaggagggcuccccccucgaggaccucgcccuccucgaggcccucuccgaggucguccagaacaccgagaaccucaaggacgaggucuaccacauccucaagguccucuuccucuucgaguucgacgagcagggccgcgagcuccagaaggccuucgaggacacccuccagcucauggagcgcucccuccccgagaucuggacccucaccuaccagcagaacuccgccacccccguccucggccccaacuccaccgccaacuccaucauggccuccuaccagcagcagaagaccuccguccccguccucgacgccgagcucuucaucccccccaagaucaaccgccgcacccaguggaagcucucccuccucgacuga

SEQ ID NO: 44557 - RNA, 2265 nt, Artificial Sequence
  derived and/or modified sequence opt2 from IKBKB__Homo_sapiens__NP_001177649
auguucuccggcggcugccacucccccggcuucggccgccccucccccgccuuccccgcccccggcucccccccccccgccccccgccccugccgccaggagaccggcgagcagaucgccaucaagcagugccgccaggagcucuccccccgcaaccgcgagcgcuggugccucgagauccagaucaugcgccgccucacccaccccaacgucgucgccgcccgcgacguccccgagggcaugcagaaccucgcccccaacgaccucccccuccucgccauggaguacugccagggcggcgaccuccgcaaguaccucaaccaguucgagaacugcugcggccuccgcgagggcgccauccucacccuccucuccgacaucgccuccgcccuccgcuaccuccacgagaaccgcaucauccaccgcgaccucaagcccgagaacaucguccuccagcagggcgagcagcgccucauccacaagaucaucgaccucggcuacgccaaggagcucgaccagggcucccucugcaccuccuucgucggcacccuccaguaccucgcccccgagcuccucgagcagcagaaguacaccgucaccgucgacuacugguccuucggcacccucgccuucgagugcaucaccggcuuccgccccuuccuccccaacuggcagcccguccaguggcacuccaagguccgccagaaguccgaggucgacaucgucgucuccgaggaccucaacggcaccgucaaguucuccuccucccuccccuaccccaacaaccucaacuccguccucgccgagcgccucgagaaguggcuccagcucaugcucauguggcacccccgccagcgcggcaccgaccccaccuacggccccaacggcugcuucaaggcccucgacgacauccucaaccucaagcucguccacauccucaacauggucaccggcaccauccacaccuaccccgucaccgaggacgagucccuccagucccucaaggcccgcauccagcaggacaccggcauccccgaggaggaccaggagcuccuccaggaggccggccucgcccucauccccgacaagcccgccacccagugcaucuccgacggcaagcucaacgagggccacacccucgacauggaccucgucuuccucuucgacaacuccaagaucaccuacgagacccagaucuccccccgcccccagcccgaguccgucuccugcauccuccaggagcccaagcgcaaccucgccuucuuccagcuccgcaaggucuggggccaggucuggcacuccauccagacccucaaggaggacugcaaccgccuccagcagggccagcgcgccgccaugaugaaccuccuccgcaacaacuccugccucuccaagaugaagaacuccauggccuccaugucccagcagcucaaggccaagcucgacuucuucaagaccuccauccagaucgaccucgagaaguacuccgagcagaccgaguucggcaucaccuccgacaagcuccuccucgccuggcgcgagauggagcaggccgucgagcucugcggccgcgagaacgaggucaagcuccucgucgagcgcaugauggcccuccagaccgacaucgucgaccuccagcgcucccccaugggccgcaagcagggcggcacccucgacgaccucgaggagcaggcccgcgagcucuaccgccgccuccgcgagaagccccgcgaccagcgcaccgagggcgacucccaggagaugguccgccuccuccuccaggccauccaguccuucgagaagaagguccgcgucaucuacacccagcucuccaagaccgucgucugcaagcagaaggcccucgagcuccuccccaaggucgaggaggucgucucccucaugaacgaggacgagaagaccgucguccgccuccaggagaagcgccagaaggagcucuggaaccuccucaagaucgccugcuccaagguccgcggccccgucuccggcucccccgacuccaugaacgccucccgccucucccagcccggccagcucaugucccagcccuccaccgccuccaacucccuccccgagcccgccaagaaguccgaggagcucgucgccgaggcccacaaccucugcacccuccucgagaacgccauccaggacaccguccgcgagcaggaccaguccuucaccgcccucgacugguccuggcuccagaccgaggaggaggagcacuccugccucgagcaggccuccuga

SEQ ID NO: 44558 - RNA, 1896 nt, Artificial Sequence
  derived and/or modified sequence opt2 from IKBKE__Homo_sapiens__NP_001180250
auggaguacugcuccuccggcucccuccucuccguccucgagucccccgagaacgccuucggccuccccgaggacgaguuccucgucguccuccgcugcgucgucgccggcaugaaccaccuccgcgagaacggcaucguccaccgcgacaucaagcccggcaacaucaugcgccucgucggcgaggagggccaguccaucuacaagcucaccgacuucggcgccgcccgcgagcucgacgacgacgagaaguucgucuccgucuacggcaccgaggaguaccuccaccccgacauguacgagcgcgccguccuccgcaagccccagcagaaggccuucggcgucaccgucgaccucugguccaucggcgucacccucuaccacgccgccaccggcucccuccccuucauccccuucggcggcccccgccgcaacaaggagaucauguaccgcaucaccaccgagaagcccgccggcgccaucgccggcgcccagcgccgcgagaacggcccccucgagugguccuacacccuccccaucaccugccagcucucccucggccuccagucccagcucguccccauccucgccaacauccucgaggucgagcaggccaagugcuggggcuucgaccaguucuucgccgagaccuccgacauccuccagcgcgucgucguccacgucuucucccucucccaggccguccuccaccacaucuacauccacgcccacaacaccaucgccaucuuccaggaggccguccacaagcagaccuccgucgccccccgccaccaggaguaccucuucgagggccaccucugcguccucgagcccuccgucuccgcccagcacaucgcccacaccaccgccuccuccccccucacccucuucuccaccgccauccccaagggccucgccuuccgcgaccccgcccucgacguccccaaguucguccccaaggucgaccuccaggccgacuacaacaccgccaagggcguccucggcgccggcuaccaggcccuccgccucgcccgcgcccuccucgacggccaggagcucauguuccgcggccuccacugggucauggagguccuccaggccaccugccgccgcacccucgaggucgcccgcaccucccuccucuaccucuccuccucccucggcaccgagcgcuucuccuccgucgccggcacccccgagauccaggagcucaaggccgccgccgagcuccgcucccgccuccgcacccucgccgagguccucucccgcugcucccagaacaucaccgagacccaggagucccucuccucccucaaccgcgagcucgucaagucccgcgaccagguccacgaggaccgcuccauccagcagauccagugcugccucgacaagaugaacuucaucuacaagcaguucaagaagucccgcaugcgccccggccucggcuacaacgaggagcagauccacaagcucgacaaggucaacuucucccaccucgccaagcgccuccuccaggucuuccaggaggagugcguccagaaguaccaggccucccucgucacccacggcaagcgcaugcgcgucguccacgagacccgcaaccaccuccgccucgucggcugcuccgucgccgccugcaacaccgaggcccagggcguccaggagucccucuccaagcuccucgaggagcucucccaccagcuccuccaggaccgcgccaagggcgcccaggccucccccccccccaucgcccccuaccccucccccacccgcaaggaccuccuccuccacaugcaggagcucugcgagggcaugaagcuccucgccuccgaccuccucgacaacaaccgcaucaucgagcgccucaaccgcguccccgccccccccgacgucuga

SEQ ID NO: 44559 - RNA, 1464 nt, Artificial Sequence
  derived and/or modified sequence opt2 from IKBKG__Homo_sapiens__NP_001093326
auggcccucgucauccaggucggcaagcuccgcccccgcgagguccgcaccccccagaccaucaaccccucccucuuccccucccuccccgucaagcucuccuccaucaucgagguccccuccggcggcgagcgcugcugcucccgccgcacccucgucuacaaggcccgcgccuucuggaagggcgccccccuccccugcuggaugaaccgccaccucuggaagucccagcucugcgagaugguccagcccuccggcggccccgccgccgaccaggacguccucggcgaggaguccccccucggcaagcccgccaugcuccaccuccccuccgagcagggcgcccccgagacccuccagcgcugccucgaggagaaccaggagcuccgcgacgccauccgccaguccaaccagauccuccgcgagcgcugcgaggagcuccuccacuuccaggccucccagcgcgaggagaaggaguuccucaugugcaaguuccaggaggcccgcaagcucgucgagcgccucggccucgagaagcucgaccucaagcgccagaaggagcaggcccuccgcgaggucgagcaccucaagcgcugccagcagcagauggccgaggacaaggccuccgucaaggcccaggucaccucccuccucggcgagcuccaggagucccagucccgccucgaggccgccaccaaggagugccaggcccucgagggccgcgcccgcgccgccuccgagcaggcccgccagcucgaguccgagcgcgaggcccuccagcagcagcacuccguccaggucgaccagcuccgcaugcagggccaguccgucgaggccgcccuccgcauggagcgccaggccgccuccgaggagaagcgcaagcucgcccagcuccaggucgccuaccaccagcucuuccaggaguacgacaaccacaucaaguccuccgucgucggcuccgagcgcaagcgcggcaugcagcucgaggaccucaagcagcagcuccagcaggccgaggaggcccucgucgccaagcaggaggucaucgacaagcucaaggaggaggccgagcagcacaagaucgucauggagaccguccccguccucaaggcccaggccgacaucuacaaggccgacuuccaggccgagcgccaggcccgcgagaagcucgccgagaagaaggagcuccuccaggagcagcucgagcagcuccagcgcgaguacuccaagcucaaggccuccugccaggaguccgcccgcaucgaggacaugcgcaagcgccacgucgaggucucccaggccccccucccccccgcccccgccuaccucuccuccccccucgcccuccccucccagcgccgcuccccccccgaggagccccccgacuucugcugccccaagugccaguaccaggcccccgacauggacacccuccagauccacgucauggagugcaucgaguga

SEQ ID NO: 44560 - RNA, 1674 nt, Artificial Sequence
  derived and/or modified sequence opt2 from IK__Homo_sapiens__NP_006074
augcccgagcgcgacuccgagcccuucuccaacccccucgcccccgacggccacgacgucgacgacccccacuccuuccaccaguccaagcucaccaacgaggacuuccgcaagcuccucaugaccccccgcgccgcccccaccuccgccccccccuccaagucccgccaccacgagaugccccgcgaguacaacgaggacgaggaccccgccgcccgccgccgcaagaagaaguccuacuacgccaagcuccgccagcaggagaucgagcgcgagcgcgagcucgccgagaaguaccgcgaccgcgccaaggagcgccgcgacggcgucaacaaggacuacgaggagaccgagcucaucuccaccaccgccaacuaccgcgccgucggccccaccgccgaggccgacaaguccgccgccgagaagcgccgccagcucauccaggaguccaaguuccucggcggcgacauggagcacacccaccucgucaagggccucgacuucgcccuccuccagaagguccgcgccgagaucgccuccaaggagaaggaggaggaggagcucauggagaagccccagaaggagaccaagaaggacgaggaccccgagaacaagaucgaguucaagacccgccucggccgcaacgucuaccgcaugcucuucaaguccaaggccuacgagcgcaacgagcucuuccuccccggccgcauggccuacgucgucgaccucgacgacgaguacgccgacaccgacauccccaccacccucauccgcuccaaggccgacugccccaccauggaggcccagaccacccucaccaccaacgacaucgucaucuccaagcucacccagauccucuccuaccuccgccagggcacccgcaacaagaagcucaagaagaaggacaagggcaagcucgaggagaagaagccccccgaggccgacaugaacaucuucgaggacaucggcgacuacguccccuccaccaccaagaccccccgcgacaaggagcgcgagcgcuaccgcgagcgcgagcgcgaccgcgagcgcgaccgcgaccgcgaccgcgagcgcgagcgcgagcgcgaccgcgagcgcgagcgcgagcgcgaccgcgagcgcgaggaggagaagaagcgccacuccuacuucgagaagcccaaggucgacgacgagcccauggacgucgacaagggccccggcuccaccaaggagcucaucaaguccaucaacgagaaguucgccggcuccgccggcugggagggcaccgagucccucaagaagcccgaggacaagaagcagcucggcgacuucuucggcauguccaacuccuacgccgagugcuaccccgccaccauggacgacauggccgucgacuccgacgaggaggucgacuacuccaagauggaccagggcaacaagaagggcccccucggccgcugggacuucgacacccaggaggaguacuccgaguacaugaacaacaaggaggcccuccccaaggccgccuuccaguacggcaucaagauguccgagggccgcaagacccgccgcuucaaggagaccaacgacaaggccgagcucgaccgccaguggaagaagaucuccgccaucaucgagaagcgcaagaagauggaggccgacggcgucgaggucaagcgccccaaguacuga

SEQ ID NO: 44561 - RNA, 1299 nt, Artificial Sequence
  derived and/or modified sequence opt2 from IKZF1__Homo_sapiens__NP_001207697
auggacgccgacgagggccaggacaugucccaggucuccggcaaggaguccccccccgucuccgacacccccgacgagggcgacgagcccaugcccauccccgaggaccucuccaccaccuccggcggccagcaguccuccaaguccgaccgcgucgucgccuccaacgucaaggucgagacccaguccgacgaggagaacggccgcgccugcgagaugaacggcgaggagugcgccgaggaccuccgcaugcucgacgccuccggcgagaagaugaacggcucccaccgcgaccagggcuccuccgcccucuccggcgucggcggcauccgccuccccaacggcaagcucaagugcgacaucugcggcaucaucugcaucggccccaacguccucaugguccacaagcgcucccacaccggcgagcgccccuuccagugcaaccagugcggcgccuccuucacccagaagggcaaccuccuccgccacaucaagcuccacuccggcgagaagcccuucaagugccaccucugcaacuacgccugccgccgccgcgacgcccucaccggccaccuccgcacccacuccggcgacaagggccucuccgacacccccuacgacuccuccgccuccuacgagaaggagaacgagaugaugaagucccacgucauggaccaggccaucaacaacgccaucaacuaccucggcgccgagucccuccgcccccucguccagaccccccccggcggcuccgaggucguccccgucaucucccccauguaccagcuccacaagccccucgccgagggcaccccccgcuccaaccacuccgcccaggacuccgccgucgagaaccuccuccuccucuccaaggccaagcucguccccuccgagcgcgaggccucccccuccaacuccugccaggacuccaccgacaccgaguccaacaacgaggagcagcgcuccggccucaucuaccucaccaaccacaucgccccccacgcccgcaacggccucucccucaaggaggagcaccgcgccuacgaccuccuccgcgccgccuccgagaacucccaggacgcccuccgcgucgucuccaccuccggcgagcagaugaaggucuacaagugcgagcacugccgcguccucuuccucgaccacgucauguacaccauccacaugggcugccacggcuuccgcgaccccuucgagugcaacaugugcggcuaccacucccaggaccgcuacgaguucuccucccacaucacccgcggcgagcaccgcuuccacauguccuga

SEQ ID NO: 44562 - RNA, 1503 nt, Artificial Sequence
  derived and/or modified sequence opt2 from IKZF2__Homo_sapiens__NP_001072994
auggagaccgaggccaucgacggcuacaucaccugcgacaacgagcucucccccgagcgcgagcacuccaacauggccaucgaccucaccuccuccacccccaacggccagcacgccucccccucccacaugaccuccaccaacuccgucaagcucgagaugcaguccgacgaggagugcgaccgcaagccccucucccgcgaggacgagauccgcggccacgacgagggcuccucccucgaggagccccucaucgaguccuccgaggucgccgacaaccgcaagguccaggagcuccagggcgagggcggcauccgccuccccaacggcgagcgccccuuccacugcaaccagugcggcgccuccuucacccagaagggcaaccuccuccgccacaucaagcuccacuccggcgagaagcccuucaagugccccuucugcuccuacgccugccgccgccgcgacgcccucaccggccaccuccgcacccacuccgucggcaagccccacaagugcaacuacugcggccgcuccuacaagcagcgcuccucccucgaggagcacaaggagcgcugccacaacuaccuccagaacgucuccauggaggccgccggccaggucaugucccaccacgucccccccauggaggacugcaaggagcaggagcccaucauggacaacaacaucucccucguccccuucgagcgccccgccgucaucgagaagcucaccggcaacaugggcaagcgcaaguccuccaccccccagaaguucgucggcgagaagcucaugcgcuucuccuaccccgacauccacuucgacaugaaccucaccuacgagaaggaggccgagcucaugcagucccacaugauggaccaggccaucaacaacgccaucaccuaccucggcgccgaggcccuccacccccucaugcagcacccccccuccaccaucgccgaggucgcccccgucaucuccuccgccuacucccaggucuaccaccccaaccgcaucgagcgccccaucucccgcgagaccgccgacucccacgagaacaacauggacggccccaucucccucauccgccccaagucccgcccccaggagcgcgaggccucccccuccaacuccugccucgacuccaccgacuccgaguccucccacgacgaccaccaguccuaccagggccaccccgcccucaaccccaagcgcaagcagucccccgccuacaugaaggaggacgucaaggcccucgacaccaccaaggcccccaagggcucccucaaggacaucuacaaggucuucaacggcgagggcgagcagauccgcgccuucaagugcgagcacugccgcguccucuuccucgaccacgucauguacaccauccacaugggcugccacggcuaccgcgacccccucgagugcaacaucugcggcuaccgcucccaggaccgcuacgaguucuccucccacaucguccgcggcgagcacaccuuccacuga

SEQ ID NO: 44563 - RNA, 1428 nt, Artificial Sequence
  derived and/or modified sequence opt2 from IKZF3__Homo_sapiens__NP_001244337
auggaggacauccagaccaacgccgagcucaaguccacccaggagcaguccguccccgccgacgacuccaugaaggucaaggacgaguacuccgagcgcgacgagaacguccucaaguccgagcccaugggcaacgccgaggagcccgagauccccuacuccuacucccgcgaguacaacgaguacgagaacaucaagcucgagcgccacgucgucuccuucgacuccucccgccccaccuccggcaagaugaacugcgacgucugcggccucuccugcaucuccuucaacguccucaugguccacaagcgcucccacaccggcgagcgccccuuccagugcaaccagugcggcgccuccuucacccagaagggcaaccuccuccgccacaucaagcuccacaccggcgagaagcccuucaagugccaccucugcaacuacgccugccagcgccgcgacgcccucaccggccaccuccgcacccacuccgucgagaagcccuacaagugcgaguucugcggccgcuccuacaagcagcgcuccucccucgaggagcacaaggagcgcugccgcaccuuccuccaguccaccgaccccggcgacaccgccuccgccgaggcccgccacaucaaggccgagaugggcuccgagcgcgcccucguccucgaccgccucgccuccaacgucgccaagcgcaaguccuccaugccccagaaguucaucggcgagaagcgccacugcuucgacgucaacuacaacuccuccuacauguacgagaaggaguccgagcucauccagacccgcaugauggaccaggccaucaacaacgccaucuccuaccucggcgccgaggcccuccgcccccucguccagaccccccccgcccccaccuccgagaugguccccgucaucuccuccauguaccccaucgcccucacccgcgccgagauguccaacggcgccccccaggagcucgagaagaaguccauccaccuccccgagaaguccguccccuccgagcgcggccucucccccaacaacuccggccacgacuccaccgacaccgacuccaaccacgaggagcgccagaaccacaucuaccagcagaaccacaugguccucucccgcgcccgcaacggcaugccccuccucaaggaggucccccgcuccuacgagcuccucaagcccccccccaucugcccccgcgacuccgucaaggucaucaacaaggagggcgaggucauggacgucuaccgcugcgaccacugccgcguccucuuccucgacuacgucauguucaccauccacaugggcugccacggcuuccgcgaccccuucgagugcaacaugugcggcuaccgcucccacgaccgcuacgaguucuccucccacaucgcccgcggcgagcaccgcgcccuccucaaguga

SEQ ID NO: 44564 - RNA, 1758 nt, Artificial Sequence
  derived and/or modified sequence opt2 from IKZF4__Homo_sapiens__NP_071910
augcacaccccccccgcccucccccgccgcuuccagggcggcggccgcguccgcacccccggcucccaccgccagggcaaggacaaccucgagcgcgaccccuccggcggcugcguccccgacuuccucccccaggcccaggacuccaaccacuucaucauggagucccucuucugcgaguccuccggcgacuccucccucgagaaggaguuccucggcgcccccgucggccccuccgucuccacccccaacucccagcacuccucccccucccgcucccucuccgccaacuccaucaaggucgagauguacuccgacgaggaguccucccgccuccucggccccgacgagcgccuccucgagaaggacgacuccgucaucgucgaggacucccucuccgagccccucggcuacugcgacggcuccggccccgagccccacucccccggcggcauccgccuccccaacggcaagcucaagugcgacgucugcggcauggucugcaucggccccaacguccucaugguccacaagcgcucccacaccggcgagcgccccuuccacugcaaccagugcggcgccuccuucacccagaagggcaaccuccuccgccacaucaagcuccacuccggcgagaagcccuucaagugccccuucugcaacuacgccugccgccgccgcgacgcccucaccggccaccuccgcacccacuccgucuccucccccaccgucggcaagcccuacaagugcaacuacugcggccgcuccuacaagcagcaguccacccucgaggagcacaaggagcgcugccacaacuaccuccagucccucuccaccgaggcccaggcccucgccggccagcccggcgacgagauccgcgaccucgagaugguccccgacuccaugcuccacuccuccuccgagcgccccaccuucaucgaccgccucgccaacucccucaccaagcgcaagcgcuccaccccccagaaguucgucggcgagaagcagaugcgcuucucccucuccgaccuccccuacgacgucaacuccggcggcuacgagaaggacgucgagcucgucgcccaccacucccucgagcccggcuucggcuccucccucgccuucgucggcgccgagcaccuccgcccccuccgccucccccccaccaacugcaucuccgagcucacccccgucaucuccuccgucuacacccagaugcagccccuccccggccgccucgagcuccccggcucccgcgaggccggcgagggccccgaggaccucgccgacggcggcccccuccucuaccgcccccgcggcccccucaccgaccccggcgccucccccuccaacggcugccaggacuccaccgacaccgaguccaaccacgaggaccgcgucgccggcgucgucucccucccccagggcccccccccccagcccccccccaccaucgucgucggccgccacucccccgccuacgccaaggaggaccccaagccccaggagggccuccuccgcggcacccccggccccuccaaggagguccuccgcgucgucggcgaguccggcgagcccgucaaggccuucaagugcgagcacugccgcauccucuuccucgaccacgucauguucaccauccacaugggcugccacggcuuccgcgaccccuucgagugcaacaucugcggcuaccacucccaggaccgcuacgaguucuccucccacaucguccgcggcgagcacaaggucggcuga

SEQ ID NO: 44565 - RNA, 537 nt, Artificial Sequence
  derived and/or modified sequence opt2 from IL10__Homo_sapiens__XP_011507808
augcacuccuccgcccuccucugcugccucguccuccucaccggcguccgcgccucccccggccagggcacccaguccgagaacuccugcacccacuuccccggcaaccuccccaacaugcuccgcgaccuccgcgacgccuucucccgcgucaagaccuucuuccagaugaaggaccagcucgacaaccuccuccucaaggagucccuccucgaggacuucaagggcuaccucggcugccaggcccucuccgagaugauccaguucuaccucgaggaggucaugccccaggccgagaaccaggaccccgacaucaaggcccacgucaacucccucggcgagaaccucaagacccuccgccuccgccuccgccgcugccaccgcuuccuccccugcgagaacaaguccaaggccgucgagcaggucaagaacgccuucaacaagcuccaggagaagggcaucuacaaggccauguccgaguucgacaucuucaucaacuacaucgaggccuacaugaccaugaagauccgcaacuga

SEQ ID NO: 44566 - RNA, 1737 nt, Artificial Sequence
  derived and/or modified sequence opt2 from IL10RA__Homo_sapiens__NP_001549
augcuccccugccucgucguccuccucgccgcccuccucucccuccgccucggcuccgacgcccacggcaccgagcuccccuccccccccuccgucugguucgaggccgaguucuuccaccacauccuccacuggacccccauccccaaccaguccgaguccaccugcuacgaggucgcccuccuccgcuacggcaucgaguccuggaacuccaucuccaacugcucccagacccucuccuacgaccucaccgccgucacccucgaccucuaccacuccaacggcuaccgcgcccgcguccgcgccgucgacggcucccgccacuccaacuggaccgucaccaacacccgcuucuccgucgacgaggucacccucaccgucggcuccgucaaccucgagauccacaacggcuucauccucggcaagauccagcucccccgccccaagauggcccccgccaacgacaccuacgaguccaucuucucccacuuccgcgaguacgagaucgccauccgcaagguccccggcaacuucaccuucacccacaagaaggucaagcacgagaacuucucccuccucaccuccggcgaggucggcgaguucugcguccaggucaagcccuccgucgccucccgcuccaacaagggcaugugguccaaggaggagugcaucucccucacccgccaguacuucaccgucaccaacgucaucaucuucuucgccuucguccuccuccucuccggcgcccucgccuacugccucgcccuccagcucuacguccgccgccgcaagaagcuccccuccguccuccucuucaagaagcccucccccuucaucuucaucucccagcgccccucccccgagacccaggacaccauccacccccucgacgaggaggccuuccucaaggucucccccgagcucaagaaccucgaccuccacggcuccaccgacuccggcuucggcuccaccaagcccucccuccagaccgaggagccccaguuccuccuccccgacccccacccccaggccgaccgcacccucggcaaccgcgagccccccguccucggcgacuccugcuccuccggcuccuccaacuccaccgacuccggcaucugccuccaggagcccucccucucccccuccaccggccccaccugggagcagcaggucggcuccaacucccgcggccaggacgacuccggcaucgaccucguccagaacuccgagggccgcgccggcgacacccagggcggcuccgcccucggccaccacuccccccccgagcccgagguccccggcgaggaggaccccgccgccgucgccuuccagggcuaccuccgccagacccgcugcgccgaggagaaggccaccaagaccggcugccucgaggaggaguccccccucaccgacggccucggccccaaguucggccgcugccucgucgacgaggccggccuccacccccccgcccucgccaagggcuaccucaagcaggacccccucgagaugacccucgccuccuccggcgcccccaccggccaguggaaccagcccaccgaggaguggucccuccucgcccucuccuccugcuccgaccucggcaucuccgacugguccuucgcccacgaccucgccccccucggcugcgucgccgcccccggcggccuccucggcuccuucaacuccgaccucgucacccucccccucaucuccucccuccaguccuccgaguga

SEQ ID NO: 44567 - RNA, 978 nt, Artificial Sequence
  derived and/or modified sequence opt2 from IL10RB__Homo_sapiens__NP_000619
auggccuggucccucggcuccuggcucggcggcugccuccucgucuccgcccucggcaugguccccccccccgagaacguccgcaugaacuccgucaacuucaagaacauccuccagugggagucccccgccuucgccaagggcaaccucaccuucaccgcccaguaccucuccuaccgcaucuuccaggacaagugcaugaacaccacccucaccgagugcgacuucuccucccucuccaaguacggcgaccacacccuccgcguccgcgccgaguucgccgacgagcacuccgacugggucaacaucaccuucugccccgucgacgacaccaucaucggcccccccggcaugcaggucgagguccucgccgacucccuccacaugcgcuuccucgcccccaagaucgagaacgaguacgagaccuggaccaugaagaacgucuacaacuccuggaccuacaacguccaguacuggaagaacggcaccgacgagaaguuccagaucaccccccaguacgacuucgagguccuccgcaaccucgagcccuggaccaccuacugcguccagguccgcggcuuccuccccgaccgcaacaaggccggcgagugguccgagcccgucugcgagcagaccacccacgacgagaccguccccuccuggauggucgccgucauccucauggccuccgucuucauggucugccucgcccuccucggcugcuucgcccuccucuggugcgucuacaagaagaccaaguacgccuucuccccccgcaacucccucccccagcaccucaaggaguuccucggccacccccaccacaacacccuccucuucuucuccuucccccucuccgacgagaacgacgucuucgacaagcucuccgucaucgccgaggacuccgaguccggcaagcagaaccccggcgacuccugcucccucggcaccccccccggccagggcccccaguccuga

SEQ ID NO: 44568 - RNA, 600 nt, Artificial Sequence
  derived and/or modified sequence opt2 from IL11__Homo_sapiens__NP_000632
augaacugcgucugccgccucguccucgucguccucucccucuggcccgacaccgccgucgcccccggccccccccccggccccccccgcgucucccccgacccccgcgccgagcucgacuccaccguccuccucacccgcucccuccucgccgacacccgccagcucgccgcccagcuccgcgacaaguuccccgccgacggcgaccacaaccucgacucccuccccacccucgccauguccgccggcgcccucggcgcccuccagcuccccggcguccucacccgccuccgcgccgaccuccucuccuaccuccgccacguccaguggcuccgccgcgccggcggcuccucccucaagacccucgagcccgagcucggcacccuccaggcccgccucgaccgccuccuccgccgccuccagcuccucaugucccgccucgcccucccccagcccccccccgacccccccgcccccccccucgccccccccuccuccgccuggggcggcauccgcgccgcccacgccauccucggcggccuccaccucacccucgacugggccguccgcggccuccuccuccucaagacccgccucuga

SEQ ID NO: 44569 - RNA, 1269 nt, Artificial Sequence
  derived and/or modified sequence opt2 from IL11RA__Homo_sapiens__NP_001136256
auguccuccuccugcuccggccucucccgcguccucgucgccgucgccaccgcccucgucuccgccuccucccccugcccccaggccuggggcccccccggcguccaguacggccagcccggccgcuccgucaagcucugcugccccggcgucaccgccggcgaccccgucuccugguuccgcgacggcgagcccaagcuccuccagggccccgacuccggccucggccacgagcucguccucgcccaggccgacuccaccgacgagggcaccuacaucugccagacccucgacggcgcccucggcggcaccgucacccuccagcucggcuacccccccgcccgccccgucgucuccugccaggccgccgacuacgagaacuucuccugcaccuggucccccucccagaucuccggccuccccacccgcuaccucaccuccuaccgcaagaagaccguccucggcgccgacucccagcgccgcucccccuccaccggccccuggcccugcccccaggacccccucggcgccgcccgcugcgucguccacggcgccgaguucuggucccaguaccgcaucaacgucaccgaggucaacccccucggcgccuccacccgccuccucgacgucucccuccaguccauccuccgccccgaccccccccagggccuccgcgucgaguccguccccggcuacccccgccgccuccgcgccuccuggaccuaccccgccuccuggcccugccagccccacuuccuccucaaguuccgccuccaguaccgccccgcccagcaccccgccugguccaccgucgagcccgccggccucgaggaggucaucaccgacgccgucgccggccucccccacgccguccgcgucuccgcccgcgacuuccucgacgccggcaccugguccaccuggucccccgaggccuggggcacccccuccaccggcaccauccccaaggagauccccgccuggggccagcuccacacccagcccgaggucgagccccaggucgacucccccgcccccccccgccccucccuccagccccacccccgccuccucgaccaccgcgacuccgucgagcaggucgccguccucgccucccucggcauccucuccuuccucggccucgucgccggcgcccucgcccucggccucuggcuccgccuccgccgcggcggcaaggacggcucccccaagcccggcuuccucgccuccgucauccccgucgaccgccgccccggcgcccccaaccucuga

SEQ ID NO: 44570 - RNA, 762 nt, Artificial Sequence
  derived and/or modified sequence opt2 from IL12A__Homo_sapiens__NP_000873
auguggccccccggcuccgccucccagcccccccccucccccgccgccgccaccggccuccaccccgccgcccgccccgucucccuccagugccgccucuccaugugccccgcccgcucccuccuccucgucgccacccucguccuccucgaccaccucucccucgcccgcaaccuccccgucgccacccccgaccccggcauguuccccugccuccaccacucccagaaccuccuccgcgccgucuccaacaugcuccagaaggcccgccagacccucgaguucuaccccugcaccuccgaggagaucgaccacgaggacaucaccaaggacaagaccuccaccgucgaggccugccucccccucgagcucaccaagaacgaguccugccucaacucccgcgagaccuccuucaucaccaacggcuccugccucgccucccgcaagaccuccuucaugauggcccucugccucuccuccaucuacgaggaccucaagauguaccaggucgaguucaagaccaugaacgccaagcuccucauggaccccaagcgccagaucuuccucgaccagaacaugcucgccgucaucgacgagcucaugcaggcccucaacuucaacuccgagaccgucccccagaaguccucccucgaggagcccgacuucuacaagaccaagaucaagcucugcauccuccuccacgccuuccgcauccgcgccgucaccaucgaccgcgucauguccuaccucaacgccuccuga

SEQ ID NO: 44571 - RNA, 987 nt, Artificial Sequence
  derived and/or modified sequence opt2 from IL12B__Homo_sapiens__NP_002178
augugccaccagcagcucgucaucuccugguucucccucgucuuccucgccuccccccucgucgccaucugggagcucaagaaggacgucuacgucgucgagcucgacugguaccccgacgcccccggcgagauggucguccucaccugcgacacccccgaggaggacggcaucaccuggacccucgaccaguccuccgagguccucggcuccggcaagacccucaccauccaggucaaggaguucggcgacgccggccaguacaccugccacaagggcggcgagguccucucccacucccuccuccuccuccacaagaaggaggacggcaucugguccaccgacauccucaaggaccagaaggagcccaagaacaagaccuuccuccgcugcgaggccaagaacuacuccggccgcuucaccugcugguggcucaccaccaucuccaccgaccucaccuucuccgucaaguccucccgcggcuccuccgacccccagggcgucaccugcggcgccgccacccucuccgccgagcgcguccgcggcgacaacaaggaguacgaguacuccgucgagugccaggaggacuccgccugccccgccgccgaggagucccuccccaucgaggucauggucgacgccguccacaagcucaaguacgagaacuacaccuccuccuucuucauccgcgacaucaucaagcccgacccccccaagaaccuccagcucaagccccucaagaacucccgccaggucgaggucuccugggaguaccccgacaccugguccaccccccacuccuacuucucccucaccuucugcguccagguccagggcaaguccaagcgcgagaagaaggaccgcgucuucaccgacaagaccuccgccaccgucaucugccgcaagaacgccuccaucuccguccgcgcccaggaccgcuacuacuccuccuccugguccgagugggccuccguccccugcuccuga

SEQ ID NO: 44572 - RNA, 2109 nt, Artificial Sequence
  derived and/or modified sequence opt2 from IL12RB1__Homo_sapiens__NP_001276953
auguucgucggccucuucucccuccucuccuucaacgucuuccgcuccggcgacggcgucgccgagccccgccgcuggcagcgcggcucccccggcgccgucggccucuacgucgaccccauggagccccucgucaccugggucgucccccuccucuuccucuuccuccucucccgccagggcgccgccugccgcaccuccgagugcugcuuccaggacccccccuaccccgacgccgacuccggcuccgccuccggcccccgcgaccuccgcugcuaccgcaucuccuccgaccgcuacgagugcuccuggcaguacgagggccccaccgccggcgucucccacuuccuccgcugcugccucuccuccggccgcugcugcuacuucgccgccggcuccgccacccgccuccaguucuccgaccaggccggcgucuccguccucuacaccgucacccucugggucgaguccugggcccgcaaccagaccgagaagucccccgaggucacccuccagcucuacaacuccgucaaguacgagcccccccucggcgacaucaaggucuccaagcucgccggccagcuccgcauggagugggagacccccgacaaccaggucggcgccgagguccaguuccgccaccgcacccccuccucccccuggaagcucggcgacugcggcccccaggacgacgacaccgaguccugccucugcccccucgagaugaacgucgcccaggaguuccagcuccgccgccgccagcucggcucccagggcuccuccugguccaagugguccucccccgucugcgucccccccgagaaccccccccagccccagguccgcuucuccgucgagcagcucggccaggacggccgccgccgccucacccucaaggagcagcccacccagcucgagcuccccgagggcugccagggccucgcccccggcaccgaggucaccuaccgccuccagcuccacaugcucuccugccccugcaaggccaaggccacccgcacccuccaccucggcaagaugcccuaccucuccggcgccgccuacaacgucgccgucaucuccuccaaccaguucggccccggccucaaccagaccuggcacauccccgccgacacccacaccgagcccgucgcccucaacaucuccgucggcaccaacggcaccaccauguacuggcccgcccgcgcccaguccaugaccuacugcaucgaguggcagcccgucggccaggacggcggccucgccaccugcucccucaccgccccccaggaccccgaccccgccggcauggccaccuacuccuggucccgcgaguccggcgccaugggccaggagaagugcuacuacaucaccaucuucgccuccgcccaccccgagaagcucacccucugguccaccguccucuccaccuaccacuucggcggcaacgccuccgccgccggcaccccccaccacgucuccgucaagaaccacucccucgacuccgucuccgucgacugggcccccucccuccucuccaccugccccggcguccucaaggaguacgucguccgcugccgcgacgaggacuccaagcaggucuccgagcaccccguccagcccaccgagacccaggucacccucuccggccuccgcgccggcgucgccuacaccguccagguccgcgccgacaccgccuggcuccgcggcgucuggucccagccccagcgcuucuccaucgagguccaggucuccgacuggcucaucuucuucgccucccucggcuccuuccucuccauccuccucgucggcguccucggcuaccucggccucaaccgcgccgcccgccaccucugccccccccuccccacccccugcgccuccuccgccaucgaguuccccggcggcaaggagaccuggcaguggaucaaccccgucgacuuccaggaggaggccucccuccaggaggcccucgucgucgagauguccugggacaagggcgagcgcaccgagccccucgagaagaccgagcuccccgagggcgcccccgagcucgcccucgacaccgagcucucccucgaggacggcgaccgcugcaaggccaagauguga

SEQ ID NO: 44573 - RNA, 441 nt, Artificial Sequence
  derived and/or modified sequence opt2 from IL13__Homo_sapiens__NP_002179
augcacccccuccucaacccccuccuccucgcccucggccucauggcccuccuccucaccaccgucaucgcccucaccugccucggcggcuucgccucccccggccccgucccccccuccaccgcccuccgcgagcucaucgaggagcucgucaacaucacccagaaccagaaggccccccucugcaacggcuccauggucugguccaucaaccucaccgccggcauguacugcgccgcccucgagucccucaucaacgucuccggcugcuccgccaucgagaagacccagcgcaugcucuccggcuucugcccccacaaggucuccgccggccaguucuccucccuccacguccgcgacaccaagaucgaggucgcccaguucgucaaggaccuccuccuccaccucaagaagcucuuccgcgagggccaguucaacuga

SEQ ID NO: 44574 - RNA, 1284 nt, Artificial Sequence
  derived and/or modified sequence opt2 from IL13RA1__Homo_sapiens__NP_001551
auggaguggcccgcccgccucugcggccucugggcccuccuccucugcgccggcggcggcggcggcggcggcggcgccgcccccaccgagacccagccccccgucaccaaccucuccgucuccgucgagaaccucugcaccgucaucuggaccuggaacccccccgagggcgccuccuccaacugcucccucugguacuucucccacuucggcgacaagcaggacaagaagaucgcccccgagacccgccgcuccaucgaggucccccucaacgagcgcaucugccuccaggucggcucccagugcuccaccaacgaguccgagaagcccuccauccucgucgagaagugcaucuccccccccgagggcgaccccgaguccgccgucaccgagcuccagugcaucuggcacaaccucuccuacaugaagugcuccuggcuccccggccgcaacaccucccccgacaccaacuacacccucuacuacuggcaccgcucccucgagaagauccaccagugcgagaacaucuuccgcgagggccaguacuucggcugcuccuucgaccucaccaaggucaaggacuccuccuucgagcagcacuccguccagaucauggucaaggacaacgccggcaagaucaagcccuccuucaacaucgucccccucaccucccgcgucaagcccgaccccccccacaucaagaaccucuccuuccacaacgacgaccucuacguccagugggagaacccccagaacuucaucucccgcugccucuucuacgaggucgaggucaacaacucccagaccgagacccacaacgucuucuacguccaggaggccaagugcgagaaccccgaguucgagcgcaacgucgagaacaccuccugcuucaugguccccggcguccuccccgacacccucaacaccguccgcauccgcgucaagaccaacaagcucugcuacgaggacgacaagcucugguccaacuggucccaggagauguccaucggcaagaagcgcaacuccacccucuacaucaccaugcuccucaucguccccgucaucgucgccggcgccaucaucguccuccuccucuaccucaagcgccucaagaucaucaucuucccccccauccccgaccccggcaagaucuucaaggagauguucggcgaccagaacgacgacacccuccacuggaagaaguacgacaucuacgagaagcagaccaaggaggagaccgacuccgucguccucaucgagaaccucaagaaggccucccaguga

SEQ ID NO: 44575 - RNA, 1143 nt, Artificial Sequence
  derived and/or modified sequence opt2 from IL13RA2__Homo_sapiens__NP_000631
auggccuucgucugccucgccaucggcugccucuacaccuuccucaucuccaccaccuucggcugcaccuccuccuccgacaccgagaucaaggucaaccccccccaggacuucgagaucgucgaccccggcuaccucggcuaccucuaccuccaguggcagcccccccucucccucgaccacuucaaggagugcaccgucgaguacgagcucaaguaccgcaacaucggcuccgagaccuggaagaccaucaucaccaagaaccuccacuacaaggacggcuucgaccucaacaagggcaucgaggccaagauccacacccuccuccccuggcagugcaccaacggcuccgagguccaguccuccugggccgagaccaccuacuggaucuccccccagggcauccccgagaccaagguccaggacauggacugcgucuacuacaacuggcaguaccuccucugcuccuggaagcccggcaucggcguccuccucgacaccaacuacaaccucuucuacugguacgagggccucgaccacgcccuccagugcgucgacuacaucaaggccgacggccagaacaucggcugccgcuuccccuaccucgaggccuccgacuacaaggacuucuacaucugcgucaacggcuccuccgagaacaagcccauccgcuccuccuacuucaccuuccagcuccagaacaucgucaagccccucccccccgucuaccucaccuucacccgcgaguccuccugcgagaucaagcucaagugguccaucccccucggccccauccccgcccgcugcuucgacuacgagaucgagauccgcgaggacgacaccacccucgucaccgccaccgucgagaacgagaccuacacccucaagaccaccaacgagacccgccagcucugcuucgucguccgcuccaaggucaacaucuacugcuccgacgacggcaucugguccgagugguccgacaagcagugcugggagggcgaggaccucuccaagaagacccuccuccgcuucuggcuccccuucggcuucauccucauccucgucaucuucgucaccggccuccuccuccgcaagcccaacaccuaccccaagaugauccccgaguucuucugcgacaccuga

SEQ ID NO: 44576 - RNA, 489 nt, Artificial Sequence
  derived and/or modified sequence opt2 from IL15__Homo_sapiens__NP_000576
augcgcaucuccaagccccaccuccgcuccaucuccauccagugcuaccucugccuccuccucaacucccacuuccucaccgaggccggcauccacgucuucauccucggcugcuucuccgccggccuccccaagaccgaggccaacugggucaacgucaucuccgaccucaagaagaucgaggaccucauccaguccaugcacaucgacgccacccucuacaccgaguccgacguccaccccuccugcaaggucaccgccaugaagugcuuccuccucgagcuccaggucaucucccucgaguccggcgacgccuccauccacgacaccgucgagaaccucaucauccucgccaacaacucccucuccuccaacggcaacgucaccgaguccggcugcaaggagugcgaggagcucgaggagaagaacaucaaggaguuccuccaguccuucguccacaucguccagauguucaucaacaccuccuga

SEQ ID NO: 44577 - RNA, 696 nt, Artificial Sequence
  derived and/or modified sequence opt2 from IL15RA__Homo_sapiens__NP_001230468
auguccgucgagcacgccgacaucugggucaaguccuacucccucuacucccgcgagcgcuacaucugcaacuccggcuucaagcgcaaggccggcaccuccucccucaccgagugcguccucaacaaggccaccaacgucgcccacuggaccacccccucccucaagugcauccgcgaccccgcccucguccaccagcgccccgccccccccuccaccgucaccaccgccggcgucaccccccagcccgagucccucucccccuccggcaaggagcccgccgccuccucccccuccuccaacaacaccgccgccaccaccgccgccaucguccccggcucccagcucaugcccuccaagucccccuccaccggcaccaccgagaucuccucccacgaguccucccacggcacccccucccagaccaccgccaagaacugggagcucaccgccuccgccucccaccagccccccggcgucuacccccagggccacuccgacaccaccgucgccaucuccaccuccaccguccuccucugcggccucuccgccgucucccuccucgccugcuaccucaagucccgccagacccccccccucgccuccgucgagauggaggccauggaggcccuccccgucaccuggggcaccuccucccgcgacgaggaccucgagaacugcucccaccaccucuga

SEQ ID NO: 44578 - RNA, 3996 nt, Artificial Sequence
  derived and/or modified sequence opt2 from IL16__Homo_sapiens__NP_001165599
auggagucccacucccgcgccggcaagucccgcaaguccgccaaguuccgcuccaucucccgcucccucaugcucugcaacgccaagaccuccgacgacggcuccucccccgacgagaaguaccccgaccccuucgagaucucccucgcccagggcaaggagggcaucuuccacuccuccguccagcucgccgacaccuccgaggccggccccuccuccguccccgaccucgcccucgccuccgaggccgcccagcuccaggccgccggcaacgaccgcggcaagaccugccgccgcaucuucuucaugaaggaguccuccaccgccuccucccgcgagaagcccggcaagcucgaggcccaguccuccaacuuccucuuccccaaggccugccaccagcgcgcccgcuccaacuccaccuccgucaaccccuacugcacccgcgagaucgacuuccccaugaccaagaaguccgccgcccccaccgaccgccagcccuacucccucugcuccaaccgcaagucccucucccagcagcucgacugccccgccggcaaggccgccggcaccucccgccccacccgcucccucuccaccgcccagcucguccagcccuccggcggccuccaggccuccgucaucuccaacaucguccucaugaagggccaggccaagggccucggcuucuccaucgucggcggcaaggacuccaucuacggccccaucggcaucuacgucaagaccaucuucgccggcggcgccgccgccgccgacggccgccuccaggagggcgacgagauccucgagcucaacggcgaguccauggccggccucacccaccaggacgcccuccagaaguucaagcaggccaagaagggccuccucacccucaccguccgcacccgccucaccgccccccccucccucugcucccaccucucccccccccucugccgcucccucuccuccuccaccugcaucaccaaggacuccuccuccuucgcccucgagucccccuccgcccccaucuccaccgccaagcccaacuaccgcaucauggucgaggucucccuccagaaggaggccggcgucggccucggcaucggccucugcuccguccccuacuuccagugcaucuccggcaucuucguccacacccucucccccggcuccgucgcccaccucgacggccgccuccgcugcggcgacgagaucgucgagaucuccgacucccccguccacugccucacccucaacgaggucuacaccauccucucccacugcgaccccggccccguccccaucaucgucucccgccaccccgacccccaggucuccgagcagcagcucaaggaggccgucgcccaggccgucgagaacaccaaguucggcaaggagcgccaccaguggucccucgagggcgucaagcgccucgaguccuccuggcacggccgccccacccucgagaaggagcgcgagaagaacuccgcccccccccaccgccgcgcccagaaggucaugauccgcuccuccuccgacuccuccuacauguccggcucccccggcggcucccccggcuccggcuccgccgagaagcccuccuccgacgucgacaucuccacccacucccccucccucccccucgcccgcgagcccgucguccucuccaucgccuccucccgccucccccaggagucccccccccuccccgagucccgcgacucccaccccccccuccgccucaagaaguccuucgagauccucguccgcaagcccauguccuccaagcccaagccccccccccgcaaguacuucaaguccgacuccgacccccagaagucccucgaggagcgcgagaacuccuccugcuccuccggccacaccccccccaccugcggccaggaggcccgcgagcuccucccccuccuccucccccaggaggacaccgccggccgcucccccuccgccuccgccggcugccccggccccggcaucggcccccagaccaaguccuccaccgagggcgagcccggcuggcgccgcgccucccccgucacccagaccucccccaucaagcacccccuccucaagcgccaggcccgcauggacuacuccuucgacaccaccgccgaggaccccuggguccgcaucuccgacugcaucaagaaccucuucucccccaucauguccgagaaccacggccacaugccccuccagcccaacgccucccucaacgaggaggagggcacccagggccaccccgacggcaccccccccaagcucgacaccgccaacggcacccccaaggucuacaaguccgccgacuccuccaccgucaagaagggcccccccgucgcccccaagcccgccugguuccgccagucccucaagggccuccgcaaccgcgccuccgacccccgcggccuccccgaccccgcccucuccacccagcccgcccccgccucccgcgagcaccucggcucccacauccgcgccuccuccuccuccuccuccauccgccagcgcaucuccuccuucgagaccuucggcuccucccagcuccccgacaagggcgcccagcgccucucccuccagcccuccuccggcgaggccgccaagccccucggcaagcacgaggagggccgcuucuccggccuccucggccgcggcgccgcccccacccucgucccccagcagcccgagcagguccucuccuccggcucccccgccgccuccgaggcccgcgaccccggcgucuccgagucccccccccccggccgccagcccaaccagaagacccucccccccggccccgacccccuccuccgccuccucuccacccaggccgaggagucccagggccccguccucaagaugcccucccagcgcgcccgcuccuucccccucacccgcucccaguccugcgagaccaagcuccucgacgagaagaccuccaagcucuacuccaucuccucccaggucuccuccgccgucaugaagucccuccucugccuccccuccuccaucuccugcgcccagacccccugcauccccaaggagggcgccucccccaccuccuccuccaacgaggacuccgccgccaacggcuccgccgagaccuccgcccucgacaccggcuucucccucaaccucuccgagcuccgcgaguacaccgagggccucaccgaggccaaggaggacgacgacggcgaccacuccucccuccaguccggccaguccgucaucucccuccucuccuccgaggagcucaagaagcucaucgaggaggucaagguccucgacgaggccacccucaagcagcucgacggcauccacgucaccauccuccacaaggaggagggcgccggccucggcuucucccucgccggcggcgccgaccucgagaacaaggucaucaccguccaccgcgucuuccccaacggccucgccucccaggagggcaccauccagaagggcaacgagguccucuccaucaacggcaagucccucaagggcaccacccaccacgacgcccucgccauccuccgccaggcccgcgagccccgccaggccgucaucgucacccgcaagcucacccccgaggccaugcccgaccucaacuccuccaccgacuccgccgccuccgccuccgccgccuccgacgucuccgucgaguccaccgaggccaccgucugcaccgucacccucgagaagauguccgccggccucggcuucucccucgagggcggcaagggcucccuccacggcgacaagccccucaccaucaaccgcaucuucaagggcgccgccuccgagcaguccgagaccguccagcccggcgacgagauccuccagcucggcggcaccgccaugcagggccucacccgcuucgaggccuggaacaucaucaaggcccuccccgacggccccgucaccaucgucauccgccgcaagucccuccaguccaaggagaccaccgccgccggcgacuccuga

SEQ ID NO: 44579 - RNA, 468 nt, Artificial Sequence
  derived and/or modified sequence opt2 from IL17A__Homo_sapiens__NP_002181
augacccccggcaagaccucccucgucucccuccuccuccuccucucccucgaggccaucgucaaggccggcaucaccaucccccgcaaccccggcugccccaacuccgaggacaagaacuucccccgcaccgucauggucaaccucaacauccacaaccgcaacaccaacaccaaccccaagcgcuccuccgacuacuacaaccgcuccaccucccccuggaaccuccaccgcaacgaggaccccgagcgcuaccccuccgucaucugggaggccaagugccgccaccucggcugcaucaacgccgacggcaacgucgacuaccacaugaacuccguccccauccagcaggagauccucguccuccgccgcgagcccccccacugccccaacuccuuccgccucgagaagauccucgucuccgucggcugcaccugcgucacccccaucguccaccacgucgccuga

SEQ ID NO: 44580 - RNA, 543 nt, Artificial Sequence
  derived and/or modified sequence opt2 from IL17B__Homo_sapiens__NP_055258
auggacuggccccacaaccuccucuuccuccucaccaucuccaucuuccucggccucggccagccccgcucccccaaguccaagcgcaagggccagggccgccccggcccccucgcccccggcccccaccaggucccccucgaccucgucucccgcaugaagcccuacgcccgcauggaggaguacgagcgcaacaucgaggagauggucgcccagcuccgcaacuccuccgagcucgcccagcgcaagugcgaggucaaccuccagcucuggauguccaacaagcgcucccucucccccuggggcuacuccaucaaccacgaccccucccgcauccccgucgaccuccccgaggcccgcugccucugccucggcugcgucaaccccuucaccaugcaggaggaccgcuccauggucuccguccccgucuucucccagguccccguccgccgccgccucugccccccccccccccgcaccggccccugccgccagcgcgccgucauggagaccaucgccgucggcugcaccugcaucuucuga

SEQ ID NO: 44581 - RNA, 594 nt, Artificial Sequence
  derived and/or modified sequence opt2 from IL17C__Homo_sapiens__NP_037410
augacccuccuccccggccuccucuuccucaccuggcuccacaccugccucgcccaccacgaccccucccuccgcggccacccccacucccacggcaccccccacugcuacuccgccgaggagcucccccucggccaggcccccccccaccuccucgcccgcggcgccaaguggggccaggcccuccccgucgcccucgucuccucccucgaggccgccucccaccgcggccgccacgagcgccccuccgccaccacccagugccccguccuccgccccgaggagguccucgaggccgacacccaccagcgcuccaucucccccuggcgcuaccgcgucgacaccgacgaggaccgcuacccccagaagcucgccuucgccgagugccucugccgcggcugcaucgacgcccgcaccggccgcgagaccgccgcccucaacuccguccgccuccuccagucccuccucguccuccgccgccgccccugcucccgcgacggcuccggccuccccacccccggcgccuucgccuuccacaccgaguucauccacguccccgucggcugcaccugcguccucccccgcuccgucuga

SEQ ID NO: 44582 - RNA, 609 nt, Artificial Sequence
  derived and/or modified sequence opt2 from IL17D__Homo_sapiens__NP_612141
augcucgucgccggcuuccuccucgcccucccccccuccugggccgccggcgccccccgcgccggccgccgccccgcccgcccccgcggcugcgccgaccgccccgaggagcuccucgagcagcucuacggccgccucgccgccggcguccucuccgccuuccaccacacccuccagcucggcccccgcgagcaggcccgcaacgccuccugccccgccggcggccgccccgccgaccgccgcuuccgcccccccaccaaccuccgcuccgucucccccugggccuaccgcaucuccuacgaccccgcccgcuacccccgcuaccuccccgaggccuacugccucugccgcggcugccucaccggccucuucggcgaggaggacguccgcuuccgcuccgcccccgucuacaugcccaccgucguccuccgccgcacccccgccugcgccggcggccgcuccgucuacaccgaggccuacgucaccauccccgucggcugcaccugcguccccgagcccgagaaggacgccgacuccaucaacuccuccaucgacaagcagggcgccaagcuccuccucggccccaacgacgcccccgccggccccuga

SEQ ID NO: 44583 - RNA, 492 nt, Artificial Sequence
  derived and/or modified sequence opt2 from IL17F__Homo_sapiens__XP_011512578
augaccgucaagacccuccacggccccgccauggucaaguaccuccuccucuccauccucggccucgccuuccucuccgaggccgccgcccgcaagauccccaaggucggccacaccuucuuccagaagcccgaguccugcccccccguccccggcggcuccaugaagcucgacaucggcaucaucaacgagaaccagcgcgucuccaugucccgcaacaucgagucccgcuccaccucccccuggaacuacaccgucaccugggaccccaaccgcuaccccuccgaggucguccaggcccagugccgcaaccucggcugcaucaacgcccagggcaaggaggacaucuccaugaacuccguccccauccagcaggagacccucgucguccgccgcaagcaccagggcugcuccgucuccuuccagcucgagaagguccucgucaccgucggcugcaccugcgucacccccgucauccaccacguccaguga

SEQ ID NO: 44584 - RNA, 2499 nt, Artificial Sequence
  derived and/or modified sequence opt2 from IL17RA__Homo_sapiens__NP_001276834
augggcgccgcccgcuccccccccuccgccguccccggcccccuccucggccuccuccuccuccuccucggcguccucgcccccggcggcgccucccuccgccuccucgaccaccgcgcccucgucugcucccagcccggccucaacugcaccgucaagaacuccaccugccucgacgacuccuggauccacccccgcaaccucacccccuccucccccaaggaccuccagauccagcuccacuucgcccacacccagcagggcgaccucuuccccgucgcccacaucgaguggacccuccagaccgacgccuccauccucuaccucgagggcgccgagcucuccguccuccagcucaacaccaacgagcgccucugcguccgcuucgaguuccucuccaagcuccgccaccaccaccgccgcuggcgcuucaccuucucccacuucgucgucgaccccgaccaggaguacgaggucaccguccaccaccuccccaagcccauccccgacggcgaccccaaccaccaguccaagaacuuccucguccccgacugcgagcacgcccgcaugaaggucaccacccccugcauguccuccggcucccucugggaccccaacaucaccgucgagacccucgaggcccaccagcuccgcgucuccuucacccucuggaacgaguccacccacuaccagauccuccucaccuccuucccccacauggagaaccacuccugcuucgagcacaugcaccacauccccgccccccgccccgaggaguuccaccagcgcuccaacgucacccucacccuccgcaaccucaagggcugcugccgccaccagguccagauccagcccuucuucuccuccugccucaacgacugccuccgccacuccgccaccgucuccugccccgagaugcccgacacccccgagcccauccccggccccggcuccgagaaguacuccgacgacaccaaguacaccgacggccuccccgccgccgaccucaucccccccccccucaagccccgcaaggucuggaucaucuacuccgccgaccacccccucuacgucgacgucguccucaaguucgcccaguuccuccucaccgccugcggcaccgaggucgcccucgaccuccucgaggagcaggccaucuccgaggccggcgucaugaccugggucggccgccagaagcaggagauggucgaguccaacuccaagaucaucguccucugcucccgcggcacccgcgccaaguggcaggcccuccucggccgcggcgcccccguccgccuccgcugcgaccacggcaagcccgucggcgaccucuucaccgccgccaugaacaugauccuccccgacuucaagcgccccgccugcuucggcaccuacgucgucugcuacuucuccgaggucuccugcgacggcgacguccccgaccucuucggcgccgccccccgcuacccccucauggaccgcuucgaggaggucuacuuccgcauccaggaccucgagauguuccagcccggccgcaugcaccgcgucggcgagcucuccggcgacaacuaccuccgcucccccggcggccgccagcuccgcgccgcccucgaccgcuuccgcgacuggcagguccgcugccccgacugguucgagugcgagaaccucuacuccgccgacgaccaggacgcccccucccucgacgaggaggucuucgaggagccccuccucccccccggcaccggcaucgucaagcgcgccccccucguccgcgagcccggcucccaggccugccucgccaucgacccccucgucggcgaggagggcggcgccgccgucgccaagcucgagccccaccuccagccccgcggccagcccgccccccagccccuccacacccucguccucgccgccgaggagggcgcccucgucgccgccgucgagcccggcccccucgccgacggcgccgccguccgccucgcccucgccggcgagggcgaggccugcccccuccucggcucccccggcgccggccgcaacuccguccucuuccuccccgucgaccccgaggacuccccccucggcuccuccacccccauggccucccccgaccuccuccccgaggacguccgcgagcaccucgagggccucaugcucucccucuucgagcagucccucuccugccaggcccagggcggcugcucccgccccgccaugguccucaccgacccccacacccccuacgaggaggagcagcgccaguccguccaguccgaccagggcuacaucucccgcuccuccccccagccccccgagggccucaccgagauggaggaggaggaggaggaggagcaggaccccggcaagcccgcccucccccucucccccgaggaccucgagucccuccgcucccuccagcgccagcuccucuuccgccagcuccagaagaacuccggcugggacaccaugggcuccgaguccgagggccccuccgccuga

SEQ ID NO: 44585 - RNA, 1509 nt, Artificial Sequence
  derived and/or modified sequence opt2 from IL17RB__Homo_sapiens__NP_061195
augucccucguccuccucucccucgccgcccucugccgcuccgccgucccccgcgagcccaccguccagugcggcuccgagaccggccccucccccgaguggaugcuccagcacgaccucauccccggcgaccuccgcgaccuccgcgucgagcccgucaccaccuccgucgccaccggcgacuacuccauccucaugaacgucuccuggguccuccgcgccgacgccuccauccgccuccucaaggccaccaagaucugcgucaccggcaaguccaacuuccaguccuacuccugcguccgcugcaacuacaccgaggccuuccagacccagacccgccccuccggcggcaaguggaccuucuccuacaucggcuuccccgucgagcucaacaccgucuacuucaucggcgcccacaacauccccaacgccaacaugaacgaggacggccccuccauguccgucaacuucaccucccccggcugccucgaccacaucaugaaguacaagaagaagugcgucaaggccggcucccucugggaccccaacaucaccgccugcaagaagaacgaggagaccgucgaggucaacuucaccaccaccccccucggcaaccgcuacauggcccucauccagcacuccaccaucaucggcuucucccaggucuucgagccccaccagaagaagcagacccgcgccuccgucgucauccccgucaccggcgacuccgagggcgccaccguccagcucacccccuacuuccccaccugcggcuccgacugcauccgccacaagggcaccgucguccucugcccccagaccggcguccccuucccccucgacaacaacaaguccaagcccggcggcuggcucccccuccuccuccucucccuccucgucgccaccuggguccucgucgccggcaucuaccucauguggcgccacgagcgcaucaagaagaccuccuucuccaccaccacccuccucccccccaucaagguccucgucgucuaccccuccgagaucugcuuccaccacaccaucugcuacuucaccgaguuccuccagaaccacugccgcuccgaggucauccucgagaaguggcagaagaagaagaucgccgagaugggccccguccaguggcucgccacccagaagaaggccgccgacaaggucgucuuccuccucuccaacgacgucaacuccgucugcgacggcaccugcggcaaguccgagggcucccccuccgagaacucccaggaccucuucccccucgccuucaaccucuucugcuccgaccuccgcucccagauccaccuccacaaguacgucgucgucuacuuccgcgagaucgacaccaaggacgacuacaacgcccucuccgucugccccaaguaccaccucaugaaggacgccaccgccuucugcgccgagcuccuccacgucaagcagcaggucuccgccggcaagcgcucccaggccugccacgacggcugcugcucccucuga

SEQ ID NO: 44586 - RNA, 2124 nt, Artificial Sequence
  derived and/or modified sequence opt2 from IL17RC__Homo_sapiens__NP_001190192
augcccguccccugguuccuccucucccucgcccucggccgcucccccgucguccucucccucgagcgccucgucggcccccaggacgccacccacugcucccccggccucuccugccgccucugggacuccgacauccucugccuccccggcgacaucguccccgcccccggccccguccucgcccccacccaccuccagaccgagcucguccuccgcugccagaaggagaccgacugcgaccucugccuccgcgucgccguccaccucgccguccacggccacugggaggagcccgaggacgaggagaaguucggcggcgccgccgacuccggcgucgaggagccccgcaacgccucccuccaggcccaggucguccucuccuuccaggccuaccccaccgcccgcugcguccuccucgagguccagguccccgccgcccucguccaguucggccaguccgucggcuccgucgucuacgacugcuucgaggccgcccucggcuccgagguccgcaucugguccuacacccagccccgcuacgagaaggagcucaaccacacccagcagcuccccgacugccgcggccucgaggucuggaacuccauccccuccugcugggcccuccccuggcucaacgucuccgccgacggcgacaacguccaccucguccucaacgucuccgaggagcagcacuucggccucucccucuacuggaaccagguccagggcccccccaagccccgcuggcacaagaaccucaccggcccccagaucaucacccucaaccacaccgaccucguccccugccucugcauccaggucuggccccucgagcccgacuccguccgcaccaacaucugccccuuccgcgaggacccccgcgcccaccagaaccucuggcaggccgcccgccuccgccuccucacccuccaguccuggcuccucgacgcccccugcucccuccccgccgaggccgcccucugcuggcgcgcccccggcggcgaccccugccagccccucguccccccccucuccugggagaacgucaccgucgacaagguccucgaguucccccuccucaagggccaccccaaccucugcguccaggucaacuccuccgagaagcuccagcuccaggagugccucugggccgacucccucggcccccucaaggacgacguccuccuccucgagacccgcggcccccaggacaaccgcucccucugcgcccucgagcccuccggcugcaccucccuccccuccaaggccuccacccgcgccgcccgccucggcgaguaccuccuccaggaccuccaguccggccagugccuccagcucugggacgacgaccucggcgcccucugggccugccccauggacaaguacauccacaagcgcugggcccucgucuggcucgccugccuccucuucgccgccgcccucucccucauccuccuccucaagaaggaccacgccaaggccgccgcccgcggccgcgccgcccuccuccucuacuccgccgacgacuccggcuucgagcgccucgucggcgcccucgccuccgcccucugccagcucccccuccgcgucgccgucgaccucuggucccgccgcgagcucuccgcccagggccccgucgccugguuccacgcccagcgccgccagacccuccaggagggcggcgucgucguccuccucuucucccccggcgccgucgcccucugcuccgaguggcuccaggacggcgucuccggccccggcgcccacggcccccacgacgccuuccgcgccucccucuccugcguccuccccgacuuccuccagggccgcgcccccggcuccuacgucggcgccugcuucgaccgccuccuccaccccgacgccguccccgcccucuuccgcaccguccccgucuucacccuccccucccagcuccccgacuuccucggcgcccuccagcagccccgcgccccccgcuccggccgccuccaggagcgcgccgagcaggucucccgcgcccuccagcccgcccucgacuccuacuuccacccccccggcacccccgcccccggccgcggcgucggccccggcgccggccccggcgccggcgacggcaccuga

SEQ ID NO: 44587 - RNA, 2220 nt, Artificial Sequence
  derived and/or modified sequence opt2 from IL17RD__Homo_sapiens__NP_060033
auggcccccuggcuccagcucugcuccgucuucuucaccgucaacgccugccucaacggcucccagcucgccgucgccgccggcggcuccggccgcgcccgcggcgccgacaccugcggcuggcgcggcgucggccccgccucccgcaacuccggccucuacaacaucaccuucaaguacgacaacugcaccaccuaccucaaccccgucggcaagcacgucaucgccgacgcccagaacaucaccaucucccaguacgccugccacgaccaggucgccgucaccauccucuggucccccggcgcccucggcaucgaguuccucaagggcuuccgcgucauccucgaggagcucaaguccgagggccgccagugccagcagcucauccucaaggaccccaagcagcucaacuccuccuucaagcgcaccggcauggagucccagcccuuccucaacaugaaguucgagaccgacuacuucgucaaggucguccccuuccccuccaucaagaacgaguccaacuaccaccccuucuucuuccgcacccgcgccugcgaccuccuccuccagcccgacaaccucgccugcaagcccuucuggaagccccgcaaccucaacaucucccagcacggcuccgacaugcaggucuccuucgaccacgccccccacaacuucggcuuccgcuucuucuaccuccacuacaagcucaagcacgagggccccuucaagcgcaagaccugcaagcaggagcagaccaccgagaccaccuccugccuccuccagaacgucucccccggcgacuacaucaucgagcucgucgacgacaccaacaccacccgcaaggucaugcacuacgcccucaagcccguccacucccccugggccggccccauccgcgccgucgccaucaccgucccccucgucgucaucuccgccuucgccacccucuucaccgucaugugccgcaagaagcagcaggagaacaucuacucccaccucgacgaggaguccuccgaguccuccaccuacaccgccgcccucccccgcgagcgccuccgcccccgccccaaggucuuccucugcuacuccuccaaggacggccagaaccacaugaacgucguccagugcuucgccuacuuccuccaggacuucugcggcugcgaggucgcccucgaccucugggaggacuucucccucugccgcgagggccagcgcgagugggucauccagaagauccacgagucccaguucaucaucgucgucugcuccaagggcaugaaguacuucgucgacaagaagaacuacaagcacaagggcggcggccgcggcuccggcaagggcgagcucuuccucgucgccgucuccgccaucgccgagaagcuccgccaggccaagcaguccuccuccgccgcccucuccaaguucaucgccgucuacuucgacuacuccugcgagggcgacguccccggcauccucgaccucuccaccaaguaccgccucauggacaaccucccccagcucugcucccaccuccacucccgcgaccacggccuccaggagcccggccagcacacccgccagggcucccgccgcaacuacuuccgcuccaaguccggccgcucccucuacgucgccaucugcaacaugcaccaguucaucgacgaggagcccgacugguucgagaagcaguucguccccuuccacccccccccccuccgcuaccgcgagcccguccucgagaaguucgacuccggccucguccucaacgacgucaugugcaagcccggccccgaguccgacuucugccucaaggucgaggccgccguccucggcgccaccggccccgccgacucccagcacgagucccagcacggcggccucgaccaggacggcgaggcccgccccgcccucgacggcuccgccgcccuccagccccuccuccacaccgucaaggccggcucccccuccgacaugccccgcgacuccggcaucuacgacuccuccguccccuccuccgagcucucccucccccucauggagggccucuccaccgaccagaccgagaccuccucccucaccgaguccgucuccuccuccuccggccucggcgaggaggagccccccgcccuccccuccaagcuccucuccuccggcuccugcaaggccgaccucggcugccgcuccuacaccgacgagcuccacgccgucgccccccucuga

SEQ ID NO: 44588 - RNA, 1602 nt, Artificial Sequence
  derived and/or modified sequence opt2 from IL17RE__Homo_sapiens__NP_001180309
augggcuccucccgccucgccgcccuccuccucccccuccuccucaucgucaucgaccucuccgacuccgccggcaucggcuuccgccaccucccccacuggaacacccgcugcccccucgccucccacaccgacgacuccuucaccggcuccuccgccuacauccccugccgcaccuggugggcccucuucuccaccaagcccuggugcguccgcgucuggcacugcucccgcugccucugccagcaccuccucuccggcggcuccggccuccagcgcggccucuuccaccuccucguccagaaguccaagaaguccuccaccuucaaguucuaccgccgccacaagaugcccgcccccgcccagcgcaagcuccucccccgccgccaccucuccgagaagucccaccacaucuccauccccucccccgacaucucccacaagggccuccgcuccaagcgcacccagcccuccgaccccgagaccugggagucccucccccgccucgacucccagcgccacggcggccccgaguucuccuucgaccuccuccccgaggcccgcgccauccgcgucaccaucuccuccggccccgaggucuccguccgccucugccaccagugggcccucgagugcgaggagcucuccucccccuacgacguccagaagaucgucuccggcggccacaccgucgagcuccccuacgaguuccuccuccccugccucugcaucgaggccuccuaccuccaggaggacaccguccgccgcaagaagugccccuuccaguccuggcccgaggccuacggcuccgacuucuggaaguccguccacuucaccgacuacucccagcacacccagauggucauggcccucacccuccgcugcccccucaagcucgaggccgcccucugccagcgccacgacuggcacacccucugcaaggaccuccccaacgccaccgcccgcgaguccgacggcugguacguccucgagaaggucgaccuccacccccagcucugcuucaaguucuccuucggcaacuccucccacgucgagugcccccaccagaccggcucccucaccuccuggaacgucuccauggacacccaggcccagcagcucauccuccacuucuccucccgcaugcacgccaccuucuccgccgccuggucccuccccggccucggccaggacacccucgucccccccgucuacaccgucucccaggcccgcggcuccucccccgucucccucgaccucaucauccccuuccuccgccccggcugcugcguccuccuccacgccucccucuccucccccggcggcgaggacgccuggcucaucggcgucggcggcuccguccccuccggcgucgccguccgcugccccgucugccucgaggccccccucgucuccggcugccuccuccagacccccggcgcccucgaccccggcaccgccggccccccccaccccaccggcugcugcuccggcccccaccuccccgcccccaccguccgccccggccccuccgccgccuccgccccccccgcccgcggcggccucggcggcgccgccgcccccggcggcuccgccggcuga

SEQ ID NO: 44589 - RNA, 1011 nt, Artificial Sequence
  derived and/or modified sequence opt2 from IL17REL__Homo_sapiens__NP_001001694
augucccgcuccguccucgaggcccucaccuccuccaccgccaugcagugcguccccuccgacggcugcgccaugcuccuccgcguccgcgccuccaucacccuccacgagcgccuccgcggccucgaggccugcgccaugucccucgacacccaggagacccagugccaguccgucugggucgcccgcgccucccaccgccagcagggcggccagcagcuccagguccacuucggcugcuucgccgucuccgucgcccagcaccucuacgucacccuccgcaccaucccccacuucugcggcguccagcucgaccagcgccaccucgucgaggccggcaagcucuccuacugggucgaccgccgccgcaaggccauccucguccaggucccccgcgccuccggcucccccgacuacuaccuccgccucugccucaagcgcuucaccugcgaggacgccggcgcccccguccgcgucaccgccaacuccgucucccaggccgucuuccuccccuacucccaggagcuccccugccucugccucgagggcugguccgccacccccgacgccguccgcauccagaucugccccuucgagaacgacaccgaggcccucgagguccucugggacaccgucuacuaccaccccgagucccagacccucuccugggagcccgccugccccgucuccggccacgucucccucugcuggcgccccggccccggcgccggcugccgcaagcuccagcaguccucccagcucguccaccgccgcguccaguacccccucgucgacacccagccccagcucugccucaaguucuccaccuccuggggcuccuggguccgcugccccuucgagcagcgccgcuuccccaccccccccaccucccgcugcaccugcgucaccggcggcucccacuccucccuccccgccaacgcccacucccgccccgcccgcucccuccagccccaggucaccuggcagcccccccuccuccuccccuccuga

SEQ ID NO: 44590 - RNA, 585 nt, Artificial Sequence
  derived and/or modified sequence opt2 from IL18BP__Homo_sapiens__NP_001034749
augaccaugcgccacaacuggacccccgaccucuccccccucuggguccuccuccucugcgcccacgucgucacccuccucguccgcgccacccccgucucccagaccaccaccgccgccaccgccuccguccgcuccaccaaggaccccugccccucccagccccccgucuuccccgccgccaagcagugccccgcccucgaggucaccuggcccgaggucgaggucccccucaacggcacccucucccucuccugcgucgccugcucccgcuuccccaacuucuccauccucuacuggcucggcaacggcuccuucaucgagcaccuccccggccgccucugggagggcuccaccucccgcgagcgcggcuccaccggcacccagcucugcaaggcccucguccucgagcagcucacccccgcccuccacuccaccaacuucuccugcguccucgucgaccccgagcaggucguccagcgccacgucguccucgcccagcucugggccggccuccgcgccacccucccccccacccaggaggcccuccccuccucccacuccuccccccagcagcagggcuga

SEQ ID NO: 44591 - RNA, 570 nt, Artificial Sequence
  derived and/or modified sequence opt2 from IL18__Homo_sapiens__NP_001230140
auggccgccgagcccgucgaggacaacugcaucaacuucgucgccaugaaguucaucgacaacacccucuacuucaucgagaaccucgaguccgacuacuucggcaagcucgaguccaagcucuccgucauccgcaaccucaacgaccagguccucuucaucgaccagggcaaccgcccccucuucgaggacaugaccgacuccgacugccgcgacaacgccccccgcaccaucuucaucaucuccauguacaaggacucccagccccgcggcauggccgucaccaucuccgucaagugcgagaagaucuccacccucuccugcgagaacaagaucaucuccuucaaggagaugaacccccccgacaacaucaaggacaccaaguccgacaucaucuucuuccagcgcuccguccccggccacgacaacaagaugcaguucgaguccuccuccuacgagggcuacuuccucgccugcgagaaggagcgcgaccucuucaagcucauccucaagaaggaggacgagcucggcgaccgcuccaucauguucaccguccagaacgaggacuga

SEQ ID NO: 44592 - RNA, 1626 nt, Artificial Sequence
  derived and/or modified sequence opt2 from IL18R1__Homo_sapiens__NP_003846
augaacugccgcgagcucccccucacccucuggguccucaucuccgucuccaccgccgaguccugcaccucccgcccccacaucaccgucgucgagggcgagcccuucuaccucaagcacugcuccugcucccucgcccacgagaucgagaccaccaccaaguccugguacaaguccuccggcucccaggagcacgucgagcucaacccccgcuccuccucccgcaucgcccuccacgacugcguccucgaguucuggcccgucgagcucaacgacaccggcuccuacuucuuccagaugaagaacuacacccagaaguggaagcucaacgucauccgccgcaacaagcacuccugcuucaccgagcgccaggucaccuccaagaucgucgaggucaagaaguucuuccagaucaccugcgagaacuccuacuaccagacccucgucaacuccaccucccucuacaagaacugcaagaagcuccuccucgagaacaacaagaaccccaccaucaagaagaacgccgaguucgaggaccagggcuacuacuccugcguccacuuccuccaccacaacggcaagcucuucaacaucaccaagaccuucaacaucaccaucgucgaggaccgcuccaacaucguccccguccuccucggccccaagcucaaccacgucgccgucgagcucggcaagaacguccgccucaacugcuccgcccuccucaacgaggaggacgucaucuacuggauguucggcgaggagaacggcuccgaccccaacauccacgaggagaaggagaugcgcaucaugacccccgagggcaaguggcacgccuccaagguccuccgcaucgagaacaucggcgaguccaaccucaacguccucuacaacugcaccgucgccuccaccggcggcaccgacaccaaguccuucauccucguccgcaaggccgacauggccgacauccccggccacgucuucacccgcggcaugaucaucgccguccucauccucgucgccgucgucugccucgucaccgucugcgucaucuaccgcgucgaccucguccucuucuaccgccaccucacccgccgcgacgagacccucaccgacggcaagaccuacgacgccuucgucuccuaccucaaggagugccgccccgagaacggcgaggagcacaccuucgccgucgagauccucccccgcguccucgagaagcacuucggcuacaagcucugcaucuucgagcgcgacgucguccccggcggcgccgucgucgacgagauccacucccucaucgagaagucccgccgccucaucaucguccucuccaaguccuacauguccaacgagguccgcuacgagcucgaguccggccuccacgaggcccucgucgagcgcaagaucaagaucauccucaucgaguucacccccgucaccgacuucaccuuccucccccagucccucaagcuccucaagucccaccgcguccucaaguggaaggccgacaagucccucuccuacaacucccgcuucuggaagaaccuccucuaccucaugcccgccaagaccgucaagcccggccgcgacgagcccgagguccuccccguccucuccgaguccuga

SEQ ID NO: 44593 - RNA, 1800 nt, Artificial Sequence
  derived and/or modified sequence opt2 from IL18RAP__Homo_sapiens__NP_003844
augcucugccucggcuggaucuuccucuggcucgucgccggcgagcgcaucaagggcuucaacaucuccggcugcuccaccaagaagcuccucuggaccuacuccacccgcuccgaggaggaguucguccucuucugcgaccuccccgagccccagaagucccacuucugccaccgcaaccgccucucccccaagcagguccccgagcaccuccccuucaugggcuccaacgaccucuccgacguccagugguaccagcagcccuccaacggcgacccccucgaggacauccgcaaguccuacccccacaucauccaggacaagugcacccuccacuuccucacccccggcgucaacaacuccggcuccuacaucugccgccccaagaugaucaagucccccuacgacgucgccugcugcgucaagaugauccucgaggucaagccccagaccaacgccuccugcgaguacuccgccucccacaagcaggaccuccuccucggcuccaccggcuccaucuccugccccucccucuccugccaguccgacgcccagucccccgccgucaccugguacaagaacggcaagcuccucuccgucgagcgcuccaaccgcaucgucgucgacgaggucuacgacuaccaccagggcaccuacgucugcgacuacacccaguccgacaccgucuccuccuggaccguccgcgccgucguccagguccgcaccaucgucggcgacaccaagcucaagcccgacauccucgaccccgucgaggacacccucgaggucgagcucggcaagccccucaccaucuccugcaaggcccgcuucggcuucgagcgcgucuucaaccccgucaucaagugguacaucaaggacuccgaccucgagugggaggucuccguccccgaggccaaguccaucaaguccacccucaaggacgagaucaucgagcgcaacaucauccucgagaaggucacccagcgcgaccuccgccgcaaguucgucugcuucguccagaacuccaucggcaacaccacccaguccguccagcucaaggagaagcgcggcgucguccuccucuacauccuccucggcaccaucggcacccucgucgccguccucgccgccuccgcccuccucuaccgccacuggaucgagaucguccuccucuaccgcaccuaccaguccaaggaccagacccucggcgacaagaaggacuucgacgccuucgucuccuacgccaagugguccuccuuccccuccgaggccaccuccucccucuccgaggagcaccucgcccucucccucuuccccgacguccucgagaacaaguacggcuacucccucugccuccucgagcgcgacgucgcccccggcggcgucuacgccgaggacaucgucuccaucaucaagcgcucccgccgcggcaucuucauccucucccccaacuacgucaacggccccuccaucuucgagcuccaggccgccgucaaccucgcccucgacgaccagacccucaagcucauccucaucaaguucugcuacuuccaggagcccgagucccucccccaccucgucaagaaggcccuccgcguccuccccaccgucaccuggcgcggccucaaguccgucccccccaacucccgcuucugggccaagaugcgcuaccacaugcccgucaagaacucccagggcuucaccuggaaccagcuccgcaucaccucccgcaucuuccaguggaagggccucucccgcaccgagaccaccggccgcuccucccagcccaaggagugguga

SEQ ID NO: 44594 - RNA, 534 nt, Artificial Sequence
  derived and/or modified sequence opt2 from IL19__Homo_sapiens__NP_037503
augaagcuccagugcgucucccucuggcuccucggcaccauccucauccucugcuccgucgacaaccacggccuccgccgcugccucaucuccaccgacaugcaccacaucgaggaguccuuccaggagaucaagcgcgccauccaggccaaggacaccuuccccaacgucaccauccucuccacccucgagacccuccagaucaucaagccccucgacgucugcugcgucaccaagaaccuccucgccuucuacgucgaccgcgucuucaaggaccaccaggagcccaaccccaagauccuccgcaagaucuccuccaucgccaacuccuuccucuacaugcagaagacccuccgccagugccaggagcagcgccagugccacugccgccaggaggccaccaacgccacccgcgucauccacgacaacuacgaccagcucgagguccacgccgccgccaucaagucccucggcgagcucgacgucuuccucgccuggaucaacaagaaccacgaggucauguucuccgccuga

SEQ ID NO: 44595 - RNA, 816 nt, Artificial Sequence
  derived and/or modified sequence opt2 from IL1A__Homo_sapiens__NP_000566
auggccaagguccccgacauguucgaggaccucaagaacugcuacuccgagaacgaggaggacuccuccuccaucgaccaccucucccucaaccagaaguccuucuaccacgucuccuacggcccccuccacgagggcugcauggaccaguccgucucccucuccaucuccgagaccuccaagaccuccaagcucaccuucaaggaguccauggucgucgucgccaccaacggcaagguccucaagaagcgccgccucucccucucccaguccaucaccgacgacgaccucgaggccaucgccaacgacuccgaggaggagaucaucaagccccgcuccgcccccuucuccuuccucuccaacgucaaguacaacuucaugcgcaucaucaaguacgaguucauccucaacgacgcccucaaccaguccaucauccgcgccaacgaccaguaccucaccgccgccgcccuccacaaccucgacgaggccgucaaguucgacaugggcgccuacaaguccuccaaggacgacgccaagaucaccgucauccuccgcaucuccaagacccagcucuacgucaccgcccaggacgaggaccagcccguccuccucaaggagaugcccgagauccccaagaccaucaccggcuccgagaccaaccuccucuucuucugggagacccacggcaccaagaacuacuucaccuccgucgcccaccccaaccucuucaucgccaccaagcaggacuacugggucugccucgccggcggcccccccuccaucaccgacuuccagauccucgagaaccaggccuga

SEQ ID NO: 44596 - RNA, 810 nt, Artificial Sequence
  derived and/or modified sequence opt2 from IL1B__Homo_sapiens__NP_000567
auggccgagguccccgagcucgccuccgagaugauggccuacuacuccggcaacgaggacgaccucuucuucgaggccgacggccccaagcagaugaagugcuccuuccaggaccucgaccucugcccccucgacggcggcauccagcuccgcaucuccgaccaccacuacuccaagggcuuccgccaggccgccuccgucgucgucgccauggacaagcuccgcaagaugcucguccccugcccccagaccuuccaggagaacgaccucuccaccuucuuccccuucaucuucgaggaggagcccaucuucuucgacaccugggacaacgaggccuacguccacgacgcccccguccgcucccucaacugcacccuccgcgacucccagcagaagucccucgucauguccggccccuacgagcucaaggcccuccaccuccagggccaggacauggagcagcaggucgucuucuccauguccuucguccagggcgaggaguccaacgacaagauccccgucgcccucggccucaaggagaagaaccucuaccucuccugcguccucaaggacgacaagcccacccuccagcucgaguccgucgaccccaagaacuaccccaagaagaagauggagaagcgcuucgucuucaacaagaucgagaucaacaacaagcucgaguucgaguccgcccaguuccccaacugguacaucuccaccucccaggccgagaacaugcccgucuuccucggcggcaccaagggcggccaggacaucaccgacuucaccaugcaguucgucuccuccuga

SEQ ID NO: 44597 - RNA, 459 nt, Artificial Sequence
  derived and/or modified sequence opt2 from IL1F10__Homo_sapiens__NP_115945
augugcucccuccccauggcccgcuacuacaucaucaaguacgccgaccagaaggcccucuacacccgcgacggccagcuccucgucggcgaccccgucgccgacaacugcugcgccgagaagaucugcauccuccccaaccgcggccucgcccgcaccaagguccccaucuuccucggcauccagggcggcucccgcugccucgccugcgucgagaccgaggagggccccucccuccagcucgaggacgucaacaucgaggagcucuacaagggcggcgaggaggccacccgcuucaccuucuuccaguccuccuccggcuccgccuuccgccucgaggccgccgccuggcccggcugguuccucugcggccccgccgagccccagcagcccguccagcucaccaaggaguccgagcccuccgcccgcaccaaguucuacuucgagcaguccugguga

SEQ ID NO: 44598 - RNA, 1710 nt, Artificial Sequence
  derived and/or modified sequence opt2 from IL1R1__Homo_sapiens__XP_011509420
augaagguccuccuccgccucaucugcuucaucgcccuccucaucuccucccucgaggccgacaagugcaaggagcgcgaggagaagaucauccucgucuccuccgccaacgagaucgacguccgccccugcccccucaaccccaacgagcacaagggcaccaucaccugguacaaggacgacuccaagacccccgucuccaccgagcaggccucccgcauccaccagcacaaggagaagcucugguucguccccgccaaggucgaggacuccggccacuacuacugcgucguccgcaacuccuccuacugccuccgcaucaagaucuccgccaaguucgucgagaacgagcccaaccucugcuacaacgcccaggccaucuucaagcagaagcuccccgucgccggcgacggcggccucgucugccccuacauggaguucuucaagaacgagaacaacgagcuccccaagcuccagugguacaaggacugcaagccccuccuccucgacaacauccacuucuccggcgucaaggaccgccucaucgucaugaacgucgccgagaagcaccgcggcaacuacaccugccacgccuccuacaccuaccucggcaagcaguaccccaucacccgcgucaucgaguucaucacccucgaggagaacaagcccacccgccccgucaucgucucccccgccaacgagaccauggaggucgaccucggcucccagauccagcucaucugcaacgucaccggccagcucuccgacaucgccuacuggaaguggaacggcuccgucaucgacgaggacgaccccguccucggcgaggacuacuacuccgucgagaaccccgccaacaagcgccgcuccacccucaucaccguccucaacaucuccgagaucgagucccgcuucuacaagcaccccuucaccugcuucgccaagaacacccacggcaucgacgccgccuacauccagcucaucuaccccgucaccaacuuccagaagcacaugaucggcaucugcgucacccucaccgucaucaucgucugcuccgucuucaucuacaagaucuucaagaucgacaucguccucugguaccgcgacuccugcuacgacuuccuccccaucaaggccuccgacggcaagaccuacgacgccuacauccucuaccccaagaccgucggcgagggcuccaccuccgacugcgacaucuucgucuucaagguccuccccgagguccucgagaagcagugcggcuacaagcucuucaucuacggccgcgacgacuacgucggcgaggacaucgucgaggucaucaacgagaacgucaagaagucccgccgccucaucaucauccucguccgcgagaccuccggcuucuccuggcucggcggcuccuccgaggagcagaucgccauguacaacgcccucguccaggacggcaucaaggucguccuccucgagcucgagaagauccaggacuacgagaagaugcccgaguccaucaaguucaucaagcagaagcacggcgccauccgcugguccggcgacuucacccagggcccccaguccgccaagacccgcuucuggaagaacguccgcuaccacaugcccguccagcgccgcucccccuccuccaagcaccagcuccucucccccgccaccaaggagaagcuccagcgcgaggcccacgucccccucggcuga

SEQ ID NO: 44599 - RNA, 1197 nt, Artificial Sequence
  derived and/or modified sequence opt2 from IL1R2__Homo_sapiens__NP_004624
augcuccgccucuacguccucgucaugggcgucuccgccuucacccuccagcccgccgcccacaccggcgccgcccgcuccugccgcuuccgcggccgccacuacaagcgcgaguuccgccucgagggcgagcccgucgcccuccgcugcccccagguccccuacuggcucugggccuccgucuccccccgcaucaaccucaccuggcacaagaacgacuccgcccgcaccguccccggcgaggaggagacccgcaugugggcccaggacggcgcccucuggcuccuccccgcccuccaggaggacuccggcaccuacgucugcaccacccgcaacgccuccuacugcgacaagauguccaucgagcuccgcgucuucgagaacaccgacgccuuccuccccuucaucuccuacccccagauccucacccucuccaccuccggcguccucgucugccccgaccucuccgaguucacccgcgacaagaccgacgucaagauccagugguacaaggacucccuccuccucgacaaggacaacgagaaguuccucuccguccgcggcaccacccaccuccucguccacgacgucgcccucgaggacgccggcuacuaccgcugcguccucaccuucgcccacgagggccagcaguacaacaucacccgcuccaucgagcuccgcaucaagaagaagaaggaggagaccauccccgucaucaucuccccccucaagaccaucuccgccucccucggcucccgccucaccauccccugcaaggucuuccucggcaccggcaccccccucaccaccaugcucugguggaccgccaacgacacccacaucgaguccgccuaccccggcggccgcgucaccgagggcccccgccaggaguacuccgagaacaacgagaacuacaucgaggucccccucaucuucgaccccgucacccgcgaggaccuccacauggacuucaagugcgucguccacaacacccucuccuuccagacccuccgcaccaccgucaaggaggccuccuccaccuucuccuggggcaucguccucgccccccucucccucgccuuccucguccucggcggcaucuggaugcaccgccgcugcaagcaccgcaccggcaaggccgacggccucaccguccucuggccccaccaccaggacuuccaguccuaccccaaguga

SEQ ID NO: 44600 - RNA, 1713 nt, Artificial Sequence
  derived and/or modified sequence opt2 from IL1RAP__Homo_sapiens__NP_001161401
augacccuccucuggugcgucgucucccucuacuucuacggcauccuccaguccgacgccuccgagcgcugcgacgacuggggccucgacaccaugcgccagauccaggucuucgaggacgagcccgcccgcaucaagugcccccucuucgagcacuuccucaaguucaacuacuccaccgcccacuccgccggccucacccucaucugguacuggacccgccaggaccgcgaccucgaggagcccaucaacuuccgccuccccgagaaccgcaucuccaaggagaaggacguccucugguuccgccccacccuccucaacgacaccggcaacuacaccugcaugcuccgcaacaccaccuacugcuccaaggucgccuucccccucgaggucguccagaaggacuccugcuucaacucccccaugaagcuccccguccacaagcucuacaucgaguacggcauccagcgcaucaccugccccaacgucgacggcuacuuccccuccuccgucaagcccaccaucaccugguacaugggcugcuacaagauccagaacuucaacaacgucauccccgagggcaugaaccucuccuuccucaucgcccucaucuccaacaacggcaacuacaccugcgucgucaccuaccccgagaacggccgcaccuuccaccucacccgcacccucaccgucaaggucgucggcucccccaagaacgccgucccccccgucauccacucccccaacgaccacgucgucuacgagaaggagcccggcgaggagcuccucauccccugcaccgucuacuucuccuuccucauggacucccgcaacgaggucugguggaccaucgacggcaagaagcccgacgacaucaccaucgacgucaccaucaacgaguccaucucccacucccgcaccgaggacgagacccgcacccagauccucuccaucaagaaggucaccuccgaggaccucaagcgcuccuacgucugccacgcccgcuccgccaagggcgaggucgccaaggccgccaaggucaagcagaagguccccgccccccgcuacaccgucgagcucgccugcggcuucggcgccaccguccuccucgucgucauccucaucgucgucuaccacgucuacuggcucgagaugguccucuucuaccgcgcccacuucggcaccgacgagaccauccucgacggcaaggaguacgacaucuacgucuccuacgcccgcaacgccgaggaggaggaguucguccuccucacccuccgcggcguccucgagaacgaguucggcuacaagcucugcaucuucgaccgcgacucccuccccggcggcaucgucaccgacgagacccucuccuucauccagaagucccgccgccuccucgucguccucucccccaacuacguccuccagggcacccaggcccuccucgagcucaaggccggccucgagaacauggccucccgcggcaacaucaacgucauccucguccaguacaaggccgucaaggagaccaaggucaaggagcucaagcgcgccaagaccguccucaccgucaucaaguggaagggcgagaaguccaaguacccccagggccgcuucuggaagcagcuccaggucgccaugcccgucaagaaguccccccgccgcuccuccuccgacgagcagggccucuccuacuccucccucaagaacgucuga

SEQ ID NO: 44601 - RNA, 2091 nt, Artificial Sequence
  derived and/or modified sequence opt2 from IL1RAPL1__Homo_sapiens__XP_005274498
augaaggcccccaucccccaccucauccuccucuacgccaccuucacccagucccucaaggucgucaccaagcgcggcuccgccgacggcugcaccgacugguccaucgacaucaagaaguaccagguccucgucggcgagcccguccgcaucaagugcgcccucuucuacggcuacauccgcaccaacuacucccucgcccaguccgccggccucucccucaugugguacaaguccuccggccccggcgacuucgaggagcccaucgccuucgacggcucccgcauguccaaggaggaggacuccaucugguuccgccccacccuccuccaggacuccggccucuacgccugcgucauccgcaacuccaccuacugcaugaaggucuccaucucccucaccgucggcgagaacgacaccggccucugcuacaacuccaagaugaaguacuucgagaaggccgagcucuccaaguccaaggagaucuccugccgcgacaucgaggacuuccuccuccccacccgcgagcccgagauccucugguacaaggagugccgcaccaagaccuggcgccccuccaucgucuucaagcgcgacacccuccucauccgcgagguccgcgaggacgacaucggcaacuacaccugcgagcucaaguacggcggcuucgucguccgccgcaccaccgagcucaccgucaccgccccccucaccgacaagccccccaagcuccucuaccccauggaguccaagcucaccauccaggagacccagcucggcgacuccgccaaccucaccugccgcgccuucuucggcuacuccggcgacgucuccccccucaucuacuggaugaagggcgagaaguucaucgaggaccucgacgagaaccgcgucugggaguccgacauccgcauccucaaggagcaccucggcgagcaggaggucuccaucucccucaucgucgacuccgucgaggagggcgaccucggcaacuacuccugcuacgucgagaacggcaacggccgccgccacgccuccguccuccuccacaagcgcgagcucauguacaccgucgagcucgccggcggccucggcgccauccuccuccuccucgucugccucgucaccaucuacaagugcuacaagaucgagaucaugcucuucuaccgcaaccacuucggcgccgaggagcucgacggcgacaacaaggacuacgacgccuaccucuccuacaccaaggucgaccccgaccaguggaaccaggagaccggcgaggaggagcgcuucgcccucgagauccuccccgacaugcucgagaagcacuacggcuacaagcucuucauccccgaccgcgaccucauccccaccggcaccuacaucgaggacgucgcccgcugcgucgaccaguccaagcgccucaucaucgucaugacccccaacuacgucguccgccgcggcugguccaucuucgagcucgagacccgccuccgcaacaugcucgucaccggcgagaucaaggucauccucaucgagugcuccgagcuccgcggcaucaugaacuaccaggaggucgaggcccucaagcacaccaucaagcuccucaccgucaucaaguggcacggccccaagugcaacaagcucaacuccaaguucuggaagcgccuccaguacgagaugcccuucaagcgcaucgagcccaucacccacgagcaggcccucgacgucuccgagcagggccccuucggcgagcuccagaccgucuccgccaucuccauggccgccgccaccuccaccgcccucgccaccgcccaccccgaccuccgcuccaccuuccacaacaccuaccacucccagaugcgccagaagcacuacuaccgcuccuacgaguacgacgucccccccaccggcacccucccccucaccuccaucggcaaccagcacaccuacugcaacauccccaugacccucaucaacggccagcgcccccagaccaaguccucccgcgagcagaaccccgacgaggcccacaccaacuccgccauccucccccuccucccccgcgagaccuccaucuccuccgucaucugguga

SEQ ID NO: 44602 - RNA, 2061 nt, Artificial Sequence
  derived and/or modified sequence opt2 from IL1RAPL2__Homo_sapiens__NP_059112
augaagccccccuuccuccucgcccucgucgucugcuccgucgucuccaccaaccucaagauggucuccaagcgcaacuccgucgacggcugcaucgacugguccgucgaccucaagaccuacauggcccucgccggcgagcccguccgcgucaagugcgcccucuucuacuccuacauccgcaccaacuacuccaccgcccaguccaccggccuccgccucaugugguacaagaacaagggcgaccucgaggagcccaucaucuucuccgagguccgcauguccaaggaggaggacuccaucugguuccacuccgccgaggcccaggacuccggcuucuacaccugcguccuccgcaacuccaccuacugcaugaaggucuccaugucccucaccgucgccgagaacgaguccggccucugcuacaacucccgcauccgcuaccucgagaaguccgaggucaccaagcgcaaggagaucuccugccccgacauggacgacuucaagaaguccgaccaggagcccgacgucgucugguacaaggagugcaagcccaagauguggcgcuccaucaucauccagaagggcaacgcccuccucauccaggagguccaggaggaggacggcggcaacuacaccugcgagcucaaguacgagggcaagcucguccgccgcaccaccgagcucaaggucaccgcccuccucaccgacaagccccccaagccccucuuccccauggagaaccagcccuccgucaucgacguccagcucggcaagccccucaacauccccugcaaggccuucuucggcuucuccggcgaguccggccccaugaucuacuggaugaagggcgagaaguucaucgaggagcucgccggccacauccgcgagggcgagauccgccuccucaaggagcaccucggcgagaaggaggucgagcucgcccucaucuucgacuccgucgucgaggccgaccucgccaacuacaccugccacgucgagaaccgcaacggccgcaagcacgccuccguccuccuccgcaagaaggaccucaucuacaagaucgagcucgccggcggccucggcgccaucuuccuccuccucguccuccucgucgucaucuacaagugcuacaacaucgagcucaugcucuucuaccgccagcacuucggcgccgacgagaccaacgacgacaacaaggaguacgacgccuaccucuccuacaccaaggucgaccaggacacccucgacugcgacaaccccgaggaggagcaguucgcccucgagguccuccccgacguccucgagaagcacuacggcuacaagcucuucauccccgagcgcgaccucauccccuccggcaccuacauggaggaccucacccgcuacgucgagcagucccgccgccucaucaucguccucacccccgacuacauccuccgccgcggcugguccaucuucgagcucgagucccgccuccacaacaugcucgucuccggcgagaucaaggucauccucaucgagugcaccgagcucaagggcaaggucaacugccaggaggucgagucccucaagcgcuccaucaagcuccucucccucaucaaguggaagggcuccaaguccuccaagcucaacuccaaguucuggaagcaccucgucuacgagaugcccaucaagaagaaggagaugcucccccgcugccacguccucgacuccgccgagcagggccucuucggcgagcuccagcccauccccuccaucgccaugaccuccaccuccgccacccucgucuccucccaggccgaccuccccgaguuccaccccuccgacuccaugcagauccgccacugcugccgcggcuacaagcacgagauccccgccaccacccuccccguccccucccucggcaaccaccacaccuacugcaaccucccccucacccuccucaacggccagcucccccucaacaacacccucaaggacacccaggaguuccaccgcaacuccucccuccucccccucuccuccaaggagcucuccuucaccuccgacaucugguga

SEQ ID NO: 44603 - RNA, 636 nt, Artificial Sequence
  derived and/or modified sequence opt2 from IL1RL1__Homo_sapiens__NP_001269337
auguacuccaccgucuccggcuccgagaagaacuccaagaucuacugccccaccaucgaccucuacaacuggaccgccccccucgagugguucaagaacugccaggcccuccagggcucccgcuaccgcgcccacaaguccuuccucgucaucgacaacgucaugaccgaggacgccggcgacuacaccugcaaguucauccacaacgagaacggcgccaacuacuccgucaccgccacccgcuccuucaccgucaaggacgagcagggcuucucccucuuccccgucaucggcgcccccgcccagaacgagaucaaggaggucgagaucggcaagaacgccaaccucaccugcuccgccugcuucggcaagggcacccaguuccucgccgccguccucuggcagcucaacggcaccaagaucaccgacuucggcgagccccgcauccagcaggaggagggccagaaccaguccuucuccaacggccucgccugccucgacaugguccuccgcaucgccgacgucaaggaggaggaccuccuccuccaguacgacugccucgcccucaaccuccacggccuccgccgccacaccguccgccucucccgcaagaaccccuccaaggagugcuucuga

SEQ ID NO: 44604 - RNA, 1728 nt, Artificial Sequence
  derived and/or modified sequence opt2 from IL1RL2__Homo_sapiens__NP_003845
auguggucccuccuccucugcggccucuccaucgcccucccccucuccgucaccgccgacggcugcaaggacaucuucaugaagaacgagauccucuccgccucccagcccuucgccuucaacugcaccuucccccccaucaccuccggcgaggucuccgucaccugguacaagaacuccuccaagauccccgucuccaagaucauccagucccgcauccaccaggacgagaccuggauccucuuccuccccauggaguggggcgacuccggcgucuaccagugcgucaucaagggccgcgacuccugccaccgcauccacgucaaccucaccgucuucgagaagcacuggugcgacaccuccaucggcggccuccccaaccucuccgacgaguacaagcagauccuccaccucggcaaggacgacucccucaccugccaccuccacuuccccaaguccugcguccucggccccaucaagugguacaaggacugcaacgagaucaagggcgagcgcuucaccguccucgagacccgccuccucgucuccaacgucuccgccgaggaccgcggcaacuacgccugccaggccauccucacccacuccggcaagcaguacgagguccucaacggcaucaccgucuccaucaccgagcgcgccggcuacggcggcuccguccccaagaucaucuaccccaagaaccacuccaucgagguccagcucggcaccacccucaucgucgacugcaacgucaccgacaccaaggacaacaccaaccuccgcugcuggcgcgucaacaacacccucgucgacgacuacuacgacgaguccaagcgcauccgcgagggcgucgagacccacgucuccuuccgcgagcacaaccucuacaccgucaacaucaccuuccucgaggucaagauggaggacuacggccuccccuucaugugccacgccggcgucuccaccgccuacaucauccuccagcuccccgcccccgacuuccgcgccuaccucaucggcggccucaucgcccucgucgccgucgccgucuccgucgucuacaucuacaacaucuucaagaucgacaucguccucugguaccgcuccgccuuccacuccaccgagaccaucgucgacggcaagcucuacgacgccuacguccucuaccccaagccccacaaggagucccagcgccacgccgucgacgcccucguccucaacauccuccccgagguccucgagcgccagugcggcuacaagcucuucaucuucggccgcgacgaguuccccggccaggccgucgccaacgucaucgacgagaacgucaagcucugccgccgccucaucgucaucgucguccccgagucccucggcuucggccuccucaagaaccucuccgaggagcagaucgccgucuacuccgcccucauccaggacggcaugaaggucauccucaucgagcucgagaagaucgaggacuacaccgucaugcccgaguccauccaguacaucaagcagaagcacggcgccauccgcuggcacggcgacuucaccgagcagucccagugcaugaagaccaaguucuggaagaccguccgcuaccacaugcccccccgccgcugccgccccuucccccccguccagcuccuccagcacacccccugcuaccgcaccgccggccccgagcucggcucccgccgcaagaagugcacccucaccaccggcuga

SEQ ID NO: 44605 - RNA, 480 nt, Artificial Sequence
  derived and/or modified sequence opt2 from IL1RN__Homo_sapiens__NP_000568
auggcccucgagaccaucugccgccccuccggccgcaaguccuccaagaugcaggccuuccgcaucugggacgucaaccagaagaccuucuaccuccgcaacaaccagcucgucgccggcuaccuccagggccccaacgucaaccucgaggagaagaucgacgucguccccaucgagccccacgcccucuuccucggcauccacggcggcaagaugugccucuccugcgucaaguccggcgacgagacccgccuccagcucgaggccgucaacaucaccgaccucuccgagaaccgcaagcaggacaagcgcuucgccuucauccgcuccgacuccggccccaccaccuccuucgaguccgccgccugccccggcugguuccucugcaccgccauggaggccgaccagcccgucucccucaccaacaugcccgacgagggcgucauggucaccaaguucuacuuccaggaggacgaguga

SEQ ID NO: 44606 - RNA, 531 nt, Artificial Sequence
  derived and/or modified sequence opt2 from IL20__Homo_sapiens__NP_061194
augaaggccuccucccucgccuucucccuccucuccgccgccuucuaccuccucuggacccccuccaccggccucaagacccucaaccucggcuccugcgucaucgccaccaaccuccaggagauccgcaacggcuucuccgagauccgcggcuccguccaggccaaggacggcaacaucgacauccgcauccuccgccgcaccgagucccuccaggacaccaagcccgccaaccgcugcugccuccuccgccaccuccuccgccucuaccucgaccgcgucuucaagaacuaccagacccccgaccacuacacccuccgcaagaucuccucccucgccaacuccuuccucaccaucaagaaggaccuccgccucugccacgcccacaugaccugccacugcggcgaggaggccaugaagaaguacucccagauccucucccacuucgagaagcucgagccccaggccgccgucgucaaggcccucggcgagcucgacauccuccuccaguggauggaggagaccgaguga

SEQ ID NO: 44607 - RNA, 1515 nt, Artificial Sequence
  derived and/or modified sequence opt2 from IL20RA__Homo_sapiens__NP_001265651
augaagaacguccuccaguggaccccccccgagggccuccagggcgucaaggucaccuacaccguccaguacuucaucuacggccagaagaaguggcucaacaaguccgagugccgcaacaucaaccgcaccuacugcgaccucuccgccgagaccuccgacuacgagcaccaguacuacgccaaggucaaggccaucuggggcaccaagugcuccaagugggccgaguccggccgcuucuaccccuuccucgagacccagaucggcccccccgaggucgcccucaccaccgacgagaaguccaucuccgucguccucaccgcccccgagaaguggaagcgcaaccccgaggaccuccccgucuccaugcagcagaucuacuccaaccucaaguacaacgucuccguccucaacaccaaguccaaccgcaccuggucccagugcgucaccaaccacacccucguccucaccuggcucgagcccaacacccucuacugcguccacgucgaguccuucguccccggccccccccgccgcgcccagcccuccgagaagcagugcgcccgcacccucaaggaccaguccuccgaguucaaggccaagaucaucuucugguacguccuccccaucuccaucaccgucuuccucuucuccgucaugggcuacuccaucuaccgcuacauccacgucggcaaggagaagcaccccgccaaccucauccucaucuacggcaacgaguucgacaagcgcuucuucguccccgccgagaagaucgucaucaacuucaucacccucaacaucuccgacgacuccaagaucucccaccaggacaugucccuccucggcaaguccuccgacgucuccucccucaacgacccccagcccuccggcaaccuccgccccccccaggaggaggaggaggucaagcaccucggcuacgccucccaccucauggagaucuucugcgacuccgaggagaacaccgagggcaccucccucacccagcaggagucccucucccgcaccaucccccccgacaagaccgucaucgaguacgaguacgacguccgcaccaccgacaucugcgccggccccgaggagcaggagcucucccuccaggaggaggucuccacccagggcacccuccucgagucccaggccgcccucgccguccucggcccccagacccuccaguacuccuacaccccccagcuccaggaccucgacccccucgcccaggagcacaccgacuccgaggagggccccgaggaggagcccuccaccacccucgucgacugggacccccagaccggccgccucugcauccccucccucuccuccuucgaccaggacuccgagggcugcgagcccuccgagggcgacggccucggcgaggagggccuccucucccgccucuacgaggagcccgcccccgaccgcccccccggcgagaacgagaccuaccucaugcaguucauggaggaguggggccucuacguccagauggagaacuga

SEQ ID NO: 44608 - RNA, 936 nt, Artificial Sequence
  derived and/or modified sequence opt2 from IL20RB__Homo_sapiens__NP_653318
augcagaccuucaccaugguccucgaggagaucuggaccucccucuucaugugguucuucuacgcccucauccccugccuccucaccgacgaggucgccauccuccccgccccccagaaccucuccguccucuccaccaacaugaagcaccuccucauguggucccccgucaucgcccccggcgagaccgucuacuacuccgucgaguaccagggcgaguacgagucccucuacaccucccacaucuggauccccuccuccuggugcucccucaccgagggccccgagugcgacgucaccgacgacaucaccgccaccguccccuacaaccuccgcguccgcgccacccucggcucccagaccuccgccugguccauccucaagcaccccuucaaccgcaacuccaccauccucacccgccccggcauggagaucaccaaggacggcuuccaccucgucaucgagcucgaggaccucggcccccaguucgaguuccucgucgccuacuggcgccgcgagcccggcgccgaggagcacgucaagaugguccgcuccggcggcauccccguccaccucgagaccauggagcccggcgccgccuacugcgucaaggcccagaccuucgucaaggccaucggccgcuacuccgccuucucccagaccgagugcgucgagguccagggcgaggccaucccccucguccucgcccucuucgccuucgucggcuucaugcucauccucgucgucgucccccucuucgucuggaagaugggccgccuccuccaguacuccugcugccccgucgucguccuccccgacacccucaagaucaccaacuccccccagaagcucaucuccugccgccgcgaggaggucgacgccugcgccaccgccgucaugucccccgaggagcuccuccgcgccuggaucuccuga

SEQ ID NO: 44609 - RNA, 489 nt, Artificial Sequence
  derived and/or modified sequence opt2 from IL21__Homo_sapiens__NP_068575
augcgcuccucccccggcaacauggagcgcaucgucaucugccucauggucaucuuccucggcacccucguccacaaguccuccucccagggccaggaccgccacaugauccgcaugcgccagcucaucgacaucgucgaccagcucaagaacuacgucaacgaccucguccccgaguuccuccccgcccccgaggacgucgagaccaacugcgagugguccgccuucuccugcuuccagaaggcccagcucaaguccgccaacaccggcaacaacgagcgcaucaucaacgucuccaucaagaagcucaagcgcaagccccccuccaccaacgccggccgccgccagaagcaccgccucaccugccccuccugcgacuccuacgagaagaagccccccaaggaguuccucgagcgcuucaagucccuccuccagaagaugauccaccagcaccucuccucccgcacccacggcuccgaggacuccuga

SEQ ID NO: 44610 - RNA, 1617 nt, Artificial Sequence
  derived and/or modified sequence opt2 from IL21R__Homo_sapiens__NP_068570
augccccgcggcugggccgccccccuccuccuccuccuccuccagggcggcuggggcugccccgaccucgucugcuacaccgacuaccuccagaccgucaucugcauccucgagauguggaaccuccaccccuccacccucacccucaccuggcaggaccaguacgaggagcucaaggacgaggccaccuccugcucccuccaccgcuccgcccacaacgccacccacgccaccuacaccugccacauggacgucuuccacuucauggccgacgacaucuucuccgucaacaucaccgaccaguccggcaacuacucccaggagugcggcuccuuccuccucgccgaguccaucaagcccgccccccccuucaacgucaccgucaccuucuccggccaguacaacaucuccuggcgcuccgacuacgaggaccccgccuucuacaugcucaagggcaagcuccaguacgagcuccaguaccgcaaccgcggcgaccccugggccgucuccccccgccgcaagcucaucuccgucgacucccgcuccgucucccuccucccccucgaguuccgcaaggacuccuccuacgagcuccagguccgcgccggccccaugcccggcuccuccuaccagggcaccugguccgagugguccgaccccgucaucuuccagacccaguccgaggagcucaaggagggcuggaacccccaccuccuccuccuccuccuccucgucaucgucuucauccccgccuucuggucccucaagacccacccccucuggcgccucuggaagaagaucugggccguccccucccccgagcgcuucuucaugccccucuacaagggcugcuccggcgacuucaagaagugggucggcgcccccuucaccggcuccucccucgagcucggccccuggucccccgagguccccuccacccucgaggucuacuccugccaccccccccgcucccccgccaagcgccuccagcucaccgagcuccaggagcccgccgagcucgucgaguccgacggcguccccaagcccuccuucuggcccaccgcccagaacuccggcggcuccgccuacuccgaggagcgcgaccgccccuacggccucgucuccaucgacaccgucaccguccucgacgccgagggccccugcaccuggcccugcuccugcgaggacgacggcuaccccgcccucgaccucgacgccggccucgagcccucccccggccucgaggacccccuccucgacgccggcaccaccguccucuccugcggcugcgucuccgccggcucccccggccucggcggcccccucggcucccuccucgaccgccucaagcccccccucgccgacggcgaggacugggccggcggccuccccuggggcggccgcucccccggcggcgucuccgaguccgaggccggcuccccccucgccggccucgacauggacaccuucgacuccggcuucgucggcuccgacugcuccucccccgucgagugcgacuucaccucccccggcgacgagggccccccccgcuccuaccuccgccagugggucgucaucccccccccccucuccucccccggcccccaggccuccuga

SEQ ID NO: 44611 - RNA, 540 nt, Artificial Sequence
  derived and/or modified sequence opt2 from IL22__Homo_sapiens__NP_065386
auggccgcccuccagaaguccgucuccuccuuccucaugggcacccucgccaccuccugccuccuccuccucgcccuccucguccagggcggcgccgccgcccccaucuccucccacugccgccucgacaaguccaacuuccagcagcccuacaucaccaaccgcaccuucaugcucgccaaggaggccucccucgccgacaacaacaccgacguccgccucaucggcgagaagcucuuccacggcgucuccauguccgagcgcugcuaccucaugaagcagguccucaacuucacccucgaggagguccucuucccccaguccgaccgcuuccagcccuacaugcaggaggucguccccuuccucgcccgccucuccaaccgccucuccaccugccacaucgagggcgacgaccuccacauccagcgcaacguccagaagcucaaggacaccgucaagaagcucggcgaguccggcgagaucaaggccaucggcgagcucgaccuccucuucaugucccuccgcaacgccugcaucuga

SEQ ID NO: 44612 - RNA, 792 nt, Artificial Sequence
  derived and/or modified sequence opt2 from IL22RA2__Homo_sapiens__NP_443194
augaugcccaagcacugcuuccucggcuuccucaucuccuucuuccucaccggcgucgccggcacccaguccacccacgagucccucaagccccagcgcguccaguuccagucccgcaacuuccacaacauccuccaguggcagcccggccgcgcccucaccggcaacuccuccgucuacuucguccaguacaagaucauguucuccugcuccaugaaguccucccaccagaagcccuccggcugcuggcagcacaucuccugcaacuuccccggcugccgcacccucgccaaguacggccagcgccaguggaagaacaaggaggacugcuggggcacccaggagcucuccugcgaccucaccuccgagaccuccgacauccaggagcccuacuacggccgcguccgcgccgccuccgccggcuccuacuccgagugguccaugaccccccgcuucacccccuggugggagaccaagaucgacccccccgucaugaacaucacccaggucaacggcucccuccucgucauccuccacgcccccaaccuccccuaccgcuaccagaaggagaagaacgucuccaucgaggacuacuacgagcuccucuaccgcgucuucaucaucaacaacucccucgagaaggagcagaaggucuacgagggcgcccaccgcgccgucgagaucgaggcccucaccccccacuccuccuacugcgucgucgccgagaucuaccagcccaugcucgaccgccgcucccagcgcuccgaggagcgcugcgucgagauccccuga

SEQ ID NO: 44613 - RNA, 570 nt, Artificial Sequence
  derived and/or modified sequence opt2 from IL23A__Homo_sapiens__XP_011536779
augcucggcucccgcgccgucaugcuccuccuccuccuccccuggaccgcccagggccgcgccguccccggcggcuccucccccgccuggacccagugccagcagcucucccagaagcucugcacccucgccugguccgcccacccccucgucggccacauggaccuccgcgaggagggcgacgaggagaccaccaacgacgucccccacauccagugcggcgacggcugcgacccccagggccuccgcgacaacucccaguucugccuccagcgcauccaccagggccucaucuucuacgagaagcuccucggcuccgacaucuucaccggcgagcccucccuccuccccgacucccccgucggccagcuccacgccucccuccucggccucucccagcuccuccagcccgagggccaccacugggagacccagcagauccccucccucucccccucccagcccuggcagcgccuccuccuccgcuucaagauccuccgcucccuccaggccuucgucgccgucgccgcccgcgucuucgcccacggcgccgccacccucucccccuga

SEQ ID NO: 44614 - RNA, 1980 nt, Artificial Sequence
  derived and/or modified sequence opt2 from IL23R__Homo_sapiens__XP_011539091
augcuccucugccacggcauccucuuccccuggauccaggucuucgcccgcaagcuccaggagggcaacucccucuuccuccuccccgacaugaaccaggucaccauccagugggacgccgucaucgcccucuacauccucuucuccuggugccacggcggcaucaccaacaucaacugcuccggccacaucugggucgagcccgccaccaucuucaagaugggcaugaacaucuccaucuacugccaggccgccaucaagaacugccagccccgcaagcuccacuucuacaagaacggcaucaaggagcgcuuccagaucacccgcaucaacaagaccaccgcccgccucugguacaagaacuuccucgagccccacgccuccauguacugcaccgccgagugccccaagcacuuccaggagacccucaucugcggcaaggacaucuccuccggcuacccccccgacauccccgacgaggucaccugcgucaucuacgaguacuccggcaacaugaccugcaccuggaacgccggcaagcucaccuacaucgacaccaaguacgucguccacgucaagucccucgagaccgaggaggagcagcaguaccucaccuccuccuacaucaacaucuccaccgacucccuccagggcggcaagaaguaccucgucuggguccaggccgccaacgcccucggcauggaggaguccaagcagcuccagauccaccucgacgacaucgucauccccuccgccgccgucaucucccgcgccgagaccaucaacgccaccguccccaagaccaucaucuacugggacucccagaccaccaucgagaaggucuccugcgagaugcgcuacaaggccaccaccaaccagaccuggaacgucaaggaguucgacaccaacuucaccuacguccagcaguccgaguucuaccucgagcccaacaucaaguacgucuuccagguccgcugccaggagaccggcaagcgcuacuggcagcccugguccucccucuucuuccacaagacccccgagaccgucccccaggucaccuccaaggccuuccagcacgacaccuggaacuccggccucaccgucgccuccaucuccaccggccaccucaccuccgacaaccgcggcgacaucggccuccuccucggcaugaucgucuucgccgucaugcucuccauccucucccucaucggcaucuucaaccgcuccuuccgcaccggcaucaagcgccgcauccuccuccucauccccaaguggcucuacgaggacauccccaacaugaagaacuccaacgucgucaagaugcuccaggagaacuccgagcucaugaacaacaacuccuccgagcagguccucuacgucgaccccaugaucaccgagaucaaggagaucuucauccccgagcacaagcccaccgacuacaagaaggagaacaccggcccccucgagacccgcgacuacccccagaacucccucuucgacaacaccaccgucgucuacauccccgaccucaacaccggcuacaagccccagaucuccaacuuccuccccgagggcucccaccucuccaacaacaacgagaucaccucccucacccucaagccccccgucgacucccucgacuccggcaacaacccccgccuccagaagcaccccaacuucgccuucuccgucuccuccgucaacucccucuccaacaccaucuuccucggcgagcucucccucauccucaaccagggcgagugcuccucccccgacauccagaacuccgucgaggaggagaccaccaugcuccucgagaacgacucccccuccgagaccauccccgagcagacccuccuccccgacgaguucgucuccugccucggcaucgucaacgaggagcuccccuccaucaacaccuacuucccccagaacauccucgagucccacuucaaccgcaucucccuccucgagaaguga

SEQ ID NO: 44615 - RNA, 624 nt, Artificial Sequence
  derived and/or modified sequence opt2 from IL24__Homo_sapiens__NP_001172085
augaacuuccagcagcgccuccagucccucuggacccucgccucccgccccuucugccccccccuccucgccaccgccucccagaugcagauggucguccuccccugccucggcuucacccuccuccucuggucccaggucuccggcgcccagggccaggaguuccacuucggccccugccaggucaagggcgucgucccccagaagcucugggaggccuucugggccgucaaggacaccaugcaggcccaggacaacaucaccuccgcccgccuccuccagcaggagguccuccagaacgucuccgacgccgaguccugcuaccucguccacacccuccucgaguucuaccucaagaccgucuucaagaacuaccacaaccgcaccgucgagguccgcacccucaaguccuucuccacccucgccaacaacuucguccucaucgucucccagcuccagcccucccaggagaacgagauguucuccauccgcgacuccgcccaccgccgcuuccuccucuuccgccgcgccuucaagcagcucgacgucgaggccgcccucaccaaggcccucggcgaggucgacauccuccucaccuggaugcagaaguucuacaagcucuga

SEQ ID NO: 44616 - RNA, 534 nt, Artificial Sequence
  derived and/or modified sequence opt2 from IL25__Homo_sapiens__NP_073626
augcgcgagcgcccccgccucggcgaggacuccucccucaucucccucuuccuccaggucgucgccuuccucgccauggucaugggcacccacaccuacucccacuggcccuccugcugccccuccaagggccaggacaccuccgaggagcuccuccgcugguccaccguccccguccccccccucgagcccgcccgccccaaccgccaccccgaguccugccgcgccuccgaggacggcccccucaacucccgcgccaucucccccuggcgcuacgagcucgaccgcgaccucaaccgccucccccaggaccucuaccacgcccgcugccucugcccccacugcgucucccuccagaccggcucccacauggacccccgcggcaacuccgagcuccucuaccacaaccagaccgucuucuaccgccgccccugccacggcgagaagggcacccacaagggcuacugccucgagcgccgccucuaccgcgucucccucgccugcgucugcguccgcccccgcgucaugggcuga

SEQ ID NO: 44617 - RNA, 516 nt, Artificial Sequence
  derived and/or modified sequence opt2 from IL26__Homo_sapiens__XP_011536870
augcucgucaacuucauccuccgcugcggccuccuccucgucacccucucccucgccaucgccaagcacaagcaguccuccuucaccaaguccugcuacccccgcggcacccucucccaggccgucgacgcccucuacaucaaggccgccuggcucaaggccaccauccccgaggaccgcaucaagaacauccgccuccucaagaagaagaccaagaagcaguucaugaagaacugccaguuccaggagcagcuccucuccuucuucauggaggacgucuucggccagcuccagcuccagggcugcaagaagauccgcuucgucgaggacuuccacucccuccgccagaagcucucccacugcaucuccugcgccuccuccgcccgcgagaugaaguccaucacccgcaugaagcgcaucuucuaccgcaucggcaacaagggcaucuacaaggccaucuccgagcucgacauccuccucuccuggaucaagaagcuccucgaguccucccaguga

SEQ ID NO: 44618 - RNA, 732 nt, Artificial Sequence
  derived and/or modified sequence opt2 from IL27__Homo_sapiens__NP_663634
augggccagaccgccggcgaccucggcuggcgccucucccuccuccuccucccccuccuccucguccaggccggcgucuggggcuucccccgcccccccggccgcccccagcucucccuccaggagcuccgccgcgaguucaccgucucccuccaccucgcccgcaagcuccucuccgagguccgcggccaggcccaccgcuucgccgagucccaccuccccggcgucaaccucuaccuccucccccucggcgagcagcuccccgacgucucccucaccuuccaggccuggcgccgccucuccgaccccgagcgccucugcuucaucuccaccacccuccagcccuuccacgcccuccucggcggccucggcacccagggccgcuggaccaacauggagcgcaugcagcucugggccaugcgccucgaccuccgcgaccuccagcgccaccuccgcuuccagguccucgccgccggcuucaaccuccccgaggaggaggaggaggaggaggaggaggaggaggaggagcgcaagggccuccuccccggcgcccucggcuccgcccuccagggccccgcccaggucuccuggccccagcuccucuccaccuaccgccuccuccacucccucgagcucguccucucccgcgccguccgcgagcuccuccuccucuccaaggccggccacuccgucuggccccucggcuuccccacccucuccccccagcccuga

SEQ ID NO: 44619 - RNA, 1911 nt, Artificial Sequence
  derived and/or modified sequence opt2 from IL27RA__Homo_sapiens__NP_004834
augcgcggcggccgcggcgcccccuucuggcucuggccccuccccaagcucgcccuccucccccuccucuggguccucuuccagcgcacccgcccccagggcuccgccggcccccuccagugcuacggcgucggcccccucggcgaccucaacugcuccugggagccccucggcgaccucggcgcccccuccgagcuccaccuccagucccagaaguaccgcuccaacaagacccagaccgucgccgucgccgccggccgcuccugggucgccaucccccgcgagcagcucaccauguccgacaagcuccucgucuggggcaccaaggccggccagccccucuggccccccgucuucgucaaccucgagacccagaugaagcccaacgccccccgccucggccccgacgucgacuucuccgaggacgacccccucgaggccaccguccacugggccccccccaccuggcccucccacaagguccucaucugccaguuccacuaccgccgcugccaggaggccgccuggacccuccucgagcccgagcucaagaccaucccccucacccccgucgagauccaggaccucgagcucgccaccggcuacaaggucuacggccgcugccgcauggagaaggaggaggaccucuggggcgaguggucccccauccucuccuuccagaccccccccuccgcccccaaggacgucugggucuccggcaaccucugcggcacccccggcggcgaggagccccuccuccucuggaaggcccccggccccugcguccaggucuccuacaaggucugguucugggucggcggccgcgagcucucccccgagggcaucaccugcugcugcucccucauccccuccggcgccgagugggcccgcgucuccgccgucaacgccaccuccugggagccccucaccaaccucucccucgucugccucgacuccgccuccgccccccgcuccgucgccgucuccuccaucgccggcuccaccgagcuccucgucaccuggcagcccggccccggcgagccccucgagcacgucgucgacugggcccgcgacggcgacccccucgagaagcucaacuggguccgccucccccccggcaaccucuccgcccuccuccccggcaacuucaccgucggcguccccuaccgcaucaccgucaccgccgucuccgccuccggccucgccuccgccuccuccgucuggggcuuccgcgaggagcucgccccccucgucggccccacccucuggcgccuccaggacgccccccccggcacccccgccaucgccuggggcgaggucccccgccaccagcuccgcggccaccucacccacuacacccucugcgcccaguccggcaccucccccuccgucugcaugaacgucuccggcaacacccaguccgucacccuccccgaccuccccuggggccccugcgagcucugggucaccgccuccaccaucgccggccagggcccccccggccccauccuccgccuccaccuccccgacaacacccuccgcuggaagguccuccccggcauccucuuccucuggggccucuuccuccucggcugcggccucucccucgccaccuccggccgcugcuaccaccuccgccacaagguccucccccgcugggucugggagaagguccccgaccccgccaacuccuccuccggccagccccacauggagcagguccccgaggcccagccccucggcgaccuccccauccucgaggucgaggagauggagcccccccccgucauggaguccucccagcccgcccaggccaccgccccccucgacuccggcuacgagaagcacuuccuccccacccccgaggagcucggccuccucggccccccccgcccccagguccucgccuga

SEQ ID NO: 44620 - RNA, 462 nt, Artificial Sequence
  derived and/or modified sequence opt2 from IL2__Homo_sapiens__NP_000577
auguaccgcaugcagcuccucuccugcaucgcccucucccucgcccucgucaccaacuccgcccccaccuccuccuccaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcaccuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucaccuga

SEQ ID NO: 44621 - RNA, 819 nt, Artificial Sequence
  derived and/or modified sequence opt2 from IL2RA__Homo_sapiens__NP_000408
auggacuccuaccuccucauguggggccuccucaccuucaucaugguccccggcugccaggccgagcucugcgacgacgacccccccgagaucccccacgccaccuucaaggccauggccuacaaggagggcaccaugcucaacugcgagugcaagcgcggcuuccgccgcaucaaguccggcucccucuacaugcucugcaccggcaacuccucccacuccuccugggacaaccagugccagugcaccuccuccgccacccgcaacaccaccaagcaggucaccccccagcccgaggagcagaaggagcgcaagaccaccgagaugcagucccccaugcagcccgucgaccaggccucccuccccggccacugccgcgagcccccccccugggagaacgaggccaccgagcgcaucuaccacuucgucgucggccagauggucuacuaccagugcguccagggcuaccgcgcccuccaccgcggccccgccgaguccgucugcaagaugacccacggcaagacccgcuggacccagccccagcucaucugcaccggcgagauggagaccucccaguuccccggcgaggagaagccccaggccucccccgagggccgccccgaguccgagaccuccugccucgucaccaccaccgacuuccagauccagaccgagauggccgccaccauggagaccuccaucuucaccaccgaguaccaggucgccgucgccggcugcgucuuccuccucaucuccguccuccuccucuccggccucaccuggcagcgccgccagcgcaagucccgccgcaccaucuga

SEQ ID NO: 44622 - RNA, 1656 nt, Artificial Sequence
  derived and/or modified sequence opt2 from IL2RB__Homo_sapiens__NP_000869
auggccgcccccgcccucuccuggcgccucccccuccucauccuccuccucccccucgccaccuccugggccuccgccgccgucaacggcaccucccaguucaccugcuucuacaacucccgcgccaacaucuccugcgucuggucccaggacggcgcccuccaggacaccuccugccagguccacgccuggcccgaccgccgccgcuggaaccagaccugcgagcuccuccccgucucccaggccuccugggccugcaaccucauccucggcgcccccgacucccagaagcucaccaccgucgacaucgucacccuccgcguccucugccgcgagggcguccgcuggcgcgucauggccauccaggacuucaagcccuucgagaaccuccgccucauggcccccaucucccuccaggucguccacgucgagacccaccgcugcaacaucuccugggagaucucccaggccucccacuacuucgagcgccaccucgaguucgaggcccgcacccucucccccggccacaccugggaggaggccccccuccucacccucaagcagaagcaggaguggaucugccucgagacccucacccccgacacccaguacgaguuccagguccgcgucaagccccuccagggcgaguucaccaccuggucccccuggucccagccccucgccuuccgcaccaagcccgccgcccucggcaaggacaccauccccuggcucggccaccuccucgucggccucuccggcgccuucggcuucaucauccucgucuaccuccucaucaacugccgcaacaccggccccuggcucaagaagguccucaagugcaacacccccgaccccuccaaguucuucucccagcucuccuccgagcacggcggcgacguccagaaguggcucuccucccccuuccccuccuccuccuucucccccggcggccucgcccccgagaucuccccccucgagguccucgagcgcgacaaggucacccagcuccuccuccagcaggacaagguccccgagcccgccucccucuccuccaaccacucccucaccuccugcuucaccaaccagggcuacuucuucuuccaccuccccgacgcccucgagaucgaggccugccaggucuacuucaccuacgaccccuacuccgaggaggaccccgacgagggcgucgccggcgcccccaccggcuccuccccccagccccuccagccccucuccggcgaggacgacgccuacugcaccuuccccucccgcgacgaccuccuccucuucucccccucccuccucggcggccccuccccccccuccaccgcccccggcggcuccggcgccggcgaggagcgcaugccccccucccuccaggagcgcgucccccgcgacugggacccccagccccucggcccccccacccccggcguccccgaccucgucgacuuccagcccccccccgagcucguccuccgcgaggccggcgaggagguccccgacgccggcccccgcgagggcgucuccuuccccuggucccgcccccccggccagggcgaguuccgcgcccucaacgcccgccucccccucaacaccgacgccuaccucucccuccaggagcuccagggccaggaccccacccaccucgucuga

SEQ ID NO: 44623 - RNA, 1110 nt, Artificial Sequence
  derived and/or modified sequence opt2 from IL2RG__Homo_sapiens__NP_000197
augcucaagcccucccuccccuucaccucccuccucuuccuccagcucccccuccucggcgucggccucaacaccaccauccucacccccaacggcaacgaggacaccaccgccgacuucuuccucaccaccaugcccaccgacucccucuccgucuccacccucccccuccccgagguccagugcuucgucuucaacgucgaguacaugaacugcaccuggaacuccuccuccgagccccagcccaccaaccucacccuccacuacugguacaagaacuccgacaacgacaagguccagaagugcucccacuaccucuucuccgaggagaucaccuccggcugccagcuccagaagaaggagauccaccucuaccagaccuucgucguccagcuccaggacccccgcgagccccgccgccaggccacccagaugcucaagcuccagaaccucgucauccccugggcccccgagaaccucacccuccacaagcucuccgagucccagcucgagcucaacuggaacaaccgcuuccucaaccacugccucgagcaccucguccaguaccgcaccgacugggaccacuccuggaccgagcaguccgucgacuaccgccacaaguucucccuccccuccgucgacggccagaagcgcuacaccuuccgcguccgcucccgcuucaacccccucugcggcuccgcccagcacugguccgaguggucccaccccauccacuggggcuccaacaccuccaaggagaaccccuuccucuucgcccucgaggccgucgucaucuccgucggcuccaugggccucaucaucucccuccucugcgucuacuucuggcucgagcgcaccaugccccgcauccccacccucaagaaccucgaggaccucgucaccgaguaccacggcaacuucuccgccugguccggcgucuccaagggccucgccgagucccuccagcccgacuacuccgagcgccucugccucgucuccgagaucccccccaagggcggcgcccucggcgagggccccggcgccucccccugcaaccagcacucccccuacugggccccccccugcuacacccucaagcccgagaccuga

SEQ ID NO: 44624 - RNA, 495 nt, Artificial Sequence
  derived and/or modified sequence opt2 from IL31__Homo_sapiens__XP_011536628
auggccucccacuccggccccuccaccuccguccucuuccucuucugcugccucggcggcuggcucgccucccacacccuccccguccgccuccuccgccccuccgacgacguccagaagaucgucgaggagcuccagucccucuccaagaugcuccucaaggacgucgaggaggagaagggcguccucgucucccagaacuacacccuccccugccucucccccgacgcccagccccccaacaacauccacucccccgccauccgcgccuaccucaagaccauccgccagcucgacaacaaguccgucaucgacgagaucaucgagcaccucgacaagcucaucuuccaggacgcccccgagaccaacaucuccguccccaccgacacccacgagugcaagcgcuucauccucaccaucucccagcaguucuccgagugcauggaccucgcccucaagucccucaccuccggcgcccagcaggccaccaccuga

SEQ ID NO: 44625 - RNA, 2238 nt, Artificial Sequence
  derived and/or modified sequence opt2 from IL31RA__Homo_sapiens__NP_001229565
augaagcucuccccccagcccuccugcgucaaccucggcaugauguggaccugggcccucuggaugcuccccucccucugcaaguucucccucgccgcccuccccgccaagcccgagaacaucuccugcgucuacuacuaccgcaagaaccucaccugcaccuggucccccggcaaggagaccuccuacacccaguacaccgucaagcgcaccuacgccuucggcgagaagcacgacaacugcaccaccaacuccuccaccuccgagaaccgcgccuccugcuccuucuuccucccccgcaucaccauccccgacaacuacaccaucgaggucgaggccgagaacggcgacggcgucaucaagucccacaugaccuacuggcgccucgagaacaucgccaagaccgagccccccaagaucuuccgcgucaagcccguccucggcaucaagcgcaugauccagaucgaguggaucaagcccgagcucgcccccgucuccuccgaccucaaguacacccuccgcuuccgcaccgucaacuccaccuccuggauggaggucaacuucgccaagaaccgcaaggacaagaaccagaccuacaaccucaccggccuccagcccuucaccgaguacgucaucgcccuccgcugcgccgucaaggaguccaaguucugguccgacuggucccaggagaagaugggcaugaccgaggaggaggcccccugcggccucgagcucuggcgcguccucaagcccgccgaggccgacggccgccgccccguccgccuccucuggaagaaggcccgcggcgcccccguccucgagaagacccucggcuacaacaucugguacuaccccgaguccaacaccaaccucaccgagaccaugaacaccaccaaccagcagcucgagcuccaccucggcggcgaguccuucugggucuccaugaucuccuacaacucccucggcaagucccccgucgccacccuccgcauccccgccauccaggagaaguccuuccagugcaucgaggucaugcaggccugcgucgccgaggaccagcucgucgucaaguggcaguccuccgcccucgacgucaacaccuggaugaucgagugguuccccgacgucgacuccgagcccaccacccucuccugggaguccgucucccaggccaccaacuggaccauccagcaggacaagcucaagcccuucuggugcuacaacaucuccgucuaccccaugcuccacgacaaggucggcgagcccuacuccauccaggccuacgccaaggagggcguccccuccgagggccccgagaccaaggucgagaacaucggcgucaagaccgucaccaucaccuggaaggagauccccaaguccgagcgcaagggcaucaucugcaacuacaccaucuucuaccaggccgagggcggcaagggcuucuccaagaccgucaacuccuccauccuccaguacggccucgagucccucaagcgcaagaccuccuacaucguccaggucauggccuccaccuccgccggcggcaccaacggcaccuccaucaacuucaagacccucuccuucuccgucuucgagaucauccucaucaccucccucaucggcggcggccuccucauccucaucauccucaccgucgccuacggccucaagaagcccaacaagcucacccaccucugcuggcccaccguccccaaccccgccgaguccuccaucgccaccuggcacggcgacgacuucaaggacaagcucaaccucaaggaguccgacgacuccgucaacaccgaggaccgcauccucaagcccugcuccacccccuccgacaagcucgucaucgacaagcucgucgucaacuucggcaacguccuccaggagaucuucaccgacgaggcccgcaccggccaggagaacaaccucggcggcgagaagaacggcuacgucaccugccccuuccgccccgacugcccccucggcaaguccuucgaggagcuccccgucucccccgagauccccccccgcaagucccaguaccuccgcucccgcaugcccgagggcacccgccccgaggccaaggagcagcuccucuucuccggccagucccucguccccgaccaccucugcgaggagggcgcccccaaccccuaccucaagaacuccgucaccgcccgcgaguuccucgucuccgagaagcuccccgagcacaccaagggcgaggucuga

SEQ ID NO: 44626 - RNA, 396 nt, Artificial Sequence
  derived and/or modified sequence opt2 from IL32__Homo_sapiens__NP_001012651
augugcuuccccaagguccucuccgacgacaugaagaagcucaaggcccgcaugcaccaggccaucgagcgcuucuacgacaagaugcagaacgccgaguccggccgcggccaggucauguccucccucgccgagcucgaggacgacuucaaggagggcuaccucgagaccgucgccgccuacuacgaggagcagcaccccgagcucaccccccuccucgagaaggagcgcgacggccuccgcugccgcggcaaccgcucccccguccccgacgucgaggaccccgccaccgaggagcccggcgaguccuucugcgacaaguccuacggcgccccccgcggcgacaaggaggagcucaccccccagaagugcuccgagccccaguccuccaaguga

SEQ ID NO: 44627 - RNA, 687 nt, Artificial Sequence
  derived and/or modified sequence opt2 from IL33__Homo_sapiens__NP_001186569
augaagcccaagaugaaguacuccaccaacaagaucuccaccgccaaguggaagaacaccgccuccaaggcccucugcuucaagcucggcaagucccagcagaaggccaaggaggucugccccauguacuucaugaagcuccgcuccggccucaugaucaagaaggaggccugcuacuuccgccgcgagaccaccaagcgccccucccucaagaccggccgcaagcacaagcgccaccucguccucgccgccugccagcagcaguccaccgucgagugcuucgccuucggcaucuccggcguccagaaguacacccgcgcccuccacgacuccuccaucaccgacaagguccuccucuccuacuacgagucccagcaccccuccaacgaguccggcgacggcgucgacggcaagaugcucauggucacccucucccccaccaaggacuucuggcuccacgccaacaacaaggagcacuccgucgagcuccacaagugcgagaagccccuccccgaccaggccuucuucguccuccacaacaugcacuccaacugcgucuccuucgagugcaagaccgaccccggcgucuucaucggcgucaaggacaaccaccucgcccucaucaaggucgacuccuccgagaaccucugcaccgagaacauccucuucaagcucuccgagaccuga

SEQ ID NO: 44628 - RNA, 729 nt, Artificial Sequence
  derived and/or modified sequence opt2 from IL34__Homo_sapiens__XP_011521205
augccccgcggcuucaccuggcuccgcuaccucggcaucuuccucggcgucgcccucggcaacgagccccucgagauguggccccucacccagaacgaggagugcaccgucaccggcuuccuccgcgacaagcuccaguaccgcucccgccuccaguacaugaagcacuacuuccccaucaacuacaagaucuccguccccuacgagggcgucuuccgcaucgccaacgucacccgccuccagcgcgcccaggucuccgagcgcgagcuccgcuaccucuggguccucgucucccucuccgccaccgaguccguccaggacguccuccucgagggccaccccuccuggaaguaccuccaggaggucgagacccuccuccucaacguccagcagggccucaccgacgucgaggucucccccaaggucgaguccguccucucccuccucaacgcccccggccccaaccucaagcucguccgccccaaggcccuccucgacaacugcuuccgcgucauggagcuccucuacugcuccugcugcaagcaguccuccguccucaacuggcaggacugcgagguccccuccccccaguccugcucccccgagcccucccuccaguacgccgccacccagcucuacccccccccccccuggucccccuccucccccccccacuccaccggcuccguccgccccguccgcgcccagggcgagggccuccuccccuga

SEQ ID NO: 44629 - RNA, 477 nt, Artificial Sequence
  derived and/or modified sequence opt2 from IL36A__Homo_sapiens__NP_055255
auggagaaggcccucaagaucgacaccccccagcagggcuccauccaggacaucaaccaccgcgucuggguccuccaggaccagacccucaucgccgucccccgcaaggaccgcaugucccccgucaccaucgcccucaucuccugccgccacgucgagacccucgagaaggaccgcggcaaccccaucuaccucggccucaacggccucaaccucugccucaugugcgccaaggucggcgaccagcccacccuccagcucaaggagaaggacaucauggaccucuacaaccagcccgagcccgucaaguccuuccucuucuaccacucccaguccggccgcaacuccaccuucgaguccgucgccuuccccggcugguucaucgccgucuccuccgagggcggcugcccccucauccucacccaggagcucggcaaggccaacaccaccgacuucggccucaccaugcucuucuga

SEQ ID NO: 44630 - RNA, 495 nt, Artificial Sequence
  derived and/or modified sequence opt2 from IL36B__Homo_sapiens__NP_055253
augaacccccagcgcgaggccgcccccaaguccuacgccauccgcgacucccgccagauggucuggguccucuccggcaacucccucaucgccgccccccucucccgcuccaucaagcccgucacccuccaccucaucgccugccgcgacaccgaguucuccgacaaggagaagggcaacauggucuaccucggcaucaagggcaaggaccucugccucuucugcgccgagauccagggcaagcccacccuccagcucaagcuccagggcucccaggacaacaucggcaaggacaccugcuggaagcucgucggcauccacaccugcaucaaccucgacguccgcgaguccugcuucaugggcacccucgaccaguggggcaucggcgucggccgcaagaaguggaaguccuccuuccagcaccaccaccuccgcaagaaggacaaggacuucuccuccaugcgcaccaacaucggcaugcccggccgcauguga

SEQ ID NO: 44631 - RNA, 510 nt, Artificial Sequence
  derived and/or modified sequence opt2 from IL36G__Homo_sapiens__NP_062564
augcgcggcacccccggcgacgccgacggcggcggccgcgccgucuaccaguccaugugcaagcccaucaccggcaccaucaacgaccucaaccagcaggucuggacccuccagggccagaaccucgucgccgucccccgcuccgacuccgucacccccgucaccgucgccgucaucaccugcaaguaccccgaggcccucgagcagggccgcggcgaccccaucuaccucggcauccagaaccccgagaugugccucuacugcgagaaggucggcgagcagcccacccuccagcucaaggagcagaagaucauggaccucuacggccagcccgagcccgucaagcccuuccucuucuaccgcgccaagaccggccgcaccuccacccucgaguccgucgccuuccccgacugguucaucgccuccuccaagcgcgaccagcccaucauccucaccuccgagcucggcaaguccuacaacaccgccuucgagcucaacaucaacgacuga

SEQ ID NO: 44632 - RNA, 468 nt, Artificial Sequence
  derived and/or modified sequence opt2 from IL36RN__Homo_sapiens__NP_775262
augguccucuccggcgcccucugcuuccgcaugaaggacuccgcccucaagguccucuaccuccacaacaaccagcuccucgccggcggccuccacgccggcaaggucaucaagggcgaggagaucuccgucguccccaaccgcuggcucgacgccucccucucccccgucauccucggcguccagggcggcucccagugccucuccugcggcgucggccaggagcccacccucacccucgagcccgucaacaucauggagcucuaccucggcgccaaggaguccaaguccuucaccuucuaccgccgcgacaugggccucaccuccuccuucgaguccgccgccuaccccggcugguuccucugcaccguccccgaggccgaccagcccguccgccucacccagcuccccgagaacggcggcuggaacgcccccaucaccgacuucuacuuccagcagugcgacuga

SEQ ID NO: 44633 - RNA, 657 nt, Artificial Sequence
  derived and/or modified sequence opt2 from IL37__Homo_sapiens__NP_055254
auguccuucgucggcgagaacuccggcgucaagaugggcuccgaggacugggagaaggacgagccccagugcugccucgaggaccccgccggcuccccccucgagcccggccccucccuccccaccaugaacuucguccacaccucccccaaggucaagaaccucaaccccaagaaguucuccauccacgaccaggaccacaagguccucguccucgacuccggcaaccucaucgccguccccgacaagaacuacauccgccccgagaucuucuucgcccucgccuccucccucuccuccgccuccgccgagaagggcucccccauccuccucggcgucuccaagggcgaguucugccucuacugcgacaaggacaagggccagucccaccccucccuccagcucaagaaggagaagcucaugaagcucgccgcccagaaggaguccgcccgccgccccuucaucuucuaccgcgcccaggucggcuccuggaacaugcucgaguccgccgcccaccccggcugguucaucugcaccuccugcaacugcaacgagcccgucggcgucaccgacaaguucgagaaccgcaagcacaucgaguucuccuuccagcccgucugcaaggccgagaugucccccuccgaggucuccgacuga

SEQ ID NO: 44634 - RNA, 459 nt, Artificial Sequence
  derived and/or modified sequence opt2 from IL3__Homo_sapiens__NP_000579
augucccgccuccccguccuccuccuccuccagcuccucguccgccccggccuccaggcccccaugacccagaccaccccccucaagaccuccugggucaacugcuccaacaugaucgacgagaucaucacccaccucaagcagcccccccucccccuccucgacuucaacaaccucaacggcgaggaccaggacauccucauggagaacaaccuccgccgccccaaccucgaggccuucaaccgcgccgucaagucccuccagaacgccuccgccaucgaguccauccucaagaaccuccuccccugccucccccucgccaccgccgcccccacccgccaccccauccacaucaaggacggcgacuggaacgaguuccgccgcaagcucaccuucuaccucaagacccucgagaacgcccaggcccagcagaccacccucucccucgccaucuucuga

SEQ ID NO: 44635 - RNA, 903 nt, Artificial Sequence
  derived and/or modified sequence opt2 from IL3RA__Homo_sapiens__NP_001254642
augguccuccucuggcucacccuccuccucaucgcccuccccugccuccuccagaccaaggagggcggcaagcccugggccggcgccgagaaccucaccugcuggauccacgacgucgacuuccucuccugcuccugggccgucggccccggcgcccccgccgacguccaguacgaccucuaccucaacgucgccaaccgccgccagcaguacgagugccuccacuacaagaccgacgcccagggcacccgcaucggcugccgcuucgacgacaucucccgccucuccuccggcucccaguccucccacauccucguccgcggccgcuccgccgccuucggcauccccugcaccgacaaguucgucgucuucucccagaucgagauccucaccccccccaacaugaccgccaagugcaacaagacccacuccuucaugcacuggaagaugcgcucccacuucaaccgcaaguuccgcuacgagcuccagauccagaagcgcaugcagcccgucaucaccgagcagguccgcgaccgcaccuccuuccagcuccucaaccccggcaccuacaccguccagauccgcgcccgcgagcgcgucuacgaguuccucuccgccugguccaccccccagcgcuucgagugcgaccaggaggagggcgccaacacccgcgccuggcgcaccucccuccucaucgcccucggcacccuccucgcccucgucugcgucuucgucaucugccgccgcuaccucgucaugcagcgccucuucccccgcaucccccacaugaaggaccccaucggcgacuccuuccagaacgacaagcucgucgucugggaggccggcaaggccggccucgaggagugccucgucaccgagguccaggucguccagaagaccuga

SEQ ID NO: 44636 - RNA, 462 nt, Artificial Sequence
  derived and/or modified sequence opt2 from IL4__Homo_sapiens__NP_000580
augggccucaccucccagcuccuccccccccucuucuuccuccucgccugcgccggcaacuucguccacggccacaagugcgacaucacccuccaggagaucaucaagacccucaacucccucaccgagcagaagacccucugcaccgagcucaccgucaccgacaucuucgccgccuccaagaacaccaccgagaaggagaccuucugccgcgccgccaccguccuccgccaguucuacucccaccacgagaaggacacccgcugccucggcgccaccgcccagcaguuccaccgccacaagcagcucauccgcuuccucaagcgccucgaccgcaaccucuggggccucgccggccucaacuccugccccgucaaggaggccaaccaguccacccucgagaacuuccucgagcgccucaagaccaucaugcgcgagaaguacuccaagugcuccuccuga

SEQ ID NO: 44637 - RNA, 1770 nt, Artificial Sequence
  derived and/or modified sequence opt2 from IL4I1__Homo_sapiens__NP_001244947
augcccaacgacgacuucugccccggccucaccaucaaggccaugggcgccgagcgcgccccccagcgccagcccugcacccuccaccuccucguccucguccccauccuccucucccucgucgccucccaggacuggaaggccgagcgcucccaggaccccuucgagaagugcaugcaggaccccgacuacgagcagcuccucaaggucgucaccuggggccucaaccgcacccucaagccccagcgcgucaucgucgucggcgccggcgucgccggccucgucgccgccaagguccucuccgacgccggccacaaggucaccauccucgaggccgacaaccgcaucggcggccgcaucuucaccuaccgcgaccagaacaccggcuggaucggcgagcucggcgccaugcgcaugcccuccucccaccgcauccuccacaagcucugccagggccucggccucaaccucaccaaguucacccaguacgacaagaacaccuggaccgagguccacgaggucaagcuccgcaacuacgucgucgagaagguccccgagaagcucggcuacgcccuccgcccccaggagaagggccacucccccgaggacaucuaccagauggcccucaaccaggcccucaaggaccucaaggcccucggcugccgcaaggccaugaagaaguucgagcgccacacccuccucgaguaccuccucggcgagggcaaccucucccgccccgccguccagcuccucggcgacgucauguccgaggacggcuucuucuaccucuccuucgccgaggcccuccgcgcccacuccugccucuccgaccgccuccaguacucccgcaucgucggcggcugggaccuccucccccgcgcccuccucuccucccucuccggccucguccuccucaacgcccccgucgucgccaugacccagggcccccacgacguccacguccagaucgagaccuccccccccgcccgcaaccucaagguccucaaggccgacgucguccuccucaccgccuccggccccgccgucaagcgcaucaccuucucccccccccucccccgccacaugcaggaggcccuccgccgccuccacuacguccccgccaccaaggucuuccucuccuuccgccgccccuucuggcgcgaggagcacaucgagggcggccacuccaacaccgaccgccccucccgcaugaucuucuacccccccccccgcgagggcgcccuccuccucgccuccuacaccugguccgacgccgccgccgccuucgccggccucucccgcgaggaggcccuccgccucgcccucgacgacgucgccgcccuccacggccccgucguccgccagcucugggacggcaccggcgucgucaagcgcugggccgaggaccagcacucccagggcggcuucgucguccagccccccgcccucuggcagaccgagaaggacgacuggaccguccccuacggccgcaucuacuucgccggcgagcacaccgccuacccccacggcugggucgagaccgccgucaaguccgcccuccgcgccgccaucaagaucaacucccgcaagggccccgccuccgacaccgccucccccgagggccacgccuccgacauggagggccagggccacguccacggcgucgccuccucccccucccacgaccucgccaaggaggagggcucccacccccccguccagggccagcucucccuccagaacaccacccacacccgcaccucccacuga

SEQ ID NO: 44638 - RNA, 2433 nt, Artificial Sequence
  derived and/or modified sequence opt2 from IL4R__Homo_sapiens__NP_001244336
augcagaaggacgcccgccgcgagggcaacaugaagguccuccaggagcccaccugcgucuccgacuacauguccaucuccaccugcgaguggaagaugaacggccccaccaacugcuccaccgagcuccgccuccucuaccagcucgucuuccuccucuccgaggcccacaccugcauccccgagaacaacggcggcgccggcugcgucugccaccuccucauggacgacgucgucuccgccgacaacuacacccucgaccucugggccggccagcagcuccucuggaagggcuccuucaagcccuccgagcacgucaagccccgcgcccccggcaaccucaccguccacaccaacgucuccgacacccuccuccucaccugguccaaccccuacccccccgacaacuaccucuacaaccaccucaccuacgccgucaacaucugguccgagaacgaccccgccgacuuccgcaucuacaacgucaccuaccucgagcccucccuccgcaucgccgccuccacccucaaguccggcaucuccuaccgcgcccgcguccgcgccugggcccagugcuacaacaccaccugguccgaguggucccccuccaccaaguggcacaacuccuaccgcgagcccuucgagcagcaccuccuccucggcgucuccgucuccugcaucgucauccucgccgucugccuccucugcuacgucuccaucaccaagaucaagaaggaguggugggaccagauccccaaccccgcccgcucccgccucgucgccaucaucauccaggacgcccagggcucccagugggagaagcgcucccgcggccaggagcccgccaagugcccccacuggaagaacugccucaccaagcuccuccccugcuuccucgagcacaacaugaagcgcgacgaggacccccacaaggccgccaaggagaugcccuuccagggcuccggcaaguccgccuggugccccgucgagaucuccaagaccguccucuggcccgaguccaucuccgucguccgcugcgucgagcucuucgaggcccccgucgagugcgaggaggaggaggaggucgaggaggagaagggcuccuucugcgccucccccgaguccucccgcgacgacuuccaggagggccgcgagggcaucgucgcccgccucaccgagucccucuuccucgaccuccucggcgaggagaacggcggcuucugccagcaggacaugggcgaguccugccuccucccccccuccggcuccaccuccgcccacaugcccugggacgaguuccccuccgccggccccaaggaggccccccccuggggcaaggagcagccccuccaccucgagcccuccccccccgccucccccacccagucccccgacaaccucaccugcaccgagaccccccucgucaucgccggcaaccccgccuaccgcuccuucuccaacucccucucccagucccccugcccccgcgagcucggccccgacccccuccucgcccgccaccucgaggaggucgagcccgagaugcccugcgucccccagcucuccgagcccaccaccgucccccagcccgagcccgagaccugggagcagauccuccgccgcaacguccuccagcacggcgccgccgccgcccccgucuccgcccccaccuccggcuaccaggaguucguccacgccgucgagcagggcggcacccaggccuccgccgucgucggccucggcccccccggcgaggccggcuacaaggccuucuccucccuccucgccuccuccgccgucucccccgagaagugcggcuucggcgccuccuccggcgaggagggcuacaagcccuuccaggaccucauccccggcugccccggcgaccccgcccccguccccgucccccucuucaccuucggccucgaccgcgagcccccccgcuccccccaguccucccaccuccccuccuccucccccgagcaccucggccucgagcccggcgagaaggucgaggacaugcccaagcccccccucccccaggagcaggccaccgacccccucgucgacucccucggcuccggcaucgucuacuccgcccucaccugccaccucugcggccaccucaagcagugccacggccaggaggacggcggccagacccccgucauggccucccccugcugcggcugcugcugcggcgaccgcuccuccccccccaccaccccccuccgcgcccccgaccccucccccggcggcgucccccucgaggccucccucugccccgccucccucgcccccuccggcaucuccgagaaguccaaguccuccuccuccuuccaccccgcccccggcaacgcccaguccuccucccagacccccaagaucgucaacuucgucuccgucggccccaccuacaugcgcgucuccuga

SEQ ID NO: 44639 - RNA, 528 nt, Artificial Sequence
  derived and/or modified sequence opt2 from IL5__Homo_sapiens__XP_006714664
augggcgucgucgucggcuggaucggcgaccccggcuccggcaccgacaacaagcucaccggcgacgccguccucuacuacgcccucucccuccccaaggccaacgccgagcgcuuccgcgccaugcgcaugcuccuccaccucucccuccucgcccucggcgccgccuacgucuacgccauccccaccgagauccccaccuccgcccucgucaaggagacccucgcccuccucuccacccaccgcacccuccucaucgccaacgagacccuccgcauccccguccccguccacaagaaccaccagcucugcaccgaggagaucuuccagggcaucggcacccucgagucccagaccguccagggcggcaccgucgagcgccucuucaagaaccucucccucaucaagaaguacaucgacggccagaagaagaagugcggcgaggagcgccgccgcgucaaccaguuccucgacuaccuccaggaguuccucggcgucaugaacaccgaguggaucaucgaguccuga

SEQ ID NO: 44640 - RNA, 1263 nt, Artificial Sequence
  derived and/or modified sequence opt2 from IL5RA__Homo_sapiens__NP_000555
augaucaucgucgcccacguccuccucauccuccucggcgccaccgagauccuccaggccgaccuccuccccgacgagaagaucucccuccucccccccgucaacuucaccaucaaggucaccggccucgcccagguccuccuccaguggaagcccaaccccgaccaggagcagcgcaacgucaaccucgaguaccaggucaagaucaacgcccccaaggaggacgacuacgagacccgcaucaccgaguccaagugcgucaccauccuccacaagggcuucuccgccuccguccgcaccauccuccagaacgaccacucccuccucgccuccuccugggccuccgccgagcuccacgccccccccggcucccccggcaccuccaucgucaaccucaccugcaccaccaacaccaccgaggacaacuacucccgccuccgcuccuaccaggucucccuccacugcaccuggcucgucggcaccgacgcccccgaggacacccaguacuuccucuacuaccgcuacggcuccuggaccgaggagugccaggaguacuccaaggacacccucggccgcaacaucgccugcugguucccccgcaccuucauccucuccaagggccgcgacuggcucgccguccucgucaacggcuccuccaagcacuccgccauccgccccuucgaccagcucuucgcccuccacgccaucgaccagaucaaccccccccucaacgucaccgccgagaucgagggcacccgccucuccauccagugggagaagcccgucuccgccuuccccauccacugcuucgacuacgaggucaagauccacaacacccgcaacggcuaccuccagaucgagaagcucaugaccaacgccuucaucuccaucaucgacgaccucuccaaguacgacguccagguccgcgccgccgucuccuccaugugccgcgaggccggccucugguccgaguggucccagcccaucuacgucggcaacgacgagcacaagccccuccgcgagugguucgucaucgucaucauggccaccaucugcuucauccuccucauccucucccucaucugcaagaucugccaccucuggaucaagcucuucccccccauccccgcccccaaguccaacaucaaggaccucuucgucaccaccaacuacgagaaggccggcuccuccgagaccgagaucgaggucaucugcuacaucgagaagcccggcgucgagacccucgaggacuccgucuucuga

SEQ ID NO: 44641 - RNA, 639 nt, Artificial Sequence
  derived and/or modified sequence opt2 from IL6__Homo_sapiens__NP_000591
augaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagauguga

SEQ ID NO: 44642 - RNA, 1407 nt, Artificial Sequence
  derived and/or modified sequence opt2 from IL6R__Homo_sapiens__NP_000556
augcucgccgucggcugcgcccuccucgccgcccuccucgccgcccccggcgccgcccucgccccccgccgcugccccgcccaggaggucgcccgcggcguccucaccucccuccccggcgacuccgucacccucaccugccccggcgucgagcccgaggacaacgccaccguccacuggguccuccgcaagcccgccgccggcucccaccccucccgcugggccggcaugggccgccgccuccuccuccgcuccguccagcuccacgacuccggcaacuacuccugcuaccgcgccggccgccccgccggcaccguccaccuccucgucgacgucccccccgaggagccccagcucuccugcuuccgcaaguccccccucuccaacgucgucugcgaguggggcccccgcuccacccccucccucaccaccaaggccguccuccucguccgcaaguuccagaacucccccgccgaggacuuccaggagcccugccaguacucccaggagucccagaaguucuccugccagcucgccguccccgagggcgacuccuccuucuacaucgucuccaugugcgucgccuccuccgucggcuccaaguucuccaagacccagaccuuccagggcugcggcauccuccagcccgacccccccgccaacaucaccgucaccgccgucgcccgcaacccccgcuggcucuccgucaccuggcaggacccccacuccuggaacuccuccuucuaccgccuccgcuucgagcuccgcuaccgcgccgagcgcuccaagaccuucaccaccuggauggucaaggaccuccagcaccacugcgucauccacgacgccugguccggccuccgccacgucguccagcuccgcgcccaggaggaguucggccagggcgagugguccgaguggucccccgaggccaugggcacccccuggaccgagucccgcuccccccccgccgagaacgaggucuccacccccaugcaggcccucaccaccaacaaggacgacgacaacauccucuuccgcgacuccgccaacgccaccucccuccccguccaggacuccuccuccgucccccuccccaccuuccucgucgccggcggcucccucgccuucggcacccuccucugcaucgccaucguccuccgcuucaagaagaccuggaagcuccgcgcccucaaggagggcaagaccuccaugcacccccccuacucccucggccagcucguccccgagcgcccccgccccacccccguccucgucccccucaucuccccccccgucucccccuccucccucggcuccgacaacaccuccucccacaaccgccccgacgcccgcgacccccgcucccccuacgacaucuccaacaccgacuacuucuucccccgcuga

SEQ ID NO: 44643 - RNA, 2574 nt, Artificial Sequence
  derived and/or modified sequence opt2 from IL6ST__Homo_sapiens__NP_001177910
augcucacccuccagaccuggcucguccaggcccucuucaucuuccucaccaccgaguccaccggcgagcuccucgaccccugcggcuacaucucccccgagucccccgucguccagcuccacuccaacuucaccgccgucugcguccucaaggagaagugcauggacuacuuccacgucaacgccaacuacaucgucuggaagaccaaccacuucaccauccccaaggagcaguacaccaucaucaaccgcaccgccuccuccgucaccuucaccgacaucgccucccucaacauccagcucaccugcaacauccucaccuucggccagcucgagcagaacgucuacggcaucaccaucaucuccggccucccccccgagaagcccaagaaccucuccugcaucgucaacgagggcaagaagaugcgcugcgagugggacggcggccgcgagacccaccucgagaccaacuucacccucaaguccgagugggccacccacaaguucgccgacugcaaggccaagcgcgacacccccaccuccugcaccgucgacuacuccaccgucuacuucgucaacaucgaggucugggucgaggccgagaacgcccucggcaaggucaccuccgaccacaucaacuucgaccccgucuacaaggucaagcccaaccccccccacaaccucuccgucaucaacuccgaggagcucuccuccauccucaagcucaccuggaccaaccccuccaucaaguccgucaucauccucaaguacaacauccaguaccgcaccaaggacgccuccaccuggucccagaucccccccgaggacaccgccuccacccgcuccuccuucaccguccaggaccucaagcccuucaccgaguacgucuuccgcauccgcugcaugaaggaggacggcaagggcuacugguccgacugguccgaggaggccuccggcaucaccuacgaggaccgccccuccaaggcccccuccuucugguacaagaucgaccccucccacacccagggcuaccgcaccguccagcucgucuggaagacccucccccccuucgaggccaacggcaagauccucgacuacgaggucacccucacccgcuggaagucccaccuccagaacuacaccgucaacgccaccaagcucaccgucaaccucaccaacgaccgcuaccucgccacccucaccguccgcaaccucgucggcaaguccgacgccgccguccucaccauccccgccugcgacuuccagggcaaccucgccgaguccaagugcuaccucaucaccgucacccccgucuacgccgacggccccggcucccccgaguccaucaaggccuaccucaagcaggccccccccuccaagggccccaccguccgcaccaagaaggucggcaagaacgaggccguccucgagugggaccagcuccccgucgacguccagaacggcuucauccgcaacuacaccaucuucuaccgcaccaucaucggcaacgagaccgccgucaacgucgacuccucccacaccgaguacacccucuccucccucaccuccgacacccucuacaugguccgcauggccgccuacaccgacgagggcggcaaggacggccccgaguucaccuucaccacccccaaguucgcccagggcgagaucgaggccaucgucguccccgucugccucgccuuccuccucaccacccuccucggcguccucuucugcuucaacaagcgcgaccucaucaagaagcacaucuggcccaacguccccgaccccuccaagucccacaucgcccagugguccccccacacccccccccgccacaacuucaacuccaaggaccagauguacuccgacggcaacuucaccgacgucuccgucgucgagaucgaggccaacgacaagaagcccuuccccgaggaccucaagucccucgaccucuucaagaaggagaagaucaacaccgagggccacuccuccggcaucggcggcuccuccugcauguccuccucccgccccuccaucuccuccuccgacgagaacgaguccucccagaacaccuccuccaccguccaguacuccaccgucguccacuccggcuaccgccaccagguccccuccguccaggucuucucccgcuccgaguccacccagccccuccucgacuccgaggagcgccccgaggaccuccagcucgucgaccacgucgacggcggcgacggcauccucccccgccagcaguacuucaagcagaacugcucccagcacgaguccucccccgacaucucccacuucgagcgcuccaagcaggucuccuccgucaacgaggaggacuucguccgccucaagcagcagaucuccgaccacaucucccaguccugcggcuccggccagaugaagauguuccaggaggucuccgccgccgacgccuucggccccggcaccgagggccaggucgagcgcuucgagaccgucggcauggaggccgccaccgacgagggcaugcccaaguccuaccucccccagaccguccgccagggcggcuacaugccccaguga

SEQ ID NO: 44644 - RNA, 402 nt, Artificial Sequence
  derived and/or modified sequence opt2 from IL7__Homo_sapiens__NP_001186815
auguuccacgucuccuuccgcuacaucuucggccuccccccccucauccucguccuccuccccgucgccuccuccgacugcgacaucgagggcaaggacggcaagcaguacgaguccguccucauggucuccaucgaccagcuccucgacuccaugaaggagaucggcuccaacugccucaacaacgaguucaacuucuucaagcgccacaucugcgacgccaacaaggucaagggccgcaagcccgccgcccucggcgaggcccagcccaccaagucccucgaggagaacaagucccucaaggagcagaagaagcucaacgaccucugcuuccucaagcgccuccuccaggagaucaagaccugcuggaacaagauccucaugggcaccaaggagcacuga

SEQ ID NO: 44645 - RNA, 1380 nt, Artificial Sequence
  derived and/or modified sequence opt2 from IL7R__Homo_sapiens__NP_002176
augaccauccucggcaccaccuucggcauggucuucucccuccuccaggucgucuccggcgaguccggcuacgcccagaacggcgaccucgaggacgccgagcucgacgacuacuccuucuccugcuacucccagcucgaggucaacggcucccagcacucccucaccugcgccuucgaggaccccgacgucaacaucaccaaccucgaguucgagaucugcggcgcccucgucgaggucaagugccucaacuuccgcaagcuccaggagaucuacuucaucgagaccaagaaguuccuccucaucggcaaguccaacaucugcgucaaggucggcgagaagucccucaccugcaagaagaucgaccucaccaccaucgucaagcccgaggcccccuucgaccucuccgucgucuaccgcgagggcgccaacgacuucgucgucaccuucaacaccucccaccuccagaagaaguacgucaagguccucaugcacgacgucgccuaccgccaggagaaggacgagaacaaguggacccacgucaaccucuccuccaccaagcucacccuccuccagcgcaagcuccagcccgccgccauguacgagaucaagguccgcuccauccccgaccacuacuucaagggcuucugguccgaguggucccccuccuacuacuuccgcacccccgagaucaacaacuccuccggcgagauggaccccauccuccucaccaucuccauccucuccuucuucuccgucgcccuccucgucauccucgccugcguccucuggaagaagcgcaucaagcccaucgucuggcccucccuccccgaccacaagaagacccucgagcaccucugcaagaagccccgcaagaaccucaacgucuccuucaaccccgaguccuuccucgacugccagauccaccgcgucgacgacauccaggcccgcgacgaggucgagggcuuccuccaggacaccuucccccagcagcucgaggaguccgagaagcagcgccucggcggcgacguccagucccccaacugccccuccgaggacgucgucaucacccccgaguccuucggccgcgacuccucccucaccugccucgccggcaacgucuccgccugcgacgcccccauccucuccuccucccgcucccucgacugccgcgaguccggcaagaacggcccccacgucuaccaggaccuccuccucucccucggcaccaccaacuccacccuccccccccccuucucccuccaguccggcauccucacccucaaccccgucgcccagggccagcccauccucaccucccucggcuccaaccaggaggaggccuacgucaccauguccuccuucuaccagaaccaguga

SEQ ID NO: 44646 - RNA, 435 nt, Artificial Sequence
  derived and/or modified sequence opt2 from IL9__Homo_sapiens__NP_000581
augcuccucgccaugguccucaccuccgcccuccuccucugcuccgucgccggccagggcugccccacccucgccggcauccucgacaucaacuuccucaucaacaagaugcaggaggaccccgccuccaagugccacugcuccgccaacgucaccuccugccucugccucggcauccccuccgacaacugcacccgccccugcuucuccgagcgccucucccagaugaccaacaccaccaugcagacccgcuacccccucaucuucucccgcgucaagaaguccgucgagguccucaagaacaacaagugccccuacuucuccugcgagcagcccugcaaccagaccaccgccggcaacgcccucaccuuccucaagucccuccucgagaucuuccagaaggagaagaugcgcggcaugcgcggcaagaucuga

SEQ ID NO: 44647 - RNA, 1566 nt, Artificial Sequence
  derived and/or modified sequence opt2 from IL9R__Homo_sapiens__NP_002177
augggccucggccgcugcaucugggagggcuggacccucgaguccgaggcccuccgccgcgacaugggcaccuggcuccucgccugcaucugcaucugcaccugcgucugccucggcgucuccgucaccggcgagggccagggcccccgcucccgcaccuucaccugccucaccaacaacauccuccgcaucgacugccacugguccgcccccgagcucggccagggcuccucccccuggcuccucuucaccuccaaccaggcccccggcggcacccacaagugcauccuccgcggcuccgagugcaccgucguccucccccccgaggccguccucguccccuccgacaacuucaccaucaccuuccaccacugcauguccggccgcgagcaggucucccucgucgaccccgaguaccucccccgccgccacgucaagcucgacccccccuccgaccuccaguccaacaucuccuccggccacugcauccucaccugguccaucucccccgcccucgagcccaugaccacccuccucuccuacgagcucgccuucaagaagcaggaggaggccugggagcaggcccagcaccgcgaccacaucgucggcgucaccuggcucauccucgaggccuucgagcucgaccccggcuucauccacgaggcccgccuccgcguccagauggccacccucgaggacgacgucgucgaggaggagcgcuacaccggccagugguccgaguggucccagcccgucugcuuccaggccccccagcgccagggcccccucaucccccccuggggcuggcccggcaacacccucgucgccgucuccaucuuccuccuccucaccggccccaccuaccuccucuucaagcucuccccccgcgucaagcgcaucuucuaccagaacguccccucccccgccauguucuuccagccccucuacuccguccacaacggcaacuuccagaccuggaugggcgcccacggcgccggcguccuccucucccaggacugcgccggcaccccccagggcgcccucgagcccugcguccaggaggccaccgcccuccucaccugcggccccgcccgccccuggaaguccgucgcccucgaggaggagcaggagggccccggcacccgccuccccggcaaccucuccuccgaggacguccuccccgccggcugcaccgaguggcgcguccagacccucgccuaccucccccaggaggacugggcccccaccucccucacccgccccgccccccccgacuccgagggcucccgcuccuccuccuccuccuccuccuccaacaacaacaacuacugcgcccucggcugcuacggcggcuggcaccucuccgcccuccccggcaacacccaguccuccggccccauccccgcccucgccugcggccucuccugcgaccaccagggccucgagacccagcagggcgucgccuggguccucgccggccacugccagcgccccggccuccacgaggaccuccagggcaugcuccuccccuccguccucuccaaggcccgcuccuggaccuucuga

SEQ ID NO: 44648 - RNA, 1641 nt, Artificial Sequence
  derived and/or modified sequence opt2 from ILDR1__Homo_sapiens__NP_001186728
auggccuggcccaagcuccccgcccccuggcuccuccucugcaccuggcuccccgccggcugccucucccuccucgucaccguccagcacaccgagcgcuacgucacccucuucgccuccaucauccucaagugcgacuacaccaccuccgcccagcuccaggacgucgucgucaccuggcgcuucaaguccuucugcaaggaccccaucuucgacuacuacuccgccuccuaccaggccgcccucucccucggccaggaccccuccaacgacugcaacgacaaccagcgcgagguccgcaucgucgcccagcgccgcggccagaacgagcccguccucggcgucgacuaccgccagcgcaagaucaccauccagaaccgcgccgaccucgucaucaacgaggucauguggugggaccacggcgucuacuacugcaccaucgaggcccccggcgacaccuccggcgaccccgacaaggaggucaagcucaucguccuccacuggcucaccgucaucuucaucauccucggcgcccuccuccuccuccuccucaucggcgucugcuggugccagugcugcccccaguacugcugcugcuacauccgcugccccugcugccccgcccacugcugcugccccgaggaggcccucgcccgccaccgcuacaugaagcaggcccaggcccucggcccccagaugaugggcaagccccucuacuggggcgccgaccgcuccucccaggucuccuccuaccccaugcacccccuccuccagcgcgaccucucccuccccuccucccucccccagaugcccaugacccagaccaccaaccagccccccaucgccaacggcguccucgaguaccucgagaaggagcuccgcaaccucaaccucgcccagccccucccccccgaccucaagggccgcuucggccaccccugcuccaugcucuccucccucggcuccgaggucgucgagcgccgcaucauccaccuccccccccucauccgcgaccucuccuccucccgccgcaccuccgacucccuccaccagcaguggcucacccccauccccucccgccccugggaccuccgcgagggccgcucccaccaccacuaccccgacuuccaccaggagcuccaggaccgcggccccaaguccugggcccucgagcgccgcgagcucgaccccuccugguccggccgccaccgcuccucccgccucaacggcucccccauccacugguccgaccgcgacucccucuccgacguccccuccuccuccgaggcccgcuggcgccccucccacccccccuuccgcucccgcugccaggagcgcccccgccgccccuccccccgcgaguccacccagcgccacggccgccgccgccgccaccgcuccuacucccccccccuccccuccggccucuccuccugguccuccgaggaggacaaggagcgccagccccaguccuggcgcgcccaccgccgcggcucccacuccccccacuggcccgaggagaagccccccuccuaccgcucccucgacaucacccccggcaagaacucccgcaagaagggcuccgucgagcgccgcuccgagaaggacuccucccacuccggccgcuccgucgucaucuga

SEQ ID NO: 44649 - RNA, 1920 nt, Artificial Sequence
  derived and/or modified sequence opt2 from ILDR2__Homo_sapiens__NP_955383
auggaccgcguccuccuccgcuggaucucccucuucuggcucaccgccauggucgagggccuccaggucaccguccccgacaagaagaaggucgccaugcucuuccagcccaccguccuccgcugccacuucuccaccuccucccaccagcccgccgucguccaguggaaguucaaguccuacugccaggaccgcaugggcgagucccucggcauguccuccacccgcgcccagucccucuccaagcgcaaccucgagugggaccccuaccucgacugccucgacucccgccgcaccguccgcgucgucgccuccaagcagggcuccaccgucacccucggcgacuucuaccgcggccgcgagaucaccaucguccacgacgccgaccuccagaucggcaagcucauguggggcgacuccggccucuacuacugcaucaucaccacccccgacgaccucgagggcaagaacgaggacuccgucgagcuccucguccucggccgcaccggccuccucgccgaccuccuccccuccuucgccgucgagaucaugcccgagugggucuucgucggccucguccuccucggcgucuuccucuucuucguccucgucggcaucugcuggugccagugcugcccccacuccugcugcugcuacguccgcugccccugcugccccgacuccugcugcugcccccaggcccucuacgaggccggcaaggccgccaaggccggcuacccccccuccgucuccggcguccccggccccuacuccauccccuccgucccccucggcggcgcccccuccuccggcaugcucauggacaagccccacccccccccccucgcccccuccgacuccaccggcggcucccacuccguccgcaagggcuaccgcauccaggccgacaaggagcgcgacuccaugaagguccucuacuacgucgagaaggagcucgcccaguucgaccccgcccgccgcaugcgcggccgcuacaacaacaccaucuccgagcucuccucccuccacgaggaggacuccaacuuccgccaguccuuccaccagaugcgcuccaagcaguuccccgucuccggcgaccucgaguccaaccccgacuacugguccggcgucaugggcggcuccuccggcgccucccgcggccccuccgccauggaguacaacaaggaggaccgcgaguccuuccgccacucccagccccgcuccaaguccgagaugcucucccgcaagaacuucgccaccggcguccccgccgucuccauggacgagcucgccgccuucgccgacuccuacggccagcgcccccgccgcgccgacggcaacucccacgaggcccgcggcggcucccgcuucgagcgcuccgagucccgcgcccacuccggcuucuaccaggacgacucccucgaggaguacuacggccagcgcucccgcucccgcgagccccucaccgacgccgaccgcggcugggccuucucccccgcccgccgccgccccgccgaggacgcccaccucccccgccucgucucccgcacccccggcaccgcccccaaguacgaccacuccuaccucggcuccgcccgcgagcgccaggcccgccccgagggcgccucccgcggcggcucccucgagacccccuccaagcgcuccgcccagcucggcccccgcuccgccuccuacuacgccugguccccccccggcaccuacaaggccggcuccucccaggacgaccaggaggacgccuccgacgacgcccucccccccuacuccgagcucgagcucacccgcggccccuccuaccgcggccgcgaccuccccuaccacuccaacuccgagaagaagcgcaagaaggagcccgccaagaagaccaacgacuuccccacccgcaugucccucgucgucuga

SEQ ID NO: 44650 - RNA, 1059 nt, Artificial Sequence
  derived and/or modified sequence opt2 from ILF2__Homo_sapiens__NP_001254738
auggccuucccccgcgucaagcccgcccccgacgagaccuccuucuccgaggcccuccucaagcgcaaccaggaccucgcccccaacuccgccgagcaggccuccauccucucccucgucaccaagaucaacaacgucaucgacaaccucaucgucgcccccggcaccuucgagguccagaucgaggagguccgccaggucggcuccuacaagaagggcaccaugaccaccggccacaacgucgccgaccucgucgucauccucaagauccuccccacccucgaggccgucgccgcccucggcaacaaggucgucgagucccuccgcgcccaggaccccuccgagguccucaccaugcucaccaacgagaccggcuucgagaucuccuccuccgacgccaccgucaagauccucaucaccaccgucccccccaaccuccgcaagcucgaccccgagcuccaccucgacaucaagguccuccaguccgcccucgccgccauccgccacgcccgcugguucgaggagaacgccucccaguccaccgucaagguccucauccgccuccucaaggaccuccgcauccgcuuccccggcuucgagccccucacccccuggauccucgaccuccucggccacuacgccgucaugaacaaccccacccgccagccccucgcccucaacgucgccuaccgccgcugccuccagauccucgccgccggccucuuccuccccggcuccgucggcaucaccgaccccugcgaguccggcaacuuccgcguccacaccgucaugacccucgagcagcaggacauggucugcuacaccgcccagacccucguccgcauccucucccacggcggcuuccgcaagauccucggccaggagggcgacgccuccuaccucgccuccgagaucuccaccugggacggcgucaucgucacccccuccgagaaggccuacgagaagccccccgagaagaaggagggcgaggaggaggaggagaacaccgaggagcccccccagggcgaggaggaggaguccauggagacccaggaguga

SEQ ID NO: 44651 - RNA, 2121 nt, Artificial Sequence
  derived and/or modified sequence opt2 from ILF3__Homo_sapiens__NP_001131145
augcgccccaugcgcaucuucgucaacgacgaccgccacgucauggccaagcacuccuccgucuaccccacccaggaggagcucgaggccguccagaacauggucucccacaccgagcgcgcccucaaggccgucuccgacuggaucgacgagcaggagaagggcuccuccgagcaggccgaguccgacaacauggacgucccccccgaggacgacuccaaggagggcgccggcgagcagaagaccgagcacaugacccgcacccuccgcggcgucaugcgcgucggccucgucgccaagggccuccuccucaagggcgaccucgaccucgagcucguccuccucugcaaggagaagcccaccaccgcccuccucgacaaggucgccgacaaccucgccauccagcucgccgccgucaccgaggacaaguacgagauccuccaguccgucgacgacgccgccaucgucaucaagaacaccaaggagcccccccucucccucaccauccaccucaccucccccgucguccgcgaggagauggagaagguccucgccggcgagacccucuccgucaacgacccccccgacguccucgaccgccagaagugccucgccgcccucgccucccuccgccacgccaagugguuccaggcccgcgccaacggccucaaguccugcgucaucgucauccgcguccuccgcgaccucugcacccgcguccccaccuggggcccccuccgcggcuggccccucgagcuccucugcgagaaguccaucggcaccgccaaccgccccaugggcgccggcgaggcccuccgccgcguccucgagugccucgccuccggcaucgucaugcccgacggcuccggcaucuacgaccccugcgagaaggaggccaccgacgccaucggccaccucgaccgccagcagcgcgaggacaucacccaguccgcccagcacgcccuccgccucgccgccuucggccagcuccacaagguccucggcauggacccccuccccuccaagaugcccaagaagcccaagaacgagaaccccgucgacuacaccguccagaucccccccuccaccaccuacgccaucacccccaugaagcgccccauggaggaggacggcgaggagaagucccccuccaagaagaagaagaagauccagaagaaggaggagaaggccgagcccccccaggccaugaacgcccucaugcgccucaaccagcucaagcccggccuccaguacaagcucgucucccagaccggccccguccacgcccccaucuucaccauguccgucgaggucgacggcaacuccuucgaggccuccggccccuccaagaagaccgccaagcuccacgucgccgucaagguccuccaggacaugggccuccccaccggcgccgagggccgcgacuccuccaagggcgaggacuccgccgaggagaccgaggccaagcccgccgucgucgcccccgcccccgucgucgaggccgucuccacccccuccgccgccuuccccuccgacgccaccgccgagaacgucaagcagcagggccccauccucaccaagcacggcaagaaccccgucauggagcucaacgagaagcgccgcggccucaaguacgagcucaucuccgagaccggcggcucccacgacaagcgcuucgucauggaggucgaggucgacggccagaaguuccagggcgccggcuccaacaagaaggucgccaaggccuacgccgcccucgccgcccucgagaagcucuuccccgacaccccccucgcccucgacgccaacaagaagaagcgcgcccccguccccguccgcggcggccccaaguucgccgccaagccccacaaccccggcuucggcaugggcggccccaugcacaacgaggucccccccccccccaaccuccgcggccgcggccgcggcggcuccauccgcggccgcggccgcggccgcggcuucggcggcgccaaccacggcggcuacaugaacgccggcgccggcuacggcuccuacggcuacggcggcaacuccgccaccgccggcuacuccgacuucuucaccgacugcuacggcuaccacgacuucggcuccuccuga

SEQ ID NO: 44652 - RNA, 1359 nt, Artificial Sequence
  derived and/or modified sequence opt2 from ILK__Homo_sapiens__NP_001014795
auggacgacaucuucacccagugccgcgagggcaacgccgucgccguccgccucuggcucgacaacaccgagaacgaccucaaccagggcgacgaccacggcuucuccccccuccacugggccugccgcgagggccgcuccgccgucgucgagaugcucaucaugcgcggcgcccgcaucaacgucaugaaccgcggcgacgacaccccccuccaccucgccgccucccacggccaccgcgacaucguccagaagcuccuccaguacaaggccgacaucaacgccgucaacgagcacggcaacgucccccuccacuacgccugcuucuggggccaggaccaggucgccgaggaccucgucgccaacggcgcccucgucuccaucugcaacaaguacggcgagaugcccgucgacaaggccaaggccccccuccgcgagcuccuccgcgagcgcgccgagaagaugggccagaaccucaaccgcauccccuacaaggacaccuucuggaagggcaccacccgcacccgcccccgcaacggcacccucaacaagcacuccggcaucgacuucaagcagcucaacuuccucaccaagcucaacgagaaccacuccggcgagcucuggaagggccgcuggcagggcaacgacaucgucgucaagguccucaagguccgcgacugguccacccgcaagucccgcgacuucaacgaggagugcccccgccuccgcaucuucucccaccccaacguccuccccguccucggcgccugccaguccccccccgccccccaccccacccucaucacccacuggaugcccuacggcucccucuacaacguccuccacgagggcaccaacuucgucgucgaccagucccaggccgucaaguucgcccucgacauggcccgcggcauggccuuccuccacacccucgagccccucaucccccgccacgcccucaacucccgcuccgucaugaucgacgaggacaugaccgcccgcaucuccauggccgacgucaaguucuccuuccagugccccggccgcauguacgcccccgccugggucgcccccgaggcccuccagaagaagcccgaggacaccaaccgccgcuccgccgacaugugguccuucgccguccuccucugggagcucgucacccgcgagguccccuucgccgaccucuccaacauggagaucggcaugaaggucgcccucgagggccuccgccccaccaucccccccggcaucuccccccacgucugcaagcucaugaagaucugcaugaacgaggaccccgccaagcgccccaaguucgacaugaucguccccauccucgagaagaugcaggacaaguga

SEQ ID NO: 44653 - RNA, 501 nt, Artificial Sequence
  derived and/or modified sequence opt2 from IMMP1L__Homo_sapiens__NP_001291203
augcuccgcggcguccucggcaagaccuuccgccucgucggcuacaccauccaguacggcugcaucgcccacugcgccuucgaguacgucggcggcgucgucaugugcuccggccccuccauggagcccaccauccagaacuccgacaucgucuucgccgagaaccucucccgccacuucuacggcauccagcgcggcgacaucgucaucgccaagucccccuccgaccccaaguccaacaucugcaagcgcgucaucggccucgagggcgacaagauccucaccaccucccccuccgacuucuucaagucccacuccuacguccccaugggccacgucuggcucgagggcgacaaccuccagaacuccaccgacucccgcugcuacggccccauccccuacggccucauccgcggccgcaucuucuucaagaucuggccccucuccgacuucggcuuccuccgcgccucccccaacggccaccgcuucuccgacgacuga

SEQ ID NO: 44654 - RNA, 528 nt, Artificial Sequence
  derived and/or modified sequence opt2 from IMMP2L__Homo_sapiens__XP_005250687
auggcccagucccagggcugggucaagcgcuacaucaaggccuucugcaagggcuucuucgucgccguccccgucgccgucaccuuccucgaccgcgucgccugcgucgcccgcgucgagggcgccuccaugcagcccucccucaaccccggcggcucccaguccuccgacgucguccuccucaaccacuggaagguccgcaacuucgagguccaccgcggcgacaucgucucccucgucucccccaagaaccccgagcagaagaucaucaagcgcgucaucgcccucgagggcgacaucguccgcaccaucggccacaagaaccgcuacgucaaggucccccgcggccacaucugggucgagggcgaccaccacggccacuccuucgacuccaacuccuucggccccgucucccucggccuccuccacgcccacgccacccacauccucuggccccccgagcgcuggcagaagcucgaguccguccucccccccgagcgccuccccguccagcgcgaggaggaguga

SEQ ID NO: 44655 - RNA, 2274 nt, Artificial Sequence
  derived and/or modified sequence opt2 from IMMT__Homo_sapiens__NP_001093639
augcuccgcgccugccagcucuccggcgucaccgccgccgcccaguccugccucugcggcaaguucguccuccgcccccuccgccccugccgccgcuacuccaccuccggcuccuccggccucaccaccggcaagaucgccggcgccggccuccucuucgucggcggcggcaucggcggcaccauccucuacgccaagugggacucccacuuccgcgaguccgucgagaagaccauccccuacuccgacaagcucuucgagaugguccucggccccgccgccuacaacgucccccuccccaagaaguccauccaguccggcccccucaagaucuccuccgucuccgaggucaugaaggaguccaagcagcccgccucccagcuccagaagcagaagggcgacacccccgccuccgccaccgcccccaccgaggccgcccagaucaucuccgccgccggcgacacccucuccguccccgcccccgccguccagcccgaggagucccucaagaccgaccaccccgagaucggcgagggcaagcccacccccgcccucuccgaggccuccuccuccuccauccgcgagcgcccccccgaggaggucgccgcccgccucgcccagcaggagaagcaggagcaggucaagaucgagucccucgccaagucccucgaggacgcccuccgccagaccgccuccgucacccuccaggccaucgccgcccagaacgccgccguccaggccgucaacgcccacuccaacauccucaaggccgccauggacaacuccgagaucgccggcgagaagaaguccgcccaguggcgcaccgucgagggcgcccucaaggagcgccgcaaggccgucgacgaggccgccgacgcccuccucaaggccaaggaggagcucgagaagaugaaguccgucaucgagaacgccaagaagaaggaggucgccggcgccaagccccacaucaccgccgccgagggcaagcuccacaacaugaucgucgaccucgacaacgucgucaagaagguccaggccgcccaguccgaggccaaggucgucucccaguaccacgagcucgucguccaggcccgcgacgacuucaagcgcgagcucgacuccaucacccccgagguccuccccggcuggaagggcauguccgucuccgaccucgccgacaagcucuccaccgacgaccucaacucccucaucgcccacgcccaccgccgcaucgaccagcucaaccgcgagcucgccgagcagaaggccaccgagaagcagcacaucacccucgcccucgagaagcagaagcucgaggagaagcgcgccuucgacuccgccgucgccaaggcccucgagcaccaccgcuccgagauccaggccgagcaggaccgcaagaucgaggagguccgcgacgccauggagaacgagaugcgcacccagcuccgccgccaggccgccgcccacaccgaccaccuccgcgacguccuccgcguccaggagcaggagcucaaguccgaguucgagcagaaccucuccgagaagcucuccgagcaggagcuccaguuccgccgccucucccaggagcaggucgacaacuucacccucgacaucaacaccgccuacgcccgccuccgcggcaucgagcaggccguccagucccacgccgucgccgaggaggaggcccgcaaggcccaccagcucuggcucuccgucgaggcccucaaguacuccaugaagaccuccuccgccgagacccccaccaucccccucggcuccgccgucgaggccaucaaggccaacugcuccgacaacgaguucacccaggcccucaccgccgccaucccccccgagucccucacccgcggcgucuacuccgaggagacccuccgcgcccgcuucuacgccguccagaagcucgcccgccgcgucgccaugaucgacgagacccgcaacucccucuaccaguacuuccucuccuaccuccagucccuccuccucuuccccccccagcagcucaagcccccccccgagcucugccccgaggacaucaacaccuucaagcuccucuccuacgccuccuacugcaucgagcacggcgaccucgagcucgccgccaaguucgucaaccagcucaagggcgagucccgccgcgucgcccaggacuggcucaaggaggcccgcaugacccucgagaccaagcagaucgucgagauccucaccgccuacgccuccgccgucggcaucggcaccacccagguccagcccgaguga

SEQ ID NO: 44656 - RNA, 555 nt, Artificial Sequence
  derived and/or modified sequence opt2 from IMP3__Homo_sapiens__NP_060755
augguccgcaagcucaaguuccacgagcagaagcuccucaagcaggucgacuuccucaacugggaggucaccgaccacaaccuccacgagcuccgcguccuccgccgcuaccgccuccagcgccgcgaggacuacacccgcuacaaccagcucucccgcgccguccgcgagcucgcccgccgccuccgcgaccuccccgagcgcgaccaguuccgcguccgcgccuccgccgcccuccucgacaagcucuacgcccucggccucguccccacccgcggcucccucgagcucugcgacuucgucaccgccuccuccuucugccgccgccgccuccccaccguccuccucaagcuccgcauggcccagcaccuccaggccgccgucgccuucgucgagcagggccacguccgcgucggccccgacgucgucaccgaccccgccuuccucgucacccgcuccauggaggacuucgucaccugggucgacuccuccaagaucaagcgccacguccucgaguacaacgaggagcgcgacgacuucgaccucgaggccuga

SEQ ID NO: 44657 - RNA, 1011 nt, Artificial Sequence
  derived and/or modified sequence opt2 from IMPA1__Homo_sapiens__NP_001138350
augggccagcgccccggccccguccuccccgccgucgccguccucggccaggucgccaagcgcaaggucgccuggcuccuccgcuggaaggccgucacccgcaccgagaccgccggcaacuccuccggcgucuacggcuucggcaagaugaagaucuucgucaaguacuuccagaagauggccgaccccuggcaggagugcauggacuacgccgucacccucgcccgccaggccggcgaggucgucugcgaggccaucaagaacgagaugaacgucaugcucaaguccucccccgucgaccucgucaccgccaccgaccagaaggucgagaagaugcucaucuccuccaucaaggagaaguaccccucccacuccuucaucggcgaggaguccgucgccgccggcgagaaguccauccucaccgacaaccccaccuggaucaucgaccccaucgacggcaccaccaacuucguccaccgcuuccccuucgucgccgucuccaucggcuucgccgucaacaagaagaucgaguucggcgucgucuacuccugcgucgagggcaagauguacaccgcccgcaagggcaagggcgccuucugcaacggccagaagcuccaggucucccagcaggaggacaucaccaagucccuccucgucaccgagcucggcuccucccgcacccccgagaccguccgcaugguccucuccaacauggagaagcucuucugcauccccguccacggcauccgcuccgucggcaccgccgccgucaacaugugccucgucgccaccggcggcgccgacgccuacuacgagaugggcauccacugcugggacgucgccggcgccggcaucaucgucaccgaggccggcggcguccucauggacgucaccggcggccccuucgaccucaugucccgccgcgucaucgccgccaacaaccgcauccucgccgagcgcaucgccaaggagauccaggucaucccccuccagcgcgacgacgaggacuga

SEQ ID NO: 44658 - RNA, 867 nt, Artificial Sequence
  derived and/or modified sequence opt2 from IMPA2__Homo_sapiens__NP_055029
augaagcccuccggcgaggaccaggccgcccucgccgccggccccugggaggagugcuuccaggccgccguccagcucgcccuccgcgccggccagaucauccgcaaggcccucaccgaggagaagcgcgucuccaccaagaccuccgccgccgaccucgucaccgagaccgaccaccucgucgaggaccucaucaucuccgagcuccgcgagcgcuuccccucccaccgcuucaucgccgaggaggccgccgccuccggcgccaagugcguccucacccacucccccaccuggaucaucgaccccaucgacggcaccugcaacuucguccaccgcuuccccaccgucgccgucuccaucggcuucgccguccgccaggagcucgaguucggcgucaucuaccacugcaccgaggagcgccucuacaccggccgccgcggccgcggcgccuucugcaacggccagcgccuccgcgucuccggcgagaccgaccucuccaaggcccucguccucaccgagaucggccccaagcgcgaccccgccacccucaagcucuuccucuccaacauggagcgccuccuccacgccaaggcccacggcguccgcgucaucggcuccuccacccucgcccucugccaccucgccuccggcgccgccgacgccuacuaccaguucggccuccacugcugggaccucgccgccgccaccgucaucauccgcgaggccggcggcaucgucaucgacaccuccggcggcccccucgaccucauggccugccgcgucgucgccgccuccacccgcgagauggccaugcucaucgcccaggcccuccagaccaucaacuacggccgcgacgacgagaaguga

SEQ ID NO: 44659 - RNA, 963 nt, Artificial Sequence
  derived and/or modified sequence opt2 from IMPACT__Homo_sapiens__NP_060909
auggccgagggcgacgccggcuccgaccagcgccagaacgaggagaucgaggccauggccgccaucuacggcgaggaguggugcgucaucgacgacugcgccaagaucuucugcauccgcaucuccgacgacaucgacgaccccaaguggacccucugccuccaggucaugcuccccaacgaguaccccggcaccgccccccccaucuaccagcucaacgcccccuggcucaagggccaggagcgcgccgaccucuccaacucccucgaggagaucuacauccagaacaucggcgaguccauccucuaccucugggucgagaagauccgcgacguccucauccagaagucccagaugaccgagcccggccccgacgucaagaagaagaccgaggaggaggacgucgagugcgaggacgaccucauccucgccugccagcccgaguccuccgucaaggcccucgacuucgacaucuccgagacccgcaccgaggucgaggucgaggagcucccccccaucgaccacggcauccccaucaccgaccgccgcuccaccuuccaggcccaccucgcccccgucgucugccccaagcaggucaagaugguccucuccaagcucuacgagaacaagaagaucgccuccgccacccacaacaucuacgccuaccgcaucuacugcgaggacaagcagaccuuccuccaggacugcgaggacgacggcgagaccgccgccggcggccgccuccuccaccucauggagauccucaacgucaagaacgucauggucgucgucucccgcugguacggcggcauccuccucggccccgaccgcuucaagcacaucaacaacugcgcccgcaacauccucgucgagaagaacuacaccaacucccccgaggaguccuccaaggcccucggcaagaacaagaagguccgcaaggacaagaagcgcaacgagcacuga

SEQ ID NO: 44660 - RNA, 1080 nt, Artificial Sequence
  derived and/or modified sequence opt2 from IMPAD1__Homo_sapiens__NP_060283
auggcccccaugggcauccgccucuccccccucggcgucgccgucuucugccuccucggccucggcguccucuaccaccucuacuccggcuuccucgccggccgcuucucccucuucggccucggcggcgagcccggcggcggcgccgccggccccgccgccgccgccgacggcggcaccgucgaccuccgcgagaugcucgccgucuccguccucgccgccguccgcggcggcgacgagguccgccgcguccgcgaguccaacguccuccacgagaaguccaagggcaagacccgcgagggcgccgaggacaagaugaccuccggcgacguccucuccaaccgcaagauguucuaccuccucaagaccgccuuccccuccguccagaucaacaccgaggagcacgucgacgccgccgaccaggaggucauccucugggaccacaagauccccgaggacauccucaaggaggucaccacccccaaggagguccccgccgaguccgucaccgucuggaucgacccccucgacgccacccaggaguacaccgaggaccuccgcaaguacgucaccaccauggucugcgucgccgucaacggcaagcccaugcucggcgucauccacaagcccuucuccgaguacaccgccugggccauggucgacggcggcuccaacgucaaggcccgcuccuccuacaacgagaagaccccccgcaucgucgucucccgcucccacuccggcauggucaagcaggucgcccuccagaccuucggcaaccagaccaccaucauccccgccggcggcgccggcuacaagguccucgcccuccucgacguccccgacaagucccaggagaaggccgaccucuacauccacgucaccuacaucaagaagugggacaucugcgccggcaacgccauccucaaggcccucggcggccacaugaccacccucuccggcgaggagaucuccuacaccggcuccgacggcaucgagggcggccuccucgccuccauccgcaugaaccaccaggcccucguccgcaagcuccccgaccucgagaagaccggccacaaguga

SEQ ID NO: 44661 - RNA, 1800 nt, Artificial Sequence
  derived and/or modified sequence opt2 from IMPDH1__Homo_sapiens__NP_000874
auggagggcccccucaccccccccccccuccagggcggcggcgccgccgccguccccgagcccggcgcccgccagcaccccggccacgagaccgccgcccagcgcuacuccgcccgccuccuccaggccggcuacgagcccgaguccccccgccucgaccucgccacccaccccaccaccccccgcuccgagcucuccuccgucguccuccucgccggcgucggcguccagauggaccgccuccgccgcgccuccauggccgacuaccucaucuccggcggcaccggcuacguccccgaggacggccucaccgcccagcagcucuucgccuccgccgacggccucaccuacaacgacuuccucauccuccccggcuucaucgacuucaucgccgacgaggucgaccucaccuccgcccucacccgcaagaucacccucaagaccccccucaucuccucccccauggacaccgucaccgaggccgacauggccaucgccauggcccucaugggcggcaucggcuucauccaccacaacugcacccccgaguuccaggccaacgagguccgcaaggucaagaaguucgagcagggcuucaucaccgaccccgucguccucucccccucccacaccgucggcgacguccucgaggccaagaugcgccacggcuucuccggcauccccaucaccgagaccggcaccaugggcuccaagcucgucggcaucgucaccucccgcgacaucgacuuccucgccgagaaggaccacaccacccuccucuccgaggucaugaccccccgcaucgagcucgucgucgcccccgccggcgucacccucaaggaggccaacgagauccuccagcgcuccaagaagggcaagcuccccaucgucaacgacugcgacgagcucgucgccaucaucgcccgcaccgaccucaagaagaaccgcgacuacccccucgccuccaaggacucccagaagcagcuccucugcggcgccgccgucggcacccgcgaggacgacaaguaccgccucgaccuccucacccaggccggcgucgacgucaucguccucgacuccucccagggcaacuccgucuaccagaucgccaugguccacuacaucaagcagaaguacccccaccuccaggucaucggcggcaacgucgucaccgccgcccaggccaagaaccucaucgacgccggcgucgacggccuccgcgucggcaugggcugcggcuccaucugcaucacccaggaggucauggccugcggccgcccccagggcaccgccgucuacaaggucgccgaguacgcccgccgcuucggcguccccaucaucgccgacggcggcauccagaccgucggccacgucgucaaggcccucgcccucggcgccuccaccgucaugaugggcucccuccucgccgccaccaccgaggcccccggcgaguacuucuucuccgacggcguccgccucaagaaguaccgcggcaugggcucccucgacgccauggagaaguccuccuccucccagaagcgcuacuucuccgagggcgacaaggucaagaucgcccagggcgucuccggcuccauccaggacaagggcuccauccagaaguucguccccuaccucaucgccggcauccagcacggcugccaggacaucggcgcccgcucccucuccguccuccgcuccaugauguacuccggcgagcucaaguucgagaagcgcaccauguccgcccagaucgagggcggcguccacggccuccacuccuacgagaagcgccucuacuga

SEQ ID NO: 44662 - RNA, 1545 nt, Artificial Sequence
  derived and/or modified sequence opt2 from IMPDH2__Homo_sapiens__NP_000875
auggccgacuaccucaucuccggcggcaccuccuacguccccgacgacggccucaccgcccagcagcucuucaacugcggcgacggccucaccuacaacgacuuccucauccuccccggcuacaucgacuucaccgccgaccaggucgaccucaccuccgcccucaccaagaagaucacccucaagaccccccucgucuccucccccauggacaccgucaccgaggccggcauggccaucgccauggcccucaccggcggcaucggcuucauccaccacaacugcacccccgaguuccaggccaacgagguccgcaaggucaagaaguacgagcagggcuucaucaccgaccccgucguccucucccccaaggaccgcguccgcgacgucuucgaggccaaggcccgccacggcuucugcggcauccccaucaccgacaccggccgcaugggcucccgccucgucggcaucaucuccucccgcgacaucgacuuccucaaggaggaggagcacgacugcuuccucgaggagaucaugaccaagcgcgaggaccucgucgucgcccccgccggcaucacccucaaggaggccaacgagauccuccagcgcuccaagaagggcaagcuccccaucgucaacgaggacgacgagcucgucgccaucaucgcccgcaccgaccucaagaagaaccgcgacuacccccucgccuccaaggacgccaagaagcagcuccucugcggcgccgccaucggcacccacgaggacgacaaguaccgccucgaccuccucgcccaggccggcgucgacgucgucguccucgacuccucccagggcaacuccaucuuccagaucaacaugaucaaguacaucaaggacaaguaccccaaccuccaggucaucggcggcaacgucgucaccgccgcccaggccaagaaccucaucgacgccggcgucgacgcccuccgcgucggcaugggcuccggcuccaucugcaucacccaggagguccucgccugcggccgcccccaggccaccgccgucuacaaggucuccgaguacgcccgccgcuucggcguccccgucaucgccgacggcggcauccagaacgucggccacaucgccaaggcccucgcccucggcgccuccaccgucaugaugggcucccuccucgccgccaccaccgaggcccccggcgaguacuucuucuccgacggcauccgccucaagaaguaccgcggcaugggcucccucgacgccauggacaagcaccucuccucccagaaccgcuacuucuccgaggccgacaagaucaaggucgcccagggcgucuccggcgccguccaggacaagggcuccauccacaaguucguccccuaccucaucgccggcauccagcacuccugccaggacaucggcgccaagucccucacccagguccgcgccaugauguacuccggcgagcucaaguucgagaagcgcaccuccuccgcccaggucgagggcggcguccacucccuccacuccuacgagaagcgccucuucuga

SEQ ID NO: 44663 - RNA, 2160 nt, Artificial Sequence
  derived and/or modified sequence opt2 from IMPG1__Homo_sapiens__NP_001269297
auguaccucgagacccgccgcgccaucuucgucuucuggaucuuccuccagguccagggcaccaaggucugccaggaggccgucugggaggccuaccgcaucuuccucgaccgcauccccgacaccggcgaguaccaggacugggucuccaucugccagcaggagaccuucugccucuucgacaucggcaagaacuucuccaacucccaggagcaccucgaccuccuccagcagcgcaucaagcagcgcuccuuccccgaccgcaaggacgagaucuccgccgagaagacccucggcgagcccggcgagaccaucgucaucuccaccgacgucgccaacgucucccucggccccuucccccucacccccgacgacacccuccucaacgagauccucgacaacacccucaacgacaccaagaugcccaccaccgagcgcgagaccgaguucgccguccucgaggagcagcgcgucgagcucuccgucucccucgucaaccagaaguucaaggccgagcucgccgacucccagucccccuacuaccaggagcucgccggcaagucccagcuccagaugcagaagaucuucaagaagcuccccggcuucaagaagauccacguccucggcuuccgccccaagaaggagaaggacggcuccuccuccaccgagaugcagcucaccgccaucuucaagcgccacuccgccgaggccaagucccccgccuccgaccuccucuccuucgacuccaacaagaucgaguccgaggaggucuaccacggcaccauggaggaggacaagcagcccgagaucuaccucaccgccaccgaccucaagcgccucaucuccaaggcccucgaggaggagcagucccucgacgucggcaccauccaguucaccgacgagaucgccggcucccuccccgccuucggccccgacacccaguccgagcuccccaccuccuucgccgucaucaccgaggacgccacccucucccccgagcucccccccgucgagccccagcucgagaccgucgacggcgccgagcacggccuccccgacaccuccugguccccccccgccauggccuccaccucccucuccgaggccccccccuucuucauggccuccuccaucuucucccucaccgaccagggcaccaccgacaccauggccaccgaccagaccaugcucguccccggccucaccauccccaccuccgacuacuccgccaucucccagcucgcccucggcaucucccacccccccgccuccuccgacgacucccgcuccuccgccggcggcgaggacaugguccgccaccucgacgagauggaccucuccgacacccccgcccccuccgagguccccgagcucuccgaguacgucuccguccccgaccacuuccucgaggacaccacccccgucuccgcccuccaguacaucaccaccuccuccaugaccaucgcccccaagggccgcgagcucgucgucuucuucucccuccgcgucgccaacauggccuucuccaacgaccucuucaacaaguccucccucgaguaccgcgcccucgagcagcaguucacccagcuccucguccccuaccuccgcuccaaccucaccggcuucaagcagcucgagauccucaacuuccgcaacggcuccgucaucgucaacuccaagaugaaguucgccaaguccguccccuacaaccucaccaaggccguccacggcguccucgaggacuuccgcuccgccgccgcccagcagcuccaccucgagaucgacuccuacucccucaacaucgagcccgccgaccaggccgaccccugcaaguuccucgccugcggcgaguucgcccagugcgucaagaacgagcgcaccgaggaggccgagugccgcugcaagcccggcuacgacucccagggcucccucgacggccucgagcccggccucugcggccccggcaccaaggagugcgagguccuccagggcaagggcgcccccugccgccuccccgaccacuccgagaaccaggccuacaagaccuccgucaagaaguuccagaaccagcagaacaacaaggucaucuccaagcgcaacuccgagcuccucaccgucgaguacgaggaguucaaccaccaggacugggagggcaacuga

SEQ ID NO: 44664 - RNA, 3726 nt, Artificial Sequence
  derived and/or modified sequence opt2 from IMPG2__Homo_sapiens__NP_057331
augaucauguucccccucuucggcaagaucucccucggcauccucaucuucguccucaucgagggcgacuuccccucccucaccgcccagaccuaccucuccaucgaggagauccaggagcccaaguccgccgucuccuuccuccuccccgaggaguccaccgaccucucccucgccaccaagaagaagcagccccucgaccgccgcgagaccgagcgccaguggcucauccgccgccgccgcuccauccucuuccccaacggcgucaagaucugccccgacgaguccgucgccgaggccgucgccaaccacgucaaguacuucaagguccgcgucugccaggaggccgucugggaggccuuccgcaccuucugggaccgccuccccggccgcgaggaguaccacuacuggaugaaccucugcgaggacggcgucaccuccaucuucgagaugggcaccaacuucuccgaguccgucgagcaccgcucccucaucaugaagaagcucaccuacgccaaggagaccgucuccuccuccgagcucuccucccccguccccgucggcgacaccuccacccucggcgacaccacccucuccgucccccaccccgaggucgacgccuacgagggcgccuccgaguccucccucgagcgccccgaggaguccaucuccaacgagaucgagaacgucaucgaggaggccaccaagcccgccggcgagcagaucgccgaguucuccauccaccuccucggcaagcaguaccgcgaggagcuccaggacuccuccuccuuccaccaccagcaccucgaggaggaguucaucuccgaggucgagaacgccuucaccggccuccccggcuacaaggagauccgcguccucgaguuccgcucccccaaggagaacgacuccggcgucgacgucuacuacgccgucaccuucaacggcgaggccaucuccaacaccaccugggaccucaucucccuccacuccaacaaggucgagaaccacggccucgucgagcucgacgacaagcccaccgucgucuacaccaucuccaacuuccgcgacuacaucgccgagacccuccagcagaacuuccuccucggcaacuccucccucaaccccgaccccgacucccuccagcucaucaacguccgcggcguccuccgccaccagaccgaggaccucgucuggaacacccaguccuccucccuccaggccacccccuccuccauccucgacaacaccuuccaggccgccuggcccuccgccgacgaguccaucaccuccuccauccccccccucgacuucuccuccggcccccccuccgccaccggccgcgagcucugguccgaguccccccucggcgaccucgucuccacccacaagcucgccuuccccuccaagaugggccucuccuccucccccgagguccucgaggucuccucccucacccuccacuccgucacccccgccguccuccagaccggccuccccgucgccuccgaggagcgcaccuccggcucccaccucgucgaggacggccucgccaacgucgaggaguccgaggacuuccucuccaucgacucccuccccuccuccuccuucacccagcccguccccaaggagaccauccccuccauggaggacuccgacgucucccucaccuccucccccuaccucaccuccuccauccccuucggccucgacucccucaccuccaaggucaaggaccagcucaaggucucccccuuccuccccgacgccuccauggagaaggagcucaucuucgacggcggccucggcuccggcuccggccagaaggucgaccucaucaccuggcccugguccgagaccuccuccgagaaguccgccgagccccucuccaagcccuggcucgaggacgacgacucccuccuccccgccgagaucgaggacaagaagcucguccucgucgacaagauggacuccaccgaccagaucuccaagcacuccaaguacgagcacgacgaccgcuccacccacuuccccgaggaggagccccucuccggccccgccguccccaucuucgccgacaccgccgccgaguccgccucccucacccuccccaagcacaucuccgagguccccggcgucgacgacuacuccgucaccaaggccccccucauccucaccuccgucgccaucuccgccuccaccgacaaguccgaccaggccgacgccauccuccgcgaggacauggagcagaucaccgaguccuccaacuacgagugguucgacuccgaggucuccauggucaagcccgacaugcagacccucuggaccauccuccccgaguccgagcgcgucuggacccgcaccuccucccucgagaagcucucccgcgacauccucgccuccaccccccaguccgccgaccgccucuggcucuccgucacccaguccaccaagcucccccccaccaccaucuccacccuccucgaggacgaggucaucaugggcguccaggacaucucccucgagcucgaccgcaucggcaccgacuacuaccagcccgagcagguccaggagcagaacggcaaggucggcuccuacgucgagauguccaccuccguccacuccaccgagauggucuccgucgccuggcccaccgagggcggcgacgaccucuccuacacccagaccuccggcgcccucgucgucuucuucucccuccgcgucaccaacaugauguucuccgaggaccucuucaacaagaacucccucgaguacaaggcccucgagcagcgcuuccucgagcuccucguccccuaccuccaguccaaccucaccggcuuccagaaccucgagauccucaacuuccgcaacggcuccaucgucgucaacucccgcaugaaguucgccaacuccgucccccccaacgucaacaacgccgucuacaugauccucgaggacuucugcaccaccgccuacaacaccaugaaccucgccaucgacaaguacucccucgacgucgaguccggcgacgaggccaaccccugcaaguuccaggccugcaacgaguucuccgagugccucgucaaccccugguccggcgaggccaagugccgcugcuuccccggcuaccucuccgucgaggagcgccccugccagucccucugcgaccuccagcccgacuucugccucaacgacggcaagugcgacaucaugcccggccacggcgccaucugccgcugccgcgucggcgagaacuggugguaccgcggcaagcacugcgaggaguucgucuccgagcccgucaucaucggcaucaccaucgccuccgucgucggccuccucgucaucuucuccgccaucaucuacuucuucauccgcacccuccaggcccaccacgaccgcuccgagcgcgagucccccuucuccggcuccucccgccagcccgacucccucuccuccaucgagaacgccgucaaguacaaccccgucuacgagucccaccgcgccggcugcgagaaguacgagggccccuacccccagcaccccuucuacuccuccgccuccggcgacgucaucggcggccucucccgcgaggagauccgccagauguacgaguccuccgagcucucccgcgaggagauccaggagcgcaugcgcguccucgagcucuacgccaacgaccccgaguucgccgccuucguccgcgagcagcaggucgaggaggucuga

SEQ ID NO: 44665 - RNA, 5739 nt, Artificial Sequence
  derived and/or modified sequence opt2 from INADL__Homo_sapiens__XP_011538767
augcccgagaaccccgccaccgacaagcuccagguccuccagguccucgaccgccucaagaugaagcuccaggagaagggcgacaccucccagaacgagaagcucuccauguucuacgagacccucaaguccccccucuucaaccagauccucacccuccagcaguccaucaagcagcucaagggccagcucaaccacauccccuccgacugcuccgccaacuucgacuucucccgcaagggccuccucgucuucaccgacggcuccaucaccaacggcaacguccaccgccccuccaacaacuccaccgucuccggccucuuccccuggacccccaagcucggcaacgaggacuucaacuccgucauccagcagauggcccagggccgccagaucgaguacaucgacaucgagcgccccuccaccggcggccucggcuucuccgucgucgcccuccgcucccagaaccucggcaaggucgacaucuucgucaaggacguccagcccggcuccgucgccgaccgcgaccagcgccucaaggagaacgaccagauccucgccaucaaccacaccccccucgaccagaacaucucccaccagcaggccaucgcccuccuccagcagaccaccggcucccuccgccucaucgucgcccgcgagcccguccacaccaaguccuccaccuccuccucccucaacgacaccacccuccccgagaccgucugcuggggccacgucgaggaggucgagcucaucaacgacggcuccggccucggcuucggcaucgucggcggcaagaccuccggcgucgucguccgcaccaucguccccggcggccucgccgaccgcgacggccgccuccagaccggcgaccacauccucaagaucggcggcaccaacguccagggcaugaccuccgagcaggucgcccagguccuccgcaacugcggcaacuccguccgcaugcucgucgcccgcgaccccgccggcgacaucuccgucaccccccccgcccccgccgcccuccccgucgcccuccccaccgucgccuccaagggccccggcuccgacuccucccucuucgagaccuacaacgucgagcucguccgcaaggacggccagucccucggcauccgcaucgucggcuacgucggcaccucccacaccggcgaggccuccggcaucuacgucaaguccaucauccccggcuccgccgccuaccacaacggccacauccaggucaacgacaagaucgucgccgucgacggcgucaacauccagggcuucgccaaccacgacgucgucgagguccuccgcaacgccggccaggucguccaccucacccucguccgccgcaagaccuccuccuccaccuccccccucgagccccccuccgaccgcggcaccgucgucgagccccucaagccccccgcccucuuccucaccggcgccgucgagaccgagaccaacgucgacggcgaggacgaggagaucaaggagcgcaucgacacccucaagaacgacaacauccaggcccucgagaagcucgagaagguccccgacucccccgagaacgagcucaagucccgcugggagaaccuccucggccccgacuacgaggucauggucgccacccucgacacccagaucgccgacgacgccgagcuccagaaguacuccaagcuccuccccauccacacccuccgccucggcgucgaggucgacuccuucgacggccaccacuacaucuccuccaucgucuccggcggccccgucgacacccucggccuccuccagcccgaggacgagcuccucgaggucaacggcaugcagcucuacggcaagucccgccgcgaggccgucuccuuccucaaggagguccccccccccuucacccucgucugcugccgccgccucuucgacgacgaggccuccgucgacgagccccgccgcaccgagaccucccuccccgagaccgaggucgaccacaacauggacgucaacaccgaggaggacgacgacggcgagcucgcccucuggucccccgaggucaagaucgucgagcucgucaaggacugcaagggccucggcuucuccauccucgacuaccaggacccccucgaccccacccgcuccgucaucgucauccgcucccucgucgccgacggcgucgccgagcgcuccggcggccuccuccccggcgaccgccucgucuccgucaacgaguacugccucgacaacaccucccucgccgaggccgucgagauccucaaggccgucccccccggccucguccaccucggcaucugcaagccccucgucgaggacaacgaggaggaguccugcuacauccuccacuccuccuccaacgaggacaagaccgaguucuccggcaccauccacgacaucaacuccucccucauccucgaggcccccaagggcuuccgcgacgagcccuacuucaaggaggagcucgucgacgagcccuuccucgaccucggcaaguccuuccacucccagcagaaggagaucgagcaguccaaggaggccugggagaugcacgaguuccucaccccccgccuccaggagauggacgaggagcgcgagauccucgucgacgaggaguacgagcucuaccaggaccccucccccuccauggagcucuacccccucucccacauccaggaggccacccccguccccuccgucaacgagcuccacuucggcacccaguggcuccacgacaacgagcccuccgagucccaggaggcccgcaccggccgcaccgucuacucccaggaggcccagcccuacggcuacugccccgagaacgucaugaaggagaacuucgucauggagucccuccccuccguccccuccaccgagggcaacucccagcagggccgcuucgacgaccucgagaaccucaacucccucgccaagaccucccucgaccucggcaugauccccaacgacguccagggccccucccuccucaucgaccuccccgucgucgcccagcgccgcgagcaggaggaccucccccucuaccagcaccaggccacccgcgucaucuccaaggccuccgccuacaccggcaugcucuccucccgcuacgccaccgacaccugcgagcuccccgagcgcgaggagggcgagggcgaggagacccccaacuucucccacuggggccccccccgcaucgucgagaucuuccgcgagcccaacgucucccucggcaucuccaucgucggcggccagaccgucaucaagcgccucaagaacggcgaggagcucaagggcaucuucaucaagcagguccucgaggacucccccgccggcaagaccaacgcccucaagaccggcgacaagauccucgaggucuccggcgucgaccuccagaacgccucccacuccgaggccgucgaggccaucaagaacgccggcaaccccgucgucuucaucguccagucccucuccuccaccccccgcgucauccccaacguccacaacaaggccaacaagaucaccggcaaccagaaccaggacacccaggagaagaaggagaagcgccagggcaccgcccccccccccaugaagcuccccccccccuacaaggcccucaccgacgacuccgacgagaacgaggaggaggacgccuucaccgaccagaagauccgccagcgcuacgccgaccuccccggcgagcuccacaucaucgagcucgagaaggacaagaacggccucggccucucccucgccggcaacaaggaccgcucccgcauguccaucuucgucgucggcaucaaccccgagggccccgccgccgccgacggccgcaugcgcaucggcgacgagcuccucgagaucaacaaccagauccucuacggccgcucccaccagaacgccuccgccaucaucaagaccgcccccuccaaggucaagcucgucuucauccgcaacgaggacgccgucaaccagauggccgucacccccuuccccguccccuccuccucccccuccuccaucgaggaccaguccggcaccgagcccaucuccuccgaggaggacggcuccgucgaggucggcaucaagcagcuccccgaguccgaguccuucaagcucgccgucucccagaugaagcagcagaaguaccccaccaaggucuccuucuccucccaggagaucccccucgcccccgccuccuccuaccacuccaccgacgccgacuucaccggcuacggcggcuuccaggccccccucuccgucgaccccgccaccugccccaucguccccggccaggagaugaucaucgagaucuccaagggccgcuccggccucggccucuccaucgucggcggcaaggacaccccccucuucuggcgccucggcuccccccgcgccuggucccagcaccucguccgcgccuucaugcuccaccaccccgucaccgaggucgagggccagaacgccaucgucauccacgaggucuacgaggagggcgccgccgcccgcgacggccgccucugggccggcgaccagauccucgaggucaacggcgucgaccuccgcaacuccucccacgaggaggccaucaccgcccuccgccagaccccccagaagguccgccucgucgucuaccgcgacgaggcccacuaccgcgacgaggagaaccucgagaucuuccccgucgaccuccagaagaaggccggccgcggccucggccucuccaucgucggcaagcgcaacggcuccggcgucuucaucuccgacaucgucaagggcggcgccgccgaccucgacggccgccucauccagggcgaccagauccucuccgucaacggcgaggacaugcgcaacgccucccaggagaccgucgccaccauccucaagugcgcccagggccucguccagcucgagaucggccgccuccgcgccggcuccuggaccuccgcccgcaccaccucccagaacucccagggcucccagcaguccgcccacuccuccugccaccccuccuucgcccccgucaucaccggccuccagaaccucgucggcaccaagcgcgucuccgaccccucccagaagaacuccggcaccgacauggagccccgcaccgucgagaucaaccgcgagcucuccgacgcccucggcaucuccaucgccggcggccgcggcuccccccucggcgacauccccgucuucaucgccaugauccaggccuccggcgucgccgcccgcacccagaagcucaaggucggcgaccgcaucgucuccaucaacggccagccccucgacggccucucccacgccgacgucgucaaccuccucaagaacgccuacggccgcaucauccuccaggucgucgccgacaccaacaucuccgccaucgccgcccagcucgagaacauguccaccggcuaccaccucggcucccccaccgccgagcaccaccccgaggacaccgagacccccccccccaagaucaucacccucgagaagggcuccgagggccucggcuucuccaucgucggcggcuacggcuccccccacggcgaccuccccaucuacgucaagaccgucuucgccaagggcgccgccgccgacgacggccgccucaagcgcggcgaccagauccucgccgucaacggcgagacccucgagggcgucacccacgagcaggccgucgccauccucaagcaccagcgcggcaccgucacccucaccguccucuccuga

SEQ ID NO: 44666 - RNA, 1500 nt, Artificial Sequence
  derived and/or modified sequence opt2 from INA__Homo_sapiens__NP_116116
auguccuucggcuccgagcacuaccucugcuccuccuccuccuaccgcaaggucuucggcgacggcucccgccucuccgcccgccucuccggcgccggcggcgccggcggcuuccgcucccagucccucucccgcuccaacgucgccuccuccgccgccugcuccuccgccuccucccucggccucggccucgccuaccgccgcccccccgccuccgacggccucgaccucucccaggccgccgcccgcaccaacgaguacaagaucauccgcaccaacgagaaggagcagcuccagggccucaacgaccgcuucgccgucuucaucgagaagguccaccagcucgagacccagaaccgcgcccucgaggccgagcucgccgcccuccgccagcgccacgccgagcccucccgcgucggcgagcucuuccagcgcgagcuccgcgaccuccgcgcccagcucgaggaggccuccuccgcccgcucccaggcccuccucgagcgcgacggccucgccgaggagguccagcgccuccgcgcccgcugcgaggaggagucccgcggccgcgagggcgccgagcgcgcccucaaggcccagcagcgcgacgucgacggcgccacccucgcccgccucgaccucgagaagaaggucgagucccuccucgacgagcucgccuucguccgccagguccacgacgaggaggucgccgagcuccucgccacccuccaggccuccucccaggccgccgccgaggucgacgucaccgucgccaagcccgaccucaccuccgcccuccgcgagauccgcgcccaguacgagucccucgccgccaagaaccuccaguccgccgaggagugguacaaguccaaguucgccaaccucaacgagcaggccgcccgcuccaccgaggccauccgcgccucccgcgaggagauccacgaguaccgccgccagcuccaggcccgcaccaucgagaucgagggccuccgcggcgccaacgagucccucgagcgccagauccucgagcucgaggagcgccacuccgccgaggucgccggcuaccaggacuccaucggccagcucgagaacgaccuccgcaacaccaaguccgagauggcccgccaccuccgcgaguaccaggaccuccucaacgucaagauggcccucgacaucgagaucgccgccuaccgcaagcuccucgagggcgaggagacccgcuucuccaccuccggccucuccaucuccggccucaacccccuccccaaccccuccuaccuccuccccccccgcauccucuccgccaccaccuccaaggucuccuccaccggccucucccucaagaaggaggaggaggaggaggaggccuccaaggucgccuccaagaagaccucccagaucggcgaguccuucgaggagauccucgaggagaccgucaucuccaccaagaagaccgagaaguccaacaucgaggagaccaccaucuccucccagaagaucuga

SEQ ID NO: 44667 - RNA, 2757 nt, Artificial Sequence
  derived and/or modified sequence opt2 from INCENP__Homo_sapiens__NP_001035784
augggcaccaccgcccccggccccauccaccuccucgagcucugcgaccagaagcucauggaguuccucugcaacauggacaacaaggaccucgucuggcucgaggagauccaggaggaggccgagcgcauguucacccgcgaguucuccaaggagcccgagcucaugcccaagacccccucccagaagaaccgccgcaagaagcgccgcaucuccuacguccaggacgagaaccgcgaccccauccgccgccgccucucccgccgcaagucccgcuccucccagcucuccucccgccgccuccgcuccaaggacuccgucgagaagcucgccaccgucgucggcgagaacggcuccguccuccgccgcgucacccgcgccgccgccgccgccgccgccgccaccauggcccucgccgcccccuccucccccacccccgagucccccaccaugcucaccaagaagcccgaggacaaccacacccagugccagcucguccccgucgucgagaucggcaucuccgagcgccagaacgccgagcagcacgucacccagcucauguccaccgagccccucccccgcacccucucccccacccccgccuccgccaccgcccccaccucccagggcauccccaccuccgacgaggaguccacccccaagaaguccaaggcccgcauccucgaguccaucaccgucuccucccucauggccaccccccaggaccccaagggccagggcgucggcaccggccgcuccgccuccaagcuccgcaucgcccaggucucccccggcccccgcgacucccccgccuuccccgacucccccuggcgcgagcgcguccucgcccccauccuccccgacaacuucuccacccccaccggcucccgcaccgacucccaguccguccgccacucccccaucgcccccuccucccccuccccccagguccucgcccagaaguacucccucgucgccaagcaggaguccgucguccgccgcgccucccgccgccucgccaagaagaccgccgaggagcccgccgccuccggccgcaucaucugccacuccuaccucgagcgccuccucaacgucgaggucccccagaaggucggcuccgagcagaaggagccccccgaggaggccgagcccgucgccgccgccgagcccgagguccccgagaacaacggcaacaacuccuggccccacaacgacaccgagaucgccaacuccacccccaaccccaagcccgccgccuccucccccgagacccccuccgccggccagcaggaggccaagaccgaccaggccgacggcccccgcgagcccccccaguccgcccgccgcaagcgcuccuacaagcaggccgucuccgagcucgacgaggagcagcaccucgaggacgaggagcuccagcccccccgcuccaagacccccuccucccccugccccgccuccaaggucguccgcccccuccgcaccuuccuccacaccguccagcgcaaccagaugcucaugacccccaccuccgccccccgcuccgucaugaaguccuucaucaagcgcaacaccccccuccgcauggaccccaagugcuccuucgucgagaaggagcgccagcgccucgagaaccuccgccgcaaggaggaggccgagcagcuccgccgccagaaggucgaggaggacaagcgccgccgccucgaggaggucaagcucaagcgcgaggagcgccuccgcaagguccuccaggcccgcgagcgcgucgagcagaugaaggaggagaagaagaagcagaucgagcagaaguucgcccagaucgacgagaagaccgagaaggccaaggaggagcgccucgccgaggagaaggccaagaagaaggccgccgccaagaagauggaggaggucgaggcccgccgcaagcaggaggaggaggcccgccgccuccgcuggcuccagcaggaggaggaggagcgccgccaccaggagcuccuccagaagaagaaggaggaggagcaggagcgccuccgcaaggccgccgaggccaagcgccucgccgagcagcgcgagcaggagcgccgcgagcaggagcgccgcgagcaggagcgccgcgagcaggagcgccgcgagcaggagcgccgcgagcaggagcgccagcucgccgagcaggagcgccgccgcgagcaggagcgccuccaggccgagcgcgagcuccaggagcgcgagaaggcccuccgccuccagaaggagcagcuccagcgcgagcucgaggagaagaagaagaaggaggagcagcagcgccucgccgagcgccagcuccaggaggagcaggagaagaaggccaaggaggccgccggcgccuccaaggcccucaacgucaccgucgacguccagucccccgccugcaccuccuaccagaugaccccccagggccaccgcgccccccccaagaucaaccccgacaacuacggcauggaccucaacuccgacgacuccaccgacgacgaggcccacccccgcaagcccauccccaccugggcccgcggcaccccccucucccaggccaucauccaccaguacuaccacccccccaaccuccucgagcucuucggcaccauccucccccucgaccucgaggacaucuucaagaaguccaagccccgcuaccacaagcgcaccuccuccgccgucuggaacucccccccccuccagggcgcccgcguccccuccucccucgccuacucccucaagaagcacuga

SEQ ID NO: 44668 - RNA, 3723 nt, Artificial Sequence
  derived and/or modified sequence opt2 from INF2__Homo_sapiens__NP_001026884
auguccgucaaggagggcgcccagcgcaagugggccgcccucaaggagaagcucggcccccaggacuccgaccccaccgaggccaaccucgaguccgccgaccccgagcucugcauccgccuccuccagaugcccuccgucgucaacuacuccggccuccgcaagcgccucgagggcuccgacggcggcuggaugguccaguuccucgagcaguccggccucgaccuccuccucgaggcccucgcccgccucuccggccgcggcgucgcccgcaucuccgacgcccuccuccagcucaccugcgucuccugcguccgcgccgucaugaacucccgccagggcaucgaguacauccucuccaaccagggcuacguccgccagcucucccaggcccucgacaccuccaacgucauggucaagaagcaggucuucgagcuccucgccgcccucugcaucuacucccccgagggccacguccucacccucgacgcccucgaccacuacaagaccgucugcucccagcaguaccgcuucuccaucgucaugaacgagcucuccggcuccgacaacguccccuacgucgucacccuccucuccgucaucaacgccgucauccucggccccgaggaccuccgcgcccgcacccagcuccgcaacgaguucaucggccuccagcuccucgacguccucgcccgccuccgcgaccucgaggacgccgaccuccucauccagcucgaggccuucgaggaggccaaggccgaggacgaggaggagcuccuccgcgucuccggcggcgucgacauguccucccaccaggaggucuucgccucccucuuccacaaggucuccugcucccccgucuccgcccagcuccucuccguccuccagggccuccuccaccucgagcccacccuccgcuccucccagcuccucugggaggcccucgagucccucgucaaccgcgccguccuccucgccuccgacgcccaggagugcacccucgaggaggucgucgagcgccuccucuccgucaagggccgcccccgccccuccccccucgucaaggcccacaaguccguccaggccaaccucgaccagucccagcgcggcuccuccccccagaacaccaccacccccaagcccuccgucgagggccagcagcccgccgccgccgccgccugcgagcccgucgaccacgcccaguccgaguccauccucaaggucucccagccccgcgcccucgagcagcaggccuccacccccccccccccccccccccccccccuccuccccggcuccuccgccgagccccccccccccccccccccccccccccuccccuccgucggcgccaaggcccuccccaccgccccccccccccccccccuccccggccucggcgccauggccccccccgcccccccccucccccccccccuccccggcuccugcgaguuccuccccccccccccccccccccuccccggccucggcugccccccccccccccccccccuccuccccggcaugggcuggggcccccccccccccccccccccccuccuccccugcaccugcuccccccccgucgccggcggcauggaggaggucaucgucgcccaggucgaccacggccucggcuccgccuggguccccucccaccgccgcgucaacccccccacccuccgcaugaagaagcucaacuggcagaagcuccccuccaacgucgcccgcgagcacaacuccaugugggccucccucuccucccccgacgccgaggccgucgagcccgacuucuccuccaucgagcgccucuucuccuuccccgccgccaagcccaaggagcccaccauggucgccccccgcgcccgcaaggagcccaaggagaucaccuuccucgacgccaagaagucccucaaccucaacaucuuccucaagcaguucaagugcuccaacgaggaggucgccgccaugauccgcgccggcgacaccaccaaguucgacgucgagguccucaagcagcuccucaagcuccuccccgagaagcacgagaucgagaaccuccgcgccuucaccgaggagcgcgccaagcucgccuccgccgaccacuucuaccuccuccuccucgccauccccugcuaccagcuccgcaucgagugcaugcuccucugcgagggcgccgccgccguccucgacaugguccgccccaaggcccagcucguccucgccgccugcgagucccuccucaccucccgccagcuccccaucuucugccagcucauccuccgcaucggcaacuuccucaacuacggcucccacaccggcgacgccgacggcuucaagaucuccacccuccucaagcucaccgagaccaagucccagcagaaccgcgucacccuccuccaccacguccucgaggaggccgagaagucccaccccgaccuccuccagcucccccgcgaccucgagcagcccucccaggccgccggcaucaaccucgagaucauccgcuccgaggccuccuccaaccucaagaagcuccucgagaccgagcgcaaggucuccgccuccgucgccgagguccaggagcaguacaccgagcgccuccaggccuccaucuccgccuuccgcgcccucgacgagcucuucgaggccaucgagcagaagcagcgcgagcucgccgacuaccucugcgaggacgcccagcagcucucccucgaggacaccuucuccaccaugaaggccuuccgcgaccucuuccuccgcgcccucaaggagaacaaggaccgcaaggagcaggccgccaaggccgagcgccgcaagcagcagcucgccgaggaggaggcccgccgcccccgcggcgaggacggcaagcccguccgcaagggccccggcaagcaggaggaggucugcgucaucgacgcccuccucgccgacauccgcaagggcuuccagcuccgcaagaccgcccgcggccgcggcgacaccgacggcggcuccaaggccgccuccauggaccccccccgcgccaccgagcccgucgccaccuccaaccccgccggcgaccccgucggcuccacccgcugccccgccuccgagcccggccucgacgccaccaccgccuccgagucccgcggcugggaccucgucgacgccgucacccccggcccccagcccacccucgagcagcucgaggagggcggcccccgcccccucgagcgccgcuccuccugguacgucgacgccuccgacguccucaccaccgaggacccccagugcccccagccccucgagggcgccuggcccgucacccucggcgacgcccaggcccucaagccccucaaguucuccuccaaccagccccccgccgccggcuccucccgccaggacgccaaggaccccaccucccuccucggcguccuccaggccgaggccgacuccaccuccgagggccucgaggacgccguccacucccgcggcgcccgcccccccgccgccggccccggcggcgacgaggacgaggacgaggaggacaccgcccccgaguccgcccucgacaccucccucgacaaguccuucuccgaggacgccgucaccgacuccuccggcuccggcacccucccccgcgcccgcggccgcgccuccaagggcaccggcaagcgccgcaagaagcgccccucccgcucccaggagggccuccgcccccgccccaaggccaaguga

SEQ ID NO: 44669 - RNA, 789 nt, Artificial Sequence
  derived and/or modified sequence opt2 from ING1__Homo_sapiens__NP_001254657
auguccuucgucgagugccccuaccacucccccgccgagcgccucgucgccgaggccgacgagggcggccccuccgccaucaccgagauccucaaggagcucgacgagugcuacgagcgcuucucccgcgagaccgacggcgcccagaagcgccgcaugcuccacugcguccagcgcgcccucauccgcucccaggagcucggcgacgagaagauccagaucgucucccagauggucgagcucgucgagaaccgcacccgccaggucgacucccacgucgagcucuucgaggcccagcaggagcucggcgacaccgccggcaacuccggcaaggccggcgccgaccgccccaagggcgaggccgccgcccaggccgacaagcccaacuccaagcgcucccgccgccagcgcaacaacgagaaccgcgagaacgccuccuccaaccacgaccacgacgacggcgccuccggcacccccaaggagaagaaggccaagaccuccaagaagaagaagcgcuccaaggccaaggccgagcgcgaggccucccccgccgaccuccccaucgaccccaacgagcccaccuacugccucugcaaccaggucuccuacggcgagaugaucggcugcgacaacgacgagugccccaucgagugguuccacuucuccugcgucggccucaaccacaagcccaagggcaagugguacugccccaagugccgcggcgagaacgagaagaccauggacaaggcccucgagaaguccaagaaggagcgcgccuacaaccgcuga

SEQ ID NO: 44670 - RNA, 723 nt, Artificial Sequence
  derived and/or modified sequence opt2 from ING2__Homo_sapiens__NP_001278888
auggaccaggacggcgaccagcagcucggccccucccgcauccucgccccccagacccucaaggagaucgacgacgucuacgagaaguacaagaaggaggacgaccucaaccagaagaagcgccuccagcagcuccuccagcgcgcccucaucaacucccaggagcucggcgacgagaagauccagaucgucacccagaugcucgagcucgucgagaaccgcgcccgccagauggagcuccacucccagugcuuccaggaccccgccgaguccgagcgcgccuccgacaaggccaagauggacuccucccagcccgagcgcuccucccgccgcccccgccgccagcgcaccuccgagucccgcgaccucugccacauggccaacggcaucgaggacugcgacgaccagccccccaaggagaagaaguccaaguccgccaagaagaagaagcgcuccaaggccaagcaggagcgcgaggccucccccgucgaguucgccaucgaccccaacgagcccaccuacugccucugcaaccaggucuccuacggcgagaugaucggcugcgacaacgagcagugccccaucgagugguuccacuucuccugcgucucccucaccuacaagcccaagggcaagugguacugccccaagugccgcggcgacaacgagaagaccauggacaaguccaccgagaagaccaagaaggaccgccgcucccgcuga

SEQ ID NO: 44671 - RNA, 1257 nt, Artificial Sequence
  derived and/or modified sequence opt2 from ING3__Homo_sapiens__NP_061944
augcucuaccucgaggacuaccucgagaugaucgagcagcuccccauggaccuccgcgaccgcuucaccgagaugcgcgagauggaccuccagguccagaacgccauggaccagcucgagcagcgcgucuccgaguucuucaugaacgccaagaagaacaagcccgaguggcgcgaggagcagauggccuccaucaagaaggacuacuacaaggcccucgaggacgccgacgagaagguccagcucgccaaccagaucuacgaccucgucgaccgccaccuccgcaagcucgaccaggagcucgccaaguucaagauggagcucgaggccgacaacgccggcaucaccgagauccucgagcgccgcucccucgagcucgacacccccucccagcccgucaacaaccaccacgcccacucccacacccccgucgagaagcgcaaguacaaccccaccucccaccacaccaccaccgaccacauccccgagaagaaguucaaguccgaggcccuccucuccacccucaccuccgacgccuccaaggagaacacccucggcugccgcaacaacaacuccaccgccuccuccaacaacgccuacaacgucaacuccucccagccccucggcuccuacaacaucggcucccucuccuccggcaccggcgccggcgccaucaccauggccgccgcccaggccguccaggccaccgcccagaugaaggagggccgccgcaccuccucccucaaggccuccuacgaggccuucaagaacaacgacuuccagcucggcaaggaguucuccauggcccgcgagaccgucggcuacuccuccuccuccgcccucaugaccacccucacccagaacgccuccuccuccgccgccgacucccgcuccggccgcaaguccaagaacaacaacaaguccuccucccagcaguccuccuccuccuccuccuccuccucccucuccuccugcuccuccuccuccaccgucguccaggagaucucccagcagaccaccgucguccccgaguccgacuccaacucccaggucgacuggaccuacgaccccaacgagccccgcuacugcaucugcaaccaggucuccuacggcgagauggucggcugcgacaaccaggacugccccaucgagugguuccacuacggcugcgucggccucaccgaggcccccaagggcaagugguacugcccccagugcaccgccgccaugaagcgccgcggcucccgccacaaguga

SEQ ID NO: 44672 - RNA, 750 nt, Artificial Sequence
  derived and/or modified sequence opt2 from ING4__Homo_sapiens__NP_001121054
auggccgccggcauguaccucgagcacuaccucgacuccaucgagaaccuccccuucgagcuccagcgcaacuuccagcucaugcgcgaccucgaccagcgcaccgaggaccucaaggccgagaucgacaagcucgccaccgaguacauguccuccgcccgcucccucuccuccgaggagaagcucgcccuccucaagcagauccaggaggccuacggcaagugcaaggaguucggcgacgacaagguccagcucgccaugcagaccuacgagauggucgacaagcacauccgccgccucgacaccgaccucgcccgcuucgaggccgaccucaaggagaagcagaucgaguccuccgacuacgacuccuccuccuccaagggcaagaagaagggccgcacccagaaggagaagaaggccgcccgcgcccgcuccaagggcaagaacuccgacgaggaggcccccaagaccgcccagaagaagcucaagcucguccgcaccucccccgaguacggcaugcccuccgucaccuucggcuccguccaccccuccgacguccucgacaugcccgucgaccccaacgagcccaccuacugccucugccaccaggucuccuacggcgagaugaucggcugcgacaaccccgacugcuccaucgagugguuccacuucgccugcgucggccucaccaccaagccccgcggcaagugguucugcccccgcugcucccaggagcgcaagaagaaguga

SEQ ID NO: 44673 - RNA, 723 nt, Artificial Sequence
  derived and/or modified sequence opt2 from ING5__Homo_sapiens__NP_115705
auggccaccgccauguaccucgagcacuaccucgacuccaucgagaaccuccccugcgagcuccagcgcaacuuccagcucaugcgcgagcucgaccagcgcaccgaggacaagaaggccgagaucgacauccucgccgccgaguacaucuccaccgucaagacccucucccccgaccagcgcgucgagcgccuccagaagauccagaacgccuacuccaagugcaaggaguacuccgacgacaagguccagcucgccaugcagaccuacgagauggucgacaagcacauccgccgccucgacgccgaccucgcccgcuucgaggccgaccucaaggacaagauggagggcuccgacuucgaguccuccggcggccgcggccucaagaagggccgcggccagaaggagaagcgcggcucccgcggccgcggccgccgcaccuccgaggaggacacccccaagaagaagaagcacaagggcggcuccgaguucaccgacaccauccucuccguccaccccuccgacguccucgacaugcccgucgaccccaacgagcccaccuacugccucugccaccaggucuccuacggcgagaugaucggcugcgacaaccccgacugccccaucgagugguuccacuucgccugcgucgaccucaccaccaagcccaagggcaagugguucugcccccgcugcguccaggagaagcgcaagaagaaguga

SEQ ID NO: 44674 - RNA, 1101 nt, Artificial Sequence
  derived and/or modified sequence opt2 from INHA__Homo_sapiens__NP_002182
augguccuccaccuccuccucuuccuccuccucaccccccagggcggccacuccugccagggccucgagcucgcccgcgagcucguccucgccaagguccgcgcccucuuccucgacgcccucggcccccccgccgucacccgcgagggcggcgaccccggcguccgccgccucccccgccgccacgcccucggcggcuucacccaccgcggcuccgagcccgaggaggaggaggacgucucccaggccauccucuuccccgccaccgacgccuccugcgaggacaaguccgccgcccgcggccucgcccaggaggccgaggagggccucuuccgcuacauguuccgccccucccagcacacccgcucccgccaggucaccuccgcccagcucugguuccacaccggccucgaccgccagggcaccgccgccuccaacuccuccgagccccuccucggccuccucgcccucucccccggcggccccgucgccguccccaugucccucggccacgcccccccccacugggccguccuccaccucgccaccuccgcccucucccuccucacccaccccguccucguccuccuccuccgcugcccccucugcaccugcuccgcccgccccgaggccacccccuuccucgucgcccacacccgcacccgcccccccuccggcggcgagcgcgcccgccgcuccaccccccucauguccuggcccuggucccccuccgcccuccgccuccuccagcgcccccccgaggagcccgccgcccacgccaacugccaccgcgucgcccucaacaucuccuuccaggagcucggcugggagcgcuggaucgucuacccccccuccuucaucuuccacuacugccacggcggcugcggccuccacaucccccccaaccucucccuccccguccccggcgccccccccacccccgcccagcccuacucccuccuccccggcgcccagcccugcugcgccgcccuccccggcaccaugcgcccccuccacguccgcaccaccuccgacggcggcuacuccuucaaguacgagaccguccccaaccuccucacccagcacugcgccugcaucuga

SEQ ID NO: 44675 - RNA, 1281 nt, Artificial Sequence
  derived and/or modified sequence opt2 from INHBA__Homo_sapiens__NP_002183
augccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccuga

SEQ ID NO: 44676 - RNA, 1224 nt, Artificial Sequence
  derived and/or modified sequence opt2 from INHBB__Homo_sapiens__NP_002184
auggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccuga

SEQ ID NO: 44677 - RNA, 1059 nt, Artificial Sequence
  derived and/or modified sequence opt2 from INHBC__Homo_sapiens__NP_005529
augaccuccucccuccuccucgccuuccuccuccucgcccccaccaccgucgccaccccccgcgccggcggccagugccccgccugcggcggccccacccucgagcucgagucccagcgcgagcuccuccucgaccucgccaagcgcuccauccucgacaagcuccaccucacccagcgccccacccucaaccgccccgucucccgcgccgcccuccgcaccgcccuccagcaccuccacggcgucccccagggcgcccuccucgaggacaaccgcgagcaggagugcgagaucaucuccuucgccgagaccggccucuccaccaucaaccagacccgccucgacuuccacuucuccuccgaccgcaccgccggcgaccgcgagguccagcaggccucccucauguucuucguccagcuccccuccaacaccaccuggacccucaagguccgcguccucguccucggcccccacaacaccaaccucacccucgccacccaguaccuccucgaggucgacgccuccggcuggcaccagcucccccucggccccgaggcccaggccgccugcucccagggccaccucacccucgagcucguccucgagggccaggucgcccaguccuccgucauccucggcggcgccgcccaccgccccuucgucgccgcccgcguccgcgucggcggcaagcaccagauccaccgccgcggcaucgacugccagggcggcucccgcaugugcugccgccaggaguucuucgucgacuuccgcgagaucggcuggcacgacuggaucauccagcccgagggcuacgccaugaacuucugcaucggccagugcccccuccacaucgccggcaugcccggcaucgccgccuccuuccacaccgccguccucaaccuccucaaggccaacaccgccgccggcaccaccggcggcggcuccugcugcguccccaccgcccgccgcccccucucccuccucuacuacgaccgcgacuccaacaucgucaagaccgacauccccgacauggucgucgaggccugcggcugcuccuga

SEQ ID NO: 44678 - RNA, 1053 nt, Artificial Sequence
  derived and/or modified sequence opt2 from INHBE__Homo_sapiens__NP_113667
augcgccuccccgacguccagcucuggcucguccuccucugggcccucguccgcgcccagggcaccggcuccgucugccccuccugcggcggcuccaagcucgccccccaggccgagcgcgcccucguccucgagcucgccaagcagcagauccucgacggccuccaccucaccucccgcccccgcaucacccacccccccccccaggccgcccucacccgcgcccuccgccgccuccagcccggcuccgucgcccccggcaacggcgaggaggucaucuccuucgccaccgucaccgacuccaccuccgccuacuccucccuccucaccuuccaccucuccaccccccgcucccaccaccucuaccacgcccgccucuggcuccacguccuccccacccuccccggcacccucugccuccgcaucuuccgcuggggcccccgccgccgccgccagggcucccgcacccuccucgccgagcaccacaucaccaaccucggcuggcacacccucacccuccccuccuccggccuccgcggcgagaaguccggcguccucaagcuccagcucgacugccgcccccucgagggcaacuccaccgucaccggccagccccgccgccuccucgacaccgccggccaccagcagcccuuccucgagcucaagauccgcgccaacgagcccggcgccggccgcgcccgccgccgcacccccaccugcgagcccgccaccccccucugcugccgccgcgaccacuacgucgacuuccaggagcucggcuggcgcgacuggauccuccagcccgagggcuaccagcucaacuacugcuccggccagugccccccccaccucgccggcucccccggcaucgccgccuccuuccacuccgccgucuucucccuccucaaggccaacaaccccuggcccgccuccaccuccugcugcguccccaccgcccgccgcccccucucccuccucuaccucgaccacaacggcaacgucgucaagaccgacguccccgacauggucgucgaggccugcggcugcuccuga

SEQ ID NO: 44679 - RNA, 1071 nt, Artificial Sequence
  derived and/or modified sequence opt2 from INO80B__Homo_sapiens__NP_112578
auguccaagcucuggcgccgcggcuccaccuccggcgccauggaggcccccgagcccggcgaggcccucgagcucucccucgccggcgcccacggccacggcguccacaagaagaagcacaagaagcacaagaagaagcacaagaagaagcaccaccaggaggaggacgccggccccacccagcccucccccgccaagccccagcucaagcucaagaucaagcucggcggccagguccucggcaccaaguccguccccaccuucaccgucauccccgagggcccccgcucccccuccccccucauggucgucgacaacgaggaggagcccauggagggcgucccccucgagcaguaccgcgccuggcucgacgaggacuccaaccucucccccuccccccuccgcgaccucuccggcggccucggcggccaggaggaggaggaggagcagcgcuggcucgacgcccucgagaagggcgagcucgacgacaacggcgaccucaagaaggagaucaacgagcgccuccucaccgcccgccagcgcgcccuccuccagaaggcccgcucccagcccucccccaugcucccccuccccgucgccgagggcugccccccccccgcccucaccgaggagaugcuccucaagcgcgaggagcgcgcccgcaagcgccgccuccaggccgcccgccgcgccgaggagcacaagaaccagaccaucgagcgccucaccaagaccgccgccaccuccggccgcggcggccgcggcggcgcccgcggcgagcgccgcggcggccgcgccgccgcccccgcccccaugguccgcuacugcuccggcgcccagggcuccacccucuccuucccccccggcguccccgcccccaccgccgucucccagcgccccucccccuccggcccccccccccgcugcuccguccccggcugcccccacccccgccgcuacgccugcucccgcaccggccaggcccucugcucccuccagugcuaccgcaucaaccuccagaugcgccucggcggccccgagggccccggcuccccccuccucgccaccuga

SEQ ID NO: 44680 - RNA, 3084 nt, Artificial Sequence
  derived and/or modified sequence opt2 from INO80D__Homo_sapiens__NP_060229
auguacgagggcaagcacauccacuucuccgaggucgacaacaagccccucugcuccuacucccccaagcucugcaagcagcgccgccucaacggcuacgccuucugcauccgccacguccucgaggacaagaccgcccccuucaagcagugcgaguacgucgccaaguacaacucccagcgcugcaccaaccccauccccaaguccgaggaccgccgcuacugcaacucccaccuccagguccucggcuucauccccaagaaggagcgcaagaagaagaacgaccccaucgacgaggucaagguccgccaccagauggacaccauggccuucucccucaccguccccacccucgcccucaagaugcccaacggccucgacggcaugucccucuccccccccggcgcccgcgucccccuccacuaccucgagaccgagcucgaggaccccuucgccuucaacgaggaggacgacgaccucaagaagggcgccaccguccgcaagaagcuccaguccaagcucgcccagaaccgccagcgccagcgcgagaccgagauccucaagguccgccaggagcacuucucccccccccccgcccccucccagcagcagcccccccagcagcacucccaccucuccccccucuccaccucccucaagccccccgcccccccccagggcuccgucugcaaguccccccagccccagaacaccucccuccccaugcagggcgucgcccccaccacccacaccaucgcccaggcccgccagcucucccacaagcgcccccucccccuccuccccuccucccgcgcccccaccgucgaccccccccgcaccgaccgcauccucaugaaggccaccgccuucuccccccacuucuccugcaucucccgccuccagcgccucgucaagcucugcacccagaagcaccagcucgacaccgaccucuucccccaccucggccucgacugguccgaggaguccggcgaggagcccgaggacuccgagcaggccucccccuaccaggucgccugguccauccgcgagacccuccgcuaccagcgccacgccuccgacgacgacgacgccgagucccgcuccucccgcgucacccagcucugcaccuacuuccagcagaaguacaagcaccucugccgccucgagcgcgccgagucccgccagaagaagugccgccacaccuuccgcaaggcccuccuccaggccgccuccaaggagcccgagugcaccggccagcucauccaggagcuccgccgcgccgccugcucccgcaccuccaucucccgcaccaagcuccgcgaggucgagcccgccgccugcuccggcaccgucaagggcgagcagugcgccaacaaggcccuccccuucacccgccacugcuuccagcacauccuccucaaccacucccagcagcucuucuccuccugcaccgccaaguucgccgacggccagcagugcuccguccccgucuucgacaucacccaccagaccccccucugcgaggagcacgccaagaagauggacaacuuccuccgcggcgacaacucccgcaagguccagcaccagcagcagcgcaagccccgcaagaagaccaagccccccgcccucaccaagaagcacaagaagaagcgccgccgcggcccccgccgcccccagaagcccaucccccccgccgucccccagggcaaccucuccaugcccgccuccgucucccuccccgucgaggccucccacauccgcucccccuccacccccgagcucuccgccgacgagcuccccgacgacaucgccaacgagaucaccgacaucccccacgaccucgagcucaaccaggaggacuucuccgacguccucccccgccuccccgacgaccuccaggacuucgacuucuucgagggcaagaacggcgaccuccuccccaccaccgaggaggccgaggagcucgagcgcgcccuccaggccgucaccucccucgagugccucuccaccaucggcguccucgcccaguccgacggcguccccguccaggagcucuccgaccgcggcaucggcgucuucuccaccggcaccggcgccuccggcauccagucccucucccgcgaggucaacaccgaccucggcgagcuccucaacggccgcaucguccacgacaacuucuccucccucgagcucgacgagaaccuccuccgcuccgccacccucuccaacccccccaccccccucgccggccagauccagggccaguucuccgcccccgccaacgucggccucaccuccgccacccucaucucccaguccgcccucggcgagcgcgccuuccccggccaguuccacggccuccacgacggcucccacgccucccagcgcccccaccccgcccagcuccucuccaaggccgacgaccucaucaccucccgccagcaguacuccuccgaccacucccacuccuccccccacggcucccacuacgacuccgagcacguccccucccccuacuccgaccacaucaccuccccccacaccaccuccuacuccggcgacaacauggccgccaccuucuccgccgagaugcccaucauggcccagcaccuccuccccacccagcucgaggucccccucggcggcgucgucaacccccgcacccacuggggcaaccuccccgucaaccucggcgaccccucccccuucuccaaccuccucggcgccgacggccaccuccucuccaccucccucuccaccccccccaccaccuccaacuccgagaccacccagcccgccuucgccaccgucacccccuccuccuccuccguccuccccggccucccccagaccuccuucuccggcaugggccccuccgccgagcucauggccuccaccucccccaagcagcagcucccccaguucuccgccgccuucggccaccagcucuccucccacuccggcauccccaaggaccuccagcccucccacuccuccaucgccccccccaccggcuucaccgucaccggcgccaccgccaccuccaccaacaacgccuccucccccuuccccucccccaacuga

SEQ ID NO: 44681 - RNA, 4671 nt, Artificial Sequence
  derived and/or modified sequence opt2 from INO80__Homo_sapiens__NP_060023
auggccuccgagcucggcgcccgcgacgacggcggcugcaccgagcucgccaagccccucuaccuccaguaccucgagcgcgcccuccgccucgaccacuuccuccgccagaccuccgccaucuucaaccgcaacaucuccuccgacgacuccgaggacggccucgacgacuccaacccccuccucccccaguccggcgacccccucauccaggucaaggaggagccccccaacucccuccucggcgagaccuccggcgccggcuccuccggcaugcucaacaccuacucccucaacggcguccuccaguccgaguccaagugcgacaagggcaaccucuacaacuucuccaagcucaagaagucccgcaaguggcucaaguccauccuccucuccgacgaguccuccgaggccgacucccaguccgaggacgacgacgaggaggagcucaaccucucccgcgaggagcuccacaacaugcuccgccuccacaaguacaagaagcuccaccagaacaaguacuccaaggacaaggagcuccagcaguaccaguacuacuccgccggccuccucuccaccuacgaccccuucuacgagcagcagcgccaccuccucggccccaagaagaagaaguucaaggaggagaagaagcucaaggccaagcucaagaaggucaagaagaagcgccgccgcgacgaggagcucuccuccgaggaguccccccgccgccaccaccaccagaccaaggucuucgccaaguucucccacgacgcccccccccccggcaccaagaagaagcaccucuccaucgagcagcucaacgcccgccgccgcaaggucuggcucuccaucgucaagaaggagcuccccaaggccaacaagcagaaggccuccgcccgcaaccucuuccucaccaacucccgcaagcucgcccaccagugcaugaaggagguccgccgcgccgcccuccaggcccagaagaacugcaaggagacccucccccgcgcccgccgccucaccaaggagaugcuccucuacuggaagaaguacgagaaggucgagaaggagcaccgcaagcgcgccgagaaggaggcccucgagcagcgcaagcucgacgaggagaugcgcgaggccaagcgccagcagcgcaagcucaacuuccucaucacccagaccgagcucuacgcccacuucaugucccgcaagcgcgacaugggccacgacggcauccaggaggagauccuccgcaagcucgaggacuccuccacccagcgccagaucgacaucggcggcggcgucgucgucaacaucacccaggaggacuacgacuccaaccacuucaaggcccaggcccucaagaacgccgagaacgccuaccacauccaccaggcccgcacccgcuccuucgacgaggacgccaaggagucccgcgccgccgcccuccgcgccgccaacaaguccggcaccggcuucggcgaguccuacucccucgccaaccccuccauccgcgccggcgaggacaucccccagcccaccaucuucaacggcaagcucaagggcuaccagcucaagggcaugaacuggcucgccaaccucuacgagcagggcaucaacggcauccucgccgacgagaugggccucggcaagaccguccaguccaucgcccuccucgcccaccucgccgagcgcgagaacaucuggggccccuuccucaucaucucccccgccuccacccucaacaacuggcaccaggaguucacccgcuucguccccaaguucaagguccuccccuacuggggcaacccccacgaccgcaaggucauccgccgcuucuggucccagaagacccucuacacccaggacgcccccuuccacgucgucaucaccuccuaccagcucgucguccaggacgucaaguacuuccagcgcgucaaguggcaguacaugguccucgacgaggcccaggcccucaaguccuccuccuccguccgcuggaagauccuccuccaguuccagugccgcaaccgccuccuccucaccggcacccccauccagaacaccauggccgagcucugggcccuccuccacuucaucaugcccacccucuucgacucccacgaggaguucaacgagugguucuccaaggacaucgagucccacgccgagaacaaguccgccaucgacgagaaccagcucucccgccuccacaugauccucaagcccuucaugcuccgccgcaucaagaaggacgucgagaacgagcucuccgacaagaucgagauccucauguacugccagcucaccucccgccagaagcuccucuaccaggcccucaagaacaagaucuccaucgaggaccuccuccaguccuccaugggcuccacccagcaggcccagaacaccaccuccucccucaugaaccucgucaugcaguuccgcaaggucugcaaccaccccgagcucuucgagcgccaggagaccuggucccccuuccacaucucccucaagcccuaccacaucuccaaguucaucuaccgccacggccagauccgcgucuucaaccacucccgcgaccgcuggcuccgcguccucucccccuucgcccccgacuacauccagcgcucccucuuccaccgcaagggcaucaacgaggaguccugcuucuccuuccuccgcuucaucgacaucucccccgccgagauggccaaccucaugcuccagggccuccucgcccgcuggcucgcccucuuccucucccucaaggccuccuaccgccuccaccagcuccgcuccuggggcgcccccgagggcgagucccaccagcgcuaccuccgcaacaaggacuuccuccucggcgucaacuucccccucuccuuccccaaccucugcuccugcccccuccucaagucccucgucuucuccucccacugcaaggccgucuccggcuacuccgaccaggucguccaccagcgccgcuccgccaccuccucccuccgccgcugccuccucaccgagcuccccuccuuccucugcgucgccuccccccgcgucaccgccgucccccucgacuccuacugcaacgaccgcuccgccgaguacgagcgccgcguccucaaggagggcggcucccucgccgccaagcagugccuccucaacggcgcccccgagcucgccgccgacuggcucaaccgccgcucccaguucuuccccgagcccgccggcggccucugguccauccgcccccagaacggcugguccuucauccgcauccccggcaaggagucccucaucaccgacuccggcaagcucuacgcccucgacguccuccucacccgccucaagucccagggccaccgcguccucaucuacucccagaugacccgcaugaucgaccuccucgaggaguacauggucuaccgcaagcacaccuacaugcgccucgacggcuccuccaagaucuccgagcgccgcgacauggucgccgacuuccagaaccgcaacgacaucuucgucuuccuccucuccacccgcgccggcggccucggcaucaaccucaccgccgccgacaccgucaucuucuacgacuccgacuggaaccccaccgucgaccagcaggccauggaccgcgcccaccgccucggccagaccaagcaggucaccgucuaccgccucaucugcaagggcaccaucgaggagcgcauccuccagcgcgccaaggagaaguccgagauccagcgcauggucaucuccggcggcaacuucaagcccgacacccucaagcccaaggaggucgucucccuccuccucgacgacgaggagcucgagaagaagcuccgccuccgccaggaggagaagcgccagcaggaggagaccaaccgcgucaaggagcgcaagcgcaagcgcgagaaguacgccgagaagaagaagaaggaggacgagcucgacggcaagcgccgcaaggagggcgucaaccucgucauccccuucguccccuccgccgacaacuccaaccucuccgccgacggcgacgacuccuucaucuccgucgacuccgccaugcccucccccuucuccgagaucuccaucuccuccgagcuccacaccggcuccaucccccucgacgaguccuccuccgacaugcucgucaucgucgacgaccccgccuccuccgccccccagucccgcgccaccaacucccccgccuccaucaccggcuccgucuccgacaccgucaacggcaucuccauccaggagaugcccgccgccggccgcggccacuccgcccgcucccgcggccgccccaagggcuccggcuccaccgccaagggcgccggcaagggccgcucccgcaaguccaccgccggcuccgccgccgccauggccggcgccaaggccggcgccgccgccgccuccgccgccgccuacgccgccuacggcuacaacgucuccaagggcaucuccgccuccuccccccuccagaccucccucguccgccccgccggccucgccgacuucggccccuccuccgccuccuccccccucuccuccccccucuccaagggcaacaacguccccggcaaccccaagaaccuccacaugaccuccucccucgcccccgacucccucguccgcaagcagggcaagggcaccaaccccuccggcggccgcuga

SEQ ID NO: 44682 - RNA, 1200 nt, Artificial Sequence
  derived and/or modified sequence opt2 from INPP1__Homo_sapiens__NP_001122400
auguccgacauccuccgcgagcuccucugcgucuccgagaaggccgccaacaucgcccgcgccugccgccagcaggaggcccucuuccagcuccucaucgaggagaagaaggagggcgagaagaacaagaaguucgccgucgacuucaagacccucgccgacguccucguccaggaggucaucaagcagaacauggagaacaaguuccccggccucgagaagaacaucuucggcgaggaguccaacgaguucaccaacgacuggggcgagaagaucacccuccgccucugcuccaccgaggaggagaccgccgagcuccucuccaagguccucaacggcaacaaggucgccuccgaggcccucgcccgcgucguccaccaggacgucgccuucaccgaccccacccucgacuccaccgagaucaacgucccccaggacauccucggcaucugggucgaccccaucgacuccaccuaccaguacaucaagggcuccgccgacaucaaguccaaccagggcaucuuccccugcggccuccagugcgucaccauccucaucggcgucuacgacauccagaccggcgucccccucaugggcgucaucaaccagcccuucgucucccgcgaccccaacacccuccgcuggaagggccagugcuacuggggccucuccuacaugggcaccaacaugcacucccuccagcucaccaucucccgccgcaacggcuccgagacccacaccggcaacaccggcuccgaggccgccuucucccccuccuucuccgccgucaucuccaccuccgagaaggagaccaucaaggccgcccucucccgcgucugcggcgaccgcaucuucggcgccgccggcgccggcuacaagucccucugcgucguccagggccucgucgacaucuacaucuucuccgaggacaccaccuucaagugggacuccugcgccgcccacgccauccuccgcgccaugggcggcggcaucgucgaccucaaggagugccucgagcgcaaccccgagaccggccucgaccucccccagcucgucuaccacgucgagaacgagggcgccgccggcgucgaccgcugggccaacaagggcggccucaucgccuaccgcucccgcaagcgccucgagaccuuccucucccuccucguccagaaccucgcccccgccgagacccacaccuga

SEQ ID NO: 44683 - RNA, 2934 nt, Artificial Sequence
  derived and/or modified sequence opt2 from INPP4A__Homo_sapiens__NP_001127696
augaccgcccgcgagcacuccccccgccacggcgcccgcgcccgcgccaugcagcgcgccuccaccaucgacgucgccgccgacaugcucggccucucccucgccggcaacauccaggaccccgacgagcccauccucgaguucucccucgccugcuccgagcuccacacccccucccucgaccgcaagcccaacuccuucgucgccgucuccgucaccacccccccccaggccuucuggaccaagcacgcccagaccgagaucaucgagggcaccaacaaccccaucuuccucuccuccaucgccuucuuccaggacucccucaucaaccagaugacccaggucaagcucuccgucuacgacgucaaggaccgcucccagggcaccauguaccuccucggcuccggcaccuucaucgucaaggaccuccuccaggaccgccaccaccgccuccaccucacccuccgcuccgccgaguccgaccgcgucggcaacaucaccgucaucggcuggcagauggaggagaaguccgaccagcgcccccccgucacccgcuccgucgacaccgucaacggccgcaugguccuccccgucgacgagucccucaccgaggcccucggcauccgcuccaaguacgccucccuccgcaaggacacccuccucaaguccgucuucggcggcgccaucugccgcauguaccgcuuccccaccaccgacggcaaccaccuccgcauccucgagcagauggccgaguccguccucucccuccacgucccccgccaguucgucaagcuccuccucgaggaggacgccgcccgcgucugcgagcucgaggagcucggcgagcucucccccugcugggagucccuccgccgccagaucgucacccaguaccagaccaucauccucaccuaccaggagaaccucaccgaccuccaccaguaccgcggccccuccuucaaggccuccucccucaaggccgacaagaagcucgaguucguccccaccaaccuccacauccagcgcaugcgcguccaggacgacggcggcuccgaccagaacuacgacaucgucaccaucggcgcccccgccgcccacugccagggcuucaaguccggcggccuccgcaagaagcuccacaaguucgaggagaccaagaagcacuucgaggagugcugcaccuccuccggcugccaguccaucaucuacaucccccaggacgucguccgcgccaaggagaucaucgcccagaucaacacccucaagacccaggucuccuacuacgccgagcgccucucccgcgccgccaaggaccgcuccgccaccggccucgagcgcacccucgccauccucgccgacaagacccgccagcucgucaccgucugcgacugcaagcuccucgccaacuccauccacggccucaacgccgcccgccccgacuacaucgccuccaaggccucccccaccuccaccgaggaggagcaggucaugcuccgcaacgaccaggacacccucauggcccgcuggaccggccgcaacucccgcuccucccuccaggucgacuggcacgaggaggagugggagaaggucuggcucaacgucgacaagucccucgagugcaucauccagcgcgucgacaagcuccuccagaaggagcgccuccacggcgagggcugcgaggacgucuuccccugcgccggcuccugcaccuccaagaagggcaaccccgacucccacgccuacuggauccgccccgaggaccccuucugcgacguccccuccucccccugccccuccaccaugcccuccaccgccugccacccccaccucaccacccacugcucccccccccccgaggaguccucccccggcgagugguccgaggcccucuacccccuccucaccacccucaccgacugcgucgccaugauguccgacaaggccaagaaggccauggucuuccuccucaugcaggacuccgcccccaccaucgccaccuaccucucccuccaguaccgccgcgacgucgucuucugccagacccucaccgcccucaucugcggcuucaucaucaagcuccgcaacugccuccacgacgacggcuuccuccgccagcucuacaccaucggccuccucgcccaguucgagucccuccucuccaccuacggcgaggagcucgccaugcucgaggacaugucccucggcaucauggaccuccgcaacgucaccuucaaggucacccaggccaccuccuccgccuccgccgacaugcuccccgucaucaccggcaaccgcgacggcuucaacguccgcgucccccuccccggcccccucuucgacgcccucccccgcgagauccaguccggcaugcuccuccgcguccagcccguccucuucaacgucggcaucaacgagcagcagacccucgccgagcgcuucggcgacaccucccuccaggaggucaucaacgucgagucccucguccgccucaacuccuacuucgagcaguucaaggagguccuccccgaggacugccucccccgcucccgcucccagaccugccuccccgagcuccuccgcuuccucggccagaacguccacgcccgcaagaacaagaacgucgacauccucuggcaggccgccgagaucugccgccgccucaacggcguccgcuucaccuccugcaaguccgccaaggaccgcaccgccauguccgucacccucgagcagugccucauccuccagcacgagcacggcauggccccccaggucuucacccaggcccucgagugcaugcgcuccgagggcugccgccgcgagaacaccaugaagaacgucggcucccgcaaguacgccuucaacucccuccagcucaaggccuuccccaagcacuaccgcccccccgagggcaccuacggcaaggucgagaccuga

SEQ ID NO: 44684 - RNA, 2775 nt, Artificial Sequence
  derived and/or modified sequence opt2 from INPP4B__Homo_sapiens__NP_001095139
auggagaucaaggaggagggcgccuccgaggagggccagcacuuccuccccaccgcccaggccaacgaccccggcgacugccaguucaccuccauccagaagacccccaacgagccccagcucgaguucauccucgccugcaaggaccucgucgcccccguccgcgaccgcaagcucaacacccucguccagaucuccgucauccaccccgucgagcagucccucacccgcuacuccuccaccgagaucgucgagggcacccgcgacccccucuuccucaccggcgucaccuuccccuccgaguaccccaucuacgaggagaccaagaucaagcucaccgucuacgacgucaaggacaagucccacgacaccguccgcaccuccguccuccccgagcacaaggaccccccccccgaggucggccgcuccuuccucggcuacgccuccuucaaggucggcgagcuccucaaguccaaggagcagcuccucguccucucccuccgcaccuccgacggcggcaaggucgucggcaccaucgaggucuccgucgucaagaugggcgagaucgaggacggcgaggccgaccacaucaccaccgacguccagggccagaagugcgcccucgucugcgagugcaccgcccccgaguccgucuccggcaaggacaaccuccccuuccucaacuccguccucaagaaccccgucugcaagcucuaccgcuuccccaccuccgacaacaaguggaugcgcauccgcgagcagauguccgaguccauccucuccuuccacauccccaaggagcucaucucccuccacaucaaggaggaccucugccgcaaccaggagaucaaggagcucggcgagcucuccccccacugggacaaccuccgcaagaacguccucacccacugcgaccagauggucaacauguaccaggacauccucaccgagcucuccaaggagaccggcuccuccuucaaguccuccuccuccaagggcgagaagacccucgaguucguccccaucaaccuccaccuccagcgcaugcagguccacuccccccaccucaaggacgcccucuacgacgucaucaccgucggcgcccccgccgcccacuuccagggcuucaagaacggcggccuccgcaagcuccuccaccgcuucgagaccgagcgccgcaacaccggcuaccaguucaucuacuacucccccgagaacaccgccaaggccaaggagguccucuccaacaucaaccagcuccagccccucaucgccacccacgccgaccuccuccucaacuccgccucccagcacucccccgacucccucaagaacucccucaagaugcucuccgagaagaccgagcucuucguccacgccuucaaggaccagcucguccgcuccgcccuccucgcccucuacaccgcccgccccggcggcauccucaagaagccccccucccccaaguccuccaccgaggaguccuccccccaggaccagccccccgucaugcgcggccaggacuccaucccccaccacuccgacuacgacgaggaggagugggaccgcgucugggccaacgucggcaagucccucaacugcaucaucgccauggucgacaagcucaucgagcgcgacggcggcuccgagggcuccggcggcaacaacgacggcgagaaggagcccucccucaccgacgccauccccucccacccccgcgaggacugguacgagcagcucuacccccucauccucacccucaaggacugcaugggcgaggucgucaaccgcgccaagcagucccucaccuucguccuccuccaggagcucgccuacucccucccccagugccucaugcucacccuccgccgcgacaucgucuucucccaggcccucgccggccucgucugcggcuucaucaucaagcuccagaccucccucuacgaccccggcuuccuccagcagcuccacaccgucggccucaucguccaguacgagggccuccucuccaccuacuccgacgagaucggcaugcucgaggacauggccgucggcaucuccgaccucaagaaggucgccuucaagaucaucgaggccaaguccaacgacguccuccccgucaucaccggccgccgcgagcacuacgucgucgaggucaagcuccccgcccgcauguucgagucccucccccuccagaucaaggagggccagcuccuccacgucuaccccguccucuucaacgucggcaucaacgagcagcagacccucgccgagcgcuucggcgacgucucccuccaggaguccaucaaccaggagaacuucgagcuccuccaggaguacuacaagaucuucauggagaagaugccccccgacuacaucucccacuuccaggagcagaacgaccucaaggcccuccucgagaaccuccuccagaacauccaguccaagaagcgcaagaacgucgagaucauguggcucgccgccaccaucugccgcaagcucaacggcauccgcuucaccugcugcaaguccgccaaggaccgcaccuccauguccgucacccucgagcagugcuccauccuccgcgacgagcaccagcuccacaaggacuucuucauccgcgcccucgacugcaugcgccgcgagggcugccgcaucgagaacguccucaagaacaucaagugccgcaaguacgccuucaacaugcuccagcucauggccuuccccaaguacuaccgcccccccgagggcaccuacggcaaggccgacaccuga

SEQ ID NO: 44685 - RNA, 1239 nt, Artificial Sequence
  derived and/or modified sequence opt2 from INPP5A__Homo_sapiens__NP_005530
auggccggcaaggccgccgcccccggcaccgccguccuccucgucaccgccaacgucggcucccucuucgacgaccccgagaaccuccagaagaacuggcuccgcgaguucuaccaggucguccacacccacaagccccacuucauggcccuccacugccaggaguucggcggcaagaacuacgaggccuccaugucccacgucgacaaguucgucaaggagcuccucuccuccgacgccaugaaggaguacaaccgcgcccgcgucuaccucgacgagaacuacaagucccaggagcacuucaccgcccucggcuccuucuacuuccuccacgagucccucaagaacaucuaccaguucgacuucaaggccaagaaguaccgcaaggucgccggcaaggagaucuacuccgacacccucgaguccacccccaugcucgagaaggagaaguucccccaggacuacuuccccgagugcaaguggucccgcaagggcuucauccgcacccgcuggugcaucgccgacugcgccuucgaccucgucaacauccaccucuuccacgacgccuccaaccucgucgccugggagaccucccccuccgucuacuccggcauccgccacaaggcccucggcuacguccucgaccgcaucaucgaccagcgcuucgagaaggucuccuacuucgucuucggcgacuucaacuuccgccucgacuccaaguccgucgucgagacccucugcaccaaggccaccaugcagaccguccgcgccgccgacaccaacgaggucgucaagcucaucuuccgcgaguccgacaacgaccgcaaggucaugcuccagcucgagaagaagcucuucgacuacuucaaccaggaggucuuccgcgacaacaacggcaccgcccuccucgaguucgacaaggagcucuccgucuucaaggaccgccucuacgagcucgacaucuccuucccccccuccuaccccuacuccgaggacgcccgccagggcgagcaguacaugaacacccgcugccccgccuggugcgaccgcauccucaugucccccuccgccaaggagcucguccuccgcuccgaguccgaggagaaggucgucaccuacgaccacaucggccccaacgucugcaugggcgaccacaagcccgucuuccucgccuuccgcaucaugcccggcgccggcaagccccacgcccacguccacaagugcugcgucguccaguga

SEQ ID NO: 44686 - RNA, 2250 nt, Artificial Sequence
  derived and/or modified sequence opt2 from INPP5B__Homo_sapiens__NP_001284363
auguccgccgccgccggcucccgcgagcgcaacaccgccggcggcuccaacuucgacggccuccgccccaacggcaagggcguccccauggaccaguccucccgcggccaggacaagcccgagucccuccagccccgccagaacaaguccaaguccgagaucaccgacaugguccgcuccuccaccaucaccgucuccgacaaggcccacauccucuccaugcagaaguucggccuccgcgacaccaucgucaagucccaccuccuccagaaggaggaggacuacaccuacauccagaacuuccgcuucuucgccggcaccuacaacgucaacggccagucccccaaggagugccuccgccucuggcucuccaacggcauccaggcccccgacgucuacugcgucggcuuccaggagcucgaccucuccaaggaggccuucuucuuccacgacacccccaaggaggaggagugguucaaggccgucuccgagggccuccaccccgacgccaaguacgccaaggucaagcucauccgccucgucggcaucaugcuccuccucuacgucaagcaggagcacgccgccuacaucuccgaggucgaggccgagaccgucggcaccggcaucaugggccgcaugggcaacaagggcggcgucgccauccgcuuccaguuccacaacaccuccaucugcgucgucaacucccaccucgccgcccacaucgaggaguacgagcgccgcaaccaggacuacaaggacaucugcucccgcaugcaguucugccagcccgaccccucccuccccccccucaccaucuccaaccacgacgucauccucuggcucggcgaccucaacuaccgcaucgaggagcucgacgucgagaaggucaagaagcucaucgaggagaaggacuuccagaugcucuacgccuacgaccagcucaagauccaggucgccgccaagaccgucuucgagggcuucaccgagggcgagcucaccuuccagcccaccuacaaguacgacaccggcuccgacgacugggacaccuccgagaagugccgcgcccccgccuggugcgaccgcauccucuggaagggcaagaacaucacccagcucuccuaccagucccacauggcccucaagaccuccgaccacaagcccgucuccuccgucuucgacaucggcguccgcgucgucaacgacgagcucuaccgcaagacccucgaggagaucguccgcucccucgacaagauggagaacgccaacauccccuccgucucccucuccaagcgcgaguucugcuuccagaacgucaaguacaugcagcucaaggucgaguccuucaccauccacaacggccagguccccugccacuucgaguucaucaacaagcccgacgaggaguccuacugcaagcaguggcucaacgccaaccccucccgcggcuuccuccuccccgacuccgacgucgagaucgaccucgagcucuucgucaacaagaugaccgccaccaagcucaacuccggcgaggacaagaucgaggacauccucguccuccaccucgaccgcggcaaggacuacuuccucuccgucuccggcaacuaccuccccuccugcuucggcucccccauccacacccucugcuacaugcgcgagcccauccucgaccucccccucgagaccaucuccgagcucacccucaugcccgucuggaccggcgacgacggcucccagcucgacucccccauggagauccccaaggagcucuggaugauggucgacuaccucuaccgcaacgccguccagcaggaggaccucuuccagcagcccggccuccgcuccgaguucgagcacauccgcgacugccucgacaccggcaugaucgacaaccucuccgccuccaaccacuccgucgccgaggcccuccuccucuuccucgagucccuccccgagcccgucaucugcuacuccaccuaccacaacugccucgagugcuccggcaacuacaccgccuccaagcaggucaucuccacccuccccaucuuccacaagaacgucuuccacuaccucauggccuuccuccgcgagcuccucaagaacuccgccaagaaccaccucgacgagaacauccucgccuccaucuucggcucccuccuccuccgcaaccccgccggccaccagaagcucgacaugaccgagaagaagaaggcccaggaguucauccaccaguuccucugcaacccccucuga

SEQ ID NO: 44687 - RNA, 3570 nt, Artificial Sequence
  derived and/or modified sequence opt2 from INPP5D__Homo_sapiens__NP_001017915
augguccccugcuggaaccacggcaacaucacccgcuccaaggccgaggagcuccucucccgcaccggcaaggacggcuccuuccucguccgcgccuccgaguccaucucccgcgccuacgcccucugcguccucuaccgcaacugcgucuacaccuaccgcauccuccccaacgaggacgacaaguucaccguccaggccuccgagggcgucuccaugcgcuucuucaccaagcucgaccagcucaucgaguucuacaagaaggagaacaugggccucgucacccaccuccaguaccccgucccccucgaggaggaggacaccggcgacgaccccgaggaggacaccgucgaguccgucgucuccccccccgagcuccccccccgcaacaucccccucaccgccuccuccugcgaggccaaggagguccccuucuccaacgagaacccccgcgccaccgagaccucccgccccucccucuccgagacccucuuccagcgccuccaguccauggacaccuccggccuccccgaggagcaccucaaggccauccaggacuaccucuccacccagcucgcccaggacuccgaguucgucaagaccggcuccuccucccucccccaccucaagaagcucaccacccuccucugcaaggagcucuacggcgaggucauccgcacccuccccucccucgagucccuccagcgccucuucgaccagcagcucucccccggccuccgcccccgcccccagguccccggcgaggccaaccccaucaacauggucuccaagcucucccagcucaccucccuccucuccuccaucgaggacaaggucaaggcccuccuccacgagggccccgaguccccccaccgccccucccucaucccccccgucaccuucgaggucaaggccgagucccucggcaucccccagaagaugcagcucaaggucgacgucgaguccggcaagcucaucaucaagaaguccaaggacggcuccgaggacaaguucuacucccacaagaagauccuccagcucaucaagucccagaaguuccucaacaagcucgucauccucgucgagaccgagaaggagaagauccuccgcaaggaguacgucuucgccgacuccaagaagcgcgagggcuucugccagcuccuccagcagaugaagaacaagcacuccgagcagcccgagcccgacaugaucaccaucuucaucggcaccuggaacaugggcaacgcccccccccccaagaagaucaccuccugguuccucuccaagggccagggcaagacccgcgacgacuccgccgacuacaucccccacgacaucuacgucaucggcacccaggaggacccccucuccgagaaggaguggcucgagauccucaagcacucccuccaggagaucaccuccgucaccuucaagaccgucgccauccacacccucuggaacauccgcaucgucguccucgccaagcccgagcacgagaaccgcaucucccacaucugcaccgacaacgucaagaccggcaucgccaacacccucggcaacaagggcgccgucggcgucuccuucauguucaacggcaccucccucggcuucgucaacucccaccucaccuccggcuccgagaagaagcuccgccgcaaccagaacuacaugaacauccuccgcuuccucgcccucggcgacaagaagcucucccccuucaacaucacccaccgcuucacccaccucuucugguucggcgaccucaacuaccgcgucgaccuccccaccugggaggccgagaccaucauccagaagaucaagcagcagcaguacgccgaccuccucucccacgaccagcuccucaccgagcgccgcgagcagaaggucuuccuccacuucgaggaggaggagaucaccuucgcccccaccuaccgcuucgagcgccucacccgcgacaaguacgccuacaccaagcagaaggccaccggcaugaaguacaaccuccccuccuggugcgaccgcguccucuggaaguccuacccccucguccacgucgucugccaguccuacggcuccaccuccgacaucaugaccuccgaccacucccccgucuucgccaccuucgaggccggcgucaccucccaguucgucuccaagaacggccccggcaccgucgacucccagggccagaucgaguuccuccgcugcuacgccacccucaagaccaagucccagaccaaguucuaccucgaguuccacuccuccugccucgaguccuucgucaagucccaggagggcgagaacgaggagggcuccgagggcgagcucgucgucaaguucggcgagacccuccccaagcucaagcccaucaucuccgaccccgaguaccuccucgaccagcacauccucaucuccaucaaguccuccgacuccgacgaguccuacggcgagggcugcaucgcccuccgccucgaggccaccgagacccagcuccccaucuacaccccccucacccaccacggcgagcucaccggccacuuccagggcgagaucaagcuccagaccucccagggcaagacccgcgagaagcucuacgacuucgucaagaccgagcgcgacgaguccuccggccccaagacccucaagucccucaccucccacgaccccaugaagcagugggaggucaccucccgcgccccccccugcuccggcuccuccaucaccgagaucaucaaccccaacuacaugggcgucggccccuucggcccccccaugccccuccacgucaagcagacccucucccccgaccagcagcccaccgccugguccuacgaccagccccccaaggacuccccccucggccccugccgcggcgaguccccccccaccccccccggccagccccccaucucccccaagaaguuccuccccuccaccgccaaccgcggccuccccccccgcacccaggagucccgccccuccgaccucggcaagaacgccggcgacacccucccccaggaggaccucccccucaccaagcccgagauguucgagaacccccucuacggcucccucuccuccuuccccaagcccgccccccgcaaggaccaggagucccccaagaugccccgcaaggagcccccccccugccccgagcccggcauccucucccccuccaucguccucaccaaggcccaggaggccgaccgcggcgagggccccggcaagcagguccccgccccccgccuccgcuccuucaccugcuccuccuccgccgagggccgcgccgccggcggcgacaagucccagggcaagcccaagacccccgucuccucccaggcccccguccccgccaagcgccccaucaagcccucccgcuccgagaucaaccagcagaccccccccacccccaccccccgccccccccuccccgucaagucccccgccguccuccaccuccagcacuccaagggccgcgacuaccgcgacaacaccgagcucccccaccacggcaagcaccgccccgaggagggcccccccggcccccucggccgcaccgccaugcaguga

SEQ ID NO: 44688 - RNA, 1935 nt, Artificial Sequence
  derived and/or modified sequence opt2 from INPP5E__Homo_sapiens__NP_063945
augcccuccaaggccgagaaccuccgccccuccgagcccgccccccagccccccgagggccgcacccuccagggccagcuccccggcgccccccccgcccagcgcgccggcuccccccccgacgcccccggcuccgagucccccgcccucgccugcuccacccccgccacccccuccggcgaggacccccccgcccgcgccgcccccaucgccccccgcccccccgcccgcccccgccucgagcgcgcccucucccucgacgacaagggcuggcgccgccgccgcuuccgcggcucccaggaggaccucgaggcccgcaacggcaccucccccucccgcggcuccguccaguccgagggccccggcgcccccgcccacuccugcuccccccccugccucuccaccucccuccaggagauccccaagucccgcggcguccucuccuccgagcgcggcucccccuccuccggcggcaacccccucuccggcgucgccuccuccucccccaaccucccccaccgcgacgccgccgucgccggcuccuccccccgccuccccucccuccuccccccccgccccccccccgcccucucccucgacaucgccuccgacucccuccgcaccgccaacaaggucgacuccgaccucgccgacuacaagcuccgcgcccagccccuccucguccgcgcccacuccucccucggccccggccgcccccgcuccccccucgccugcgacgacugcucccuccgcuccgccaaguccuccuucucccuccucgcccccauccgcuccaaggacguccgcucccgcuccuaccucgagggcucccuccucgccuccggcgcccuccucggcgccgacgagcucgcccgcuacuuccccgaccgcaacgucgcccucuucgucgccaccuggaacaugcagggccagaaggagcucccccccucccucgacgaguuccuccuccccgccgaggccgacuacgcccaggaccucuacgucaucggcguccaggagggcugcuccgaccgccgcgagugggagacccgccuccaggagacccucggcccccacuacguccuccucuccuccgccgcccacggcguccucuacaugucccucuucauccgccgcgaccucaucugguucugcuccgaggucgagugcuccaccgucaccacccgcaucgucucccagaucaagaccaagggcgcccucggcaucuccuucaccuucuucggcaccuccuuccucuucaucaccucccacuucaccuccggcgacggcaaggucgccgagcgccuccucgacuacacccgcaccguccaggcccucguccucccccgcaacguccccgacaccaaccccuaccgcuccuccgccgccgacgucaccacccgcuucgacgaggucuucugguucggcgacuucaacuuccgccucuccggcggccgcaccgucgucgacgcccuccucugccagggccucgucgucgacguccccgcccuccuccagcacgaccagcucauccgcgagaugcgcaagggcuccaucuucaagggcuuccaggagcccgacauccacuuccuccccuccuacaaguucgacaucggcaaggacaccuacgacuccaccuccaagcagcgcacccccuccuacaccgaccgcguccucuaccgcucccgccacaagggcgacaucugccccgucuccuacuccuccugccccggcaucaagaccuccgaccaccgccccgucuacggccucuuccgcgucaagguccgccccggccgcgacaacaucccccucgccgccggcaaguucgaccgcgagcucuaccuccucggcaucaagcgccgcaucuccaaggagauccagcgccagcaggcccuccagucccagaacuccuccaccaucugcuccgucuccuga

SEQ ID NO: 44689 - RNA, 1569 nt, Artificial Sequence
  derived and/or modified sequence opt2 from INPP5F__Homo_sapiens__NP_001230123
augugccacgacgucaucuucauggccuggcucaagcagcaguucuccgagugcacccucaucgacgccacccaccgcgacgucgacguccuccuccuccucuccaacuccgccuacuacgucgccuacuacgacgacgaggucgacaaggucaaccaguaccagcgccucucccucgagaaccucgagaagaucgagaucggccccgagcccacccucuucggcaagcccaaguucuccugcaugcgccuccacuaccgcuacaaggaggccuccggcuacuuccacacccuccgcgccgucaugcgcaaccccgaggaggacggcaaggacacccuccagugcaucgccgagaugcuccagaucaccaagcaggccaugggcuccgaccuccccaucaucgagaagaagcucgagcgcaaguccuccaagccccacgaggacaucaucggcauccgcucccagaaccagggcucccucgcccagggcaagaacuuccucauguccaaguucuccucccucaaccagaaggucaagcagaccaaguccaacgucaacaucggcaaccuccgcaagcucggcaacuucaccaagcccgagaugaaggucaacuuccucaagcccaaccucaaggucaaccucuggaaguccgacuccucccucgagaccauggagaacaccggcgucauggacaagguccaggccgaguccgacggcgacauguccuccgacaacgacuccuaccacuccgacgaguuccucaccaacuccaaguccgacgaggaccgccagcucgccaacucccucgaguccgucggccccaucgacuacguccuccccuccugcggcaucaucgccuccgccccccgccucggcucccgcucccagucccucuccuccaccgacuccuccguccacgcccccuccgagaucaccgucgcccacggcuccggccucggcaagggccaggaguccccccucaagaagucccccuccgccggcgacguccacauccucaccggcuucgccaagcccauggacaucuacugccaccgcuucguccaggacgcccagaacaaggucacccaccucuccgagacccgcuccgucucccagcaggccucccaggagcgcaaccagaugaccaaccaggucuccaacgagacccaguccgaguccaccgagcagacccccucccgccccucccagcucgacgucucccucuccgccaccggcccccaguuccucuccgucgagcccgcccacuccgucgccucccagaagacccccaccuccgccuccuccaugcucgagcucgagaccggccuccacgucacccccucccccuccgaguccuccuccucccgcgccgucucccccuucgccaagauccgcuccuccaugguccaggucgccuccaucacccaggccggccucacccacggcaucaacuucgccgucuccaagguccagaaguccccccccgagcccgagaucaucaaccagguccagcagaacgagcucaagaagauguucauccagugccagacccgcaucauccagaucuga

SEQ ID NO: 44690 - RNA, 1347 nt, Artificial Sequence
  derived and/or modified sequence opt2 from INPP5K__Homo_sapiens__NP_057616
auguccucccgcaagcucuccggccccaagggccgccgccucuccauccacgucgucaccuggaacgucgccuccgccgcccccccccucgaccucuccgaccuccuccagcucaacaaccgcaaccucaaccucgacaucuacgucaucggccuccaggagcucaacuccggcaucaucucccuccucuccgacgccgccuucaacgacuccugguccuccuuccucauggacguccucuccccccucuccuucaucaaggucucccacguccgcaugcagggcauccuccuccucgucuucgccaaguaccagcaccuccccuacauccagauccucuccaccaaguccacccccaccggccucuucggcuacuggggcaacaagggcggcgucaacaucugccucaagcucuacggcuacuacgucuccaucaucaacugccaccuccccccccacaucuccaacaacuaccagcgccucgagcacuucgaccgcauccucgagaugcagaacugcgagggccgcgacauccccaacauccucgaccacgaccucaucaucugguucggcgacaugaacuuccgcaucgaggacuucggccuccacuucguccgcgaguccaucaagaaccgcugcuacggcggccucugggagaaggaccagcucuccaucgccaagaagcacgacccccuccuccgcgaguuccaggagggccgccuccucuucccccccaccuacaaguucgaccgcaacuccaacgacuacgacaccuccgagaagaagcgcaagcccgccuggaccgaccgcauccucuggcgccucaagcgccagcccugcgccggccccgacacccccaucccccccgccucccacuucucccucucccuccgcggcuacuccucccacaugaccuacggcaucuccgaccacaagcccgucuccggcaccuucgaccucgagcucaagccccucgucuccgccccccucaucguccucaugcccgaggaccucuggaccgucgagaacgacaugauggucuccuacuccuccaccuccgacuuccccuccucccccugggacuggaucggccucuacaaggucggccuccgcgacgucaacgacuacgucuccuacgccugggucggcgacuccaaggucuccugcuccgacaaccucaaccaggucuacaucgacaucuccaacauccccaccaccgaggacgaguuccuccucugcuacuacuccaacucccuccgcuccgucgucggcaucucccgccccuuccagaucccccccggcucccuccgcgaggacccccucggcgaggcccagccccagaucuga

SEQ ID NO: 44691 - RNA, 3777 nt, Artificial Sequence
  derived and/or modified sequence opt2 from INPPL1__Homo_sapiens__NP_001558
auggccuccgccugcggcgcccccggccccggcggcgcccucggcucccaggcccccuccugguaccaccgcgaccucucccgcgccgccgccgaggagcuccucgcccgcgccggccgcgacggcuccuuccucguccgcgacuccgaguccgucgccggcgccuucgcccucugcguccucuaccagaagcacguccacaccuaccgcauccuccccgacggcgaggacuuccucgccguccagaccucccagggcguccccguccgccgcuuccagacccucggcgagcucaucggccucuacgcccagcccaaccagggccucgucugcgcccuccuccuccccgucgagggcgagcgcgagcccgacccccccgacgaccgcgacgccuccgacggcgaggacgagaagcccccccuccccccccgcuccggcuccaccuccaucuccgcccccaccggccccuccuccccccuccccgcccccgagacccccaccgcccccgccgccgaguccgcccccaacggccucuccaccgucucccacgacuaccucaagggcuccuacggccucgaccucgaggccguccgcggcggcgccucccaccucccccaccucacccgcacccucgccaccuccugccgccgccuccacuccgaggucgacaagguccucuccggccucgagauccucuccaaggucuucgaccagcaguccucccccauggucacccgccuccuccagcagcagaaccucccccagaccggcgagcaggagcucgagucccucguccucaagcucuccguccucaaggacuuccucuccggcauccagaagaaggcccucaaggcccuccaggacauguccuccaccgccccccccgccccccagcccuccacccgcaaggccaagaccauccccguccaggccuucgaggucaagcucgacgucacccucggcgaccucaccaagaucggcaagucccagaaguucacccucuccgucgacgucgagggcggccgccucguccuccuccgccgccagcgcgacucccaggaggacuggaccaccuucacccacgaccgcauccgccagcucaucaagucccagcgcguccagaacaagcucggcgucgucuucgagaaggagaaggaccgcacccagcgcaaggacuucaucuucgucuccgcccgcaagcgcgaggccuucugccagcuccuccagcucaugaagaacaagcacuccaagcaggacgagcccgacaugaucuccgucuucaucggcaccuggaacaugggcuccguccccccccccaagaacgucaccuccugguucaccuccaagggccucggcaagacccucgacgaggucaccgucaccaucccccacgacaucuacgucuucggcacccaggagaacuccgucggcgaccgcgaguggcucgaccuccuccgcggcggccucaaggagcucaccgaccucgacuaccgccccaucgccaugcagucccucuggaacaucaaggucgccguccucgucaagcccgagcacgagaaccgcaucucccacgucuccaccuccuccgucaagaccggcaucgccaacacccucggcaacaagggcgccgucggcgucuccuucauguucaacggcaccuccuucggcuucgucaacugccaccucaccuccggcaacgagaagaccgcccgccgcaaccagaacuaccucgacauccuccgccuccucucccucggcgaccgccagcucaacgccuucgacaucucccuccgcuucacccaccucuucugguucggcgaccucaacuaccgccucgacauggacauccaggagauccucaacuacaucucccgcaaggaguucgagccccuccuccgcgucgaccagcucaaccucgagcgcgagaagcacaaggucuuccuccgcuucuccgaggaggagaucuccuucccccccaccuaccgcuacgagcgcggcucccgcgacaccuacgccuggcacaagcagaagcccaccggcguccgcaccaacguccccuccuggugcgaccgcauccucuggaaguccuaccccgagacccacaucaucugcaacuccuacggcugcaccgacgacaucgucaccuccgaccacucccccgucuucggcaccuucgaggucggcgucaccucccaguucaucuccaagaagggccucuccaagaccuccgaccaggccuacaucgaguucgaguccaucgaggccaucgucaagaccgccucccgcaccaaguucuucaucgaguucuacuccaccugccucgaggaguacaagaaguccuucgagaacgacgcccaguccuccgacaacaucaacuuccucaagguccagugguccucccgccagcuccccacccucaagcccauccucgccgacaucgaguaccuccaggaccagcaccuccuccucaccgucaaguccauggacggcuacgaguccuacggcgagugcgucgucgcccucaaguccaugaucggcuccaccgcccagcaguuccucaccuuccucucccaccgcggcgaggagaccggcaacauccgcggcuccaugaagguccgcguccccaccgagcgccucggcacccgcgagcgccucuacgaguggaucuccaucgacaaggacgaggccggcgccaaguccaaggcccccuccgucucccgcggcucccaggagccccgcuccggcucccgcaagcccgccuucaccgaggccuccugcccccucucccgccucuucgaggagcccgagaagcccccccccaccggccgcccccccgcccccccccgcgccgccccccgcgaggagccccucaccccccgccucaagcccgagggcgcccccgagcccgagggcgucgccgcccccccccccaagaacuccuucaacaaccccgccuacuacguccucgagggcgucccccaccagcuccucccccccgagccccccucccccgcccgcgcccccguccccuccgccaccaagaacaaggucgccaucaccguccccgccccccagcucggccaccaccgccacccccgcgucggcgagggcuccuccuccgacgaggaguccggcggcacccuccccccccccgacuuccccccccccccccuccccgacuccgccaucuuccucccccccucccucgacccccuccccggccccgucguccgcggccgcggcggcgccgaggcccgcggcccccccccccccaaggcccacccccgccccccccucccccccggccccucccccgccuccaccuuccucggcgaggucgccuccggcgacgaccgcuccugcuccguccuccagauggccaagacccucuccgaggucgacuacgcccccgccggccccgcccgcuccgcccuccuccccggcccccucgagcuccagcccccccgcggccuccccuccgacuacggccgcccccucuccuucccccccccccgcauccgcgaguccauccaggaggaccucgccgaggaggcccccugccuccagggcggccgcgccuccggccucggcgaggccggcauguccgccuggcuccgcgccaucggccucgagcgcuacgaggagggccucguccacaacggcugggacgaccucgaguuccucuccgacaucaccgaggaggaccucgaggaggccggcguccaggaccccgcccacaagcgccuccuccucgacacccuccagcucuccaaguga

SEQ ID NO: 44692 - RNA, 1740 nt, Artificial Sequence
  derived and/or modified sequence opt2 from INSC__Homo_sapiens__NP_001027024
augcgccgcccccccggcaacggcgaggccgccuccgagggccccggcggcuggggccucuggggcguccaggagucccgccgccucugcugcgccggccacgaccgcugcaagcaggcccuccuccagaucggcaucaacaugauggcccuccccggcggccgccaccucgacuccgucacccuccccggccagcgccuccaccucaugcaggucgacuccguccagcgcuggauggaggaccucaagcucaugaccgagugcgagugcaugugcguccuccaggccaagcccaucucccucgaggaggacgcccagggcgaccucauccucgccggcggccccggccccggcgacccccuccagcuccuccucaagcgcggcugggucaucuccaccgagcuccgccgcaucggccagaagcucgcccaggaccgcugggcccgcguccacuccauguccguccgccucaccugccacgcccgcuccauggucuccgaguacuccgccgucucccgcaacucccucaaggagaugggcgagaucgagaagcuccucauggagaagugcuccgagcucuccgccgucaccgagcgcugccuccaggucgagaacgagcacguccucaaguccaugaaggccugcgucuccgagacccucuccaugcucggccagcacuucggccagcuccucgagcucgcccucacccgcgagguccaggcccucguccgcaagaucgacgccuccgacaacaucuacaccaccgaguccaccaccggcaaccucuucucccucacccaggagggcgccccccucugccgcaucaucgccaaggagggcggcgucgucgcccucuucaaggucugccgccaggacuccuuccgcugccucuacccccaggcccuccgcacccucgccuccaucugcugcgucgaggagggcguccaccagcucgagaaggucgacggcguccucugccucgccgacauccucaccgacaacucccacuccgaggccacccgcgccgaggccgccgccgucgucgcccaggucaccuccccccaccuccccgucacccagcaccucuccuccuuccucgaguccauggaggagaucgucaccgcccucgucaagcucugccaggaggccuccuccggcgaggucuuccuccucgccuccgccgcccucgccaacaucaccuucuucgacaccauggccugcgagaugcuccuccagcucaacgccauccgcguccuccucgaggccugcuccgacaagcagcgcgucgacacccccuacacccgcgaccagaucgucaccauccucgccaacauguccguccucgagcagugcgccuccgacaucauccaggagaacggcguccagcucaucaugggcaugcucuccgagaagccccgcuccggcacccccgccgaggucgccgccugcgagcgcguccagcagaaggccgccgucacccucgcccgccucucccgcgaccccgacgucgcccgcgaggccguccgccucuccugcaugucccgccucaucgagcucugccgcucccccuccgagcgcaacuccuccgacgccguccucgucgccugccucgccgcccuccgccgccucgccggcgucugccccgagggccuccaggacuccgacuuccagcagcucguccagccccgccucgucgacuccuuccuccucugcuccaacauggaggaguccuucgucuga

SEQ ID NO: 44693 - RNA, 333 nt, Artificial Sequence
  derived and/or modified sequence opt2 from INS__Homo_sapiens__NP_001278826
auggcccucuggaugcgccuccucccccuccucgcccuccucgcccucuggggccccgaccccgccgccgccuucgucaaccagcaccucugcggcucccaccucgucgaggcccucuaccucgucugcggcgagcgcggcuucuucuacacccccaagacccgccgcgaggccgaggaccuccaggucggccaggucgagcucggcggcggccccggcgccggcucccuccagccccucgcccucgagggcucccuccagaagcgcggcaucgucgagcagugcugcaccuccaucugcucccucuaccagcucgagaacuacugcaacuga

SEQ ID NO: 44694 - RNA, 834 nt, Artificial Sequence
  derived and/or modified sequence opt2 from INSIG1__Homo_sapiens__NP_005533
augccccgccuccacgaccacuucugguccugcuccugcgcccacuccgcccgccgccgcggccccccccgcgccuccgccgccggccucgccgccaaggucggcgagaugaucaacgucuccgucuccggccccucccuccucgccgcccacggcgcccccgacgccgaccccgccccccgcggccgcuccgccgccauguccggccccgagcccggcucccccuaccccaacaccuggcaccaccgccuccuccagcgcucccucguccucuucuccgucggcgucguccucgcccucguccucaaccuccuccagauccagcgcaacgucacccucuuccccgaggaggucaucgccaccaucuucuccuccgccuggugggucccccccugcugcggcaccgccgccgccgucgucggccuccucuaccccugcaucgacucccaccucggcgagccccacaaguucaagcgcgagugggccuccgucaugcgcugcaucgccgucuucgucggcaucaaccacgccuccgccaagcucgacuucgccaacaacguccagcucucccucacccucgccgcccucucccucggccucugguggaccuucgaccgcucccgcuccggccucggccucggcaucaccaucgccuuccucgccacccucaucacccaguuccucgucuacaacggcgucuaccaguacaccucccccgacuuccucuacauccgcuccuggcuccccugcaucuucuucuccggcggcgucaccgucggcaacaucggccgccagcucgccaugggcguccccgagaagccccacuccgacuga

SEQ ID NO: 44695 - RNA, 678 nt, Artificial Sequence
  derived and/or modified sequence opt2 from INSIG2__Homo_sapiens__XP_011509594
auggccgagggcgagaccgagucccccggccccaagaagugcggccccuacaucuccuccgucaccucccaguccgucaaccucaugauccgcggcgucguccucuucuucaucggcgucuuccucgcccucguccucaaccuccuccagauccagcgcaacgucacccucuucccccccgacgucaucgccuccaucuucuccuccgccuggugggucccccccugcugcggcaccgccuccgccgucaucggccuccucuaccccugcaucgaccgccaccucggcgagccccacaaguucaagcgcgagugguccuccgucaugcgcugcgucgccgucuucgucggcaucaaccacgccuccgccaaggucgacuucgacaacaacauccagcucucccucacccucgccgcccucuccaucggccucugguggaccuucgaccgcucccgcuccggcuucggccucggcgucggcaucgccuuccucgccaccgucgucacccagcuccucgucuacaacggcgucuaccaguacaccucccccgacuuccucuacguccgcuccuggcuccccugcaucuucuucgccggcggcaucaccaugggcaacaucggccgccagcucgccauguacgagugcaaggucaucgccgagaagucccaccaggaguga

SEQ ID NO: 44696 - RNA, 603 nt, Artificial Sequence
  derived and/or modified sequence opt2 from INS-IGF2__Homo_sapiens__NP_001035835
auggcccucuggaugcgccuccucccccuccucgcccuccucgcccucuggggccccgaccccgccgccgccuucgucaaccagcaccucugcggcucccaccucgucgaggcccucuaccucgucugcggcgagcgcggcuucuucuacacccccaagacccgccgcgaggccgaggaccuccaggccuccgcccucucccucuccuccuccaccuccaccuggcccgagggccucgacgccaccgcccgcgccccccccgcccucgucgucaccgccaacaucggccaggccggcggcuccuccucccgccaguuccgccagcgcgcccucggcaccuccgacucccccguccucuucauccacugccccggcgccgccggcaccgcccagggccucgaguaccgcggccgccgcgucaccaccgagcucgucugggaggaggucgacuccuccccccagccccagggcuccgagucccuccccgcccagccccccgcccagcccgccccccagcccgagccccagcaggcccgcgagcccucccccgaggucuccugcugcggccucuggccccgccgcccccagcgcucccagaacuga

SEQ ID NO: 44697 - RNA, 474 nt, Artificial Sequence
  derived and/or modified sequence opt2 from INSL3__Homo_sapiens__NP_001252516
auggacccccgccuccccgccugggcccucguccuccucggccccgcccucgucuucgcccucggccccgcccccacccccgagaugcgcgagaagcucugcggccaccacuucguccgcgcccucguccgcgucugcggcggcccccgcugguccaccgaggcccgccgccccgccaccggcggcgaccagcgcgagucccacuccgucucccaggccggccucaagcuccucuccuccuccaacccccccacccucaccuuccaguccgucggcaucuccgacgucuccugcuacuccggcuggcgcgacgacaucugcuccaugggcugguggcccaccgucaucucccgcugggaccucgccugcucccccugcccccgcccccucaccaucaccgccaccaccguccagcucccccccacccuccacgccaccgccgccuccgucgccguccccaacaagaccugcuga

SEQ ID NO: 44698 - RNA, 420 nt, Artificial Sequence
  derived and/or modified sequence opt2 from INSL4__Homo_sapiens__NP_002186
auggccucccucuuccgcuccuaccuccccgccaucuggcuccuccucucccagcuccuccgcgagucccucgccgccgagcuccgcggcugcggcccccgcuucggcaagcaccuccucuccuacugccccaugcccgagaagaccuucaccaccacccccggcggcuggcuccucgaguccggccgccccaaggagauggucuccaccuccaacaacaaggacggccaggcccucggcaccaccuccgaguucauccccaaccucucccccgagcucaagaagccccucuccgagggccagcccucccucaagaagaucauccucucccgcaagaagcgcuccggccgccaccgcuucgaccccuucugcugcgaggucaucugcgacgacggcaccuccgucaagcucugcaccuga

SEQ ID NO: 44699 - RNA, 642 nt, Artificial Sequence
  derived and/or modified sequence opt2 from INSL6__Homo_sapiens__NP_009110
augccccgccuccuccgccucucccuccucuggcucggccuccuccucguccgcuucucccgcgagcucuccgacaucuccuccgcccgcaagcucugcggccgcuaccucgucaaggagaucgagaagcucugcggccacgccaacuggucccaguuccgcuucgaggaggagacccccuucucccgccucaucgcccaggccuccgagaaggucgaggccuacucccccuaccaguucgaguccccccagaccgccucccccgcccgcggccgcggcaccaaccccgucuccaccuccugggaggaggccgucaacuccugggagaugcagucccuccccgaguacaaggacaagaagggcuacuccccccucggcaagacccgcgaguucuccuccucccacaacaucaacgucuacauccacgagaacgccaaguuccagaagaagcgccgcaacaagaucaagacccucuccaaccucuucuggggccaccacccccagcgcaagcgccgcggcuacuccgagaagugcugccucaccggcugcaccaaggaggagcucuccaucgccugccuccccuacaucgacuucaagcgccucaaggagaagcgcuccucccucgucaccaagaucuacuga

SEQ ID NO: 44700 - RNA, 1533 nt, Artificial Sequence
  derived and/or modified sequence opt2 from INSM1__Homo_sapiens__NP_002187
augccccgcggcuuccucgucaagcgcuccaagaaguccacccccgucuccuaccgcguccgcggcggcgaggacggcgaccgcgcccuccuccucucccccuccugcggcggcgcccgcgccgagccccccgcccccucccccguccccggcccccuccccccccccccccccgccgagcgcgcccacgccgcccucgccgccgcccucgccugcgcccccggcccccagccccccccccagggcccccgcgccgcccacuucggcaaccccgaggccgcccaccccgccccccucuacucccccacccgccccgucucccgcgagcacgagaagcacaaguacuucgagcgcuccuucaaccucggcucccccgucuccgccgaguccuuccccacccccgccgcccuccucggcggcggcggcggcggcggcgccuccggcgccggcggcggcggcaccugcggcggcgacccccuccucuucgcccccgccgagcucaagaugggcaccgccuucuccgccggcgccgaggccgcccgcggccccggccccggccccccccucccccccgccgccgcccuccgcccccccggcaagcgcccccccccccccaccgccgccgagccccccgccaaggccgucaaggcccccggcgccaagaagcccaaggccauccgcaagcuccacuucgaggacgaggucaccaccucccccguccucggccucaagaucaaggagggccccgucgaggccccccgcggccgcgccggcggcgccgcccgcccccucggcgaguucaucugccagcucugcaaggaggaguacgccgaccccuucgcccucgcccagcacaagugcucccgcaucguccgcgucgaguaccgcugccccgagugcgccaaggucuucuccugccccgccaaccucgccucccaccgccgcuggcacaagccccgccccgcccccgccgccgcccgcgcccccgagcccgaggccgccgcccgcgccgaggcccgcgaggcccccggcggcggcuccgaccgcgacacccccucccccggcggcgucuccgaguccggcuccgaggacggccucuacgagugccaccacugcgccaagaaguuccgccgccaggccuaccuccgcaagcaccuccucgcccaccaccaggcccuccaggccaagggcgccccccucgccccccccgccgaggaccuccucgcccucuaccccggccccgacgagaaggccccccaggaggccgccggcgacggcgagggcgccggcguccucggccucuccgccuccgccgagugccaccucugccccgucugcggcgaguccuucgccuccaagggcgcccaggagcgccaccuccgccuccuccacgccgcccaggucuuccccugcaaguacugccccgccaccuucuacuccucccccggccucacccgccacaucaacaagugccaccccuccgagaaccgccaggucauccuccuccagguccccguccgccccgccugcuga

SEQ ID NO: 44701 - RNA, 1701 nt, Artificial Sequence
  derived and/or modified sequence opt2 from INSM2__Homo_sapiens__NP_115983
augccccgcggcuuccucgucaagcgcaccaagcgcaccggcggccucuaccgcguccgccucgccgagcgcgucuucccccuccucggcccccagggcgccccccccuuccucgaggaggcccccuccgccucccuccccggcgccgagcgcgccaccccccccacccgcgaggagcccggcaagggccucaccgccgaggccgcccgcgagcaguccggcucccccugccgcgccgccggcgucucccccggcaccggcggccgcgagggcgccgaguggcgcgccggcggccgcgagggccccggccccucccccucccccucccccucccccgccaagcccgccggcgccgagcuccgccgcgccuuccucgagcgcugccucuccucccccgucuccgccgaguccuuccccggcggcgccgccgccgucgccgccuucuccugcuccgucgcccccgccgccgcccccacccccggcgagcaguuccuccucccccuccgcgcccccuuccccgagcccgcccuccagcccgaccccgccccccucuccgccgcccuccagucccucaagcgcgccgccggcggcgagcgccgcggcaaggcccccaccgacugcgccuccggccccgccgccgccggcaucaagaagcccaaggccaugcgcaagcucuccuucgccgacgaggucaccaccucccccguccucggccucaagaucaaggaggaggagcccggcgcccccucccgcggccucggcggcucccgcaccccccucggcgaguucaucugccagcucugcaaggagcaguacgccgaccccuucgcccucgcccagcaccgcugcucccgcaucguccgcgucgaguaccgcugccccgagugcgacaaggucuucuccugccccgccaaccucgccucccaccgccgcuggcacaagccccgccccgccgccgccaacgccgccaccgucuccuccgccgacggcaagccccccuccuccuccuccuccuccucccgcgacuccggcgccaucgccuccuuccucgccgagggcaaggagaacucccgcaucgagcgcaccgccgaccagcacccccaggcccgcgacuccuccggcgccgaccagcaccccgacuccgccccccgccagggccuccagguccucacccaccccgagcccccccucccccagggccccuacaccgagggcguccucggccgccgcguccccguccccggcuccaccuccggcggccgcggcuccgagaucuucgucugccccuacugccacaagaaguuccgccgccaggccuaccuccgcaagcaccucuccacccacgaggccggcuccgcccgcgcccucgcccccggcuucggcuccgagcgcggcgccccccucgccuucgccugcccccucugcggcgcccacuuccccaccgccgacauccgcgagaagcaccgccucuggcacgccguccgcgaggagcuccuccuccccgcccucgccggcgccccccccgagaccuccggccccuccggccccuccgacggcuccgcccagcagaucuucuccugcaagcacugccccuccaccuucuucuccucccccggccucacccgccacaucaacaagugccaccccuccgagucccgccagguccuccuccuccagaugccccuccgccccggcugcuga

SEQ ID NO: 44702 - RNA, 4149 nt, Artificial Sequence
  derived and/or modified sequence opt2 from INSR__Homo_sapiens__NP_000199
auggccaccggcggccgccgcggcgccgccgccgccccccuccucgucgccgucgccgcccuccuccucggcgccgccggccaccucuaccccggcgaggucugccccggcauggacauccgcaacaaccucacccgccuccacgagcucgagaacugcuccgucaucgagggccaccuccagauccuccucauguucaagacccgccccgaggacuuccgcgaccucuccuuccccaagcucaucaugaucaccgacuaccuccuccucuuccgcgucuacggccucgagucccucaaggaccucuuccccaaccucaccgucauccgcggcucccgccucuucuucaacuacgcccucgucaucuucgagaugguccaccucaaggagcucggccucuacaaccucaugaacaucacccgcggcuccguccgcaucgagaagaacaacgagcucugcuaccucgccaccaucgacuggucccgcauccucgacuccgucgaggacaacuacaucguccucaacaaggacgacaacgaggagugcggcgacaucugccccggcaccgccaagggcaagaccaacugccccgccaccgucaucaacggccaguucgucgagcgcugcuggacccacucccacugccagaaggucugccccaccaucugcaagucccacggcugcaccgccgagggccucugcugccacuccgagugccucggcaacugcucccagcccgacgaccccaccaagugcgucgccugccgcaacuucuaccucgacggccgcugcgucgagaccugccccccccccuacuaccacuuccaggacuggcgcugcgucaacuucuccuucugccaggaccuccaccacaagugcaagaacucccgccgccagggcugccaccaguacgucauccacaacaacaagugcauccccgagugccccuccggcuacaccaugaacuccuccaaccuccucugcacccccugccucggccccugccccaaggucugccaccuccucgagggcgagaagaccaucgacuccgucaccuccgcccaggagcuccgcggcugcaccgucaucaacggcucccucaucaucaacauccgcggcggcaacaaccucgccgccgagcucgaggccaaccucggccucaucgaggagaucuccggcuaccucaagauccgccgcuccuacgcccucgucucccucuccuucuuccgcaagcuccgccucauccgcggcgagacccucgagaucggcaacuacuccuucuacgcccucgacaaccagaaccuccgccagcucugggacugguccaagcacaaccucaccaucacccagggcaagcucuucuuccacuacaaccccaagcucugccucuccgagauccacaagauggaggaggucuccggcaccaagggccgccaggagcgcaacgacaucgcccucaagaccaacggcgaccaggccuccugcgagaacgagcuccucaaguucuccuacauccgcaccuccuucgacaagauccuccuccgcugggagcccuacuggccccccgacuuccgcgaccuccucggcuucaugcucuucuacaaggaggcccccuaccagaacgucaccgaguucgacggccaggacgccugcggcuccaacuccuggaccgucgucgacaucgaccccccccuccgcuccaacgaccccaagucccagaaccaccccggcuggcucaugcgcggccucaagcccuggacccaguacgccaucuucgucaagacccucgucaccuucuccgacgagcgccgcaccuacggcgccaaguccgacaucaucuacguccagaccgacgccaccaaccccuccgucccccucgaccccaucuccgucuccaacuccuccucccagaucauccucaaguggaagccccccuccgaccccaacggcaacaucacccacuaccucgucuucugggagcgccaggccgaggacuccgagcucuucgagcucgacuacugccucaagggccucaagcuccccucccgcaccugguccccccccuucgaguccgaggacucccagaagcacaaccaguccgaguacgaggacuccgccggcgagugcugcuccugccccaagaccgacucccagauccucaaggagcucgaggaguccuccuuccgcaagaccuucgaggacuaccuccacaacgucgucuucgucccccgcaagaccuccuccggcaccggcgccgaggacccccgccccucccgcaagcgccgcucccucggcgacgucggcaacgucaccgucgccguccccaccgucgccgccuuccccaacaccuccuccaccuccguccccaccucccccgaggagcaccgccccuucgagaaggucgucaacaaggagucccucgucaucuccggccuccgccacuucaccggcuaccgcaucgagcuccaggccugcaaccaggacacccccgaggagcgcugcuccgucgccgccuacgucuccgcccgcaccaugcccgaggccaaggccgacgacaucgucggccccgucacccacgagaucuucgagaacaacgucguccaccucauguggcaggagcccaaggagcccaacggccucaucguccucuacgaggucuccuaccgccgcuacggcgacgaggagcuccaccucugcgucucccgcaagcacuucgcccucgagcgcggcugccgccuccgcggccucucccccggcaacuacuccguccgcauccgcgccaccucccucgccggcaacggcuccuggaccgagcccaccuacuucuacgucaccgacuaccucgacguccccuccaacaucgccaagaucaucaucggcccccucaucuucgucuuccucuucuccgucgucaucggcuccaucuaccucuuccuccgcaagcgccagcccgacggcccccucggcccccucuacgccuccuccaaccccgaguaccucuccgccuccgacgucuuccccugcuccgucuacguccccgacgagugggaggucucccgcgagaagaucacccuccuccgcgagcucggccagggcuccuucggcauggucuacgagggcaacgcccgcgacaucaucaagggcgaggccgagacccgcgucgccgucaagaccgucaacgaguccgccucccuccgcgagcgcaucgaguuccucaacgaggccuccgucaugaagggcuucaccugccaccacgucguccgccuccucggcgucgucuccaagggccagcccacccucgucgucauggagcucauggcccacggcgaccucaaguccuaccuccgcucccuccgccccgaggccgagaacaaccccggccgccccccccccacccuccaggagaugauccagauggccgccgagaucgccgacggcauggccuaccucaacgccaagaaguucguccaccgcgaccucgccgcccgcaacugcauggucgcccacgacuucaccgucaagaucggcgacuucggcaugacccgcgacaucuacgagaccgacuacuaccgcaagggcggcaagggccuccuccccguccgcuggauggcccccgagucccucaaggacggcgucuucaccaccuccuccgacaugugguccuucggcgucguccucugggagaucaccucccucgccgagcagcccuaccagggccucuccaacgagcagguccucaaguucgucauggacggcggcuaccucgaccagcccgacaacugccccgagcgcgucaccgaccucaugcgcaugugcuggcaguucaaccccaagaugcgccccaccuuccucgagaucgucaaccuccucaaggacgaccuccaccccuccuuccccgaggucuccuucuuccacuccgaggagaacaaggcccccgaguccgaggagcucgagauggaguucgaggacauggagaacgucccccucgaccgcuccucccacugccagcgcgaggaggccggcggccgcgacggcggcuccucccucggcuucaagcgcuccuacgaggagcacauccccuacacccacaugaacggcggcaagaagaacggccgcauccucacccucccccgcuccaaccccuccuga

SEQ ID NO: 44703 - RNA, 3894 nt, Artificial Sequence
  derived and/or modified sequence opt2 from INSRR__Homo_sapiens__NP_055030
auggccguccccucccucuggcccuggggcgccugccuccccgucaucuuccucucccucggcuucggccucgacaccgucgaggucugccccucccucgacauccgcuccgaggucgccgagcuccgccagcucgagaacugcuccgucgucgagggccaccuccagauccuccucauguucaccgccaccggcgaggacuuccgcggccucuccuucccccgccucacccaggucaccgacuaccuccuccucuuccgcgucuacggccucgagucccuccgcgaccucuuccccaaccucgccgucauccgcggcacccgccucuuccucggcuacgcccucgucaucuucgagaugccccaccuccgcgacgucgcccuccccgcccucggcgccguccuccgcggcgccguccgcgucgagaagaaccaggagcucugccaccucuccaccaucgacuggggccuccuccagcccgcccccggcgccaaccacaucgucggcaacaagcucggcgaggagugcgccgacgucugccccggcguccucggcgccgccggcgagcccugcgccaagaccaccuucuccggccacaccgacuaccgcugcuggaccuccucccacugccagcgcgucugccccugcccccacggcauggccugcaccgcccgcggcgagugcugccacaccgagugccucggcggcugcucccagcccgaggacccccgcgccugcgucgccugccgccaccucuacuuccagggcgccugccucugggccugcccccccggcaccuaccaguacgaguccuggcgcugcgucaccgccgagcgcugcgccucccuccacuccguccccggccgcgccuccaccuucggcauccaccagggcuccugccucgcccagugccccuccggcuucacccgcaacuccuccuccaucuucugccacaagugcgagggccucugccccaaggagugcaaggucggcaccaagaccaucgacuccauccaggccgcccaggaccucgucggcugcacccacgucgagggcucccucauccucaaccuccgccagggcuacaaccucgagccccagcuccagcacucccucggccucgucgagaccaucaccggcuuccucaagaucaagcacuccuucgcccucgucucccucggcuucuucaagaaccucaagcucauccgcggcgacgccauggucgacggcaacuacacccucuacguccucgacaaccagaaccuccagcagcucggcuccugggucgccgccggccucaccauccccgucggcaagaucuacuucgccuucaacccccgccucugccucgagcacaucuaccgccucgaggaggucaccggcacccgcggccgccagaacaaggccgagaucaacccccgcaccaacggcgaccgcgccgccugccagacccgcacccuccgcuucgucuccaacgucaccgaggccgaccgcauccuccuccgcugggagcgcuacgagccccucgaggcccgcgaccuccucuccuucaucgucuacuacaaggagucccccuuccagaacgccaccgagcacgucggccccgacgccugcggcacccaguccuggaaccuccucgacgucgagcucccccucucccgcacccaggagcccggcgucacccucgccucccucaagcccuggacccaguacgccgucuucguccgcgccaucacccucaccaccgaggaggacuccccccaccagggcgcccagucccccaucgucuaccuccgcacccuccccgccgcccccaccgucccccaggacgucaucuccaccuccaacuccuccucccaccuccucguccgcuggaagccccccacccagcgcaacggcaaccucaccuacuaccucguccucuggcagcgccucgccgaggacggcgaccucuaccucaacgacuacugccaccgcggccuccgccuccccaccuccaacaacgacccccgcuucgacggcgaggacggcgaccccgaggccgagauggaguccgacugcugccccugccagcaccccccccccggccagguccuccccccccucgaggcccaggaggccuccuuccagaagaaguucgagaacuuccuccacaacgccaucaccauccccaucucccccuggaaggucaccuccaucaacaaguccccccagcgcgacuccggccgccaccgccgcgccgccggcccccuccgccucggcggcaacuccuccgacuucgagauccaggaggacaaggucccccgcgagcgcgccguccucuccggccuccgccacuucaccgaguaccgcaucgacauccacgccugcaaccacgccgcccacaccgucggcugcuccgccgccaccuucgucuucgcccgcaccaugccccaccgcgaggccgacggcauccccggcaaggucgccugggaggccuccuccaagaacuccguccuccuccgcuggcucgagccccccgaccccaacggccucauccucaaguacgagaucaaguaccgccgccucggcgaggaggccaccguccucugcgucucccgccuccgcuacgccaaguucggcggcguccaccucgcccuccucccccccggcaacuacuccgcccgcguccgcgccaccucccucgccggcaacggcuccuggaccgacuccgucgccuucuacauccucggccccgaggaggaggacgccggcggccuccacguccuccucaccgccacccccgucggccucacccuccucaucguccucgccgcccucggcuucuucuacggcaagaagcgcaaccgcacccucuacgccuccgucaaccccgaguacuucuccgccuccgacauguacguccccgacgagugggaggucccccgcgagcagaucuccaucauccgcgagcucggccagggcuccuucggcauggucuacgagggccucgcccgcggccucgaggccggcgaggaguccacccccgucgcccucaagaccgucaacgagcucgccuccccccgcgagugcaucgaguuccucaaggaggccuccgucaugaaggccuucaagugccaccacgucguccgccuccucggcgucgucucccagggccagcccacccucgucaucauggagcucaugacccgcggcgaccucaagucccaccuccgcucccuccgccccgaggccgagaacaaccccggccucccccagcccgcccucggcgagaugauccagauggccggcgagaucgccgacggcauggccuaccucgccgccaacaaguucguccaccgcgaccucgccgcccgcaacugcauggucucccaggacuucaccgucaagaucggcgacuucggcaugacccgcgacgucuacgagaccgacuacuaccgcaagggcggcaagggccuccuccccguccgcuggauggcccccgagucccucaaggacggcaucuucaccacccacuccgacgucugguccuucggcgucguccucugggagaucgucacccucgccgagcagcccuaccagggccucuccaacgagcagguccucaaguucgucauggacggcggcguccucgaggagcucgagggcugcccccuccagcuccaggagcucaugucccgcugcuggcagcccaacccccgccuccgccccuccuucacccacauccucgacuccauccaggaggagcuccgccccuccuuccgccuccucuccuucuacuacucccccgagugccgcggcgcccgcggcucccuccccaccaccgacgccgagcccgacuccucccccaccccccgcgacugcuccccccagaacggcggccccggccacuga

SEQ ID NO: 44704 - RNA, 1389 nt, Artificial Sequence
  derived and/or modified sequence opt2 from INTS12__Homo_sapiens__NP_001135943
auggccgccaccgucaaccucgagcucgaccccaucuuccucaaggcccucggcuuccuccacuccaaguccaaggacuccgccgagaagcucaaggcccuccucgacgagucccucgcccgcggcaucgacuccuccuaccgccccucccagaaggacgucgagccccccaagaucuccuccaccaagaacaucuccaucaagcaggagcccaagaucuccuccucccuccccuccggcaacaacaacggcaagguccucaccaccgagaaggucaagaaggaggccgagaagcgccccgccgacaagaugaaguccgacaucaccgagggcgucgacauccccaagaagccccgccucgagaagcccgagacccaguccucccccaucaccguccaguccuccaaggaccuccccauggccgaccucuccuccuucgaggagaccuccgccgacgacuucgccauggagaugggccucgccugcgucgucugccgccagaugauggucgccuccggcaaccagcucgucgagugccaggagugccacaaccucuaccaccgcgacugccacaagccccaggucaccgacaaggaggccaacgacccccgccucgucugguacugcgcccgcugcacccgccagaugaagcgcauggcccagaagacccagaagcccccccagaagcccgcccccgccgucgucuccgucacccccgccgucaaggacccccucgucaagaagcccgagaccaagcucaagcaggagaccaccuuccucgccuucaagcgcaccgaggucaagaccuccaccgucaucuccggcaacuccuccuccgccuccgucuccuccuccgucaccuccggccucaccggcugggccgccuucgccgccaagaccuccuccgccggccccuccaccgccaagcucuccuccaccacccagaacaacaccggcaagcccgccaccuccuccgccaaccagaagcccgucggccucaccggccucgccaccuccuccaagggcggcaucggcuccaagaucggcuccaacaacuccaccacccccaccgucccccucaagcccccccccccccucacccucggcaagaccggccucucccgcuccgucuccugcgacaacgucuccaaggucggccuccccucccccuccucccucguccccggcuccuccucccagcucuccggcaacggcaacuccggcaccuccggccccuccggcuccaccaccuccaagaccaccuccgaguccuccuccucccccuccgccucccucaagggccccaccucccaggagucccagcucaacgccaugaagcgccuccagauggucaagaagaaggccgcccagaagaagcucaagaaguga

SEQ ID NO: 44705 - RNA, 6573 nt, Artificial Sequence
  derived and/or modified sequence opt2 from INTS1__Homo_sapiens__NP_001073922
augaaccgcgccaagcccaccaccguccgccgccccuccgccgccgccaagcccuccggccaccccccccccggcgacuucaucgcccucggcuccaagggccaggccaacgaguccaagaccgccuccacccuccucaagcccgcccccuccggccuccccuccgagcgcaagcgcgacgccgccgccgcccucuccuccgccuccgcccucaccggccucaccaagcgccccaagcucuccuccacccccccccucuccgcccucggccgccucgccgaggccgccgucgccgagaagcgcgccaucucccccuccaucaaggagcccuccgucguccccaucgagguccuccccaccguccuccucgacgagaucgaggccgccgagcucgagggcaacgacgaccgcaucgagggcguccucugcggcgccgucaagcagcucaaggucacccgcgccaagcccgacuccacccucuaccucucccucauguaccucgccaagaucaagcccaacaucuucgccaccgagggcgucaucgaggcccucugcucccuccuccgccgcgacgccuccaucaacuucaaggccaagggcaacucccucgucuccguccucgccugcaaccuccucauggccgccuacgaggaggacgagaacuggcccgagaucuucgucaaggucuacaucgaggacucccucggcgagcgcaucugggucgacuccccccacugcaagaccuucgucgacaacauccagaccgccuucaacacccgcaugcccccccgcuccguccuccuccagggcgaggccggccgcgucgccggcgaccucggcgccggcuccuccccccaccccucccucaccgaggaggaggacucccagaccgagcuccucaucgccgaggagaagcucucccccgagcaggagggccagcucaugccccgcuacgaggagcucgccgaguccgucgaggaguacguccucgacaugcuccgcgaccagcucaaccgccgccagcccaucgacaacgucucccgcaaccuccuccgccuccucaccuccaccugcggcuacaaggagguccgccuccucgccguccagaagcucgagauguggcuccagaaccccaagcucacccgccccgcccaggaccuccucauguccgucugcaugaacugcaacacccacggcuccgaggacauggacgucaucucccaccucaucaagauccgccucaagcccaagguccuccucaaccacuucaugcucugcauccgcgagcuccucuccgcccacaaggacaaccucggcaccaccaucaagcucgucaucuucaacgagcucuccuccgcccgcaaccccaacaacaugcagguccucuacaccgcccuccagcacuccuccgagcucgcccccaaguuccucgccauggucuuccaggaccuccucaccaacaaggacgacuaccuccgcgccucccgcgcccuccuccgcgagaucaucaagcagaccaagcacgagaucaacuuccaggccuucugccucggccucaugcaggagcgcaaggagccccaguaccucgagauggaguucaaggagcgcuucgucguccacaucaccgacguccucgccgucuccaugaugcucggcaucaccgcccaggucaaggaggccggcaucgccugggacaagggcgagaagcgcaaccucgagguccuccgcuccuuccagaaccagaucgccgccauccagcgcgacgccgucugguggcuccacaccgucguccccuccaucuccaagcucgcccccaaggacuacguccacugccuccacaagguccucuucaccgagcagcccgagaccuacuacaagugggacaacuggccccccgaguccgaccgcaacuucuuccuccgccucugcuccgagguccccauccucgaggacacccucaugcgcauccucgucaucggccucucccgcgagcucccccucggccccgccgacgccauggagcucgccgaccaccucgucaagcgcgccgccgccguccaggccgacgacgucgagguccucaaggucggccgcacccagcucaucgacgccguccucaaccucugcaccuaccaccaccccgagaacauccagcucccccccggcuaccagccccccaaccucgccaucuccacccucuacuggaaggccuggccccuccuccucgucgucgccgccuucaaccccgagaacaucggccucgccgccugggaggaguaccccacccucaagaugcucauggagauggucaugaccaacaacuacuccuacccccccugcacccucaccgacgaggagacccgcaccgagaugcucaaccgcgagcuccagaccgcccagcgcgagaagcaggagauccucgccuucgagggccaccucgccgccgccuccaccaagcagaccaucaccgaguccuccucccuccuccucucccagcucaccucccucgacccccagggccccccccgccgcccccccccccacauccucgaccaggucaagucccucaaccagucccuccgccucggccaccuccucugccgcucccgcaaccccgacuuccuccuccacaucauccagcgccaggccuccucccaguccaugcccuggcucgccgaccucguccaguccuccgagggcucccucgacguccuccccguccagugccucugcgaguuccuccuccacgacgccgucgacgacgccgccuccggcgaggaggacgacgagggcgaguccaaggagcagaaggccaagaagcgccagcgccagcagaagcagcgccagcuccucggccgccuccaggaccuccuccucggccccaaggccgacgagcagaccaccugcgagguccucgacuacuuccuccgccgccucggcuccucccaggucgccucccgcguccucgccaugaagggccucucccucguccucuccgagggcucccuccgcgacggcgaggagaaggagccccccauggaggaggacgucggcgacaccgacguccuccagggcuaccaguggcuccuccgcgaccucccccgccucccccucuucgacuccguccgcuccaccaccgcccucgcccuccagcaggccauccacauggagaccgacccccagaccaucuccgccuaccucaucuaccucucccagcacacccccgucgaggagcaggcccagcacuccgaccucgcccucgacgucgcccgccucgucgucgagcgcuccaccaucaugucccaccucuucuccaagcucucccccuccgccgccuccgacgccguccucuccgcccuccucuccaucuucucccgcuacguccgccgcaugcgccaguccaaggagggcgaggaggucuacuccugguccgagucccaggaccaggucuuccuccgcugguccuccggcgagaccgccaccaugcacauccucgucguccacgccauggucauccuccucacccucggccccccccgcgccgacgacuccgaguuccaggcccuccucgacaucugguuccccgaggagaagccccuccccaccgccuuccucgucgacaccuccgaggaggcccuccuccuccccgacuggcucaagcuccgcaugauccgcuccgagguccuccgccucgucgacgccgcccuccaggaccucgagccccagcagcuccuccucuucguccaguccuucggcauccccgucuccuccauguccaagcuccuccaguuccucgaccaggccgucgcccacgacccccagacccucgagcagaacaucauggacaagaacuacauggcccaccucgucgagguccagcacgagcgcggcgccuccggcggccagaccuuccacucccuccucaccgccucccuccccccccgccgcgacuccaccgaggcccccaagcccaaguccucccccgagcagcccaucggccagggccgcauccgcgucggcacccagcuccgcguccucggccccgaggacgaccucgccggcauguuccuccagaucuucccccucucccccgacccccgcuggcaguccuccuccccccgccccgucgcccucgcccuccagcaggcccucggccaggagcucgcccgcgucguccagggcucccccgagguccccggcaucaccguccgcguccuccaggcccucgccacccuccucuccuccccccacggcggcgcccucgucauguccaugcaccgcucccacuuccucgccugcccccuccuccgccagcucugccaguaccagcgcugcgucccccaggacaccggcuucuccucccucuuccucaagguccuccuccagaugcuccaguggcucgacucccccggcgucgagggcggcccccuccgcgcccagcuccgcaugcucgccucccaggccuccgccggccgccgccucuccgacguccgcggcggccuccuccgccucgccgaggcccucgccuuccgccaggaccucgaggucgucuccuccaccguccgcgccgucaucgccacccuccgcuccggcgagcagugcuccgucgagcccgaccucaucuccaagguccuccagggccucaucgagguccgcuccccccaccucgaggagcuccucaccgccuucuucuccgccaccgccgacgccgccucccccuuccccgccugcaagcccgucgucgucgucuccucccuccuccuccaggaggaggagccccucgccggcggcaagcccggcgccgacggcggcucccucgaggccguccgccucggccccuccuccggccuccucgucgacuggcucgagaugcucgaccccgaggucgucuccuccugccccgaccuccagcuccgccuccucuucucccgccgcaagggcaagggccaggcccagguccccuccuuccgccccuaccuccucacccucuucacccaccaguccuccuggcccacccuccaccagugcauccgcguccuccucggcaagucccgcgagcagcgcuucgaccccuccgccucccucgacuuccucugggccugcauccacgucccccgcaucuggcagggccgcgaccagcgcaccccccagaagcgccgcgaggagcucguccuccgcguccagggccccgagcucaucucccucgucgagcucauccucgccgaggccgagacccgcucccaggacggcgacaccgccgccugcucccucauccaggcccgccucccccuccuccucuccugcugcugcggcgacgacgaguccguccgcaaggucaccgagcaccucuccggcugcauccagcaguggggcgacuccguccucggccgccgcugccgcgaccuccuccuccagcucuaccuccagcgccccgagcuccgcguccccguccccgagguccuccuccacuccgagggcgccgccuccuccuccgucugcaagcucgacggccucauccaccgcuucaucacccuccucgccgacaccuccgacucccgcgcccucgagaaccgcggcgccgacgccuccauggccugccgcaagcucgccgucgcccacccccuccuccuccuccgccaccuccccaugaucgccgcccuccuccacggccgcacccaccucaacuuccaggaguuccgccagcagaaccaccucuccugcuuccuccacguccucggccuccucgagcuccuccagccccacgucuuccgcuccgagcaccagggcgcccucugggacugccuccucuccuucauccgccuccuccucaacuaccgcaaguccucccgccaccucgccgccuucaucaacaaguucguccaguucauccacaaguacaucaccuacaacgcccccgccgccaucuccuuccuccagaagcacgccgacccccuccacgaccucuccuucgacaacuccgaccucgucaugcucaagucccuccucgccggccucucccuccccucccgcgacgaccgcaccgaccgcggccucgacgaggagggcgaggaggaguccuccgccggcucccucccccucgucuccgucucccucuucaccccccucaccgccgccgagauggcccccuacaugaagcgccucucccgcggccagaccgucgaggaccuccucgagguccucuccgacaucgacgagaugucccgccgccgccccgagauccucuccuucuucuccaccaaccuccagcgccucauguccuccgccgaggagugcugccgcaaccucgccuucucccucgcccuccgcuccaugcagaacucccccuccaucgccgccgccuuccuccccaccuucauguacugccucggcucccaggacuucgaggucguccagaccgcccuccgcaaccuccccgaguacgcccuccucugccaggagcacgccgccguccuccuccaccgcgccuuccucgucggcauguacggccagauggaccccuccgcccagaucuccgaggcccuccgcauccuccacauggaggccgucauguga

SEQ ID NO: 44706 - RNA, 3615 nt, Artificial Sequence
  derived and/or modified sequence opt2 from INTS2__Homo_sapiens__NP_065799
augaaggaccagcagaccgucaucaugaccgagugcaccucccuccaguucgucucccccuucgccuucgaggccaugcagaaggucgacgucgucugccucgccucccucuccgaccccgagcuccgccuccuccuccccugccucguccgcauggcccucugcgcccccgccgaccagucccaguccugggcccaggacaagaagcucauccuccgccuccucuccggcgucgaggccgucaacuccaucgucgcccuccucuccgucgacuuccacgcccucgagcaggacgccuccaaggagcagcagcuccgccacaagcucggcggcggcuccggcgaguccauccucgucucccagcuccagcacggccucacccucgaguucgagcacuccgacuccccccgccgccuccgccucguccucuccgagcuccucgccaucaugaacaaggucuccgaguccaacggcgaguucuucuucaaguccuccgagcucuucgagucccccgucuaccucgaggaggccgccgacguccucugcauccuccaggccgagcuccccucccuccuccccaucgucgacgucgccgaggcccuccuccacguccgcaacggcgccugguuccucugccuccucgucgccaacguccccgacuccuucaacgaggucugccgcggccucaucaagaacggcgagcgccaggacgaggagucccucggcggccgccgccgcaccgacgcccuccgcuuccucugcaagaugaaccccucccaggcccucaagguccgcggcauggucgucgaggagugccaccuccccggccucggcgucgcccucacccucgaccacaccaagaacgaggccugcgaggacggcgucuccgaccucgucugcuucgucuccggccuccuccucggcaccaacgccaagguccgcaccugguucggcaccuucauccgcaacggccagcagcgcaagcgcgagaccuccuccuccguccucuggcagaugcgccgccagcuccuccucgagcucaugggcauccuccccaccguccgcuccacccgcaucgucgaggaggccgacgucgacauggagcccaacgucuccgucuacuccggccucaaggaggagcacgucgucaaggccuccgcccuccuccgccucuacugcgcccucaugggcaucgccggccucaagcccaccgaggaggaggccgagcagcuccuccagcucaugaccucccgcccccccgccacccccgccggcguccgcuucgucucccucuccuucugcaugcuccucgccuucuccacccucgucuccacccccgagcaggagcagcucauggucgucuggcucuccuggaugaucaaggaggaggccuacuucgaguccaccuccggcgucuccgccuccuucggcgagaugcuccuccucgucgccauguacuuccacuccaaccagcucuccgccaucaucgaccucgucugcuccacccucggcaugaagaucgucaucaagcccuccucccucucccgcaugaagaccaucuucacccaggagaucuucaccgagcaggucgucaccgcccacgccguccgcguccccgucaccuccaaccucuccgccaacaucaccggcuuccuccccauccacugcaucuaccagcuccuccgcucccgcuccuucaccaagcacaaggucuccaucaaggacuggaucuaccgccagcucugcgagaccuccaccccccuccacccccagcuccucccccucaucgacgucuacaucaacuccauccucacccccgccuccaaguccaaccccgaggccaccaaccagcccgucaccgagcaggagauccucaacaucuuccagggcgucaucggcggcgacaacauccgccucaaccagcgcuucuccaucaccgcccagcuccucguccucuacuacauccucuccuacgaggaggcccuccucgccaacaccaagacccucgccgccaugcagcgcaagcccaaguccuacuccuccucccucauggaccagauccccaucaaguuccucauccgccaggcccagggccuccagcaggagcucggcggccuccacuccgcccuccuccgccuccucgccaccaacuacccccaccucugcaucgucgacgacuggaucugcgaggaggagaucaccggcaccgacgcccuccuccgccgcaugcuccucaccaacaacgccaagaaccacucccccaagcagcuccaggaggccuucuccgccguccccgucaaccacacccaggucaugcagaucaucgagcaccucacccuccucuccgccuccgagcucauccccuacgccgagguccucaccuccaacaugucccagcuccucaacuccggcgucccccgccgcauccuccagaccgucaacaagcucuggaugguccucaacaccgucaugccccgccgccucugggucaugaccgucaacgcccuccagcccuccaucaaguucguccgccagcagaaguacacccagaacgaccucaugaucgacccccucaucguccuccgcugcgaccagcgcguccaccgcugccccccccucauggacaucacccuccacaugcucaacggcuaccuccucgccuccaaggccuaccucuccgcccaccucaaggagaccgagcaggaccgccccucccagaacaacaccaucggccucgucggccagaccgacgcccccgaggucacccgcgaggagcucaagaacgcccuccucgccgcccaggacuccgccgccguccagauccuccucgagaucugccuccccaccgaggaggagaaggccaacggcgucaaccccgacucccuccuccgcaacguccaguccgucaucaccaccuccgcccccaacaagggcauggaggagggcgaggacaaccuccucugcaaccuccgcgagguccagugccucaucugcugccuccuccaccagauguacaucgccgaccccaacaucgccaagcucguccacuuccagggcuaccccugcgagcuccucccccucaccgucgccggcauccccuccaugcacaucugccucgacuucauccccgagcucaucgcccagcccgagcucgagaagcagaucuucgccauccagcuccucucccaccucugcauccaguacgcccuccccaagucccucuccgucgcccgccucgccgucaacgucaugggcacccuccucaccguccucacccaggccaagcgcuacgccuucuucaugcccacccuccccucccucgucuccuucugccgcgccuuccccccccucuacgaggacaucaugucccuccucauccagaucggccaggucugcgccuccgacgucgccacccagacccgcgacaucgaccccaucaucacccgccuccagcagaucaaggagaagcccuccggcuggucccagaucugcaaggacuccuccuacaagaacggcucccgcgacaccggcuccauggaccccgacguccagcucugccacugcaucgagcgcaccgucaucgagaucaucaacauguccgucuccggcaucuga

SEQ ID NO: 44707 - RNA, 3129 nt, Artificial Sequence
  derived and/or modified sequence opt2 from INTS3__Homo_sapiens__NP_075391
auggagcuccagaagggcaagggcgccgccgccgccgccgccgccuccggcgccgccggcggcggcggcggcggcgccggcgccggcgcccccggcggcggccgccuccuccucuccaccucccucgacgccaaggacgagcucgaggagcgccucgagcgcugcauguccaucgucaccuccaugaccgccggcgucuccgagcgcgaggccaacgacgcccucaacgccuacgucugcaagggccucccccagcacgaggagaucugccucggccucuucacccucauccucaccgagcccgcccaggcccagaagugcuaccgcgaccucgcccucgucucccgcgacggcaugaacaucguccucaacaagaucaaccagauccucauggagaaguaccucaagcuccaggacaccugccgcacccagcucgucuggcucguccgcgagcucgucaaguccggcguccucggcgccgacggcgucugcaugaccuucaugaagcagaucgccggcggcgacgucaccgccaagaacaucuggcucgccgaguccguccucgacauccucaccgagcagcgcgaguggguccucaaguccuccauccucaucgccauggccgucuacaccuaccuccgccucaucgucgaccaccacggcaccgcccagcuccaggcccuccgccagaaggaggucgacuucugcaucucccuccuccgcgagcgcuucauggagugccucaugaucggccgcgaccucguccgccuccuccagaacgucgcccgcauccccgaguucgagcuccucuggaaggacaucauccacaacccccaggcccucuccccccaguucaccggcauccuccagcuccuccagucccgcaccucccgcaaguuccucgccugccgccucacccccgacauggagaccaagcuccucuucaugaccucccgcguccgcuucggccagcagaagcgcuaccaggacugguuccagcgccaguaccucuccacccccgacucccagucccuccgcugcgaccucauccgcuacaucugcggcgucguccaccccuccaacgagguccucuccuccgacauccucccccgcugggccaucaucggcuggcuccucaccaccugcaccuccaacgucgccgccuccaacgccaagcucgcccucuucuacgacuggcucuucuucucccccgacaaggacuccaucaugaacaucgagcccgccauccucgucaugcaccacuccaugaagccccaccccgccaucaccgccacccuccucgacuucaugugccgcaucauccccaacuucuaccccccccucgagggccacguccgccagggcgucuucuccucccucaaccacaucgucgagaagcgcguccucgcccaccucgccccccucuucgacaaccccaagcucgacaaggagcuccgcgccaugcuccgcgagaaguuccccgaguucugcuccucccccuccccccccgucgaggucaagaucgaggagcccgucuccauggagauggacaaccacauguccgacaaggacgaguccugcuacgacaacgccgaggccgccuucuccgacgacgaggaggaccucaacuccaagggcaagaagcgcgaguuccgcuuccaccccaucaaggagaccgucgucgaggagcccgucgacaucacccccuaccucgaccagcucgacgagucccuccgcgacaagguccuccagcuccagaagggcuccgacaccgaggcccagugcgaggucaugcaggagaucgucgaccagguccucgaggaggacuucgacuccgagcagcucuccguccucgccuccugccuccaggagcucuucaaggcccacuuccgcggcgagguccuccccgaggagaucaccgaggagucccucgaggaguccgucggcaagccccucuaccucaucuuccgcaaccucugccagaugcaggaggacaacuccuccuucucccuccuccucgaccuccucuccgagcucuaccagaagcagcccaagaucggcuaccaccuccucuacuaccuccgcgccuccaaggccgccgccggcaagaugaaccucuacgaguccuucgcccaggccacccagcucggcgaccuccacaccugccucaugauggacaugaaggccugccaggaggacgacguccgccuccucugccaccucacccccuccaucuacaccgaguuccccgacgagacccuccgcuccggcgagcuccucaacaugaucgucgccgucaucgacuccgcccagcuccaggagcucgucugccacgucaugaugggcaaccucgucauguuccgcaaggacuccguccucaacauccucauccagucccucgacugggagaccuucgagcaguacugcgccuggcagcucuuccucgcccacaacaucccccucgagaccaucauccccauccuccagcaccucaaguacaaggagcaccccgaggcccucuccugccuccuccuccagcuccgccgcgagaagcccuccgaggagauggucaagaugguccucucccgccccugccaccccgacgaccaguucaccaccuccauccuccgccacuggugcaugaagcacgacgagcuccucgccgagcacaucaagucccuccucaucaagaacaacucccucccccgcaagcgccagucccuccgcuccuccuccuccaagcucgcccagcucacccucgagcagauccucgagcaccucgacaaccuccgccucaaccucaccaacaccaagcagaacuucuucucccagacccccauccuccaggcccuccagcacguccaggccuccugcgacgaggcccacaagaugaaguucuccgaccucuucucccucgccgaggaguacgaggacuccuccaccaagccccccaagucccgccgcaaggccgcccucuccuccccccgcucccgcaagaacgccacccagccccccaacgccgaggaggaguccggcuccuccuccgccuccgaggaggaggacaccaagcccaagcccaccaagcgcaagcgcaagggcuccuccgccgucggcuccgacuccgacuga

SEQ ID NO: 44708 - RNA, 2892 nt, Artificial Sequence
  derived and/or modified sequence opt2 from INTS4__Homo_sapiens__NP_291025
auggccgcccaccucaagaagcgcgucuacgaggaguucaccaaggucguccagccccaggaggagaucgccaccaagaagcuccgccucaccaagcccuccaaguccgccgcccuccacaucgaccucugcaaggccaccucccccgccgacgcccuccaguaccuccuccaguucgcccgcaagcccgucgaggccgaguccgucgagggcgucguccgcauccuccucgagcacuacuacaaggagaacgaccccuccguccgccucaagaucgccucccuccucggccuccucuccaagaccgccggcuucucccccgacugcaucauggacgacgccaucaacauccuccagaacgagaagucccaccagguccucgcccagcuccucgacacccuccucgccaucggcaccaagcuccccgagaaccaggccauccagaugcgccucgucgacgucgccugcaagcaccucaccgacaccucccacggcguccgcaacaagugccuccagcuccucggcaaccucggcucccucgagaaguccgucaccaaggacgccgagggccucgccgcccgcgacguccagaagaucaucggcgacuacuucuccgaccaggacccccgcguccgcaccgccgccaucaaggccaugcuccagcuccacgagcgcggccucaagcuccaccagaccaucuacaaccaggccugcaagcuccucuccgacgacuacgagcagguccgcuccgccgccguccagcucaucugggucgucucccagcucuaccccgaguccaucguccccauccccuccuccaacgaggagauccgccucgucgacgacgccuucggcaagaucugccacauggucuccgacggcuccugggucguccgcguccaggccgccaagcuccucggcuccauggagcaggucuccucccacuuccucgagcagacccucgacaagaagcucauguccgaccuccgccgcaagcgcaccgcccacgagcgcgccaaggagcucuacuccuccggcgaguucuccuccggccgcaaguggggcgacgacgcccccaaggaggaggucgacaccggcgccgucaaccucaucgaguccggcgccugcggcgccuucguccacggccucgaggacgagauguacgagguccgcaucgccgccgucgaggcccucugcaugcucgcccaguccucccccuccuucgccgagaagugccucgacuuccucgucgacauguucaacgacgagaucgaggagguccgccuccaguccauccacaccaugcgcaagaucuccaacaacaucacccuccgcgaggaccagcucgacaccguccucgccguccucgaggacuccucccgcgacauccgcgaggcccuccacgagcuccucugcugcaccaacgucuccaccaaggagggcauccaccucgcccucgucgagcuccucaagaaccucaccaaguaccccaccgaccgcgacuccaucuggaagugccucaaguuccucggcucccgccaccccacccucguccucccccucguccccgagcuccucuccacccaccccuucuucgacaccgccgagcccgacauggacgaccccgccuacaucgccguccucguccucaucuucaacgccgccaagaccugccccaccaugcccgcccucuucuccgaccacaccuuccgccacuacgccuaccuccgcgacucccucucccaccucguccccgcccuccgccuccccggccgcaagcucgucuccuccgccgucucccccuccaucaucccccaggaggaccccucccagcaguuccuccagcagucccucgagcgcgucuacucccuccagcaccucgacccccagggcgcccaggagcuccucgaguucaccauccgcgaccuccagcgccucggcgagcuccaguccgagcucgccggcgucgccgacuucuccgccaccuaccuccgcugccagcuccuccucaucaaggcccuccaggagaagcucuggaacgucgccgccccccucuaccucaagcaguccgaccucgccuccgccgccgccaagcagaucauggaggagaccuacaagauggaguucauguacuccggcgucgagaacaagcaggucgucaucauccaccacaugcgccuccaggccaaggcccuccagcucaucgucaccgcccgcaccacccgcggccucgacccccucuucggcaugugcgagaaguuccuccaggaggucgacuucuuccagcgcuacuucaucgccgaccucccccaccuccaggacuccuucgucgacaagcuccucgaccucaugccccgccucaugaccuccaagcccgccgaggucgucaagauccuccagaccaugcuccgccaguccgccuuccuccaccucccccuccccgagcagauccacaaggccuccgccaccaucaucgagcccgccggcgaguccgacaacccccuccgcuucaccuccggccucgucgucgcccucgacgucgacgccacccucgagcacguccaggacccccagaacaccgucaagguccagguccucuaccccgacggccaggcccagaugauccaccccaagcccgccgacuuccgcaaccccggccccggccgccaccgccucaucacccaggucuaccucucccacaccgccuggaccgaggccugccaggucgagguccgccuccuccucgccuacaacuccuccgcccgcauccccaagugccccuggauggagggcggcgagauguccccccaggucgagaccuccaucgagggcaccauccccuucuccaagcccgucaaggucuacaucaugcccaagcccgcccgccgcuga

SEQ ID NO: 44709 - RNA, 3060 nt, Artificial Sequence
  derived and/or modified sequence opt2 from INTS5__Homo_sapiens__NP_085131
auguccgcccucugcgacccccccggcgcccccggcccccccggccccgcccccgccacccacggccccgccccccucuccgcccaggagcucucccaggagaucaaggccuuccucaccggcgucgaccccauccucggccaccagcucuccgcccgcgagcacgcccgcugcggccuccuccuccuccgcucccucccccccgcccgcgccgccguccucgaccaccuccgcggcgucuucgacgaguccguccgcgcccaccucgccgcccucgacgagacccccgucgccggccccccccaccuccgcccccccccccccucccacguccccgccggcggccccggccucgaggacgucguccaggagguccagcagguccucuccgaguucauccgcgccaaccccaaggccugggcccccgucaucuccgccugguccaucgaccucaugggccagcucuccuccaccuacuccggccagcaccagcgcgucccccacgccaccggcgcccucaacgagcuccuccagcucuggaugggcugccgcgccacccgcacccucauggacaucuacguccagugccucuccgcccucaucggcuccugccccgacgccugcgucgacgcccuccucgacaccuccguccagcacuccccccacuucgacugggucgucgcccacaucggcuccuccuuccccggcaccaucaucucccgcguccucuccugcggccucaaggacuucugcguccacggcggcgccggcggcggcgccggcuccuccggcggcuccuccucccagacccccuccaccgaccccuuccccggcucccccgccauccccgccgagaagcgcguccccaagaucgccuccgucgucggcauccucggccaccucgccucccgccacggcgacuccauccgccgcgagcuccuccgcauguuccacgacucccucgccggcggcuccggcggccgcuccggcgaccccucccuccaggccaccguccccuuccuccuccagcucgccgucaugucccccgcccuccucggcaccgucuccggcgagcucgucgacugccucaagccccccgccguccucucccagcuccagcagcaccuccagggcuucccccgcgaggagcucgacaacaugcucaaccucgccguccaccucgucucccaggccuccggcgccggcgccuaccgccuccuccaguuccucgucgacaccgccaugcccgccuccgucaucaccacccagggccucgccguccccgacaccguccgcgaggccugcgaccgccucauccagcuccuccuccuccaccuccagaagcucguccaccaccgcggcggcucccccggcgagggcguccucggcccccccccccccccccgccucguccccuuccucgacgcccucaagaaccacgucggcgagcucugcggcgagacccuccgccucgagcgcaagcgcuuccucuggcagcaccagcuccucggccuccucuccgucuacacccgccccuccugcggccccgaggcccucggccaccuccucucccgcgcccgcucccccgaggagcucucccucgccacccagcucuacgccggccucgucgucucccucuccggccuccucccccucgccuuccgcuccugccucgcccgcguccacgccggcacccuccagccccccuucaccgcccgcuuccuccgcaaccucgcccuccucgucggcugggagcagcagggcggcgagggccccgccgcccucggcgcccacuucggcgaguccgccuccgcccaccucuccgaccucgccccccuccuccuccaccccgaggaggaggucgccgaggccgccgccucccuccucgccaucugccccuuccccuccgaggcccucucccccucccagcuccucggccucguccgcgccggcguccaccgcuucuucgccucccuccgccuccacggcccccccggcgucgccuccgccugccagcuccucacccgccucucccagaccucccccgccggccucaaggccguccuccagcuccucgucgagggcgcccuccaccgcggcaacaccgagcucuucggcggccaggucgacggcgacaacgagacccucuccgucgucuccgccucccucgccuccgccucccuccucgacaccaaccgccgccacaccgccgccguccccggccccggcggcaucugguccgucuuccacgccggcgucaucggccgcggccucaagccccccaaguucguccagucccgcaaccagcaggaggucaucuacaacacccagucccuccucucccuccucguccacugcugcuccgcccccggcggcaccgagugcggcgagugcuggggcgcccccauccucucccccgaggccgccaaggccgucgccgucacccucgucgaguccgucugccccgacgccgccggcgccgagcucgccuggccccccgaggagcacgcccgcgccaccgucgagcgcgaccuccgcaucggccgccgcuuccgcgagcagccccuccucuucgagcuccucaagcucgucgccgccgccccccccgcccucugcuacugcuccguccuccuccgcggccuccucgccgcccuccucggccacugggaggccucccgccaccccgacaccacccacucccccuggcaccucgaggccuccugcacccucgucgccgucauggccgagggcucccuccucccccccgcccucggcaacaugcacgaggucuucucccagcucgcccccuucgagguccgccuccuccuccucuccgucuggggcuuccuccgcgagcacggcccccucccccagaaguucaucuuccaguccgagcgcggccgcuucauccgcgacuucucccgcgagggcggcggcgagggcggcccccaccucgccguccuccacuccguccuccaccgcaacaucgaccgccucggccucuucuccggccgcuuccaggcccccucccccuccacccuccuccgccagggcaccuga

SEQ ID NO: 44710 - RNA, 2625 nt, Artificial Sequence
  derived and/or modified sequence opt2 from INTS6__Homo_sapiens__NP_001035026
augaaccagcgcucccaccucggcaccaccuaccucgacaccgccaagggcgccgucgagaccuucaugaagcuccgcgcccgcgaccccgccucccgcggcgaccgcuacaugcucgucaccuucgaggagccccccuacgccaucaaggccggcuggaaggagaaccacgccaccuucaugaacgagcucaagaaccuccaggccgagggccucaccacccucggccagucccuccgcaccgccuucgaccuccucaaccucaaccgccucgucaccggcaucgacaacuacggccagggccgcaaccccuucuuccucgagcccgccaucaucaucaccaucaccgacggcuccaagcucaccaccaccuccggcguccaggacgagcuccaccucccccucaacuccccccuccccggcuccgagcucaccaaggagcccuuccgcugggaccagcgccucuucgcccucguccuccgccuccccggcaccauguccgucgaguccgagcagcucaccggcgucccccucgacgacuccgccaucacccccaugugcgaggucaccggcggccgcuccuacuccgucugcuccccccgcaugcucaaccagugccucgagucccucguccagaagguccaguccggcgucgucaucaacuucgagaaggccggccccgaccccucccccgucgaggacggccagcccgacaucucccgccccuucggcucccagcccuggcacuccugccacaagcucaucuacguccgccccaaccccaagaccggcguccccaucggccacuggcccguccccgaguccuucuggcccgaccagaacucccccacccuccccccccgcaccucccaccccgucgucaaguucuccugcaccgacugcgagcccauggucaucgacaagcuccccuucgacaaguacgagcucgagcccuccccccucacccaguucauccucgagcgcaaguccccccagaccugcuggcaggucuacgucuccaacuccgccaaguacuccgagcucggccaccccuucggcuaccucaaggccuccaccgcccucaacugcgucaaccucuucgucaugcccuacaacuaccccguccuccucccccuccucgacgaccucuucaagguccacaaggccaagcccacccucaaguggcgccaguccuucgaguccuaccucaagaccaugccccccuacuaccucggcccccucaagaaggccguccgcaugaugggcgcccccaaccucaucgccgacuccauggaguacggccucuccuacuccgucaucuccuaccucaagaagcucucccagcaggccaagaucgaguccgaccgcgucaucggcuccgucggcaagaaggucguccaggagaccggcaucaagguccgcucccgcucccacggccucuccauggccuaccgcaaggacuuccagcagcuccuccagggcaucuccgaggacgucccccaccgccuccucgaccucaacaugaaggaguacaccggcuuccaggucgcccuccucaacaaggaccucaagccccagaccuuccgcaacgccuacgacaucccccgccgcaaccuccucgaccaccucacccgcaugcgcuccaaccuccucaaguccacccgccgcuuccucaagggccaggacgaggaccagguccacuccguccccaucgcccagaugggcaacuaccaggaguaccucaagcagguccccuccccccuccgcgagcucgaccccgaccagccccgccgccuccacaccuucggcaaccccuucaagcucgacaagaagggcaugaugaucgacgaggccgacgaguucgucgccggcccccagaacaagcacaagcgccccggcgagcccaacaugcagggcauccccaagcgccgccgcugcauguccccccuccuccgcggccgccagcagaaccccgucgucaacaaccacaucggcggcaagggcccccccgcccccaccacccaggcccagcccgaccucaucaagccccucccccuccacaagaucuccgagaccaccaacgacuccaucauccacgacgucgucgagaaccacgucgccgaccagcucuccuccgacaucacccccaacgccauggacaccgaguucuccgccuccucccccgccucccuccucgagcgccccaccaaccacauggaggcccucggccacgaccaccucggcaccaacgaccucaccgucggcggcuuccucgagaaccacgaggagccccgcgacaaggagcagugcgccgaggagaacauccccgccuccucccucaacaagggcaagaagcucaugcacugccgcucccacgaggaggucaacaccgagcucaaggcccagaucaugaaggagauccgcaagcccggccgcaaguacgagcgcaucuucacccuccucaagcacguccagggcucccuccagacccgccucaucuuccuccagaacgucaucaaggaggccucccgcuucaagaagcgcaugcucaucgagcagcucgagaacuuccucgacgagauccaccgccgcgccaaccagaucaaccacaucaacuccaacuga

SEQ ID NO: 44711 - RNA, 2742 nt, Artificial Sequence
  derived and/or modified sequence opt2 from INTS7__Homo_sapiens__NP_001186738
auggccuccaacuccaccaaguccuuccucgccgacgccggcuacggcgagcaggagcucgacgccaacuccgcccucauggagcucgacaagggccuccgcuccggcaagcucggcgagcagugcgaggccgucguccgcuucccccgccucuuccagaaguaccccuuccccauccucaucaacuccgccuuccucaagcucgccgacgucuuccgcgucggcaugcucggcucccucgccuccaucauccccgagcgcaagaacgcccaccacuccauccgccagucccucgacucccacgacaacgucgaggucgaggccgccgucuucgccgccgccaacuucuccgcccaguccaaggacuucgccgucggcaucugcaacaagaucuccgagaugauccagggccucgccacccccgucgaccucaagcucaagcucauccccauccuccagcacaugcaccacgacgccauccucgccuccuccgcccgccagcuccuccagcagcucgucaccuccuaccccuccaccaagauggucaucgucucccuccacaccuucacccuccucgccgccuccucccucgucgacacccccaagcagauccagcuccuccuccaguaccucaagaacgacccccgcaaggccgucaagcgccucgccauccaggaccucaagcuccucgccaacaagaccccccacaccuggucccgcgagaacauccaggcccucugcgagugcgcccuccagacccccuacgacucccucaagcucggcaugcucuccguccucuccacccucuccggcaccaucgccaucaagcacuacuucuccaucguccccggcaacgucuccuccuccccccgcuccuccgaccucgucaagcucgcccaggagugcugcuaccacaacaaccgcggcaucgccgcccacggcguccgcguccucaccaacaucaccgucuccugccaggagaaggaccuccucgcccucgagcaggacgccgucuucggccucgagucccuccucguccucugcucccaggacgacucccccggcgcccaggccacccucaagaucgcccucaacugcauggucaagcucgccaagggccgcccccaccucucccaguccgucgucgagacccuccucacccagcuccacuccgcccaggacgccgcccgcauccucaugugccacugccucgccgccaucgccaugcagcuccccguccucggcgacggcaugcucggcgaccucauggagcucuacaaggucaucggccgcuccgccaccgacaagcagcaggagcuccucgucucccucgccaccgucaucuucgucgccucccagaaggcccucuccgucgaguccaaggccgucaucaagcagcagcucgaguccgucuccaacggcuggaccgucuaccgcaucgcccgccaggccucccgcaugggcaaccacgacauggccaaggagcucuaccagucccuccucacccaggucgccuccgagcacuucuacuucuggcucaacucccucaaggaguucucccacgccgagcagugccucaccggccuccaggaggagaacuacuccuccgcccucuccugcaucgccgagucccucaaguucuaccacaagggcaucgccucccucaccgccgccuccaccccccucaacccccucuccuuccagugcgaguucgucaagcuccgcaucgaccuccuccaggccuucucccagcucaucugcaccugcaacucccucaagaccucccccccccccgccaucgccaccaccaucgccaugacccucggcaacgaccuccagcgcugcggccgcaucuccaaccagaugaagcaguccauggaggaguuccgcucccucgccucccgcuacggcgaccucuaccaggccuccuucgacgccgacuccgccacccuccgcaacgucgagcuccagcagcaguccugccuccucaucucccacgccaucgaggcccucauccucgaccccgaguccgccuccuuccaggaguacggcuccaccggcaccgcccacgccgacuccgaguacgagcgccgcaugauguccgucuacaaccacguccucgaggaggucgagucccucaaccgcaaguacacccccgucuccuacaugcacaccgccugccucugcaacgccaucaucgcccuccucaaggucccccucuccuuccagcgcuacuucuuccagaagcuccaguccaccuccaucaagcucgcccucucccccuccccccgcaaccccgccgagcccaucgccguccagaacaaccagcagcucgcccucaaggucgagggcgucguccagcacggcuccaagcccggccucuuccgcaagauccaguccgucugccucaacgucuccuccacccuccaguccaaguccggccaggacuacaagauccccaucgacaacaugaccaacgagauggagcagcgcgucgagccccacaacgacuacuucuccacccaguuccuccucaacuucgccauccucggcacccacaacaucaccgucgaguccuccgucaaggacgccaacggcaucgucuggaagaccggcccccgcaccaccaucuucgucaagucccucgaggaccccuacucccagcagauccgccuccagcagcagcaggcccagcagccccuccagcagcagcagcagcgcaacgccuacacccgcuucuga

SEQ ID NO: 44712 - RNA, 2988 nt, Artificial Sequence
  derived and/or modified sequence opt2 from INTS8__Homo_sapiens__NP_060334
auguccgccgaggccgccgaccgcgaggccgccaccuccucccgccccugcacccccccccagaccugcugguucgaguuccuccucgaggagucccuccucgagaagcaccuccgcaagcccugccccgaccccgcccccguccagcucaucguccaguuccucgagcaggccuccaagcccuccgucaacgagcagaaccagguccagcccccccccgacaacaagcgcaaccgcauccucaagcuccucgcccucaaggucgccgcccaccucaagugggaccucgacauccucgagaagucccucuccguccccguccucaacaugcuccucaacgagcuccucugcaucuccaaggucccccccggcaccaagcacgucgacauggaccucgccacccucccccccaccaccgccauggccguccuccucuacaaccgcugggccauccgcaccaucguccaguccuccuuccccgucaagcaggccaagcccggccccccccagcucuccgucaugaaccagaugcagcaggagaaggagcucaccgagaacauccucaagguccucaaggagcaggccgccgacuccauccucguccucgaggccgcccucaagcucaacaaggaccucuacguccacaccaugcgcacccucgaccuccucgccauggagcccggcauggucaacggcgagaccgaguccuccaccgccggccucaaggucaagaccgaggagaugcagugccaggucugcuacgaccucggcgccgccuacuuccagcagggcuccaccaacuccgccgucuacgagaacgcccgcgagaaguucuuccgcaccaaggagcucaucgccgagaucggcucccucucccuccacugcaccaucgacgagaagcgccucgccggcuacugccaggccugcgacguccucguccccuccuccgacuccaccucccagcagcucacccccuacucccagguccacaucugccuccgcuccggcaacuaccaggaggucauccagaucuucaucgaggacaaccucacccucucccuccccguccaguuccgccaguccguccuccgcgagcucuucaagaaggcccagcagggcaacgaggcccucgacgagaucugcuucaaggucugcgccugcaacaccguccgcgacauccucgagggccgcaccaucuccguccaguucaaccagcucuuccuccgccccaacaaggagaagaucgacuuccuccucgaggucugcucccgcuccgucaaccucgagaaggccuccgagucccucaagggcaacauggccgccuuccucaagaacgucugccucggccucgaggaccuccaguacgucuucaugaucuccucccacgagcucuucaucacccuccucaaggacgaggagcgcaagcuccucgucgaccagaugcgcaagcgcuccccccgcgucaaccucugcaucaagcccgucaccuccuucuacgacauccccgccuccgccuccgucaacaucggccagcucgagcaccagcucauccucuccgucgaccccuggcgcauccgccagauccucaucgagcuccacggcaugaccuccgagcgccaguucuggaccgucuccaacaagugggagguccccuccgucuacuccggcgucauccucggcaucaaggacaaccucacccgcgaccucgucuacauccucauggccaagggccuccacugcuccaccgucaaggacuucucccacgccaagcagcucuucgccgccugccucgagcucgucaccgaguucucccccaagcuccgccaggucaugcucaacgagaugcuccuccucgacauccacacccacgaggccggcaccggccaggccggcgagcgcccccccuccgaccucaucucccgcguccgcggcuaccucgagaugcgccuccccgacaucccccuccgccaggucaucgccgaggagugcgucgccuucaugcucaacuggcgcgagaacgaguaccucacccuccagguccccgccuuccuccuccaguccaaccccuacgucaagcucggccagcuccucgccgccaccugcaaggagcuccccggccccaaggagucccgccgcaccgccaaggaccucugggaggucgucguccagaucugcuccgucuccucccagcacaagcgcggcaacgacggccgcgucucccucaucaagcagcgcgaguccacccucggcaucauguaccgcuccgagcuccucuccuucaucaagaagcuccgcgagccccucguccucaccaucauccucucccucuucgucaagcuccacaacguccgcgaggacaucgucaacgacaucaccgccgagcacaucuccaucuggcccuccuccauccccaaccuccaguccgucgacuucgaggccgucgccaucaccgucaaggagcucguccgcuacacccucuccaucaaccccaacaaccacuccuggcucaucauccaggccgacaucuacuucgccaccaaccaguacuccgccgcccuccacuacuaccuccaggccggcgccgucugcuccgacuucuucaacaaggccgucccccccgacgucuacaccgaccaggucaucaagcgcaugaucaagugcugcucccuccucaacugccacacccaggucgccauccucugccaguuccuccgcgagaucgacuacaagaccgccuucaagucccuccaggagcagaacucccacgacgccauggacuccuacuacgacuacaucugggacgucaccauccucgaguaccucaccuaccuccaccacaagcgcggcgagaccgacaagcgccagaucgccaucaaggccaucggccagaccgagcucaacgccuccaaccccgaggagguccuccagcucgccgcccagcgccgcaagaagaaguuccuccaggccauggccaagcucuacuucuga

SEQ ID NO: 44713 - RNA, 2829 nt, Artificial Sequence
  derived and/or modified sequence opt2 from INTU__Homo_sapiens__NP_056508
auggccuccgucgccuccugcgacucccgccccuccuccgacgagcuccccggcgaccccuccucccaggaggaggacgaggacuacgacuucgaggaccgcgucuccgacuccggcuccuacuccuccgccuccuccgacuacgacgaccucgagcccgaguggcucgacuccguccagaagaacggcgagcucuucuaccucgagcucuccgaggacgaggaggagucccuccuccccgagacccccaccgucaaccacguccgcuucuccgagaacgagaucaucaucgaggacgacuacaaggagcgcaagaaguacgagcccaagcucaagcaguucaccaagauccuccgccgcaagcgccuccuccccaagcgcugcaacaagaagaacuccaacgacaacggccccgucuccauccucaagcaccaguccaaccagaagaccggcgucaucguccagcagcgcuacaaggacgucaacgucuacgucaaccccaagaagcucaccgucaucaaggccaaggagcagcucaagcuccucgagguccucgucggcaucauccaccagaccaagugguccuggcgccgcaccggcaagcagggcgacggcgagcgccucgucguccacggccuccuccccggcggcuccgccaugaaguccggccagguccucaucggcgacguccucgucgccgucaacgacgucgacgucaccaccgagaacaucgagcgcguccucuccugcauccccggccccaugcaggucaagcucaccuucgagaacgccuacgacgucaagcgcgagaccucccacccccgccagaagaagacccaguccaacaccuccgaccucgucaagcuccucuggggcgaggaggucgagggcauccagcaguccggccucaacaccccccacaucaucauguaccucacccuccagcucgacuccgagaccuccaaggaggagcaggagauccucuaccacuaccccauguccgaggccucccagaagcucaaguccguccgcggcaucuuccucacccucugcgacaugcucgagaacgucaccggcacccaggucaccuccuccucccuccuccucaacggcaagcagauccacgucgccuacuggaaggaguccgacaagcuccuccucaucggccuccccgccgaggaggucccccucccccgccuccgcaacaugaucgagaacgucauccagacccucaaguucauguacggcucccucgacuccgccuucugccagaucgagaacgucccccgccucgaccacuucuucaaccucuucuuccagcgcgcccuccagcccgccaagcuccacuccuccgccucccccuccgcccagcaguacgacgccuccuccgccguccuccucgacaaccuccccggcguccgcuggcucacccucccccucgagaucaagauggagcucgacauggcccucuccgaccucgaggccgccgacuucgccgagcucuccgaggacuacuacgacaugcgccgccucuacaccauccucggcuccucccucuucuacaagggcuaccucaucugcucccaccuccccaaggacgaccucaucgacaucgccgucuacugccgccacuacugccuccucccccucgccgccaagcagcgcaucggccagcucaucaucuggcgcgaggucuucccccagcaccaccuccgcccccucgccgacuccuccaccgaggucuuccccgagcccgagggccgcuacuuccuccucgucgucggccucaagcacuacaugcucugcguccuccucgaggccggcggcugcgccuccaaggccaucggcucccccggccccgacugcgucuacgucgaccaggucaagaccacccuccaccagcucgacggcgucgacucccgcaucgacgagcgccucgccuccucccccguccccugccucuccugcgccgacugguuccucaccggcucccgcgagaagaccgacucccucaccaccucccccauccucucccgccuccagggcaccuccaaggucgccaccucccccaccugccgccgcacccucuucggcgacuacucccucaagacccgcaagcccucccccuccugcuccuccggcggcuccgacaacggcugcgagggcggcgaggacgacggcuucuccccccacaccacccccgacgccguccgcaagcagcgcgagucccagggcuccgacggccucgaggaguccggcacccuccucaaggucaccaagaagaaguccacccuccccaaccccuuccaccucggcaaccucaagaaggaccuccccgagaaggagcucgagaucuacaacaccgucaagcucaccuccggccccgagaacacccucuuccacuacgucgcccucgagaccguccagggcaucuucaucacccccacccucgaggaggucgcccagcucuccggcuccauccacccccagcucaucaagaacuuccaccagugcugccucuccauccgcgccgucuuccagcagacccucgucgaggagaagaagaagggccucaacuccggcgaccacuccgacuccgccaaguccgucuccucccucaaccccgucaaggagcacggcguccucuucgagugcucccccggcaacuggaccgaccagaagaaggccccccccgucauggccuacugggucgucggccgccucuuccuccaccccaagccccaggagcucuacgucugcuuccacgacuccgucaccgagaucgccaucgagaucgccuucaagcucuucuucggccucacccucuga

SEQ ID NO: 44714 - RNA, 3198 nt, Artificial Sequence
  derived and/or modified sequence opt2 from INVS__Homo_sapiens__NP_055240
augaacaaguccgagaaccuccucuucgccggcuccucccucgccucccagguccacgccgccgccgucaacggcgacaagggcgcccuccagcgccucaucgucggcaacuccgcccucaaggacaaggaggaccaguucggccgcaccccccucauguacugcguccucgccgaccgccucgacugcgccgacgcccuccucaaggccggcgccgacgucaacaagaccgaccacucccagcgcaccgcccuccaccucgccgcccagaagggcaacuaccgcuucaugaagcuccuccucacccgccgcgccaacuggaugcagaaggaccucgaggagaugaccccccuccaccucaccacccgccaccgcucccccaagugccucgcccuccuccucaaguucauggcccccggcgaggucgacacccaggacaagaacaagcagaccgcccuccacugguccgccuacuacaacaaccccgagcacgucaagcuccucaucaagcacgacuccaacaucggcauccccgacgucgagggcaagaucccccuccacugggccgccaaccacaaggaccccuccgccguccacaccguccgcugcauccucgacgccgcccccaccgagucccuccucaacuggcaggacuacgagggccgcaccccccuccacuucgccgucgccgacggcaacgucaccgucgucgacguccucaccuccuacgaguccugcaacaucaccuccuacgacaaccucuuccgcaccccccuccacugggccgcccuccucggccacgcccagaucguccaccuccuccucgagcgcaacaaguccggcaccauccccuccgacucccagggcgccaccccccuccacuacgccgcccaguccaacuucgccgagaccgucaaggucuuccucaagcaccccuccgucaaggacgacuccgaccucgagggccgcaccuccuucaugugggccgccggcaagggcuccgacgacguccuccgcaccaugcucucccucaaguccgacaucgacaucaacauggccgacaaguacggcggcaccgcccuccacgccgccgcccucuccggccacgucuccaccgucaagcuccuccucgagaacaacgcccaggucgacgccaccgacgucaugaagcacaccccccucuuccgcgccugcgagaugggccacaaggacgucauccagacccucaucaagggcggcgcccgcgucgaccucgucgaccaggacggccacucccuccuccacugggccgcccucggcggcaacgccgacgucugccagauccucaucgagaacaagaucaaccccaacguccaggacuacgccggccgcaccccccuccagugcgccgccuacggcggcuacaucaacugcauggccguccucauggagaacaacgccgaccccaacauccaggacaaggagggccgcaccgcccuccacugguccugcaacaacggcuaccucgacgccaucaagcuccuccucgacuucgccgccuuccccaaccagauggagaacaacgaggagcgcuacaccccccucgacuacgcccuccucggcgagcgccacgaggucauccaguucaugcucgagcacggcgcccucuccaucgccgccauccaggacaucgccgccuucaagauccaggccgucuacaagggcuacaagguccgcaaggccuuccgcgaccgcaagaaccuccucaugaagcacgagcagcuccgcaaggacgccgccgccaagaagcgcgaggaggagaacaagcgcaaggaggccgagcagcagaagggccgccgcucccccgacuccugccgcccccaggcccuccccugccuccccuccacccaggacguccccucccgccagucccgcgcccccuccaagcagccccccgccggcaacgucgcccagggccccgagccccgcgacucccgcggcucccccggcggcucccucggcggcgcccuccagaaggagcagcacgucuccuccgaccuccagggcaccaacucccgccgccccaacgagaccgcccgcgagcacuccaagggccaguccgccugcguccacuuccgccccaacgagggcuccgacggcucccgccaccccggcguccccuccgucgagaagucccgcggcgagaccgccggcgacgagcgcugcgccaagggcaagggcuucgucaagcagcccuccugcauccgcgucgccggccccgacgagaagggcgaggacucccgccgcgccgccgccucccuccccccccacgacucccacuggaagcccucccgccgccacgacaccgagcccaaggccaagugcgccccccagaagcgccgcacccaggagcuccgcggcggccgcugcucccccgccggcuccucccgccccggcuccgcccgcggcgaggccguccacgccggccagaaccccccccaccaccgcaccccccgcaacaaggucacccaggccaagcucaccggcggccucuacucccaccucccccaguccaccgaggagcuccgcuccggcgcccgccgccucgagaccuccacccucuccgaggacuuccaggucuccaaggagaccgaccccgcccccggcccccucuccggccaguccgucaacaucgaccuccuccccgucgagcuccgccuccagaucauccagcgcgagcgccgccgcaaggagcucuuccgcaagaagaacaaggccgccgccgucauccagcgcgccuggcgcuccuaccagcuccgcaagcaccucucccaccuccgccacaugaagcagcucggcgccggcgacgucgaccgcuggcgccaggaguccaccgcccuccuccuccaggucuggcgcaaggagcucgagcucaaguucccccagaccaccgccgucuccaaggcccccaagucccccuccaagggcaccuccggcaccaaguccaccaagcacuccguccucaagcagaucuacggcugcucccacgagggcaagauccaccaccccacccgcuccgucaaggccuccuccguccuccgccucaacuccgucuccaaccuccagugcauccaccuccucgagaacuccggccgcuccaagaacuucuccuacaaccuccaguccgccacccagcccaagaacaagaccaagcccuga

SEQ ID NO: 44715 - RNA, 831 nt, Artificial Sequence
  derived and/or modified sequence opt2 from IP6K1__Homo_sapiens__NP_001006115
augcucgacggcaacuccggccucuccuccgagaagaucucccacaaccccuggucccuccgcugccacaagcagcagcucucccgcaugcgcuccgaguccaaggaccgcaagcucuacaaguuccuccuccucgagaacgucguccaccacuucaaguaccccugcguccucgaccucaagaugggcacccgccagcacggcgacgacgccuccgccgagaaggccgcccgccagaugcgcaagugcgagcaguccaccuccgccacccucggcguccgcgucugcggcaugcaggucuaccagcucgacaccggccacuaccucugccgcaacaaguacuacggccgcggccucuccaucgagggcuuccgcaacgcccucuaccaguaccuccacaacggccucgaccuccgccgcgaccucuucgagcccauccucuccaagcuccgcggccucaaggccguccucgagcgccaggccuccuaccgcuucuacuccuccucccuccucgucaucuacgacggcaaggagugccgcgccgaguccugccucgaccgccgcuccgagaugcgccucaagcaccucgacaugguccuccccgaggucgccuccuccugcggccccuccaccucccccuccaacaccucccccgaggccggccccuccucccagcccaaggucgacguccgcaugaucgacuucgcccacuccaccuucaagggcuuccgcgacgaccccaccguccacgacggccccgaccgcggcuacgucuucggccucgagaaccucaucuccaucauggagcagaugcgcgacgagaaccaguga

SEQ ID NO: 44716 - RNA, 294 nt, Artificial Sequence
  derived and/or modified sequence opt2 from IP6K2__Homo_sapiens__NP_001005911
augucccccgccuuccgcgccauggacgucgagccccgcgccaagggcguccuccucgagcccuucguccaccaggucggcggccacuccugcguccuccgcuucaacgagaccacccucugcaagccccucgucccccgcgagcaccaguucuacgagacccuccccgccgagaugcgcaaguucaccccccaguacaagggccagucccagcgcccccucgucuccuggcccucccucccccacuucuuccccugguccuucccccucuggccccagggcuccgucgccuga

SEQ ID NO: 44717 - RNA, 1233 nt, Artificial Sequence
  derived and/or modified sequence opt2 from IP6K3__Homo_sapiens__NP_001136355
auggucguccagaacuccgccgacgccggcgacaugcgcgccggcguccagcucgagcccuuccuccaccaggucggcggccacauguccgucaugaaguacgacgagcacaccgucugcaagccccucgucucccgcgagcagcgcuucuacgagucccucccccucgccaugaagcgcuucaccccccaguacaagggcaccgucaccguccaccucuggaaggacuccaccggccaccucucccucgucgccaaccccgucaaggagucccaggagcccuucaaggucuccaccgaguccgccgccgucgccaucuggcagacccuccagcagaccaccggcuccaacggcuccgacugcacccucgcccaguggccccacgcccagcucgcccgcucccccaaggagucccccgccaaggcccuccuccgcuccgagccccaccucaacacccccgccuucucccucgucgaggacaccaacggcaaccaggucgagcgcaaguccuucaaccccuggggccuccagugccaccaggcccaccucacccgccucugcuccgaguaccccgagaacaagcgccaccgcuuccuccuccucgagaacgucgucucccaguacacccaccccugcguccucgaccucaagaugggcacccgccagcacggcgacgacgccuccgaggagaagaaggcccgccacaugcgcaagugcgcccaguccaccuccgccugccucggcguccgcaucugcggcaugcaggucuaccagaccgacaagaaguacuuccucugcaaggacaaguacuacggccgcaagcucuccgucgagggcuuccgccaggcccucuaccaguuccuccacaacggcucccaccuccgccgcgagcuccucgagcccauccuccaccagcuccgcgcccuccucuccgucauccgcucccaguccuccuaccgcuucuacuccuccucccuccucgucaucuacgacggccaggagccccccgagcgcgcccccggcuccccccacccccacgaggccccccaggccgcccacggcuccucccccggcggccucaccaaggucgacauccgcaugaucgacuucgcccacaccaccuacaagggcuacuggaacgagcacaccaccuacgacggccccgaccccggcuacaucuucggccucgagaaccucauccgcauccuccaggacauccaggagggcgaguga

SEQ ID NO: 44718 - RNA, 1317 nt, Artificial Sequence
  derived and/or modified sequence opt2 from IPCEF1__Homo_sapiens__XP_005266979
augaccuccuacauggccaucgacggcuccgcccuccaggucccccuccgccagaagccccgccgcaagacccagggcuuccucaccaugucccgccgccgcaucuccugcaaggaccucggccacgccgacugccagggcuggcucuacaagaagaaggagaagggcuccuuccucuccaacaaguggaagaaguucugggucauccucaagggcuccucccucuacugguacuccaaccagauggccgagaaggccgacggcuucgucaaccuccccgacuucaccgucgagcgcgccuccgagugcaagaagaagcacgccuucaagaucucccacccccagaucaagaccuucuacuucgccgccgagaacguccaggagaugaacgucuggcucaacaagcucggcuccgccgucauccaccaggaguccaccaccaaggacgaggagugcuacuccgaguccgagcaggaggaccccgagaucgccgccgagacccccccccccccccacgccucccagacccagucccucaccgcccagcaggccuccuccuccucccccucccucuccggcaccuccuacuccuucuccucccucgagaacaccgucaagacccccuccuccuuccccuccucccucuccaaggagcgccagucccuccccgacaccgucaacucccucuccgccgccgaggacgagggccagcccaucaccuucgccguccagguccacucccccguccccuccgaggccggcauccacaaggcccucgagaacuccuucgucaccuccgaguccggcuuccucaacucccucuccuccgacgacaccuccucccucuccuccaaccacgaccaccucaccguccccgacaagcccgccggcuccaagaucauggacaaggaggagaccaaggucuccgaggacgacgagauggagaagcucuacaagucccucgagcaggccucccucuccccccucggcgaccgccgccccuccaccaagaaggagcuccgcaaguccuucgucaagcgcugcaagaaccccuccaucaacgagaagcuccacaagauccgcacccucaacuccacccucaagugcaaggagcacgaccucgccaugaucaaccagcuccucgacgaccccaagcucaccgcccgcaaguaccgcgaguggaaggucaugaacacccuccucauccaggacaucuaccagcagcagcgcgccucccccgcccccgacgacaccgacgacaccccccaggagcucaagaagucccccuccucccccuccgucgagaacuccaucuga

SEQ ID NO: 44719 - RNA, 1251 nt, Artificial Sequence
  derived and/or modified sequence opt2 from IPMK__Homo_sapiens__NP_689416
auggccaccgagccccccuccccccuccgcgucgaggcccccggcccccccgagaugcgcaccucccccgccaucgaguccacccccgagggcaccccccagcccgccggcggccgccuccgcuuccucaacggcugcgucccccucucccaccaggucgccggccacauguacggcaaggacaaggucggcauccuccagcaccccgacggcaccguccucaagcagcuccagccccccccccgcggcccccgcgagcucgaguucuacaacauggucuacgccgccgacugcuucgacggcguccuccucgagcuccgcaaguaccuccccaaguacuacggcaucugguccccccccaccgcccccaacgaccucuaccucaagcucgaggacgucacccacaaguucaacaagcccugcaucauggacgucaagaucggccagaaguccuacgaccccuucgccuccuccgagaagauccagcagcaggucuccaaguacccccucauggaggagaucggcuuccucguccucggcaugcgcgucuaccacguccacuccgacuccuacgagaccgagaaccagcacuacggccgcucccucaccaaggagaccaucaaggacggcgucucccgcuucuuccacaacggcuacugccuccgcaaggacgccgucgccgccuccauccagaagaucgagaagauccuccagugguucgagaaccagaagcagcucaacuucuacgccuccucccuccucuucgucuacgagggcuccucccagcccaccaccaccaagcucaacgaccgcacccucgccgagaaguuccucuccaagggccagcucuccgacaccgagguccucgaguacaacaacaacuuccacguccucuccuccaccgccaacggcaagaucgaguccuccgucggcaagucccucuccaagauguacgcccgccaccgcaagaucuacaccaagaagcaccacucccagaccucccucaaggucgagaaccucgagcaggacaacggcuggaaguccaugucccaggagcaccucaacggcaacguccucucccagcucgagaaggucuucuaccaccuccccaccggcugccaggagaucgccgaggucgagguccgcaugaucgacuucgcccacgucuuccccuccaacaccaucgacgagggcuacgucuacggccucaagcaccucaucuccguccuccgcuccauccucgacaacuga

SEQ ID NO: 44720 - RNA, 3048 nt, Artificial Sequence
  derived and/or modified sequence opt2 from IPO11__Homo_sapiens__NP_001128251
augguccagcccaucauccaccucggcuacgucgucuacucccuccucuaccucggcuacaagcccguccagcacgucaccgcccucaacaccgucuccuccugccacaagauggucuccauggaccucaacuccgccuccaccgucguccuccagguccucacccaggccaccucccaggacaccgccguccucaagcccgccgaggagcagcucaagcagugggagacccagcccggcuucuacuccguccuccucaacaucuucaccaaccacacccucgacaucaacguccgcuggcucgccguccucuacuucaagcacggcaucgaccgcuacuggcgccgcgucgccccccacgcccucuccgaggaggagaagaccacccuccgcgccggccucaucaccaacuucaacgagcccaucaaccagaucgccacccagaucgccguccucaucgccaaggucgcccgccucgacugcccccgccaguggcccgagcucauccccacccucaucgaguccgucaagguccaggacgaccuccgccagcaccgcgcccuccucaccuucuaccacgucaccaagacccucgccuccaagcgccucgccgccgaccgcaagcucuucuacgaccucgccuccggcaucuacaacuucgccugcucccucuggaaccaccacaccgacaccuuccuccaggaggucuccuccggcaacgaggccgccauccucuccucccucgagcgcacccuccucucccucaagguccuccgcaagcucaccgucaacggcuucgucgagccccacaagaacauggaggucaugggcuuccuccacggcaucuucgagcgccucaagcaguuccucgagugcucccgcuccaucggcaccgacaacgucugccgcgaccgccucgagaagaccaucauccucuucaccaagguccuccucgacuuccucgaccagcaccccuucuccuucaccccccucauccagcgcucccucgaguucuccgucuccuacgucuucaccgaggucggcgagggcgucaccuucgagcgcuucaucguccagugcaugaaccucaucaagaugaucgucaagaacuacgccuacaagcccuccaagaacuucgaggacuccucccccgagacccucgaggcccacaagaucaagauggccuucuucaccuaccccacccucaccgagaucugccgccgccucgucucccacuacuuccuccucaccgaggaggagcucaccaugugggaggaggaccccgagggcuucaccgucgaggagaccggcggcgacuccuggaaguacucccuccgccccugcaccgagguccucuucaucgacaucuuccacgaguacaaccagacccucacccccguccuccucgagaugaugcagacccuccagggccccaccaacgucgaggacaugaacgcccuccucaucaaggacgccgucuacaacgccgucggccucgccgccuacgagcucuucgacuccgucgacuucgaccagugguucaagaaccagcuccuccccgagcuccaggucauccacaaccgcuacaagccccuccgccgccgcgucaucuggcucaucggccaguggaucuccgucaaguucaaguccgaccuccgccccaugcucuacgaggccaucugcaaccuccuccaggaccaggaccucgucguccgcaucgagaccgccaccacccucaagcucaccgucgacgacuucgaguuccgcaccgaccaguuccuccccuaccucgagaccauguucacccuccucuuccagcuccuccagcaggucaccgagugcgacaccaagaugcacguccuccacguccucuccugcgucaucgagcgcgucaacaugcagauccgccccuacgucggcugccucguccaguaccucccccuccucuggaagcaguccgaggagcacaacaugcuccgcugcgccauccucaccacccucauccaccucguccagggccucggcgccgacuccaagaaccucuaccccuuccuccuccccgucauccagcucuccaccgacgucucccagcccccccacgucuaccuccucgaggacggccucgagcucuggcucgucacccucgagaacucccccugcaucacccccgagcuccuccgcaucuuccagaacauguccccccuccucgagcucuccuccgagaaccuccgcaccugcuucaagaucaucaacggcuacaucuuccucuccuccaccgaguuccuccagaccuacgccgucggccucugccaguccuucugcgagcuccucaaggagaucaccaccgagggccagguccagguccucaaggucgucgagaacgcccucaaggucaaccccauccucggcccccagauguuccagcccauccuccccuacgucuucaagggcaucaucgagggcgagcgcuaccccgucgucauguccaccuaccucggcgucaugggccgcguccuccuccagaacaccuccuucuucuccucccuccucaacgagauggcccacaaguucaaccaggagauggaccagcuccucggcaacaugaucgagaugugggucgaccgcauggacaacaucacccagcccgagcgccgcaagcucuccgcccucgcccuccucucccuccuccccuccgacaacuccgucauccaggacaaguucugcggcaucaucaacaucuccgucgagggccuccacgacgucaugaccgaggaccccgagaccggcaccuacaaggacugcaugcucaugucccaccucgaggagcccaaggucaccgaggacgaggagccccccaccgagcaggacaagcgcaagaagaugcucgcccucaaggaccccguccacaccgucucccuccagcaguucaucuacgagaagcucaaggcccagcaggagaugcucggcgagcagggcuuccagucccucauggagaccgucgacaccgagaucgucacccagcuccaggaguuccuccagggcuucuga

SEQ ID NO: 44721 - RNA, 1989 nt, Artificial Sequence
  derived and/or modified sequence opt2 from IPO13__Homo_sapiens__XP_011540763
auggagaccucccacggcaucugccgcaucgccgucgcccucggcgagaaccacucccgcgcccuccucgaccaggucgagcacuggcaguccuuccucgcccucgucaacaugaucauguucugcaccggcauccccggccacuaccccgucaacgagaccaccuccucccucacccucaccuucugguacacccuccaggacgacauccucuccuucgaggccgagaagcaggccgucuaccagcaggucuaccgccccgucuacuuccagcucgucgacguccuccuccacaaggcccaguuccccuccgacgaggaguacggcuucugguccuccgacgagaaggagcaguuccgcaucuaccgcgucgacaucuccgacacccucauguacgucuacgagaugcucggcgccgagcuccucuccaaccucuacgacaagcucggccgccuccucaccuccuccgaggagcccuacuccuggcagcacaccgaggcccuccucuacggcuuccaguccaucgccgagaccaucgacgucaacuacuccgacgucguccccggccucaucggccucaucccccgcaucuccaucuccaacguccagcucgccgacaccgucauguucaccaucggcgcccucuccgaguggcucgccgaccaccccgucaugaucaacuccguccucccccucguccuccacgcccucggcaaccccgagcucuccgucuccuccgucuccacccucaagaagaucugccgcgagugcaaguacgaccucccccccuacgccgccaacaucgucgccgucucccaggacguccucaugaagcagauccacaagaccucccagugcauguggcucaugcaggcccucggcuuccuccucuccgcccuccaggucgaggagauccucaagaaccuccacucccucaucucccccuacauccagcagcucgagaagcucgccgaggagauccccaaccccuccaacaagcucgccaucguccacauccucggccuccucuccaaccucuucaccacccucgacaucucccaccacgaggacgaccacgagggccccgagcuccgcaagcuccccgucccccagggccccaaccccgucgucgucguccuccagcaggucuuccagcucauccagaagguccucuccaaguggcucaacgacgcccaggucgucgaggccgucugcgccaucuucgagaaguccgucaagacccuccucgacgacuucgcccccauggucccccagcucugcgagaugcucggccgcauguacuccaccaucccccaggccuccgcccucgaccucacccgccagcucguccacaucuucgcccacgagcccgcccacuucccccccaucgaggcccucuuccuccucgucaccuccgucacccucacccucuuccagcagggcccccgcgaccaccccgacaucgucgacuccuucaugcagcuccucgcccaggcccucaagcgcaagcccgaccucuuccucugcgagcgccucgacgucaaggccgucuuccagugcgccguccucgcccucaaguuccccgaggcccccaccgucaaggccuccugcggcuucuucaccgagcuccucccccgcugcggcgaggucgaguccgucggcaaggucguccaggaggacggccgcaugcuccucaucgccguccucgaggccaucggcggccaggccucccgcucccucauggacugcuucgccgacauccucuucgcccucaacaagcacugcuucucccuccucuccauguggaucaaggaggcccuccagccccccggcuuccccuccgcccgccucucccccgagcagaaggacaccuucucccagcagauccuccgcgagcgcgucaacaagcgccgcgucaaggagauggucaaggaguucacccuccucugccgcggccuccacggcaccgacuacaccgccgacuacuga

SEQ ID NO: 44722 - RNA, 3117 nt, Artificial Sequence
  derived and/or modified sequence opt2 from IPO7__Homo_sapiens__NP_006382
auggaccccaacaccaucaucgaggcccuccgcggcaccauggaccccgcccuccgcgaggccgccgagcgccagcucaacgaggcccacaagucccucaacuucgucuccacccuccuccagaucaccauguccgagcagcucgaccuccccguccgccaggccggcgucaucuaccucaagaacaugaucacccaguacuggcccgaccgcgagaccgcccccggcgacaucucccccuacaccauccccgaggaggaccgccacugcauccgcgagaacaucgucgaggccaucauccacucccccgagcucauccgcguccagcucaccaccugcauccaccacaucaucaagcacgacuaccccucccgcuggaccgccaucgucgacaagaucggcuucuaccuccaguccgacaacuccgccugcuggcucggcauccuccucugccucuaccagcucgucaagaacuacgaguacaagaagcccgaggagcgcuccccccucgucgccgccaugcagcacuuccuccccguccucaaggaccgcuucauccagcuccucuccgaccaguccgaccaguccguccucauccagaagcagaucuucaagaucuucuacgcccucguccaguacacccucccccucgagcucaucaaccagcagaaccucaccgaguggaucgagauccucaagaccgucgucaaccgcgacguccccaacgagacccuccaggucgaggaggacgaccgccccgagcuccccugguggaagugcaagaagugggcccuccacauccucgcccgccucuucgagcgcuacggcucccccggcaacgucuccaaggaguacaacgaguucgccgaggucuuccucaaggccuucgccgucggcguccagcagguccuccucaagguccucuaccaguacaaggagaagcaguacauggccccccgcguccuccagcagacccucaacuacaucaaccagggcgucucccacgcccucaccuggaagaaccucaagccccacauccagggcaucauccaggacgucaucuucccccucaugugcuacaccgacgccgacgaggagcucuggcaggaggaccccuacgaguacauccgcaugaaguucgacgucuucgaggacuucaucucccccaccaccgccgcccagacccuccucuucaccgccugcuccaagcgcaaggagguccuccagaagaccaugggcuucugcuaccagauccucaccgagcccaacgccgacccccgcaagaaggacggcgcccuccacaugaucggcucccucgccgagauccuccucaagaagaagaucuacaaggaccagauggaguacaugcuccagaaccacgucuucccccucuucuccuccgagcucggcuacaugcgcgcccgcgccugcuggguccuccacuacuucugcgaggucaaguucaaguccgaccagaaccuccagaccgcccucgagcucacccgccgcugccucaucgacgaccgcgagaugcccgucaaggucgaggccgccaucgcccuccagguccucaucuccaaccaggagaaggccaaggaguacaucacccccuucauccgccccgucaugcaggcccuccuccacaucauccgcgagaccgagaacgacgaccucaccaacgucauccagaagaugaucugcgaguacuccgaggaggucacccccaucgccgucgagaugacccagcaccucgccaugaccuucaaccaggucauccagaccggccccgacgaggagggcuccgacgacaaggccgucaccgccaugggcauccucaacaccaucgacacccuccucuccgucgucgaggaccacaaggagaucacccagcagcucgagggcaucugccuccaggucaucggcaccguccuccagcagcacguccucgaguucuacgaggagaucuucucccucgcccacucccucaccugccagcaggucuccccccagauguggcagcuccucccccucgucuucgaggucuuccagcaggacggcuucgacuacuucaccgacaugaugccccuccuccacaacuacgucaccgucgacaccgacacccuccucuccgacaccaaguaccucgagaugaucuacuccaugugcaagaagguccucaccggcgucgccggcgaggacgccgagugccacgccgccaagcuccucgaggucaucauccuccagugcaagggccgcggcaucgaccagugcaucccccucuucgucgaggccgcccucgagcgccucacccgcgaggucaagaccuccgagcuccgcaccaugugccuccaggucgccaucgccgcccucuacuacaacccccaccuccuccucaacacccucgagaaccuccgcuuccccaacaacgucgagcccgucaccaaccacuucaucacccaguggcucaacgacgucgacugcuuccucggccuccacgaccgcaagaugugcguccucggccucugcgcccucaucgacauggagcagaucccccagguccucaaccaggucuccggccagauccuccccgccuucauccuccucuucaacggccucaagcgcgccuacgccugccacgccgagcacgagaacgacuccgacgacgacgacgaggccgaggacgacgacgagaccgaggagcucggcuccgacgaggacgacaucgacgaggacggccaggaguaccucgagauccucgccaagcaggccggcgaggacggcgacgacgaggacugggaggaggacgacgccgaggagaccgcccucgagggcuacuccaccaucaucgacgacgaggacaaccccgucgacgaguaccagaucuucaaggccaucuuccagaccauccagaaccgcaaccccgucugguaccaggcccucacccacggccucaacgaggagcagcgcaagcagcuccaggacaucgccacccucgccgaccagcgccgcgccgcccacgaguccaagaugaucgagaagcacggcggcuacaaguucuccgcccccgucguccccuccuccuucaacuucggcggccccgcccccggcaugaacuga

SEQ ID NO: 44723 - RNA, 2499 nt, Artificial Sequence
  derived and/or modified sequence opt2 from IPO8__Homo_sapiens__NP_001177924
auggagucccucacccucaagggcuacgcccucccccuccagcucgucaacaaccagaccaugaccaccuggauggagaucuuccgcaccaucaucgaccgcaccgucccccccgagacccuccacaucgacgaggacgaccgccccgagcucgucugguggaagugcaagaagugggcccuccacaucgucgcccgccucuucgagcgcuacggcucccccggcaacgucaccaaggaguacuucgaguucuccgaguucuuccucaagaccuacgccgucggcauccagcagguccuccucaagauccucgaccaguaccgccagaaggaguacgucgccccccgcguccuccagcaggccuucaacuaccucaaccagggcgucguccacuccaucaccuggaagcagaugaagccccacauccagaacaucuccgaggacgucaucuucuccgucaugugcuacaaggacgaggacgaggagcucuggcaggaggaccccuacgaguacauccgcaugaaguucgacaucuucgaggacuacgccucccccaccaccgccgcccagacccuccucuacaccgccgccaagaagcgcaaggagguccuccccaagaugauggccuucugcuaccagauccucaccgaccccaacuucgacccccgcaagaaggacggcgcccuccacgucaucggcucccucgccgagauccuccucaagaagucccucuucaaggaccagauggagcucuuccuccagaaccacgucuucccccuccuccucuccaaccucggcuaccuccgcgcccgcuccugcuggguccuccacgccuucuccucccucaaguuccacaacgagcucaaccuccgcaacgccgucgagcucgccaagaagucccucaucgaggacaaggagaugcccgucaaggucgaggccgcccucgcccuccagucccucaucuccaaccagauccaggccaaggaguacaugaagccccacguccgccccaucaugcaggagcuccuccacaucguccgcgagaccgagaacgacgacgucaccaacgucauccagaagaugaucugcgaguacucccaggaggucgccuccaucgccgucgacaugacccagcaccucgccgagaucuucggcaagguccuccaguccgacgaguacgaggaggucgaggacaagaccgucauggccaugggcauccuccacaccaucgacaccauccucaccgucgucgaggaccacaaggagaucacccagcagcucgagaacaucugccuccgcaucaucgaccucguccuccagaagcacgucaucgaguucuacgaggagauccucucccucgccuacucccucaccugccacuccaucuccccccagauguggcagcuccucggcauccucuacgaggucuuccagcaggacugcuucgaguacuucaccgacaugaugccccuccuccacaacuacgucaccaucgacaccgacacccuccucuccaacgccaagcaccucgagauccucuucaccaugugccgcaagguccucugcggcgacgccggcgaggacgccgagugccacgccgccaagcuccucgaggucaucauccuccagugcaagggccgcggcaucgaccagugcaucccccucuucguccagcucguccucgagcgccucacccgcggcgucaagaccuccgagcuccgcaccaugugccuccaggucgccaucgccgcccucuacuacaaccccgaccuccuccuccacacccucgagcgcauccagcucccccacaaccccggccccaucaccguccaguucaucaaccaguggaugaacgacaccgacugcuuccucggccaccacgaccgcaagaugugcaucaucggccucuccauccuccucgagcuccagaaccgcccccccgccgucgacgccgucgucggccagaucguccccuccauccucuuccucuuccucggccucaagcaggucugcgccacccgccagcucgucaaccgcgaggaccgcuccaaggccgagaaggccgacauggaggagaacgaggagaucuccuccgacgaggaggagaccaacgucaccgcccaggccaugcaguccaacaacggccgcggcgaggacgaggaggaggaggacgacgacugggacgaggagguccucgaggagaccgcccucgagggcuucuccaccccccucgaccucgacaacuccgucgacgaguaccaguucuucacccaggcccucaucaccguccagucccgcgacgccgccugguaccagcuccucauggccccccucuccgaggaccagcgcaccgcccuccaggaggucuacacccucgccgagcaccgccgcaccgucgccgaggccaagaagaagaucgagcagcagggcggcuucaccuucgagaacaagggcguccucuccgccuucaacuucggcaccguccccuccaacaacuga

SEQ ID NO: 44724 - RNA, 3126 nt, Artificial Sequence
  derived and/or modified sequence opt2 from IPO9__Homo_sapiens__NP_060555
auggccgccgccgccgccgccggcgccgccuccggccuccccggccccgucgcccagggccucaaggaggcccucgucgacacccucaccggcauccucucccccguccaggagguccgcgccgccgccgaggagcagaucaagguccucgaggucaccgaggaguucggcguccaccucgccgagcucaccgucgacccccagggcgcccucgccauccgccagcucgccuccgucauccucaagcaguacgucgagacccacuggugcgcccaguccgagaaguuccgcccccccgagaccaccgagcgcgccaagaucgucauccgcgagcuccuccccaacggccuccgcgaguccaucuccaagguccgcuccuccgucgccuacgccgucuccgccaucgcccacugggacuggcccgaggccuggccccagcucuucaaccuccucauggagaugcucgucuccggcgaccucaacgccguccacggcgccaugcgcguccucaccgaguucacccgcgaggucaccgacacccagaugccccucgucgcccccgucauccuccccgagauguacaagaucuucaccauggccgaggucuacggcauccgcacccgcucccgcgccgucgagaucuucaccaccugcgcccacaugaucugcaacauggaggagcucgagaagggcgccgccaagguccucaucuuccccgucguccagcaguucaccgaggccuucguccaggcccuccagauccccgacggccccaccuccgacuccggcuucaagauggagguccucaaggccgucaccgcccucgucaagaacuuccccaagcacauggucuccuccaugcagcagauccuccccaucgucuggaacacccucaccgaguccgccgccuucuacguccgcaccgaggucaacuacaccgaggaggucgaggaccccgucgacuccgacggcgagguccucggcuucgagaaccucgucuucuccaucuucgaguucguccacgcccuccucgagaacuccaaguucaaguccaccgucaagaaggcccuccccgagcucaucuacuacaucauccucuacaugcagaucaccgaggagcagaucaaggucuggaccgccaacccccagcaguucgucgaggacgaggacgacgacaccuucuccuacaccguccgcaucgccgcccaggaccuccuccucgccgucgccaccgacuuccagaacgaguccgccgccgcccucgccgccgccgccacccgccaccuccaggaggccgagcagaccaagaacuccggcaccgagcacugguggaagauccacgaggccugcaugcucgcccucggcuccgucaaggccaucaucaccgacuccgucaagaacggccgcauccacuucgacaugcacggcuuccucaccaacgucauccucgccgaccucaaccucuccgucucccccuuccuccucggccgcgcccucugggccgccucccgcuucaccgucgccaugucccccgagcucauccagcaguuccuccaggccaccgucuccggccuccacgagacccagccccccuccguccgcaucuccgccguccgcgccaucuggggcuacugcgaccagcucaaggucuccgaguccacccacguccuccagcccuuccuccccuccauccucgacggccucauccaccucgccgcccaguucuccuccgagguccucaaccucgucauggagacccucugcaucgucugcaccgucgaccccgaguucaccgccuccauggaguccaagaucugccccuucaccaucgccaucuuccucaaguacuccaacgaccccgucgucgccucccucgcccaggacaucuucaaggagcucucccagaucgaggccugccagggccccaugcagaugcgccucauccccacccucgucuccaucaugcaggcccccgccgacaagauccccgccggccucugcgccaccgccaucgacauccucaccaccgucguccgcaacaccaagcccccccucucccagcuccucaucugccaggccuuccccgccgucgcccagugcacccuccacaccgacgacaacgccaccaugcagaacggcggcgagugccuccgcgccuacgucuccgucacccucgagcaggucgcccaguggcacgacgagcagggccacaacggccucugguacgucaugcaggucgucucccagcuccucgacccccgcaccuccgaguucaccgccgccuucgucggccgccucgucuccacccucaucuccaaggccggccgcgagcucggcgagaaccucgaccagauccuccgcgccauccucuccaagaugcagcaggccgagacccucuccgucaugcagucccucaucauggucuucgcccaccucguccacacccagcucgagccccuccucgaguuccucugcucccuccccggccccaccggcaagcccgcccucgaguucgucauggccgaguggaccucccgccagcaccucuucuacggccaguacgagggcaaggucuccuccgucgcccucugcaagcuccuccagcacggcaucaacgccgacgacaagcgccuccaggacauccgcgucaagggcgaggagaucuacuccauggacgagggcauccgcacccgcuccaaguccgccaagaaccccgagcgcuggaccaacaucccccuccucgucaagauccucaagcucaucaucaacgagcucuccaacgucauggaggccaacgccgcccgccaggccacccccgccgaguggucccaggacgacuccaacgacaugugggaggaccaggaggaggaggaggaggaggaggaggacggccucgccggccagcuccucuccgacauccucgccaccuccaaguacgaggaggacuacuacgaggacgacgaggaggacgaccccgacgcccucaaggacccccucuaccagaucgaccuccaggccuaccucaccgacuuccucugccaguucgcccagcagcccugcuacaucauguucuccggccaccucaacgacaacgagcgccgcguccuccagaccaucggcaucuga

SEQ ID NO: 44725 - RNA, 1797 nt, Artificial Sequence
  derived and/or modified sequence opt2 from IQCB1__Homo_sapiens__NP_001018864
augaagcccaccggcaccgacccccgcauccucuccaucgccgccgaggucgccaagucccccgagcagaacguccccgucauccuccucaagcucaaggagaucaucaacaucaccccccucggcuccuccgagcucaagaagaucaagcaggacaucuacugcuacgaccucauccaguacugccuccucguccucucccaggacuacucccgcauccagggcggcuggaccaccaucucccagcucacccagauccucucccacugcugcgucggccucgagcccggcgaggacgccgaggaguucuacaacgagcuccuccccuccgccgccgagaacuuccucguccucggccgccagcuccagaccugcuucaucaacgccgccaaggccgaggagaaggacgagcuccuccacuucuuccagaucgucaccgacucccucuucuggcuccucggcggccacgucgagcucauccagaacguccuccaguccgaccacuuccuccaccuccuccaggccgacaacguccagaucggcuccgccgucaugaugaugcuccagaacauccuccagaucaacuccggcgaccuccuccgcaucggccgcaaggcccucuacuccauccucgacgaggucaucuucaagcucuucuccacccccucccccgucauccgcuccaccgccaccaagcuccuccuccucauggccgagucccaccaggagauccucauccuccuccgccaguccaccugcuacaagggccuccgccgccuccucuccaagcaggagaccggcaccgaguucucccaggagcuccgccagcucgucggccuccucucccccauggucuaccaggaggucgaggagcagaagcuccaccaggccgccugccucauccaggccuacuggaagggcuuccagacccgcaagcgccucaagaagcuccccuccgccgucaucgcccuccagcgcuccuuccgcuccaagcgcuccaagaugcuccucgagaucaaccgccagaaggaggaggaggaccucaagcuccagcuccagcuccagcgccagcgcgccaugcgccucucccgcgagcuccagcucuccaugcucgagaucguccaccccggccaggucgagaagcacuaccgcgagauggaggagaaguccgcccucaucauccagaagcacuggcgcggcuaccgcgagcgcaagaacuuccaccagcagcgccagucccucaucgaguacaaggccgccgucacccuccagcgcgccgcccucaaguuccucgccaagugccgcaagaagaagaagcucuucgcccccuggcgcggccuccaggagcucaccgacgcccgccgcgucgagcucaagaagcgcgucgacgacuacguccgccgccaccucggcucccccauguccgacgucgucucccgcgagcuccacgcccaggcccaggagcgccuccagcacuacuucaugggccgcgcccucgaggagcgcgcccagcagcaccgcgaggcccucaucgcccagaucuccaccaacgucgagcagcucaugaaggcccccucccucaaggaggccgagggcaaggagcccgagcucuuccucucccgcucccgccccgucgccgccaaggccaagcaggcccaccucaccacccucaagcacauccaggcccccugguggaagaagcucggcgaggaguccggcgacgagaucgacguccccaaggacgagcucuccaucgagcucgagaaccucuucaucggcggcaccaagccccccuga

SEQ ID NO: 44726 - RNA, 1332 nt, Artificial Sequence
  derived and/or modified sequence opt2 from IQCG__Homo_sapiens__NP_001127907
auggaggaggacucccucgaggacuccaaccucccccccaaggucuggcacuccgagaugaccgucuccgucaccggcgagccccccuccaccgucgaggaggagggcauccccaaggagaccgacaucgagaucauccccgagauccccgagacccucgagccccucucccuccccgacguccuccgcaucuccgccguccucgaggacaccaccgaccagcucuccauccucaacuacaucaugcccguccaguacgagggccgccaguccaucugcgucaagucccgcgagaugaaccucgagggcaccaaccucgacaagcuccccauggccuccaccaucaccaagauccccuccccccucaucaccgaggagggccccaaccuccccgagauccgccaccgcggccgcuucgccgucgaguucaacaagaugcaggaccucgucuucaagaagcccacccgccagaccaucaugaccaccgagacccucaagaagauccagaucgaccgccaguucuucuccgacgucaucgccgacaccaucaaggagcuccaggacuccgccaccuacaacucccuccuccaggcccucuccaaggagcgcgagaacaagaugcacuucuacgacaucaucgcccgcgaggagaagggccgcaagcagaucaucucccuccagaagcagcucaucaacgucaagaaggaguggcaguucgagguccagucccagaacgaguacaucgccaaccucaaggaccagcuccaggagaugaaggccaaguccaaccucgagaaccgcuacaugaagaccaacaccgagcuccagaucgcccagacccagaagaagugcaaccgcaccgaggagcuccucgucgaggagaucgagaagcuccgcaugaagaccgaggaggaggcccgcacccacaccgagaucgagauguuccuccgcaaggagcagcagaagcucgaggagcgccucgaguucuggauggagaaguacgacaaggacaccgagaugaagcagaacgagcucaacgcccucaaggccaccaaggccuccgaccucgcccaccuccaggaccucgccaagaugauccgcgaguacgagcaggucaucaucgaggaccgcaucgagaaggagcgcuccaagaagaaggucaagcaggaccuccucgagcucaaguccgucaucaagcuccaggccugguggcgcggcaccaugauccgccgcgagaucggcggcuucaagaugcccaaggacaaggucgacuccaaggacuccaagggcaagggcaagggcaaggacaagcgccgcggcaagaagaaguga

SEQ ID NO: 44727 - RNA, 3084 nt, Artificial Sequence
  derived and/or modified sequence opt2 from IQCH__Homo_sapiens__NP_001026885
auggcccagaacaccgagaaccacgaccccgucggcuccauccucauccagauccacgaggaccucuaccagcucaaggagaagcucaccaaguucucccccgaggagaagggcgagacccucgacauccagucccucgagaccgccaucaagcgcaccgaggucggccuccgcauccacaucgagaaguaccucaacgucgucaaccagaacguccucaccaccuccgucaacgacgagucccucuacaccccccaggccuccaaguggcuccuccccaccgucaucgaccagaaguccuucaucuucccccaggaguccgagggcaccuucuggcagccccagcgccagcacuccuccucccuccccgucuucccccgcgccaagaucaaggucuccaagcucaucaagggcuccaacaucuccucccucaccguccuccccuccucccacugcaccgaccccuacuucacccccauccccguccuccaggccgacgcccacaagggcauccucuccaugaucgagcgcggccucaucccccccaccgcccgcaucaccuuccagaacccccccaucaccccccgcgccgccccccuccacuccuucgacgaggcccgcaagauccccaccgucgccaccuucaccaucccccgcgagcccccccccucccccgccgaggucaaguucuuccccaagaagcagcgcuccaagggcaagucccgccgcucccgcggccaccacgaccgcaaggccaugaaggucaagaccccccuccgcgcccucaagucccucugggacuacgacuuccucaucuacgacggcgucaucgacaacaccgcccccgacuuccucgccuucaaggagcacuucucccucgccuggggcggcaucuucucccuccucgagcacgucgagaaguuccuccgcaacuacgccauccccgaggucaagaucaagggcaacaaccucgucgcccuccuccccgaguucgagcucaccaacaagcucacccgcuacgaccuccucuccguccucgaggaccccgcccacguccagaugcucaucaaccuccccggccagcgcuacaagggccaggacggcaacuccgaggccgccaugaagauccaggccaccuggaagugcuacaaggcccgcaaguucuuccucuucuaccgccagcagaagugggccuccggcgucaucgccaucgccuggcuccucuacugccacaagacccgccucaagaagauccucaaggagucccgccagcgccaccucgagaacuuccgcauccgcgccaagcaccucgccgccaacuggaaccgcauccgcaccucccgccgcaccaucauccacauccccucccucggcuacucccagcccguccgcgagcacaucgccgacuucaacacccagcagaacaugcagcucggccgccucugcgacauccucgacgccaacgucaacgucaucuacaucugcucccaccacaugaacgacgagcucguccucuacuacaagaagauccucucccuccacgccgccgucaaguccggcaaccucgaggaccgcuccgaccuccaggaccgcuucaagaucaucacccccgaggccgucaacaucuuccccaagcaccacaugugccucgccacccaccucauguacucccccaaggccaucaagcgcaucaagaaccucauccgcggcaccgaggccuacaucgucuccggccuccuccaccgcgacgaccucgccgucgccgacaugcucgacauccccauccucggcuccgagcccgagcucgcccaccucuacuccaccaaguccggcggcaagcgcgucuucgacuccgccaacgucgccgucccccccggcaucuacgacaucuacucccagcagcagaugaucgagcagcucucccagcucaucaccgaccaccuccagauccagcgcuggcucuucaagauggacuccgaguuccgcggcaacggcaccgccuucugcgacauccccuccuaccucaagugcuacaaguggguccucaaggaguccucccgcuacggccucgaggacuggcgcaagaagugggcccaggagcccgcccucgucaagaucuccgaggagcucgccggcauccucgcccagcacgcccagcccgucaacgagaagcgcuuccccaccuggcgcaaguuccuccagaccuuccucucccagggcggcgucaucgaggccuucccccccgccgacaacgucaccaaccucaccgucgacaugcucaucgagcccaacggcaagaucuccguccucuccaccggcgaccagcuccacgccgagucccccuucaucuccuccggcaccaccgucccccagaccuccgucgacccccagguccucaccuaccucugccuccagaucggcaaggccugccgcaugcgcgacgucgucggcuacuucuccaucgaccucgucaccuucaucgaccccuccacccucgagcagcaggucugggccaccggccucaaccucgccuacuccgaccagcucgcccucacccagcucacccucuaccucaccaacggccaccucgacugcucccucuccacccucgaggucccccgcuucguccccaaggagcgcaagaagaccaagugcauguccgcccucuccaugcccaugcucgccaccucccgcuacgccgucaugaccacccagcuccgccacuccaaccucucccucgucuuccacuacgucuuccuccagaucugccgcgcccacggcaucggcuacgaccucgaggagcgccagggcaccgucuucauccucuacgagcaccucaagcgccacaagcucggcaugcucaccaucggcgaggaccuccagggcguccucaugaccuucgcccgccaccucuucaucauccaccaggagaucuccgcccccaacaugcagggcgagaccaacuucaagaccaccaucgccgacaucgagaccauccuccgcgucaccaaggagaacaagaugcgcuucgaggaggagcagcaguccaaggacgacaagaaccucuccaagcccaagaaguga

SEQ ID NO: 44728 - RNA, 480 nt, Artificial Sequence
  derived and/or modified sequence opt2 from IQCJ__Homo_sapiens__NP_001036170
augcgccucgaggagcucaagcgccuccagaacccccucgagcaggucaacgacggcaaguacuccuucgagaaccaccagcucgccauggacgccgagaacaacaucgagaaguacccccucaaccuccagccccucgaguccaaggucaagaucauccagcgcgccuggcgcgaguaccuccagcgccaggagccccucggcaagcgcucccccuccccccccuccgucuccuccgagaagcucuccuccuccgucuccaugaacaccuucuccgacuccuccacccccuucgcccgcgcccccgucggcaagauccaccccuacaucuccuggcgccuccagucccccggcgacaagcuccccggcggccgcaaggucauccuccucuaccucgaccagcucgcccgccccaccggcuucauccacacccucaaggagccccagaucgagcgccucggcuuccucacccuccaguga

SEQ ID NO: 44729 - RNA, 1692 nt, Artificial Sequence
  derived and/or modified sequence opt2 from IQCJ-SCHIP1__Homo_sapiens__NP_001184042
augcgccucgaggagcucaagcgccuccagaacccccucgagcaggucaacgacggcaaguacuccuucgagaaccaccagcucgccauggacgccgagaacaacaucgagaaguacccccucaaccuccagccccucgaguccaaggucaagaucauccagcgcgccuggcgcgaguaccuccagcgccaggagccccucggcaagcgcucccccuccccccccuccgucuccuccgagaagcucuccuccuccgucuccaugaacaccuucuccgacuccuccacccccgacuaccgcgaggacggcauggaccucggcuccgacgccggcuccuccuccuccuccucccgcgccuccucccaguccaacuccaccaaggucacccccugcuccgagugcaaguccuccuccucccccggcggcucccucgaccucgucuccgcccucgaggacuacgaggagcccuuccccgucuaccagaagaaggucaucgacgagugggcccccgaggaggacggcgaggaggaggaggaggaggacgagcgcgaccagcgcggcuaccgcgacgaccgcucccccgcccgcgagcccggcgacgucuccgcccgcacccgcuccggcggcggcggcggccgcuccgccaccaccgccaugcccccccccguccccaacggcaaccuccaccagcacgacccccaggaccuccgccacaacggcaacgucgucgucgccggccgccccuccugcucccgcggcccccgccgcgccauccagaagccccagcccgccggcggccgccgcuccggccgcggccccgccgccggcggccucugccuccagccccccgacggcggcaccugcguccccgaggagccccccgucccccccauggacugggaggcccucgagaagcaccucgccggccuccaguuccgcgagcaggagguccgcaaccagggccaggcccgcaccaacuccaccuccgcccagaagaacgagcgcgaguccauccgccagaagcucgcccucggcuccuucuucgacgacggccccggcaucuacaccuccugcuccaaguccggcaagcccucccucuccucccgccuccaguccggcaugaaccuccagaucugcuucgucaacgacuccggcuccgacaaggacuccgacgccgacgacuccaagaccgagaccucccucgacaccccccucucccccauguccaagcaguccuccuccuacuccgaccgcgacaccaccgaggaggaguccgagucccucgacgacauggacuuccucacccgccagaagaagcuccaggccgaggccaagauggcccucgccauggccaagcccauggccaagaugcaggucgaggucgagaagcagaaccgcaagaagucccccgucgccgaccuccucccccacaugccccacaucuccgagugccucaugaagcgcucccucaagcccaccgaccuccgcgacaugaccaucggccagcuccaggucaucgucaacgaccuccacucccagaucgagucccucaacgaggagcucguccagcuccuccucauccgcgacgagcuccacaccgagcaggacgccaugcucgucgacaucgaggaccucacccgccacgccgagucccagcagaagcacauggccgagaagaugcccgccaaguga

SEQ ID NO: 44730 - RNA, 864 nt, Artificial Sequence
  derived and/or modified sequence opt2 from IQCK__Homo_sapiens__NP_694940
auggccgccccccgccagauccccucccacaucguccgccucaagcccuccugcuccaccgacuccuccuucacccgcacccccguccccaccgucucccucgccucccgcgagcuccccgucuccuccuggcaggucaccgagcccuccuccaagaaccucugggagcagaucugcaaggaguacgaggccgagcagccccccuuccccgagggcuacaaggucaagcaggagcccgucaucaccgucgcccccgucgaggagaugcucuuccacggcuucuccgccgagcacuacuuccccgucucccacuucaccaugaucucccgcacccccugcccccaggacaaguccgagaccaucaaccccaagaccugcucccccaaggaguaccucgagaccuucaucuuccccguccuccuccccggcauggccucccuccuccaccaggccaagaaggagaagugcuucgagcgcaagcgcaccaaguucaucgccugcgacuuccucaccgaguggcucuacaaccagaaccccaagcgcgccggcgagcccuucaccgaguucuucuccauccccuucgucgaggagcgccucaagcagcacccccgcccccccaucccccucucccuccuccucaccgaggaggaggccgcccucuacauccaguccuucuggcgcgccugcgucguccgcugcgaccccgagauccaggagcuccgccaguggcagaagaagcuccgcgaggccaagcacauccaccagcaggucaagaucuucugggccaagcaggagcagaaggucaagugcaagauggaggacgacgccguccccgccgccaagaugaagauccccuccuccuga

SEQ ID NO: 44731 - RNA, 4974 nt, Artificial Sequence
  derived and/or modified sequence opt2 from IQGAP1__Homo_sapiens__NP_003861
auguccgccgccgacgaggucgacggccucggcgucgcccgcccccacuacggcuccguccucgacaacgagcgccucaccgccgaggagauggacgagcgccgccgccagaacgucgccuacgaguaccucugccaccucgaggaggccaagcgcuggauggaggccugccucggcgaggaccucccccccaccaccgagcucgaggagggccuccgcaacggcgucuaccucgccaagcucggcaacuucuucucccccaaggucgucucccucaagaagaucuacgaccgcgagcagacccgcuacaaggccaccggccuccacuuccgccacaccgacaacgucauccaguggcucaacgccauggacgagaucggccuccccaagaucuucuaccccgagaccaccgacaucuacgaccgcaagaacaugccccgcugcaucuacugcauccacgcccucucccucuaccucuucaagcucggccucgccccccagauccaggaccucuacggcaaggucgacuucaccgaggaggagaucaacaacaugaagaccgagcucgagaaguacggcauccagaugcccgccuucuccaagaucggcggcauccucgccaacgagcucuccgucgacgaggccgcccuccacgccgccgucaucgccaucaacgaggccaucgaccgccgcauccccgccgacaccuucgccgcccucaagaaccccaacgccaugcucgucaaccucgaggagccccucgccuccaccuaccaggacauccucuaccaggccaagcaggacaagaugaccaacgccaagaaccgcaccgagaacuccgagcgcgagcgcgacgucuacgaggagcuccucacccaggccgagauccagggcaacaucaacaaggucaacaccuucuccgcccucgccaacaucgaccucgcccucgagcagggcgacgcccucgcccucuuccgcgcccuccagucccccgcccucggccuccgcggccuccagcagcagaacuccgacugguaccucaagcagcuccucuccgacaagcagcagaagcgccaguccggccagaccgacccccuccagaaggaggagcuccaguccggcgucgacgccgccaacuccgccgcccagcaguaccagcgccgccucgccgccgucgcccucaucaacgccgccauccagaagggcgucgccgagaagaccguccucgagcucaugaaccccgaggcccagcucccccaggucuaccccuucgccgccgaccucuaccagaaggagcucgccacccuccagcgccagucccccgagcacaaccucacccaccccgagcucuccgucgccgucgagaugcucuccuccgucgcccucaucaaccgcgcccucgaguccggcgacgucaacaccgucuggaagcagcucuccuccuccgucaccggccucaccaacaucgaggaggagaacugccagcgcuaccucgacgagcucaugaagcucaaggcccaggcccacgccgagaacaacgaguucaucaccuggaacgacauccaggccugcgucgaccacgucaaccucgucguccaggaggagcacgagcgcauccucgccaucggccucaucaacgaggcccucgacgagggcgacgcccagaagacccuccaggcccuccagauccccgccgccaagcucgagggcguccucgccgaggucgcccagcacuaccaggacacccucauccgcgccaagcgcgagaaggcccaggagauccaggacgaguccgccguccucuggcucgacgagauccagggcggcaucuggcaguccaacaaggacacccaggaggcccagaaguucgcccucggcaucuucgccaucaacgaggccgucgaguccggcgacgucggcaagacccucuccgcccuccgcucccccgacgucggccucuacggcgucauccccgagugcggcgagaccuaccacuccgaccucgccgaggccaagaagaagaagcucgccgucggcgacaacaacuccaagugggucaagcacugggucaagggcggcuacuacuacuaccacaaccucgagacccaggagggcggcugggacgagccccccaacuucguccagaacuccaugcagcucucccgcgaggagauccaguccuccaucuccggcgucaccgccgccuacaaccgcgagcagcucuggcucgccaacgagggccucaucacccgccuccaggcccgcugccgcggcuaccucguccgccaggaguuccgcucccgcaugaacuuccucaagaagcagauccccgccaucaccugcauccagucccaguggcgcggcuacaagcagaagaaggccuaccaggaccgccucgccuaccuccgcucccacaaggacgaggucgucaagauccagucccucgcccgcaugcaccaggcccgcaagcgcuaccgcgaccgccuccaguacuuccgcgaccacaucaacgacaucaucaagauccaggccuucauccgcgccaacaaggcccgcgacgacuacaagacccucaucaacgccgaggacccccccauggucgucguccgcaaguucguccaccuccucgaccaguccgaccaggacuuccaggaggagcucgaccucaugaagaugcgcgaggaggucaucacccucauccgcuccaaccagcagcucgagaacgaccucaaccucauggacaucaagaucggccuccucgucaagaacaagaucacccuccaggacgucgucucccacuccaagaagcucaccaagaagaacaaggagcagcucuccgacaugaugaugaucaacaagcagaagggcggccucaaggcccucuccaaggagaagcgcgagaagcucgaggccuaccagcaccucuucuaccuccuccagaccaaccccaccuaccucgccaagcucaucuuccagaugccccagaacaaguccaccaaguucauggacuccgucaucuucacccucuacaacuacgccuccaaccagcgcgaggaguaccuccuccuccgccucuucaagaccgcccuccaggaggagaucaaguccaaggucgaccagauccaggagaucgucaccggcaaccccaccgucaucaagauggucgucuccuucaaccgcggcgcccgcggccagaacgcccuccgccagauccucgcccccgucgucaaggagaucauggacgacaagucccucaacaucaagaccgaccccgucgacaucuacaaguccugggucaaccagauggagucccagaccggcgaggccuccaagcuccccuacgacgucacccccgagcaggcccucgcccacgaggaggucaagacccgccucgacuccuccauccgcaacaugcgcgccgucaccgacaaguuccucuccgccaucgucuccuccgucgacaagauccccuacggcaugcgcuucaucgccaagguccucaaggacucccuccacgagaaguuccccgacgccggcgaggacgagcuccucaagaucaucggcaaccuccucuacuaccgcuacaugaaccccgccaucgucgcccccgacgccuucgacaucaucgaccucuccgccggcggccagcucaccaccgaccagcgccgcaaccucggcuccaucgccaagaugcuccagcacgccgccuccaacaagauguuccucggcgacaacgcccaccucuccaucaucaacgaguaccucucccaguccuaccagaaguuccgccgcuucuuccagaccgccugcgacguccccgagcuccaggacaaguucaacgucgacgaguacuccgaccucgucacccucaccaagcccgucaucuacaucuccaucggcgagaucaucaacacccacacccuccuccucgaccaccaggacgccaucgcccccgagcacaacgaccccauccacgagcuccucgacgaccucggcgagguccccaccaucgagucccucaucggcgaguccuccggcaaccucaacgaccccaacaaggaggcccucgccaagaccgaggucucccucacccucaccaacaaguucgacguccccggcgacgagaacgccgagauggacgcccgcaccauccuccucaacaccaagcgccucaucgucgacgucauccgcuuccagcccggcgagacccucaccgagauccucgagacccccgccaccuccgagcaggaggccgagcaccagcgcgccaugcagcgccgcgccauccgcgacgccaagacccccgacaagaugaagaaguccaaguccgucaaggaggacuccaaccucacccuccaggagaagaaggagaagauccagaccggccucaagaagcucaccgagcucggcaccgucgaccccaagaacaaguaccaggagcucaucaacgacaucgcccgcgacauccgcaaccagcgccgcuaccgccagcgccgcaaggccgagcucgucaagcuccagcagaccuacgccgcccucaacuccaaggccaccuucuacggcgagcaggucgacuacuacaaguccuacaucaagaccugccucgacaaccucgccuccaagggcaaggucuccaagaagccccgcgagaugaagggcaagaaguccaagaagaucucccucaaguacaccgccgcccgccuccacgagaagggcguccuccucgagaucgaggaccuccaggucaaccaguucaagaacgucaucuucgagaucucccccaccgaggaggucggcgacuucgaggucaaggccaaguucaugggcguccagauggagaccuucaugcuccacuaccaggaccuccuccagcuccaguacgagggcgucgccgucaugaagcucuucgaccgcgccaaggucaacgucaaccuccucaucuuccuccucaacaagaaguucuacggcaaguga

SEQ ID NO: 44732 - RNA, 3216 nt, Artificial Sequence
  derived and/or modified sequence opt2 from IQGAP2__Homo_sapiens__NP_001272390
augcacucccuccccggcgucgucgccgucggcuacaucaacgaggccaucgacgagggcaacccccuccgcacccucgagacccuccuccuccccaccgccaacaucuccgacgucgaccccgcccacgcccagcacuaccaggacguccucuaccacgccaagucccagaagcucggcgacuccgaguccgucuccaagguccucuggcucgacgagauccagcaggccgucgacgacgccaacgucgacgaggaccgcgccaagcagugggucacccucgucgucgacgucaaccagugccucgagggcaagaaguccuccgacauccucuccguccucaaguccuccaccuccaacgccaacgacaucauccccgagugcgccgacaaguacuacgacgcccucgucaaggccaaggagcucaaguccgagcgcgucuccuccgacggcuccuggcucaagcucaaccuccacaagaaguacgacuacuacuacaacaccgacuccaaggaguccuccugggucacccccgaguccugccucuacaaggaguccuggcucaccggcaaggagaucgaggccuucuggaagggcuacaagcagcgcaaggaguacaugcaccgccgccagaccuucaucgacaacaccgacuccaucgucaagauccaguccugguuccgcauggccaccgcccgcaaguccuaccucucccgccuccaguacuuccgcgaccacaacaacgagaucgucaagauccagucccuccuccgcgccaacaaggcccgcgacgacuacaagacccucgucggcuccgagaaccccccccucaccgucauccgcaaguucgucuaccuccucgaccaguccgaccucgacuuccaggaggagcucgaggucgcccgccuccgcgaggaggucgucaccaagauccgcgccaaccagcagcucgagaaggaccucaaccucauggacaucaagaucggccuccucgucaagaaccgcaucacccucgaggacgucaucucccacuccaagaagcucaacaagaagaagggcggcgagauggagauccucaacaacaccgacaaccagggcaucaagucccucuccaaggagcgccgcaagacccucgagaccuaccagcagcucuucuaccuccuccagaccaacccccucuaccucgccaagcucaucuuccagaugccccagaacaaguccaccaaguucauggacaccgucaucuucacccucuacaacuacgccuccaaccagcgcgaggaguaccuccuccucaagcucuucaagaccgcccucgaggaggagaucaaguccaaggucgaccagguccaggacaucgucaccggcaaccccaccgucaucaagauggucgucuccuucaaccgcggcgcccgcggccagaacacccuccgccagcuccucgcccccgucgucaaggagaucaucgacgacaagucccucaucaucaacaccaaccccgucgaggucuacaaggccugggucaaccagcucgagacccagaccggcgaggccuccaagcuccccuacgacgucaccaccgagcaggcccucaccuaccccgaggucaagaacaagcucgaggccuccaucgagaaccuccgccgcgucaccgacaagguccucaacuccaucaucuccucccucgaccuccuccccuacggccuccgcuacaucgccaagguccucaagaacuccauccacgagaaguuccccgacgccaccgaggacgagcuccucaagaucgucggcaaccuccucuacuaccgcuacaugaaccccgccaucgucgcccccgacggcuucgacaucaucgacaugaccgccggcggccagaucaacuccgaccagcgccgcaaccucggcuccgucgccaagguccuccagcacgccgccuccaacaagcucuucgagggcgagaacgagcaccucuccuccaugaacaacuaccucuccgagaccuaccaggaguuccgcaaguacuucaaggaggccugcaacguccccgagcccgaggagaaguucaacauggacaaguacaccgaccucgucaccgucuccaagcccgucaucuacaucuccaucgaggagaucaucuccacccacucccuccuccucgagcaccaggacgccaucgcccccgagaagaacgaccuccucuccgagcuccucggcucccucggcgagguccccaccgucgaguccuuccucggcgagggcgccgucgaccccaacgaccccaacaaggccaacacccucucccagcucuccaagaccgagaucucccucguccucaccuccaaguacgacaucgaggacggcgaggccaucgacucccgcucccucaugaucaagaccaagaagcucaucaucgacgucauccgcaaccagcccggcaacacccucaccgagauccucgagacccccgccaccgcccagcaggaggucgaccacgccaccgacauggucucccgcgccaugaucgacucccgcacccccgaggagaugaagcacucccaguccaugaucgaggacgcccagcucccccucgagcagaagaagcgcaagauccagcgcaaccuccgcacccucgagcagaccggccacgucuccuccgagaacaaguaccaggacauccucaacgagaucgccaaggacauccgcaaccagcgcaucuaccgcaagcuccgcaaggccgagcucgccaagcuccagcagacccucaacgcccucaacaagaaggccgccuucuacgaggagcagaucaacuacuacgacaccuacaucaagaccugccucgacaaccucaagcgcaagaacacccgccgcuccaucaagcucgacggcaagggcgagcccaagggcgccaagcgcgccaagcccgucaaguacaccgccgccaagcuccacgagaagggcguccuccucgacaucgacgaccuccagaccaaccaguucaagaacgucaccuucgacaucaucgccaccgaggacgucggcaucuucgacguccgcuccaaguuccucggcgucgagauggagaagguccagcucaacauccaggaccuccuccagaugcaguacgagggcgucgccgucaugaagauguucgacaaggucaaggucaacgucaaccuccucaucuaccuccucaacaagaaguucuacggcaaguga

SEQ ID NO: 44733 - RNA, 4896 nt, Artificial Sequence
  derived and/or modified sequence opt2 from IQGAP3__Homo_sapiens__NP_839943
auggagcgccgcgccgccggccccggcugggccgccuacgagcgccucaccgccgaggagauggacgagcagcgccgccagaacgucgccuaccaguaccucugccgccucgaggaggccaagcgcuggauggaggccugccucaaggaggagcuccccucccccgucgagcucgaggagucccuccgcaacggcguccuccucgccaagcucggccacugcuucgcccccuccgucgucccccucaagaagaucuacgacgucgagcagcuccgcuaccaggccaccggccuccacuuccgccacaccgacaacaucaacuucuggcucuccgccaucgcccacaucggccuccccuccaccuucuuccccgagaccaccgacaucuacgacaagaagaacaugccccgcgucgucuacugcauccacgcccucucccucuuccucuuccgccucggccucgccccccagauccacgaccucuacggcaaggucaaguucaccgccgaggagcucuccaacauggccuccgagcucgccaaguacggccuccagcuccccgccuucuccaagaucggcggcauccucgccaacgagcucuccgucgacgaggccgccguccacgccgccguccucgccaucaacgaggccgucgagcgcggcgucgucgaggacacccucgccgcccuccagaaccccuccgcccuccucgagaaccuccgcgagccccucgccgccgucuaccaggagaugcucgcccaggccaagauggagaaggccgccaacgcccgcaaccacgacgaccgcgagucccaggacaucuacgaccacuaccucacccaggccgagauccagggcaacaucaaccacgucaacguccacggcgcccucgaggucgucgacgacgcccucgagcgccagucccccgaggcccuccucaaggcccuccaggaccccgcccucgcccuccgcggcguccgccgcgacuucgccgacugguaccucgagcagcucaacuccgaccgcgagcagaaggcccaggagcucggccucgucgagcuccucgagaaggaggagguccaggccggcgucgccgccgccaacaccaagggcgaccaggagcaggccaugcuccacgccguccagcgcaucaacaaggccauccgccgcggcgucgccgccgacaccgucaaggagcucaugugccccgaggcccagcucccccccgucuaccccgucgccuccuccauguaccagcucgagcucgccguccuccagcagcagcagggcgagcucggccaggaggagcucuucgucgccgucgagaugcucuccgccgucguccucaucaaccgcgcccucgaggcccgcgacgccuccggcuucugguccucccucgucaaccccgccaccggccucgccgaggucgagggcgagaacgcccagcgcuacuucgacgcccuccucaagcuccgccaggagcgcggcaugggcgaggacuuccucuccuggaacgaccuccaggccaccgucucccaggucaacgcccagacccaggaggagaccgaccgcguccucgccgucucccucaucaacgaggcccucgacaagggcucccccgagaagacccucuccgcccuccuccuccccgccgccggccucgacgacgucucccuccccgucgccccccgcuaccaccuccuccucgucgccgccaagcgccagaaggcccaggucaccggcgaccccggcgccguccucuggcucgaggagauccgccagggcgucguccgcgccaaccaggacaccaacaccgcccagcgcauggcccucggcgucgccgccaucaaccaggccaucaaggagggcaaggccgcccagaccgagcgcguccuccgcaaccccgccgucgcccuccgcggcgucguccccgacugcgccaacggcuaccagcgcgcccucgaguccgccauggccaagaagcagcgccccgccgacaccgccuucuggguccagcacgacaugaaggacggcaccgccuacuacuuccaccuccagaccuuccagggcaucugggagcagccccccggcugcccccucaacaccucccaccucacccgcgaggagauccaguccgccgucaccaaggucaccgccgccuacgaccgccagcagcucuggaaggccaacgucggcuucgucauccagcuccaggcccgccuccgcggcuuccucguccgccagaaguucgccgagcacucccacuuccuccgcaccuggcuccccgccgucaucaagauccaggcccacuggcgcggcuaccgccagcgcaagaucuaccucgaguggcuccaguacuucaaggccaaccucgacgccaucaucaagauccaggccugggcccgcaugugggccgcccgccgccaguaccuccgccgccuccacuacuuccagaagaacgucaacuccaucgucaagauccaggccuucuuccgcgcccgcaaggcccaggacgacuaccgcauccucguccacgccccccaccccccccucuccgucguccgccgcuucgcccaccuccucaaccagucccagcaggacuuccucgccgaggccgagcuccucaagcuccaggaggaggucguccgcaagauccgcuccaaccagcagcucgagcaggaccucaacaucauggacaucaagaucggccuccucgucaagaaccgcaucacccuccaggaggucgucucccacugcaagaagcucaccaagcgcaacaaggagcagcucuccgacaugaugguccucgacaagcagaagggccucaagucccucuccaaggagaagcgccagaagcucgaggccuaccagcaccucuucuaccuccuccagacccagcccaucuaccucgccaagcucaucuuccagaugccccagaacaagaccaccaaguucauggaggccgucaucuucucccucuacaacuacgccuccucccgccgcgaggccuaccuccuccuccagcucuucaagaccgcccuccaggaggagaucaaguccaaggucgagcagccccaggacgucgucaccggcaaccccaccgucguccgccucgucguccgcuucuaccgcaacggccgcggccaguccgcccuccaggagauccucggcaaggucauccaggacguccucgaggacaagguccucuccguccacaccgaccccguccaccucuacaagaacuggaucaaccagaccgaggcccagaccggccagcgcucccaccuccccuacgacgucacccccgagcaggcccucucccaccccgagguccagcgccgccucgacaucgcccuccgcaaccuccucgccaugaccgacaaguuccuccucgccaucaccuccuccgucgaccagauccccuacggcaugcgcuacgucgccaagguccucaaggccacccucgccgagaaguuccccgacgccaccgacuccgaggucuacaaggucgucggcaaccuccucuacuaccgcuuccucaaccccgccgucgucgcccccgacgccuucgacaucgucgccauggccgccggcggcgcccucgccgccccccagcgccacgcccucggcgccgucgcccagcuccuccagcacgccgccgccggcaaggccuucuccggccagucccagcaccuccgcguccucaacgacuaccucgaggagacccaccucaaguuccgcaaguucauccaccgcgccugccagguccccgagcccgaggagcgcuucgccgucgacgaguacuccgacauggucgccgucgccaagcccauggucuacaucaccgucggcgagcucgucaacacccaccgccuccuccucgagcaccaggacugcaucgcccccgaccaccaggacccccuccacgagcuccucgaggaccucggcgagcuccccaccauccccgaccucaucggcgaguccaucgccgccgacggccacaccgaccucuccaagcucgaggucucccucacccucaccaacaaguucgagggccucgaggccgacgccgacgacuccaacacccgcucccuccuccucuccaccaagcagcuccucgccgacaucauccaguuccaccccggcgacacccucaaggagauccucucccucuccgccucccgcgagcaggaggccgcccacaagcagcucaugucccgccgccaggccugcaccgcccagacccccgagccccuccgccgccaccgcucccucaccgcccacucccuccucccccucgccgagaagcagcgccgcguccuccgcaaccuccgccgccucgaggcccucggccucgucuccgcccgcaacggcuaccagggccucgucgacgagcucgccaaggacauccgcaaccagcaccgccaccgccaccgccgcaaggccgagcucgucaagcuccaggccacccuccagggccucuccaccaagaccaccuucuacgaggagcagggcgacuacuacucccaguacauccgcgccugccucgaccaccucgcccccgacuccaaguccuccggcaagggcaagaagcagcccucccuccacuacaccgccgcccagcuccucgagaagggcguccucgucgagaucgaggaccuccccgccucccacuuccgcaacgucaucuucgacaucacccccggcgacgaggccggcaaguucgaggucaacgccaaguuccucggcgucgacauggagcgcuuccagcuccacuaccaggaccuccuccagcuccaguacgagggcgucgccgucaugaagcucuucaacaaggccaaggucaacgucaaccuccucaucuuccuccucaacaagaaguuccuccgcaaguga

SEQ ID NO: 44734 - RNA, 3345 nt, Artificial Sequence
  derived and/or modified sequence opt2 from IQSEC1__Homo_sapiens__NP_001127854
auggccugccgccgccgcuacuucgucgagggcgaggcccccuccuccgagaccggcaccucccucgacucccccuccgccuacccccagggcccccucguccccggcuccucccucucccccgaccacuacgagcacaccuccgucggcgccuacggccucuacuccggcccccccggccagcagcagcgcacccgccgccccaagcuccagcacuccaccuccauccuccgcaagcaggccgaggaggaggccaucaagcgcucccgcucccucuccgaguccuacgagcucuccuccgaccuccaggacaagcaggucgagaugcucgagcgcaaguacggcggccgccucgucacccgccacgccgcccgcaccauccagaccgccuuccgccaguaccagaugaacaagaacuucgagcgccuccgcuccuccauguccgagaaccgcaugucccgccgcaucguccucuccaacaugcgcaugcaguucuccuucgagggccccgagaagguccacuccuccuacuucgagggcaagcaggucuccgucaccaacgacggcucccagcucggcgcccucgucucccccgagugcggcgaccucuccgagcccaccacccucaagucccccgcccccuccuccgacuucgccgacgccaucaccgagcucgaggacgccuucucccgccaggucaagucccucgccgaguccaucgacgacgcccucaacugccgcucccuccacaccgaggaggcccccgcccucgacgccgcccgcgcccgcgacaccgagccccagaccgcccuccacggcauggaccaccgcaagcucgacgagaugaccgccuccuacuccgacgucacccucuacaucgacgaggaggagcucucccccccccucccccucucccaggccggcgaccgccccuccuccaccgaguccgaccuccgccuccgcgccggcggcgccgcccccgacuacugggcccucgcccacaaggaggacaaggccgacaccgacaccuccugccgcuccacccccucccucgagcgccaggagcagcgccuccgcgucgagcaccucccccuccucaccaucgagccccccuccgacuccuccgucgaccucuccgaccgcuccgagcgcggcucccucaagcgccaguccgccuacgagcgcucccucggcggccagcagggcucccccaagcacggcccccacuccggcgcccccaagucccucccccgcgaggagcccgagcuccgcccccgccccccccgcccccucgacucccaccucgccaucaacggcuccgccaaccgccaguccaaguccgaguccgacuacuccgacggcgacaacgacuccaucaacuccaccuccaacuccaacgacaccaucaacugcuccuccgaguccuccucccgcgacucccuccgcgagcagacccucuccaagcagaccuaccacaaggaggcccgcaacuccugggacucccccgccuucuccaacgacgucauccgcaagcgccacuaccgcaucggccucaaccucuucaacaagaagcccgagaagggcguccaguaccucaucgagcgcggcuucguccccgacacccccgucggcgucgcccacuuccuccuccagcgcaagggccucucccgccagaugaucggcgaguuccucggcaaccgccagaagcaguucaaccgcgacguccucgacugcgucgucgacgagauggacuucuccaccauggagcucgacgaggcccuccgcaaguuccaggcccacauccgcguccagggcgaggcccagaaggucgagcgccucaucgaggccuucucccagcgcuacugcaucugcaaccccggcgucguccgccaguuccgcaaccccgacaccaucuucauccucgccuucgccaucauccuccucaacaccgacauguacucccccaacgucaagcccgagcgcaagaugaagcucgaggacuucaucaagaaccuccgcggcgucgacgacggcgaggacaucccccgcgagaugcucaugggcaucuacgagcgcauccgcaagcgcgagcucaagaccaacgaggaccacgucucccagguccagaaggucgagaagcucaucgucggcaagaagcccaucggcucccuccaccccggccucggcugcguccucucccucccccaccgccgccucgucugcuacugccgccucuucgagguccccgaccccaacaagccccagaagcucggccuccaccagcgcgagaucuuccucuucaacgaccuccucgucgucaccaagaucuuccagaagaagaagaacuccgucaccuacuccuuccgccaguccuucucccucuacggcaugcagguccuccucuucgagaaccaguacuaccccaacggcauccgccucaccuccuccguccccggcgccgacaucaagguccucaucaacuucaacgcccccaacccccaggaccgcaagaaguucaccgacgaccuccgcgaguccaucgccgagguccaggagauggagaagcaccgcaucgaguccgagcucgagaagcagaagggcgucguccgccccuccaugucccagugcuccucccucaagaaggaguccggcaacggcacccucucccgcgccugccucgacgacuccuacgccuccggcgagggccucaagcgcuccgcccucuccuccucccuccgcgaccucuccgaggccggcaagcgcggccgccgcuccuccgccggcucccucgaguccaacgucgagggcuccaucaucuccuccccccacaugcgccgccgcgccaccuccacccgcgagugccccucccgcccccaccagaccaugcccaacuccuccucccuccucggcucccucuucggcuccaagcgcggcaagccccccccccaggcccaccuccccuccgcccccgcccucccccccccccacccccccgucguccucccccaccuccagcacuccgucgccggccaccaccucggcccccccgagggccucccccaggccgccaugcacggccaccacacccaguacugccacaugcagaaccccccccccuaccaccaccaccaccaccaccaccccccccagcacauccagcacgcccaccaguaccaccacggcccccacggcggccaccccgccuacggcgcccacgcccacggccaccccccccuccccuccgcccacgucggccacaccguccaccaccacggccagccccccgccccccccccccccaccuccuccaaggccaagcccuccggcaucuccaccaucgucuga

SEQ ID NO: 44735 - RNA, 4467 nt, Artificial Sequence
  derived and/or modified sequence opt2 from IQSEC2__Homo_sapiens__NP_001104595
auggaggccggcuccggcccccccggcggccccggcuccgagucccccaaccgcgccgucgaguaccuccucgagcucaacaacaucaucgagucccagcagcagcuccucgagacccagcgccgccgcaucgaggagcucgagggccagcucgaccagcucacccaggagaaccgcgaccuccgcgaggagucccagcuccaccgcggcgagcuccaccgcgacccccacggcgcccgcgacucccccggccgcgagucccaguaccagaaccuccgcgagacccaguuccaccaccgcgagcuccgcgagucccaguuccaccaggccgcccgcgacgucggcuaccccaaccgcgagggcgccuaccagaaccgcgaggccgucuaccgcgacaaggagcgcgacgccuccuacccccuccaggacaccaccggcuacaccgcccgcgagcgcgacgucgcccagugccaccuccaccacgagaaccccgcccucggccgcgagcgcggcggccgcgaggccggccccgcccaccccggccgcgagaaggaggccggcuacuccgccgccgucggcgucggcccccgccccccccgcgagcgcggccagcucucccgcggcgccucccgcuccuccucccccggcgccggcggcggccacuccaccuccaccuccaccucccccgccaccacccuccagcgcaaguccgacggcgagaacucccgcaccgucuccgucgagggcgacgcccccggcuccgaccucuccaccgccgucgacucccccggcucccagccccccuaccgccucucccagcucccccccuccuccucccacaugggcggcccccccgccggcgucggccuccccugggcccagcgcgcccgccuccagcccgccuccgucgcccuccgcaagcaggaggaggaggagaucaagcgcuccaaggcccucuccgacuccuacgagcucuccaccgaccuccaggacaagaaggucgagaugcucgagcgcaaguacggcggcuccuuccucucccgccgcgccgcccgcaccauccagaccgccuuccgccaguaccgcaugaacaagaacuucgagcgccuccgcuccuccgccuccgagucccgcaugucccgccgcaucauccucuccaacaugcgcaugcaguucuccuucgaggaguacgagaaggcccagaaccccgccuacuucgagggcaagcccgccucccucgacgagggcgccauggccggcgcccgcucccaccgccucgagcgcggccuccccuacggcggcuccugcggcggcggcaucgacggcggcggcuccuccgucaccaccuccggcgaguucuccaacgacaucaccgagcucgaggacuccuucuccaagcaggucaagucccucgccgaguccaucgacgaggcccucaacugccaccccuccggccccauguccgaggagcccggcuccgcccagcucgagaagcgcgaguccaaggagcagcaggaggacuccuccgccaccuccuucuccgaccucccccucuaccucgacgacaccgucccccagcagucccccgagcgccuccccuccaccgagccccccccccagggccgccccgaguucugggcccccgccccccucccccccguccccccccccguccccuccggcacccgcgaggacggcucccgcgaggagggcacccgccgcggccccggcugccucgagugccgcgacuuccgccuccgcgccgcccaccucccccuccucaccaucgagccccccuccgacuccuccgucgaccucuccgaccgcuccgaccgcggcuccguccaccgccagcucgucuacgaggccgacggcugcuccccccacggcacccucaagcacaagggcccccccggccgcgcccccaucccccaccgccacuaccccgcccccgagggccccgcccccgccccccccggcccccucccccccgcccccaacuccggcaccggccccuccggcgucgccggcggccgccgccucggcaagugcgaggccgccggcgagaacuccgacggcggcgacaacgagucccucgaguccuccuccaacuccaacgagaccaucaacugcuccuccggcuccuccucccgcgacucccuccgcgagccccccgccaccggccucugcaagcagaccuaccagcgcgagacccgccacuccugggacucccccgccuucaacaacgacgucguccagcgccgccacuaccgcaucggccucaaccucuucaacaagaagcccgagaagggcauccaguaccucaucgagcgcggcuuccucuccgacacccccgucggcgucgcccacuucauccucgagcgcaagggccucucccgccagaugaucggcgaguuccucggcaaccgccagaagcaguucaaccgcgacguccucgacugcgucgucgacgagauggacuucuccuccauggaccucgacgacgcccuccgcaaguuccagucccacauccgcguccagggcgaggcccagaaggucgagcgccucaucgaggccuucucccagcgcuacugcgucugcaaccccgcccucguccgccaguuccgcaaccccgacaccaucuucauccucgccuucgccaucauccuccucaacaccgacauguacucccccuccgucaaggccgagcgcaagaugaagcucgacgacuucaucaagaaccuccgcggcgucgacaacggcgaggacaucccccgcgaccuccucgucggcaucuaccagcgcauccagggccgcgagcuccgcaccaacgacgaccacgucucccagguccaggccgucgagcgcaugaucgucggcaagaagcccguccucucccucccccaccgccgccucgucugcugcugccagcucuacgagguccccgaccccaaccgcccccagcgccucggccuccaccagcgcgaggucuuccucuucaacgaccuccucgucgucaccaagaucuuccagaagaagaagauccucgucaccuacuccuuccgccaguccuucccccucgucgagaugcacaugcagcucuuccagaacuccuacuaccaguucggcaucaagcuccucuccgccguccccggcggcgagcgcaagguccucaucaucuucaacgcccccucccuccaggaccgccuccgcuucaccuccgaccuccgcgaguccaucgccgagguccaggagauggagaaguaccgcgucgaguccgagcucgagaagcagaagggcaugaugcgccccaacgccucccagcccggcggcgccaaggacuccgucaacggcaccauggcccgcuccucccucgaggacaccuacggcgccggcgacggccucaagcgcggcgcccucuccuccucccuccgcgaccucuccgacgccggcaagcgcggccgccgcaacuccgucggcucccucgacuccaccaucgagggcuccgucaucuccuccccccgcccccaccagcgcaugcccccccccccccccccccccccccccgaggaguacaagucccagcgccccgucuccaacuccuccuccuuccucggcucccucuucggcuccaagcgcggcaagggccccuuccagaugccccccccccccaccggccaggccuccgccuccuccuccuccgccuccuccacccaccaccaccaccaccaccaccaccacggccacucccacggcggccucggcguccuccccgacggccaguccaagcuccaggcccuccacgcccaguacugccagggccccggccccgcccccccccccuaccuccccccccagcagcccucccuccccccccccccccagcagccccccccccucccccagcucggcuccaucccccccccccccgccuccgccccccccgucggcccccaccgccacuuccacgcccacggccccguccccggcccccagcacuacacccucggccgccccggccgcgccccccgccgcggcgccggcggccacccccaguucgccccccacggccgccacccccuccaccagcccaccuccccccucccccucuacucccccgccccccagcacccccccgcccacaagcagggccccaagcacuucaucuucucccaccacccccagaugaugcccgccgccggcgccgccggcggccccggcucccgcccccccggcggcuccuacucccacccccaccacccccaguccccccucuccccccacucccccauccccccccaccccuccuaccccccccuccccccccccuccccccacaccccccacuccccccucccccccaccuccccccacggcccccuccacgccuccggcccccccggcaccgccaacccccccuccgccaaccccaaggccaagcccucccgcaucuccaccgucgucuga

SEQ ID NO: 44736 - RNA, 3549 nt, Artificial Sequence
  derived and/or modified sequence opt2 from IQSEC3__Homo_sapiens__NP_001164209
auggagucccuccucgagaaccccguccgcgccguccucuaccucaaggagcucaccgccaucguccagaaccagcagucccucauccacacccagcgcgagcgcaucgacgagcucgagcgccgccucgacgagcucuccgccgagaaccgcucccucugggagcaccagcagcuccuccaggcccagcccccccccggccucgucccccccuccuccgccccccuccccgccgcccccgccaccgcccccgccgccgccgcccgcgcccaggagccccuccaggaccagggccagcgcuccgccgccgccccccaccccgcccccgaccgccccccccgccagcaccacggccagcuccucgagcagccccagcgcggccccggcucccgcgcccacaccccccaguccccccacaagcaccucggcacccagggcgccgucaccgacaaggagaaggagcgcccccccuccugcugcgccgccgccggcgcccuccuccagcacaagucccccuccgcccucggcaagggcguccucucccgccgccccgagaacgagaccguccuccaccaguucugcugccccgccgccgacgccugcuccgaccucgccucccaguccgacggcuccugcacccaggccggcggcggcauggaggacuccgucgucgccgccgccgccgucgccgccggccgccccuccgcccacgcccccaaggcccaggcccaggagcuccaggaggaggaggagcgccccggcgccggcgccgccuccccccgcgccggcccccagcacaaggccucccccggccgccagcagcccgcccucgccaccgcccucugcccccacgcccccgccgccuccgacuacgagcucucccucgaccucaagaacaagcagaucgagaugcucgagcacaaguacggcggccaccucgucucccgccgcgccgccugcaccauccagaccgccuuccgccaguaccagcucuccaagaacuucgagaagauccgcaacucccuccucgagucccgccucccccgccgcaucucccuccgcaagguccgcucccccaccgccgagucccucgccgccgagaaggcccucauggagggcuacggccucgucggccucccccucguccgcucccccucccucccccccaccuucgccggcacccucaccgagcucgaggacuccuucaccgagcagguccagucccucgccaaguccaucgacgacgcccucuccaccuggucccucaagaccaugugcucccuccgcgaguccggcgccuaccagcuccaccaggcccuccaggccgccgccggcccccccggccucgaggccgagggccgcgcccccgaguccgccggccccggccccggcgacgacgccgccgagacccccggccucccccccgcccacuccggcacccucaugauggccuuccgcgacgucaccguccagaucgccaaccagaacaucuccgucuccuccuccaccgcccucuccgucgccaacugccucggcgcccagaccguccaggcccccgccgagcccgccgccggcaaggccgagcagggcgagaccuccggccgcgaggcccccgaggcccccgccgucggccgcgaggacgccuccgccgaggacuccugcgccgaggccgccgccuccggcgccgccgacggcgccaccgcccccaagaccgaggaggaggaggaggaggaggagaccgccgaggucggccgcggcgccgaggccgaggccggcgaccucgagcagcucuccuccuccuccaccuccaccaaguccgccaaguccggcuccgaggccuccgccuccgccuccaaggacgcccuccaggccaugauccucucccucccccgcuaccacugcgagaaccccgccuccugcaagucccccacccucuccaccgacacccuccgcaagcgccucuaccgcaucggccucaaccucuucaacaucaaccccgacaagggcauccaguuccucaucucccgcggcuucauccccgacacccccaucggcgucgcccacuuccuccuccagcgcaagggccucucccgccagaugaucggcgaguuccucggcaacuccaagaagcaguucaaccgcgacguccucgacugcgucgucgacgagauggacuucuccuccauggagcucgacgaggcccuccgcaaguuccaggcccacauccgcguccagggcgaggcccagaaggucgagcgccucaucgaggccuucucccagcgcuacugcaugugcaaccccgaggucguccagcaguuccacaaccccgacaccaucuucauccucgccuucgccaucauccuccucaacaccgacauguacucccccaacaucaagcccgaccgcaagaugaugcucgaggacuucauccgcaaccuccgcggcgucgacgacggcgccgacaucccccgcgagcucgucgucggcaucuacgagcgcauccagcagaaggagcucaaguccaacgaggaccacgucaccuacgucaccaaggucgagaaguccaucgucggcaugaagaccguccucuccgucccccaccgccgccucgucugcugcucccgccucuucgaggucaccgacgucaacaagcuccagaagcaggccgcccaccagcgcgaggucuuccucuucaacgaccuccucgucauccucaagcucugccccaagaagaaguccuccuccaccuacaccuucugcaaguccgucggccuccucggcaugcaguuccagcucuucgagaacgaguacuacucccacggcaucacccucgucaccccccucuccggcuccgagaagaagcagguccuccacuucugcgcccucggcuccgacgagaugcagaaguucgucgaggaccucaaggaguccaucgccgaggucaccgagcucgagcagauccgcaucgagugggagcucgagaagcagcagggcaccaagacccucuccuucaagcccugcggcgcccagggcgacccccaguccaagcagggcucccccaccgccaagcgcgaggccgcccuccgcgagcgccccgccgaguccaccgucgaggucuccauccacaaccgccuccagaccucccagcacaacuccggccucggcgccgagcgcggcgcccccguccccccccccgaccuccagcccucccccccccgccagcagacccccccccuccccccccccccccccaccccccccggcacccucguccagugccagcagaucgucaaggucaucguccucgacaagcccugccucgcccgcauggagccccuccucucccaggcccucuccugcuacaccuccuccuccuccgacuccugcggcuccaccccccucggcggccccggcucccccgucaaggucacccaccagcccccccucccccccccccccccccccuacaaccacccccaccaguucugcccccccggcucccuccuccacggccaccgcuacuccuccggcucccgcucccucgucuga

SEQ ID NO: 44737 - RNA, 783 nt, Artificial Sequence
  derived and/or modified sequence opt2 from IRAK1BP1__Homo_sapiens__NP_001010844
augucccuccagaagaccccccccacccgcgucuucgucgagcucguccccugggccgaccgcucccgcgagaacaaccucgccuccggccgcgagacccuccccggccuccgccacccccucuccuccacccaggcccagaccgccacccgcgagguccaggucuccggcaccuccgaggucuccgccggccccgaccgcgcccaggucgucguccgcgucuccuccaccaaggaggccgccgccgaggccaagaaguccgucugccgccgccucgacuacaucacccagucccuccagcagcagggcguccaggccgagaacaucaccgucaccaaggacuuccgccgcgucgagaacgccuaccacauggaggccgaggucugcaucaccuucaccgaguucggcaagaugcagaacaucugcaacuuccucgucgagaagcucgacuccuccgucgucaucucccccccccaguucuaccacacccccggcuccgucgagaaccuccgccgccaggccugccucgucgccgucgagaacgccuggcgcaaggcccaggaggucugcaaccucgucggccagacccucggcaagccccuccucaucaaggaggaggagaccaaggagugggagggccagaucgacgaccaccaguccucccgccucuccuccucccucaccguccagcagaagaucaaguccgccaccauccacgccgccuccaaggucuucaucaccuucgaggucaagggcaaggagaagcgcaagaagcaccucuga

SEQ ID NO: 44738 - RNA, 2049 nt, Artificial Sequence
  derived and/or modified sequence opt2 from IRAK1__Homo_sapiens__NP_001020413
auggccggcggccccggccccggcgagcccgccgcccccggcgcccagcacuuccucuacgaggucccccccugggucaugugccgcuucuacaaggucauggacgcccucgagcccgccgacuggugccaguucgccgcccucaucguccgcgaccagaccgagcuccgccucugcgagcgcuccggccagcgcaccgccuccguccucuggcccuggaucaaccgcaacgcccgcgucgccgaccucguccacauccucacccaccuccagcuccuccgcgcccgcgacaucaucaccgccuggcacccccccgccccccuccccucccccggcaccaccgccccccgccccuccuccauccccgcccccgccgaggccgaggccugguccccccgcaagcuccccuccuccgccuccaccuuccucucccccgccuuccccggcucccagacccacuccggccccgagcucggccucguccccucccccgccucccucuggccccccccccccucccccgcccccuccuccaccaagcccggccccgaguccuccgucucccuccuccagggcgcccgccccuuccccuucugcuggccccucugcgagaucucccgcggcacccacaacuucuccgaggagcucaagaucggcgagggcggcuucggcugcgucuaccgcgccgucaugcgcaacaccgucuacgccgucaagcgccucaaggagaacgccgaccucgaguggaccgccgucaagcaguccuuccucaccgaggucgagcagcucucccgcuuccgccaccccaacaucgucgacuucgccggcuacugcgcccagaacggcuucuacugccucgucuacggcuuccuccccaacggcucccucgaggaccgccuccacugccagacccaggccugccccccccucuccuggccccagcgccucgacauccuccucggcaccgcccgcgccauccaguuccuccaccaggacucccccucccucauccacggcgacaucaaguccuccaacguccuccucgacgagcgccucacccccaagcucggcgacuucggccucgcccgcuucucccgcuucgccggcuccucccccucccaguccuccauggucgcccgcacccagaccguccgcggcacccucgccuaccuccccgaggaguacaucaagaccggccgccucgccgucgacaccgacaccuucuccuucggcgucgucguccucgagacccucgccggccagcgcgccgucaagacccacggcgcccgcaccaaguaccucaaggaccucgucgaggaggaggccgaggaggccggcgucgcccuccgcuccacccaguccacccuccaggccggccucgccgccgacgccugggccgcccccaucgccaugcagaucuacaagaagcaccucgacccccgccccggccccugcccccccgagcucggccucggccucggccagcucgccugcugcugccuccaccgccgcgccaagcgccgcccccccaugacccaggagaacuccuacgucuccuccaccggccgcgcccacuccggcgccgcccccuggcagccccucgccgcccccuccggcgccuccgcccaggccgccgagcagcuccagcgcggccccaaccagcccgucgaguccgacgagucccucggcggccucuccgccgcccuccgcuccuggcaccucacccccuccugcccccucgaccccgccccccuccgcgaggccggcugcccccagggcgacaccgccggcgaguccuccuggggcuccggccccggcucccgccccaccgccgucgagggccucgcccucggcuccuccgccuccuccuccuccgagcccccccagaucaucaucaaccccgcccgccagaagaugguccagaagcucgcccucuacgaggacggcgcccucgacucccuccagcuccucuccuccuccucccuccccggccucggccucgagcaggaccgccagggccccgaggaguccgacgaguuccaguccuga

SEQ ID NO: 44739 - RNA, 1878 nt, Artificial Sequence
  derived and/or modified sequence opt2 from IRAK2__Homo_sapiens__NP_001561
auggccugcuacaucuaccagcuccccuccuggguccucgacgaccucugccgcaacauggacgcccucuccgagugggacuggauggaguucgccuccuacgucaucaccgaccucacccagcuccgcaagaucaaguccauggagcgcguccagggcgucuccaucacccgcgagcuccucuggugguggggcaugcgccaggccaccguccagcagcucgucgaccuccucugccgccucgagcucuaccgcgccgcccagaucauccucaacuggaagcccgcccccgagauccgcugccccauccccgccuuccccgacuccgucaagcccgagaagccccucgccgccuccguccgcaaggccgaggacgagcaggaggagggccagcccguccgcauggccaccuuccccggccccggcuccucccccgcccgcgcccaccagcccgccuuccuccagccccccgaggaggacgccccccacucccuccgcuccgaccuccccaccuccuccgacuccaaggacuucuccaccuccauccccaagcaggagaagcuccucucccucgccggcgacucccucuucugguccgaggccgacgucguccaggccaccgacgacuucaaccagaaccgcaagaucucccagggcaccuucgccgacgucuaccgcggccaccgccacggcaagcccuucgucuucaagaagcuccgcgagaccgccugcuccucccccggcuccaucgagcgcuucuuccaggccgagcuccagaucugccuccgcugcugccaccccaacguccuccccguccucggcuucugcgccgcccgccaguuccacuccuucaucuaccccuacauggccaacggcucccuccaggaccgccuccagggccagggcggcuccgacccccuccccuggccccagcgcgucuccaucugcuccggccuccucugcgccgucgaguaccuccacggccucgagaucauccacuccaacgucaaguccuccaacguccuccucgaccagaaccucacccccaagcucgcccaccccauggcccaccucugccccgucaacaagcgcuccaaguacaccaugaugaagacccaccuccuccgcaccuccgccgccuaccuccccgaggacuucauccgcgucggccagcucaccaagcgcgucgacaucuucuccugcggcaucguccucgccgagguccucaccggcauccccgccauggacaacaaccgcucccccgucuaccucaaggaccuccuccucuccgacauccccuccuccaccgccucccucugcucccgcaagaccggcgucgagaacgucauggccaaggagaucugccagaaguaccucgagaagggcgccggccgccuccccgaggacugcgccgaggcccucgccaccgccgccugccucugccuccgccgccgcaacaccucccuccaggaggucugcggcuccgucgccgccgucgaggagcgccuccgcggccgcgagacccuccuccccugguccggccucuccgagggcaccggcuccuccuccaacacccccgaggagaccgacgacgucgacaacuccucccucgacgccuccuccuccauguccgucgcccccugggccggcgccgccaccccccuccuccccaccgagaacggcgagggccgccuccgcgucaucgucggccgcgaggccgacuccuccuccgaggccugcgucggccucgagcccccccaggacgucaccgagaccuccuggcagaucgagaucaacgaggccaagcgcaagcucauggagaacauccuccucuacaaggaggagaaggucgacuccaucgagcucuucggccccuga

SEQ ID NO: 44740 - RNA, 1608 nt, Artificial Sequence
  derived and/or modified sequence opt2 from IRAK3__Homo_sapiens__NP_001135995
auggccggcaacugcggcgcccgcggcgcccucuccgcccacacccuccucuucgaccucccccccgcccuccucggcgagcucugcgccguccucgacuccugcgacggcgcccucggcuggcgcggccucggcgccguccucucccccuccgagaaguccuaccaggagggcggcuuccccaacauccucuucaaggagaccgccaacgucaccgucgacaacguccucauccccgagcacaacgagaagggcauccuccucaaguccuccaucuccuuccagaacaucaucgagggcacccgcaacuuccacaaggacuuccucaucggcgagggcgagaucuucgaggucuaccgcgucgagauccagaaccucaccuacgccgucaagcucuucaagcaggagaagaagaugcagugcaagaagcacuggaagcgcuuccucuccgagcucgagguccuccuccucuuccaccaccccaacauccucgagcucgccgccuacuucaccgagaccgagaaguucugccucaucuaccccuacaugcgcaacggcacccucuucgaccgccuccagugcgucggcgacaccgccccccuccccuggcacauccgcaucggcauccucaucggcaucuccaaggccauccacuaccuccacaacguccagcccugcuccgucaucugcggcuccaucuccuccgccaacauccuccucgacgaccaguuccagcccaagcucaccgacuucgccauggcccacuuccgcucccaccucgagcaccaguccugcaccaucaacaugaccuccuccuccuccaagcaccucugguacaugcccgaggaguacauccgccagggcaagcucuccaucaagaccgacgucuacuccuucggcaucgucaucauggagguccucaccggcugccgcgucguccucgacgaccccaagcacauccagcuccgcgaccuccuccgcgagcucauggagaagcgcggccucgacuccugccucuccuuccucgacaagaaggucccccccugcccccgcaacuucuccgccaagcucuucugccucgccggccgcugcgccgccacccgcgccaagcuccgccccuccauggacgagguccucaacacccucgaguccacccaggccucccucuacuucgccgaggacccccccaccucccucaaguccuuccgcugccccuccccccucuuccucgagaacguccccuccauccccgucgaggacgacgagucccagaacaacaaccuccuccccuccgacgagggccuccgcaucgaccgcaugacccagaagacccccuucgagugcucccaguccgaggucauguuccucucccucgacaagaagcccgaguccaagcgcaacgaggaggccugcaacaugcccuccuccuccugcgaggaguccugguuccccaaguacaucguccccucccaggaccuccgccccuacaaggucaacaucgaccccuccuccgaggcccccggccacuccugccgcucccgccccgucgaguccuccugcuccuccaaguucuccugggacgaguacgagcaguacaagaaggaguga

SEQ ID NO: 44741 - RNA, 1011 nt, Artificial Sequence
  derived and/or modified sequence opt2 from IRAK4__Homo_sapiens__NP_001138728
augcccuucugcgacaaggaccgcacccucaugacccccguccagaaccucgagcaguccuacaugccccccgacuccuccucccccgagaacaagucccucgaggucuccgacacccgcuuccacuccuucuccuucuacgagcucaagaacgucaccaacaacuucgacgagcgccccaucuccgucggcggcaacaagaugggcgagggcggcuucggcgucgucuacaagggcuacgucaacaacaccaccgucgccgucaagaagcucgccgccauggucgacaucaccaccgaggagcucaagcagcaguucgaccaggagaucaaggucauggccaagugccagcacgagaaccucgucgagcuccucggcuucuccuccgacggcgacgaccucugccucgucuacgucuacaugcccaacggcucccuccucgaccgccucuccugccucgacggcacccccccccucuccuggcacaugcgcugcaagaucgcccagggcgccgccaacggcaucaacuuccuccacgagaaccaccacauccaccgcgacaucaaguccgccaacauccuccucgacgaggccuucaccgccaagaucuccgacuucggccucgcccgcgccuccgagaaguucgcccagaccgucaugaccucccgcaucgucggcaccaccgccuacauggcccccgaggcccuccgcggcgagaucacccccaaguccgacaucuacuccuucggcgucguccuccucgagaucaucaccggccuccccgccgucgacgagcaccgcgagccccagcuccuccucgacaucaaggaggagaucgaggacgaggagaagaccaucgaggacuacaucgacaagaagaugaacgacgccgacuccaccuccgucgaggccauguacuccgucgccucccagugccuccacgagaagaagaacaagcgccccgacaucaagaagguccagcagcuccuccaggagaugaccgccuccuga

SEQ ID NO: 44742 - RNA, 2892 nt, Artificial Sequence
  derived and/or modified sequence opt2 from IREB2__Homo_sapiens__NP_004127
auggacgcccccaaggccggcuacgccuucgaguaccucaucgagacccucaacgacuccucccacaagaaguucuucgacgucuccaagcucggcaccaaguacgacguccuccccuacuccauccgcguccuccucgaggccgccguccgcaacugcgacggcuuccucaugaagaaggaggacgucaugaacauccucgacuggaagaccaagcaguccaacgucgagguccccuucuuccccgcccgcguccuccuccaggacuucaccggcauccccgccauggucgacuucgccgccaugcgcgaggccgucaagacccucggcggcgaccccgagaagguccaccccgccugccccaccgaccucaccgucgaccacucccuccagaucgacuucuccaagugcgccauccagaacgcccccaaccccggcggcggcgaccuccagaaggccggcaagcucuccccccucaagguccagcccaagaagcuccccugccgcggccagaccaccugccgcggcuccugcgacuccggcgagcucggccgcaacuccggcaccuucuccucccagaucgagaacacccccauccucugccccuuccaccuccagcccguccccgagcccgagaccguccucaagaaccaggaggucgaguucggccgcaaccgcgagcgccuccaguucuucaagugguccucccgcgucuucaagaacgucgccgucaucccccccggcaccggcauggcccaccagaucaaccucgaguaccucucccgcgucgucuucgaggagaaggaccuccucuuccccgacuccgucgucggcaccgacucccacaucaccauggucaacggccucggcauccucggcuggggcgucggcggcaucgagaccgaggccgucaugcucggccuccccgucucccucacccuccccgaggucgucggcugcgagcucaccggcuccuccaaccccuucgucaccuccaucgacgucguccucggcaucaccaagcaccuccgccaggucggcgucgccggcaaguucgucgaguucuucggcuccggcgucucccagcucuccaucgucgaccgcaccaccaucgccaacaugugccccgaguacggcgccauccucuccuucuuccccgucgacaacgucacccucaagcaccucgagcacaccggcuucuccaaggccaagcucgaguccauggagaccuaccucaaggccgucaagcucuuccgcaacgaccagaacuccuccggcgagcccgaguacucccaggucauccagaucaaccucaacuccaucguccccuccgucuccggccccaagcgcccccaggaccgcgucgccgucaccgacaugaaguccgacuuccaggccugccucaacgagaaggucggcuucaagggcuuccagaucgccgccgagaagcagaaggacaucgucuccauccacuacgagggcuccgaguacaagcucucccacggcuccgucgucaucgccgccgucaucuccugcaccaacaacugcaaccccuccgucaugcucgccgccggccuccucgccaagaaggccgucgaggccggccuccgcgucaagcccuacauccgcaccucccucucccccggcuccggcauggucacccacuaccucuccuccuccggcguccuccccuaccucuccaagcucggcuucgagaucgucggcuacggcugcuccaccugcgucggcaacaccgccccccucuccgacgccguccucaacgccgucaagcagggcgaccucgucaccugcggcauccucuccggcaacaagaacuucgagggccgccucugcgacugcguccgcgccaacuaccucgccucccccccccucgucgucgccuacgccaucgccggcaccgucaacaucgacuuccagaccgagccccucggcaccgaccccaccggcaagaacaucuaccuccacgacaucuggcccucccgcgaggagguccaccgcgucgaggaggagcacgucauccucuccauguucaaggcccucaaggacaagaucgagaugggcaacaagcgcuggaacucccucgaggcccccgacuccguccucuuccccugggaccucaaguccaccuacauccgcugccccuccuucuucgacaagcucaccaaggagcccaucgcccuccaggccaucgagaacgcccacguccuccucuaccucggcgacuccgucaccaccgaccacaucucccccgccggcuccaucgcccgcaacuccgccgccgccaaguaccucaccaaccgcggccucaccccccgcgaguucaacuccuacggcgcccgccgcggcaacgacgccgucaugacccgcggcaccuucgccaacaucaagcucuucaacaaguucaucggcaagcccgcccccaagaccauccacuuccccuccggccagacccucgacgucuucgaggccgccgagcucuaccagaaggagggcaucccccucaucauccucgccggcaagaaguacggcuccggcaacucccgcgacugggccgccaagggccccuaccuccucggcgucaaggccguccucgccgaguccuacgagaagauccacaaggaccaccucaucggcaucggcaucgccccccuccaguuccuccccggcgagaacgccgacucccucggccucuccggccgcgagaccuucucccucaccuuccccgaggagcucucccccggcaucacccucaacauccagaccuccaccggcaaggucuucuccgucaucgccuccuucgaggacgacgucgagaucacccucuacaagcacggcggccuccucaacuucgucgcccgcaaguucuccuga

SEQ ID NO: 44743 - RNA, 978 nt, Artificial Sequence
  derived and/or modified sequence opt2 from IRF1__Homo_sapiens__NP_002189
augcccaucacccgcaugcgcaugcgccccuggcucgagaugcagaucaacuccaaccagauccccggccucaucuggaucaacaaggaggagaugaucuuccagauccccuggaagcacgccgccaagcacggcugggacaucaacaaggacgccugccucuuccgcuccugggccauccacaccggccgcuacaaggccggcgagaaggagcccgaccccaagaccuggaaggccaacuuccgcugcgccaugaacucccuccccgacaucgaggaggucaaggaccagucccgcaacaagggcuccuccgccguccgcgucuaccgcaugcuccccccccucaccaagaaccagcgcaaggagcgcaaguccaaguccucccgcgacgccaaguccaaggccaagcgcaaguccugcggcgacuccucccccgacaccuucuccgacggccucuccuccuccacccuccccgacgaccacuccuccuacaccguccccggcuacaugcaggaccucgaggucgagcaggcccucacccccgcccucucccccugcgccgucuccuccacccuccccgacuggcacauccccgucgaggucguccccgacuccaccuccgaccucuacaacuuccaggucucccccaugcccuccaccuccgaggccaccaccgacgaggacgaggagggcaagcuccccgaggacaucaugaagcuccucgagcaguccgaguggcagcccaccaacgucgacggcaagggcuaccuccucaacgagcccggcguccagcccaccuccgucuacggcgacuucuccugcaaggaggagcccgagaucgacucccccggcggcgacaucggccucucccuccagcgcgucuucaccgaccucaagaacauggacgccaccuggcucgacucccuccucacccccguccgccuccccuccauccaggccauccccugcgcccccuga

SEQ ID NO: 44744 - RNA, 1716 nt, Artificial Sequence
  derived and/or modified sequence opt2 from IRF2BP2__Homo_sapiens__NP_001070865
auggccgccgccgucgccgucgccgccgccucccgccgccaguccugcuaccucugcgaccucccccgcaugcccugggccaugaucugggacuucaccgagcccgucugccgcggcugcgucaacuacgagggcgccgaccgcgucgaguucgucaucgagaccgcccgccagcucaagcgcgcccacggcugcuuccccgagggccgcuccccccccggcgccgccgccuccgccgccgccaagccccccccccucuccgccaaggacauccuccuccagcagcagcagcagcucggccacggcggccccgaggccgccccccgcgccccccaggcccucgagcgcuacccccucgccgccgccgccgagcgccccccccgccucggcuccgacuucggcuccucccgccccgccgccucccucgcccagccccccaccccccagcccccccccgucaacggcauccucguccccaacggcuucuccaagcucgaggagccccccgagcucaaccgccagucccccaacccccgccgcggccacgccgucccccccacccucgucccccucaugaacggcuccgccaccccccuccccaccgcccucggccucggcggccgcgccgccgccucccucgccgccgucuccggcaccgccgccgccucccucggcuccgcccagcccaccgaccucggcgcccacaagcgccccgccuccgucuccuccuccgccgccgucgagcacgagcagcgcgaggccgccgccaaggagaagcagccccccccccccgcccaccgcggccccgccgacucccucuccaccgccgccggcgccgccgagcucuccgccgagggcgccggcaagucccgcggcuccggcgagcaggacugggucaaccgccccaagaccguccgcgacacccuccucgcccuccaccagcacggccacuccggccccuucgaguccaaguucaagaaggagcccgcccucaccgccgucgcccgcaccgcccgcaagcgcaagcccucccccgagcccgagggcgaggucggcccccccaagaucaacggcgaggcccagcccuggcucuccaccuccaccgagggccucaagauccccaugacccccaccuccuccuucgucuccccccccccccccaccgccuccccccacuccaaccgcaccaccccccccgaggccgcccagaacggccagucccccauggccgcccucauccucgucgccgacaacgccggcggcucccacgccuccaaggacgccaaccagguccacuccaccacccgccgcaacuccaacuccccccccucccccuccuccaugaaccagcgccgccucggcccccgcgaggucggcggccagggcgccggcaacaccggcggccucgagcccguccaccccgccucccuccccgacuccucccucgccaccuccgccccccucugcugcacccucugccacgagcgccucgaggacacccacuucguccagugccccuccguccccucccacaaguucugcuuccccugcucccgccaguccaucaagcagcagggcgccuccggcgaggucuacugccccuccggcgagaagugcccccucgucggcuccaacguccccugggccuucaugcagggcgagaucgccaccauccucgccggcgacgucaaggucaagaaggagcgcgacuccuga

SEQ ID NO: 44745 - RNA, 2391 nt, Artificial Sequence
  derived and/or modified sequence opt2 from IRF2BPL__Homo_sapiens__NP_078772
auguccgccgcccaggucuccuccucccgccgccaguccugcuaccucugcgaccucccccgcaugcccugggccaugaucugggacuucuccgagcccgucugccgcggcugcgucaacuacgagggcgccgaccgcaucgaguucgucaucgagaccgcccgccagcucaagcgcgcccacggcugcuuccaggacggccgcucccccggcccccccccccccgucggcgucaagaccgucgcccucuccgccaaggaggccgccgccgccgccgccgccgccgccgccgccgccgccgccgcccagcagcagcagcagcagcagcagcagcagcagcagcagcagcagcagcagcagcagcagcagcagcagcagcagcucaaccacgucgacggcuccuccaagcccgccguccucgccgcccccuccggccucgagcgcuacggccucuccgccgccgccgccgccgccgccgccgccgccgccgccgucgagcagcgcucccgcuucgaguacccccccccccccgucucccucggcuccuccucccacaccgcccgccuccccaacggccucggcggccccaacggcuuccccaagcccacccccgaggagggcccccccgagcucaaccgccagucccccaacuccuccuccgccgccgccuccgucgccucccgccgcggcacccacggcggccucgucaccggccuccccaaccccggcggcggcggcggcccccagcucaccgucccccccaaccuccucccccagacccuccucaacggccccgccuccgccgccguccucccccccccccccccccacgcccucggcucccgcggcccccccacccccgccccccccggcgcccccggcggccccgccugccucggcggcacccccggcgucuccgccaccuccuccuccgccuccuccuccaccuccuccuccgucgccgaggucggcgucggcgccggcggcaagcgccccggcuccgucuccuccaccgaccaggagcgcgagcucaaggagaagcagcgcaacgccgaggcccucgccgagcucuccgagucccuccgcaaccgcgccgaggagugggccuccaagcccaagaugguccgcgacacccuccucacccucgccggcugcacccccuacgagguccgcuucaagaaggaccacucccuccucggccgcgucuucgccuucgacgccgucuccaagcccggcauggacuacgagcucaagcucuucaucgaguaccccaccggcuccggcaacgucuacuccuccgccuccggcgucgccaagcagauguaccaggacugcaugaaggacuucggccgcggccucuccuccggcuucaaguaccucgaguacgagaagaagcacggcuccggcgacuggcgccuccucggcgaccuccuccccgaggccguccgcuucuucaaggagggcguccccggcgccgacaugcucccccagcccuaccucgacgccuccugccccaugcuccccaccgcccucgucucccucucccgcgcccccuccgccccccccggcaccggcgcccucccccccgccgcccccuccggccgcggcgccgccgccucccuccgcaagcgcaaggccucccccgagccccccgacuccgccgagggcgcccucaagcucggcgaggagcagcagcgccagcaguggauggccaaccaguccgaggcccucaagcucaccauguccgccggcggcuucgccgcccccggccacgccgccggcggcccccccccccccccccccccccucggcccccacuccaaccgcaccaccccccccgaguccgccccccagaacggccccucccccauggccgcccucauguccgucgccgacacccucggcaccgcccacucccccaaggacggcuccuccguccacuccaccaccgccuccgcccgccgcaacuccuccucccccgucucccccgccuccguccccggccagcgccgccucgccucccgcaacggcgaccucaaccuccaggucgccccccccccccccuccgcccaccccggcauggaccagguccacccccagaacauccccgacucccccauggccaacuccggcccccucugcugcaccaucugccacgagcgccucgaggacacccacuucguccagugccccuccguccccucccacaaguucugcuuccccugcucccgcgaguccaucaaggcccagggcgccaccggcgaggucuacugccccuccggcgagaagugcccccucgucggcuccaacguccccugggccuucaugcagggcgagaucgccaccauccucgccggcgacgucaaggucaagaaggagcgcgaccccuga

SEQ ID NO: 44746 - RNA, 1050 nt, Artificial Sequence
  derived and/or modified sequence opt2 from IRF2__Homo_sapiens__NP_002190
augcccgucgagcgcaugcgcaugcgccccuggcucgaggagcagaucaacuccaacaccauccccggccucaaguggcucaacaaggagaagaagaucuuccagauccccuggaugcacgccgcccgccacggcugggacgucgagaaggacgccccccucuuccgcaacugggccauccacaccggcaagcaccagcccggcgucgacaagcccgaccccaagaccuggaaggccaacuuccgcugcgccaugaacucccuccccgacaucgaggaggucaaggacaaguccaucaagaagggcaacaacgccuuccgcgucuaccgcaugcucccccucuccgagcgccccuccaagaagggcaagaagcccaagaccgagaaggaggacaaggucaagcacaucaagcaggagcccgucgaguccucccucggccucuccaacggcgucuccgaccucucccccgaguacgccguccucaccuccaccaucaagaacgaggucgacuccaccgucaacaucaucgucgucggccagucccaccucgacuccaacaucgagaaccaggagaucgucaccaacccccccgacaucugccaggucgucgaggucaccaccgaguccgacgagcagcccgucuccauguccgagcucuacccccuccagaucucccccgucuccuccuacgccgaguccgagaccaccgacuccguccccuccgacgaggaguccgccgagggccgcccccacuggcgcaagcgcaacaucgagggcaagcaguaccucuccaacaugggcacccgcggcuccuaccuccuccccggcauggccuccuucgucaccuccaacaagcccgaccuccaggucaccaucaaggaggaguccaaccccguccccuacaacuccuccuggccccccuuccaggaccucccccucuccuccuccaugacccccgccuccuccuccucccgccccgaccgcgagacccgcgccuccgucaucaagaagaccuccgacaucacccaggcccgcgucaaguccugcuga

SEQ ID NO: 44747 - RNA, 1179 nt, Artificial Sequence
  derived and/or modified sequence opt2 from IRF3__Homo_sapiens__NP_001184052
auggucggccgcaagcagggcugguccugccgcgucaccggcaucaagcccggcaagcccgccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccucuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucgaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgaguccuga

SEQ ID NO: 44748 - RNA, 1353 nt, Artificial Sequence
  derived and/or modified sequence opt2 from IRF4__Homo_sapiens__NP_001182215
augaaccucgagggcggcggccgcggcggcgaguucggcauguccgccgucuccugcggcaacggcaagcuccgccaguggcucaucgaccagaucgacuccggcaaguaccccggccucgucugggagaacgaggagaaguccaucuuccgcauccccuggaagcacgccggcaagcaggacuacaaccgcgaggaggacgccgcccucuucaaggccugggcccucuucaagggcaaguuccgcgagggcaucgacaagcccgacccccccaccuggaagacccgccuccgcugcgcccucaacaaguccaacgacuucgaggagcucgucgagcgcucccagcucgacaucuccgaccccuacaaggucuaccgcaucguccccgagggcgccaagaagggcgccaagcagcucacccucgaggacccccagauguccaugucccaccccuacaccaugaccacccccuaccccucccuccccgcccagguccacaacuacaugaugcccccccucgaccgcuccuggcgcgacuacguccccgaccagccccaccccgagauccccuaccagugccccaugaccuucggcccccgcggccaccacuggcagggccccgccugcgagaacggcugccaggucaccggcaccuucuacgccugcgccccccccgagucccaggcccccggcguccccaccgagcccuccauccgcuccgccgaggcccucgccuucuccgacugccgccuccacaucugccucuacuaccgcgagauccucgucaaggagcucaccaccuccucccccgagggcugccgcaucucccacggccacaccuacgacgccuccaaccucgaccagguccucuuccccuaccccgaggacaacggccagcgcaagaacaucgagaagcuccucucccaccucgagcgcggcgucguccucuggauggcccccgacggccucuacgccaagcgccucugccagucccgcaucuacugggacggcccccucgcccucugcaacgaccgccccaacaagcucgagcgcgaccagaccugcaagcucuucgacacccagcaguuccucuccgagcuccaggccuucgcccaccacggccgcucccucccccgcuuccaggucacccucugcuucggcgaggaguuccccgacccccagcgccagcgcaagcucaucaccgcccacgucgagccccuccucgcccgccagcucuacuacuucgcccagcagaacuccggccacuuccuccgcggcuacgaccuccccgagcacaucuccaaccccgaggacuaccaccgcuccauccgccacuccuccauccaggaguga

SEQ ID NO: 44749 - RNA, 1497 nt, Artificial Sequence
  derived and/or modified sequence opt2 from IRF5__Homo_sapiens__NP_001092097
augaaccaguccauccccgucgcccccacccccccccgccgcguccgccucaagcccuggcucgucgcccaggucaacuccugccaguaccccggccuccagugggucaacggcgagaagaagcucuucugcauccccuggcgccacgccacccgccacggccccucccaggacggcgacaacaccaucuucaaggccugggccaaggagaccggcaaguacaccgagggcgucgacgaggccgaccccgccaaguggaaggccaaccuccgcugcgcccucaacaagucccgcgacuuccgccucaucuacgacggcccccgcgacaugcccccccagcccuacaagaucuacgaggucugcuccaacggccccgcccccaccgacucccagccccccgaggacuacuccuucggcgccggcgaggaggaggaggaggaggaggagcuccagcgcaugcuccccucccucucccucaccgaggacgucaaguggccccccacccuccagccccccacccuccgcccccccacccuccagccccccacccuccagccccccgucguccucggcccccccgcccccgaccccuccccccucgcccccccccccggcaaccccgccggcuuccgcgagcuccucuccgagguccucgagcccggcccccuccccgccucccucccccccgccggcgagcagcuccuccccgaccuccucaucuccccccacaugcucccccucaccgaccucgagaucaaguuccaguaccgcggccgccccccccgcgcccucaccaucuccaacccccacggcugccgccucuucuacucccagcucgaggccacccaggagcaggucgagcucuucggccccaucucccucgagcagguccgcuuccccucccccgaggacauccccuccgacaagcagcgcuucuacaccaaccagcuccucgacguccucgaccgcggccucauccuccagcuccagggccaggaccucuacgccauccgccucugccagugcaaggucuucugguccggccccugcgccuccgcccacgacuccugccccaaccccauccagcgcgaggucaagaccaagcucuucucccucgagcacuuccucaacgagcucauccucuuccagaagggccagaccaacacccccccccccuucgagaucuucuucugcuucggcgaggaguggcccgaccgcaagccccgcgagaagaagcucaucaccguccaggucguccccgucgccgcccgccuccuccucgagauguucuccggcgagcucuccugguccgccgacuccauccgccuccagaucuccaaccccgaccucaaggaccgcauggucgagcaguucaaggagcuccaccacaucuggcagucccagcagcgccuccagcccgucgcccaggccccccccggcgccggccucggcgucggccagggccccuggcccaugcaccccgccggcaugcaguga

SEQ ID NO: 44750 - RNA, 1119 nt, Artificial Sequence
  derived and/or modified sequence opt2 from IRF6__Homo_sapiens__NP_001193625
auguacgacggcaccaaggagguccccaugaaccccgucaagaucuaccaggucugcgacaucccccagccccagggcuccaucaucaaccccggcuccaccggcuccgcccccugggacgagaaggacaacgacgucgacgaggaggacgaggaggacgagcucgaccagucccagcaccacguccccauccaggacaccuuccccuuccucaacaucaacggcucccccauggcccccgccuccgucggcaacugcuccgucggcaacugcucccccgaggccgucuggcccaagaccgagccccucgagauggaggucccccaggcccccauccagcccuucuacuccucccccgagcucuggaucuccucccuccccaugaccgaccucgacaucaaguuccaguaccgcggcaaggaguacggccagaccaugaccgucuccaacccccagggcugccgccucuucuacggcgaccucggccccaugcccgaccaggaggagcucuucggccccgucucccucgagcaggucaaguuccccggccccgagcacaucaccaacgagaagcagaagcucuucaccuccaagcuccucgacgucauggaccgcggccucauccucgaggucuccggccacgccaucuacgccauccgccucugccagugcaaggucuacugguccggccccugcgcccccucccucgucgcccccaaccucaucgagcgccagaagaaggucaagcucuucugccucgagaccuuccucuccgaccucaucgcccaccagaagggccagaucgagaagcagccccccuucgagaucuaccucugcuucggcgaggaguggcccgacggcaagccccucgagcgcaagcucauccucguccaggucauccccgucgucgcccgcaugaucuacgagauguucuccggcgacuucacccgcuccuucgacuccggcuccguccgccuccagaucuccacccccgacaucaaggacaacaucgucgcccagcucaagcagcucuaccgcauccuccagacccaggaguccuggcagcccaugcagcccacccccuccaugcagcucccccccgcccuccccccccaguga

SEQ ID NO: 44751 - RNA, 1512 nt, Artificial Sequence
  derived and/or modified sequence opt2 from IRF7__Homo_sapiens__NP_001563
auggcccucgcccccgagcgcgccgccccccgcguccucuucggcgaguggcuccucggcgagaucuccuccggcugcuacgagggccuccaguggcucgacgaggcccgcaccugcuuccgcguccccuggaagcacuucgcccgcaaggaccucuccgaggccgacgcccgcaucuucaaggccugggccgucgcccgcggccgcuggccccccuccucccgcggcggcggccccccccccgaggccgagaccgccgagcgcgccggcuggaagaccaacuuccgcugcgcccuccgcuccacccgccgcuucgucaugcuccgcgacaacuccggcgaccccgccgacccccacaaggucuacgcccucucccgcgagcucugcuggcgcgagggccccggcaccgaccagaccgaggccgaggcccccgccgccgucccccccccccagggcggcccccccggccccuuccucgcccacacccacgccggccuccaggcccccggcccccuccccgcccccgccggcgacaagggcgaccuccuccuccaggccguccagcaguccugccucgccgaccaccuccucaccgccuccuggggcgccgaccccguccccaccaaggcccccggcgagggccaggagggccucccccucaccggcgccugcgccggcggccccggccuccccgccggcgagcucuacggcugggccgucgagaccacccccucccccggcccccagcccgccgcccucaccaccggcgaggccgccgcccccgaguccccccaccaggccgagcccuaccucucccccucccccuccgccugcaccgccguccaggagcccucccccggcgcccucgacgucaccaucauguacaagggccgcaccguccuccagaaggucgucggccaccccuccugcaccuuccucuacggcccccccgaccccgccguccgcgccaccgacccccagcaggucgccuuccccucccccgccgagcuccccgaccagaagcagcuccgcuacaccgaggagcuccuccgccacgucgcccccggccuccaccucgagcuccgcggcccccagcucugggcccgccgcaugggcaagugcaaggucuacugggaggucggcggcccccccggcuccgccucccccuccacccccgccugccuccucccccgcaacugcgacacccccaucuucgacuuccgcgucuucuuccaggagcucgucgaguuccgcgcccgccagcgccgcggcuccccccgcuacaccaucuaccucggcuucggccaggaccucuccgccggccgccccaaggagaagucccucguccucgucaagcucgagcccuggcucugccgcguccaccucgagggcacccagcgcgagggcgucuccucccucgacuccuccucccucucccucugccucuccuccgccaacucccucuacgacgacaucgagugcuuccucauggagcucgagcagcccgccuga

SEQ ID NO: 44752 - RNA, 1281 nt, Artificial Sequence
  derived and/or modified sequence opt2 from IRF8__Homo_sapiens__NP_002154
augugcgaccgcaacggcggccgccgccuccgccaguggcucaucgagcagaucgacuccuccauguaccccggccucaucugggagaacgaggagaaguccauguuccgcauccccuggaagcacgccggcaagcaggacuacaaccaggaggucgacgccuccaucuucaaggccugggccgucuucaagggcaaguucaaggagggcgacaaggccgagcccgccaccuggaagacccgccuccgcugcgcccucaacaagucccccgacuucgaggaggucaccgaccgcucccagcucgacaucuccgagcccuacaaggucuaccgcaucguccccgaggaggagcagaagugcaagcucggcgucgccaccgccggcugcgucaacgaggucaccgagauggagugcggccgcuccgagaucgacgagcucaucaaggagcccuccgucgacgacuacaugggcaugaucaagcgcucccccuccccccccgaggccugccgcucccagcuccuccccgacuggugggcccagcagcccuccaccggcgucccccucgucaccggcuacaccaccuacgacgcccaccacuccgccuucucccagauggucaucuccuucuacuacggcggcaagcucgucggccaggccaccaccaccugccccgagggcugccgccucucccucucccagcccggccuccccggcaccaagcucuacggccccgagggccucgagcucguccgcuucccccccgccgacgccauccccuccgagcgccagcgccaggucacccgcaagcucuucggccaccucgagcgcggcguccuccuccacuccucccgccagggcgucuucgucaagcgccucugccagggccgcgucuucugcuccggcaacgccgucgucugcaagggccgccccaacaagcucgagcgcgacgaggucguccaggucuucgacaccucccaguucuuccgcgagcuccagcaguucuacaacucccagggccgccuccccgacggccgcgucguccucugcuucggcgaggaguuccccgacauggccccccuccgcuccaagcucauccucguccagaucgagcagcucuacguccgccagcucgccgaggaggccggcaaguccugcggcgccggcuccgucaugcaggcccccgaggagcccccccccgaccaggucuuccgcauguuccccgacaucugcgccucccaccagcgcuccuucuuccgcgagaaccagcagaucaccgucuga

SEQ ID NO: 44753 - RNA, 1182 nt, Artificial Sequence
  derived and/or modified sequence opt2 from IRF9__Homo_sapiens__NP_006075
auggccuccggccgcgcccgcugcacccgcaagcuccgcaacugggucgucgagcaggucgaguccggccaguuccccggcgucugcugggacgacaccgccaagaccauguuccgcauccccuggaagcacgccggcaagcaggacuuccgcgaggaccaggacgccgccuucuucaaggccugggccaucuucaagggcaaguacaaggagggcgacaccggcggccccgccgucuggaagacccgccuccgcugcgcccucaacaaguccuccgaguucaaggagguccccgagcgcggccgcauggacgucgccgagcccuacaaggucuaccagcuccucccccccggcaucgucuccggccagcccggcacccagaagguccccuccaagcgccagcacuccuccgucuccuccgagcgcaaggaggaggaggacgccaugcagaacugcacccucucccccuccguccuccaggacucccucaacaacgaggaggagggcgccuccggcggcgccguccacuccgacaucggcuccuccuccuccuccuccucccccgagccccaggaggucaccgacaccaccgaggcccccuuccagggcgaccagcgcucccucgaguuccuccucccccccgagcccgacuacucccuccuccucaccuucaucuacaacggccgcgucgucggcgaggcccagguccagucccucgacugccgccucgucgccgagcccuccggcuccgaguccuccauggagcagguccucuuccccaagcccggcccccucgagcccacccagcgccuccucucccagcucgagcgcggcauccucgucgccuccaacccccgcggccucuucguccagcgccucugccccauccccaucuccuggaacgccccccaggccccccccggccccggcccccaccuccuccccuccaacgagugcgucgagcucuuccgcaccgccuacuucugccgcgaccucguccgcuacuuccagggccucggccccccccccaaguuccaggucacccucaacuucugggaggagucccacggcuccucccacaccccccagaaccucaucaccgucaagauggagcaggccuucgcccgcuaccuccucgagcagacccccgagcagcaggccgccauccucucccucgucuga

SEQ ID NO: 44754 - RNA, 1446 nt, Artificial Sequence
  derived and/or modified sequence opt2 from IRG1__Homo_sapiens__NP_001245335
augaugcucaaguccaucaccgaguccuucgccaccgccauccacggccucaaggucggccaccucaccgaccgcgucauccagcgcuccaagcgcaugauccucgacacccucggcgccggcuuccucggcaccaccaccgaggucuuccacaucgccucccaguacuccaagaucuacuccuccaacaucuccuccaccgucuggggccagcccgacauccgccucccccccaccuacgccgccuucgucaacggcgucgccauccacuccauggacuucgacgacaccuggcaccccgccacccaccccuccggcgccguccuccccguccucaccgcccucgccgaggcccucccccgcucccccaaguucuccggccucgaccuccuccucgccuucaacgucggcaucgagguccagggccgccuccuccacuucgccaaggaggccaacgacaugcccaagcgcuuccacccccccuccgucgucggcacccucggcuccgccgccgccgccuccaaguuccucggccucuccuccaccaagugccgcgaggcccucgccaucgccgucucccacgccggcgcccccauggccaacgccgccacccagaccaagccccuccacaucggcaacgccgccaagcacggcaucgaggccgccuuccucgccaugcucggccuccagggcaacaagcagguccucgaccucgaggccggcuucggcgccuucuacgccaacuacucccccaagguccuccccuccaucgccuccuacuccuggcuccucgaccagcaggacgucgccuucaagcgcuuccccgcccaccucuccacccacugggucgccgacgccgccgccuccguccgcaagcaccucgucgccgagcgcgcccuccuccccaccgacuacaucaagcgcaucguccuccgcauccccaacguccaguacgucaaccgccccuuccccgucuccgagcacgaggcccgccacuccuuccaguacgucgccugcgccaugcuccucgacggcggcaucaccguccccuccuuccacgagugccagaucaaccgcccccagguccgcgagcuccucuccaaggucgagcucgaguacccccccgacaaccuccccuccuucaacauccucuacugcgagaucuccgucacccucaaggacggcgccaccuucaccgaccgcuccgacaccuucuacggccacuggcgcaagccccucucccaggaggaccucgaggagaaguuccgcgccaacgccuccaagaugcucuccugggacaccgucgagucccucaucaagaucgucaagaaccucgaggaccucgaggacugcuccguccucaccacccuccucaagggccccuccccccccgaggucgccuccaacucccccgccugcaacaacuccaucaccaaccucuccuga

SEQ ID NO: 44755 - RNA, 546 nt, Artificial Sequence
  derived and/or modified sequence opt2 from IRGM__Homo_sapiens__NP_001139277
auggaggccaugaacgucgagaaggccuccgccgacggcaaccuccccgaggucaucuccaacaucaaggagacccucaagaucgucucccgcacccccgucaacaucaccauggccggcgacuccggcaacggcauguccaccuucaucuccgcccuccgcaacaccggccacgagggcaaggccuccccccccaccgagcucgucaaggccacccagcgcugcgccuccuacuucuccucccacuucuccaacgucguccucugggaccuccccggcaccggcuccgccaccaccacccucgagaacuaccucauggagaugcaguucaaccgcuacgacuucaucauggucgccuccgcccaguucuccaugaaccacgucaugcucgccaagaccgccgaggacaugggcaagaaguucuacaucgucuggaccaagcucgacauggaccucuccaccggcgcccuccccgagguccagcuccuccagauccgcgagaacguccucgagaaccuccagaaggagcgcgucugcgaguacuga

SEQ ID NO: 44756 - RNA, 3729 nt, Artificial Sequence
  derived and/or modified sequence opt2 from IRS1__Homo_sapiens__NP_005535
auggccuccccccccgaguccgacggcuucuccgacguccgcaaggucggcuaccuccgcaagcccaaguccaugcacaagcgcuucuucguccuccgcgccgccuccgaggccggcggccccgcccgccucgaguacuacgagaacgagaagaaguggcgccacaaguccuccgcccccaagcgcuccaucccccucgaguccugcuucaacaucaacaagcgcgccgacuccaagaacaagcaccucgucgcccucuacacccgcgacgagcacuucgccaucgccgccgacuccgaggccgagcaggacuccugguaccaggcccuccuccagcuccacaaccgcgccaagggccaccacgacggcgccgccgcccucggcgccggcggcggcggcggcuccugcuccggcuccuccggccucggcgaggccggcgaggaccucuccuacggcgacgucccccccggccccgccuucaaggaggucuggcaggucauccucaagcccaagggccucggccagaccaagaaccucaucggcaucuaccgccucugccucaccuccaagaccaucuccuucgucaagcucaacuccgaggccgccgccgucguccuccagcucaugaacauccgccgcugcggccacuccgagaacuucuucuucaucgaggucggccgcuccgccgucaccggccccggcgaguucuggaugcaggucgacgacuccgucgucgcccagaacaugcacgagaccauccucgaggccaugcgcgccauguccgacgaguuccgcccccgcuccaagucccaguccuccuccaacugcuccaaccccaucuccgucccccuccgccgccaccaccucaacaaccccccccccucccaggucggccucacccgccgcucccgcaccgaguccaucaccgccaccucccccgccuccauggucggcggcaagcccggcuccuuccgcguccgcgccuccuccgacggcgagggcaccaugucccgccccgccuccgucgacggcucccccgucucccccuccaccaaccgcacccacgcccaccgccaccgcggcuccgcccgccuccaccccccccucaaccacucccgcuccauccccaugcccgccucccgcugcucccccuccgccaccucccccgucucccucuccuccuccuccaccuccggccacggcuccaccuccgacugccucuucccccgccgcuccuccgccuccgucuccggcucccccuccgacggcggcuucaucuccuccgacgaguacggcuccucccccugcgacuuccgcuccuccuuccgcuccgucacccccgacucccucggccacaccccccccgcccgcggcgaggaggagcucuccaacuacaucugcaugggcggcaagggccccuccacccucaccgcccccaacggccacuacauccucucccgcggcggcaacggccaccgcugcacccccggcaccggccucggcaccucccccgcccucgccggcgacgaggccgccuccgccgccgaccucgacaaccgcuuccgcaagcgcacccacuccgccggcaccucccccaccaucacccaccagaagacccccucccaguccuccgucgccuccaucgaggaguacaccgagaugaugcccgccuacccccccggcggcggcuccggcggccgccuccccggccaccgccacuccgccuucguccccacccgcuccuaccccgaggagggccucgagaugcacccccucgagcgccgcggcggccaccaccgccccgacuccuccacccuccacaccgacgacggcuacaugcccaugucccccggcgucgcccccguccccuccggccgcaagggcuccggcgacuacaugcccaugucccccaaguccgucuccgccccccagcagaucaucaaccccauccgccgccacccccagcgcgucgaccccaacggcuacaugaugaugucccccuccggcggcugcucccccgacaucggcggcggccccuccuccuccuccuccuccuccaacgccguccccuccggcaccuccuacggcaagcucuggaccaacggcgucggcggccaccacucccacguccucccccaccccaagccccccgucgaguccuccggcggcaagcuccuccccugcaccggcgacuacaugaacaugucccccgucggcgacuccaacaccuccucccccuccgacugcuacuacggccccgaggacccccagcacaagcccguccucuccuacuacucccucccccgcuccuucaagcacacccagcgccccggcgagcccgaggagggcgcccgccaccagcaccuccgccucuccaccuccuccggccgccuccucuacgccgccaccgccgacgacuccuccuccuccaccuccuccgacucccucggcggcggcuacugcggcgcccgccucgagcccucccucccccacccccaccaccagguccuccagccccaccucccccgcaaggucgacaccgccgcccagaccaacucccgccucgcccgccccacccgccucucccucggcgaccccaaggccuccacccucccccgcgcccgcgagcagcagcagcagcagcagccccuccuccacccccccgagcccaagucccccggcgaguacgucaacaucgaguucggcuccgaccaguccggcuaccucuccggccccgucgccuuccacuccucccccuccguccgcugccccucccagcuccagcccgccccccgcgaggaggagaccggcaccgaggaguacaugaagauggaccucggccccggccgccgcgccgccuggcaggaguccaccggcgucgagaugggccgccucggccccgccccccccggcgccgccuccaucugccgccccacccgcgccguccccuccucccgcggcgacuacaugaccaugcagauguccugcccccgccaguccuacgucgacaccucccccgccgcccccgucuccuacgccgacaugcgcaccggcaucgccgccgaggaggucucccucccccgcgccaccauggccgccgccuccuccuccuccgccgccuccgccucccccaccggcccccagggcgccgccgagcucgccgcccacuccucccuccucggcggcccccagggccccggcggcauguccgccuucacccgcgucaaccucucccccaaccgcaaccaguccgccaaggucauccgcgccgacccccagggcugccgccgccgccacuccuccgagaccuucuccuccacccccuccgccacccgcgucggcaacaccguccccuucggcgccggcgccgccgucggcggcggcggcggcuccuccuccuccuccgaggacgucaagcgccacuccuccgccuccuucgagaacgucuggcuccgccccggcgagcucggcggcgcccccaaggagcccgccaagcucugcggcgccgccggcggccucgagaacggccucaacuacaucgaccucgaccucgucaaggacuucaagcagugcccccaggagugcacccccgagccccagccccccccccccccccccccccaccagccccucggcuccggcgaguccuccuccacccgccgcuccuccgaggaccucuccgccuacgccuccaucuccuuccagaagcagcccgaggaccgccaguga

SEQ ID NO: 44757 - RNA, 4017 nt, Artificial Sequence
  derived and/or modified sequence opt2 from IRS2__Homo_sapiens__NP_003740
auggccucccccccccgccacggcccccccggccccgccuccggcgacggccccaaccucaacaacaacaacaacaacaacaaccacuccguccgcaagugcggcuaccuccgcaagcagaagcacggccacaagcgcuucuucguccuccgcggccccggcgccggcggcgacgaggccaccgccggcggcggcuccgccccccagcccccccgccucgaguacuacgaguccgagaagaaguggcgcuccaaggccggcgcccccaagcgcgucaucgcccucgacugcugccucaacaucaacaagcgcgccgacgccaagcacaaguaccucaucgcccucuacaccaaggacgaguacuucgccgucgccgccgagaacgagcaggagcaggagggcugguaccgcgcccucaccgaccucgucuccgagggccgcgccgccgccggcgacgccccccccgccgccgcccccgccgccuccugcuccgccucccuccccggcgcccucggcggcuccgccggcgccgccggcgccgaggacuccuacggccucgucgcccccgccaccgccgccuaccgcgaggucuggcaggucaaccucaagcccaagggccucggccaguccaagaaccucaccggcgucuaccgccucugccucuccgcccgcaccaucggcuucgucaagcucaacugcgagcagcccuccgucacccuccagcucaugaacauccgccgcugcggccacuccgacuccuucuucuucaucgaggucggccgcuccgccgucaccggccccggcgagcucuggaugcaggccgacgacuccgucgucgcccagaacauccacgagaccauccucgaggccaugaaggcccucaaggagcucuucgaguuccgcccccgcuccaagucccaguccuccggcuccuccgccacccaccccaucuccguccccggcgcccgccgccaccaccaccucgucaaccucccccccucccagaccggccucguccgccgcucccgcaccgacucccucgccgccaccccccccgccgccaagugcuccuccugccgcguccgcaccgccuccgagggcgacggcggcgccgccgccggcgccgccgccgccggcgcccgccccgucuccgucgccggcuccccccucucccccggccccguccgcgccccccucucccgcucccacacccucuccggcggcugcggcggccgcggcuccaaggucgcccuccuccccgccggcggcgcccuccagcacucccgcuccauguccaugcccgucgcccacuccccccccgccgccaccucccccggcucccucuccuccuccuccggccacggcuccggcuccuacccccccccccccggcccccaccccccccucccccacccccuccaccacggccccggccagcgccccuccuccggcuccgccuccgccuccggcucccccuccgaccccggcuucaugucccucgacgaguacggcuccucccccggcgaccuccgcgccuucugcucccaccgcuccaacacccccgaguccaucgccgagaccccccccgcccgcgacggcggcggcggcggcgaguucuacggcuacaugaccauggaccgcccccucucccacugcggccgcuccuaccgccgcgucuccggcgacgccgcccaggaccucgaccgcggccuccgcaagcgcaccuacucccucaccacccccgcccgccagcgccccgucccccagcccuccuccgccucccucgacgaguacacccucaugcgcgccaccuucuccggcuccgccggccgccucugccccuccugccccgccuccucccccaaggucgccuaccaccccuaccccgaggacuacggcgacaucgagaucggcucccaccgcuccuccuccuccaaccucggcgccgacgacggcuacaugcccaugacccccggcgccgcccucgccggcuccggcuccggcuccugccgcuccgacgacuacaugcccaugucccccgccuccgucuccgcccccaagcagauccuccagccccgcgccgccgccgccgccgccgccgccguccccuccgccggccccgccggccccgcccccaccuccgccgccggccgcaccuuccccgccuccggcggcggcuacaaggccuccucccccgccgaguccucccccgaggacuccggcuacaugcgcauguggugcggcuccaagcucuccauggagcacgccgacggcaagcuccuccccaacggcgacuaccucaacgucucccccuccgacgccgucaccaccggcaccccccccgacuucuucuccgccgcccuccaccccggcggcgagccccuccgcggcguccccggcugcugcuacuccucccucccccgcuccuacaaggcccccuacaccugcggcggcgacuccgaccaguacguccucauguccucccccgucggccgcauccucgaggaggagcgccucgagccccaggccacccccggccccucccaggccgccuccgccuucggcgccggccccacccagcccccccaccccgucguccccucccccguccgccccuccggcggccgccccgagggcuuccucggccagcgcggccgcgccguccgccccacccgccucucccucgagggccuccccucccuccccuccaugcacgaguacccccucccccccgagcccaagucccccggcgaguacaucaacaucgacuucggcgagcccggcgcccgccucuccccccccgcccccccccuccucgccuccgccgccuccuccuccucccuccucuccgccuccucccccgccuccucccucggcuccggcacccccggcaccuccuccgacucccgccagcgcuccccccucuccgacuacaugaaccucgacuucuccucccccaagucccccaagcccggcgcccccuccggccaccccgucggcucccucgacggccuccucucccccgaggccuccucccccuaccccccccuccccccccgccccuccgccucccccuccuccucccuccagccccccccccccccccccgcccccggcgagcucuaccgccucccccccgccuccgccgucgccaccgcccagggccccggcgccgccuccucccucuccuccgacaccggcgacaacggcgacuacaccgagauggccuucggcgucgccgccacccccccccagcccaucgccgccccccccaagcccgaggccgcccgcgucgccucccccaccuccggcgucaagcgccucucccucauggagcaggucuccggcgucgaggccuuccuccaggccucccagccccccgacccccaccgcggcgccaaggucauccgcgccgacccccagggcggccgccgccgccacuccuccgagaccuucuccuccaccaccaccgucacccccgucucccccuccuucgcccacaaccccaagcgccacaacuccgccuccgucgagaacgucucccuccgcaaguccuccgagggcggcgucggcgucggccccggcggcggcgacgagccccccaccuccccccgccagcuccagcccgcccccccccucgccccccagggccgccccuggacccccggccagcccggcggccucgucggcugccccggcuccggcggcucccccaugcgccgcgagaccuccgccggcuuccagaacggccucaacuacaucgccaucgacguccgcgaggagcccggccuccccccccagccccagccccccccccccccccucccccagcccggcgacaaguccuccuggggccgcacccgcucccucggcggccucaucuccgccgucggcgucggcuccaccggcggcggcugcggcggccccggccccggcgcccucccccccgccaacaccuacgccuccaucgacuuccucucccaccaccucaaggaggccaccaucgucaaggaguga

SEQ ID NO: 44758 - RNA, 3774 nt, Artificial Sequence
  derived and/or modified sequence opt2 from IRS4__Homo_sapiens__NP_003595
auggccuccugcuccuucacccgcgaccaggccacccgccgccuccgcggcgccgccgccgccgccgccgccgcccucgccgccgucgucaccaccccccuccucuccuccggcacccccaccgcccucaucggcaccggcuccuccugccccggcgccauguggcucuccaccgccaccggcucccgcuccgacuccgaguccgaggaggaggaccuccccgucggcgaggaggucugcaagcgcggcuaccuccgcaagcagaagcacggccaccgccgcuacuucguccucaagcucgagaccgccgacgcccccgcccgccucgaguacuacgagaacgcccgcaaguuccgccacuccguccgcgccgccgccgccgccgccgccgccgccgccuccggcgccgccauccccccccucauccccccccgccgcgucaucacccucuaccagugcuucuccgucucccagcgcgccgacgcccgcuaccgccaccucaucgcccucuucacccaggacgaguacuucgccauggucgccgagaacgaguccgagcaggaguccugguaccuccuccucucccgccucauccucgaguccaagcgccgccgcugcggcacccucggcgcccagcccgacggcgagcccgccgcccucgccgccgccgccgccgccgagccccccuucuacaaggacgucuggcaggucaucgucaagccccgcggccucggccaccgcaaggagcucuccggcgucuuccgccucugccucaccgacgaggaggucgucuucguccgccucaacaccgaggucgccuccgucgucguccagcuccucuccauccgccgcugcggccacuccgagcaguacuucuuccucgaggucggccgcuccaccgucaucggccccggcgagcucuggaugcaggucgacgacugcgucgucgcccagaacaugcacgagcucuuccucgagaagaugcgcgcccucugcgccgacgaguaccgcgcccgcugccgcuccuacuccaucuccaucggcgcccaccuccucacccuccucuccgcccgccgccaccucggccucgucccccucgagcccggcggcuggcuccgccgcucccgcuucgagcaguucugccaccuccgcgccaucggcgacggcgaggacgagaugcucuucacccgccgcuucgucacccccuccgagcccgucgcccacucccgccgcggccgccuccaccucccccgcggccgccgcucccgccgcgccgucuccguccccgccuccuucuuccgccgccucgcccccucccccgcccgcccccgccaccccgccgaggcccccaacaacggcgcccgccucuccuccgaggucuccggcuccggcuccggcaacuucggcgaggagggcaacccccagggcaaggaggaccaggagggcuccggcggcgacuacaugcccaugaacaacuggggcuccggcaacggccgcggcuccggcggcggccagggcuccaacggccagggcuccuccucccacuccuccggcggcaaccagugcuccggcgagggccagggcucccgcggcggccagggcuccaacggccagggcuccggcggcaaccagugcucccgcgacggccagggcaccgccggcggccacggcuccggcggcggccagcgccccggcggcggccacggcuccggcggcggccagggccccggcgacggccacggcuccggcggcggcaagaacuccggcggcggcaagggcuccggcuccggcaagggcuccgacggcgacggcgagcgcggcaagucccucaagaagcgcuccuacuucggcaagcucacccaguccaagcagcagcagaugccccccccccccccccccccccccccccccccccccgccggcggcaccggcggcaagggcaaguccggcggccgcuuccgccucuacuucugcgucgaccgcggcgccaccaaggagugcaaggaggccaaggaggucaaggacgccgagauccccgagggcgccgcccgcggcccccaccgcgcccgcgccuucgacgaggacgaggacgaccccuacguccccaugcgccccggcgucgccaccccccucgucuccuccuccgacuacaugcccauggccccccagaacgucuccgccuccaagaagcgccacucccgcucccccuucgaggacucccgcggcuacaugaugauguucccccgcgucucccccccccccgcccccuccccccccaaggcccccgacaccaacaaggaggacgacuccaaggacaacgacuccgaguccgacuacauguucauggcccccggcgccggcgccauccccaagaacccccgcaacccccagggcggcuccuccuccaaguccugguccuccuacuucucccuccccaaccccuuccgcuccuccccccucggccagaacgacaacuccgaguacguccccaugcuccccggcaaguuccucggccgcggccucgacaaggaggucuccuacaacugggaccccaaggacgccgccuccaagcccuccggcgagggcuccuucuccaagcccggcgacggcggcucccccuccaagcccuccgaccacgagccccccaagaacaaggccaagcgccccaaccgccucuccuucaucaccaagggcuacaagaucaagcccaagccccagaagcccacccacgagcagcgcgaggccgacuccuccuccgacuacgucaacauggacuucaccaagcgcgaguccaacacccccgcccccuccacccagggccuccccgacuccuggggcaucaucgccgagccccgccaguccgccuucuccaacuacgucaacgucgaguucggcguccccuuccccaaccccgccaacgaccucuccgaccuccuccgcgccaucccccgcgccaacccccucucccucgacuccgcccgcuggccccuccccccccucccccucuccgccaccggcuccaacgccaucgaggaggagggcgacuacaucgaggucaucuucaacuccgccaugacccccgccauggcccucgccgacuccgccauccgcuacgacgccgagaccggccgcaucuacgucgucgaccccuucuccgagugcugcauggacaucucccucucccccucccgcugcuccgagcccccccccgucgcccgccuccuccaggaggaggagcaggagcgccgccgcccccagucccgcucccaguccuucuucgccgccgcccgcgccgccgucuccgccuuccccaccgacucccucgagcgcgaccucucccccuccuccgcccccgccgucgccuccgccgccgagcccacccucgcccucucccaggucgucgccgccgccuccgcccucgccgccgcccccggcaucggcgccgccgccgccgccgccggcuucgacuccgccuccgcccgcugguuccagcccgucgccaacgccgccgacgccgaggccguccgcggcgcccaggacgucgccggcggcuccaaccccggcgcccacaaccccuccgccaaccucgcccgcggcgacaaccaggccggcggcgccgccgccgccgccgccgcccccgagccccccccccgcucccgccgcgucccccgcccccccgagcgcgaggacuccgacaacgacgacgacacccacguccgcauggacuucgcccgccgcgacaaccaguucgacucccccaagcgcggccgcuga

SEQ ID NO: 44759 - RNA, 1443 nt, Artificial Sequence
  derived and/or modified sequence opt2 from IRX1__Homo_sapiens__NP_077313
auguccuucccccagcucggcuacccccaguaccucuccgccgccggccccggcgccuacggcggcgagcgccccggcguccucgccgccgccgccgccgccgccgccgccgccuccuccggccgccccggcgccgccgagcucggcggcggcgccggcgccgccgccgucaccuccguccucggcauguacgccgccgccggccccuacgccggcgcccccaacuacuccgccuuccuccccuacgccgccgaccucucccucuucucccagaugggcucccaguacgagcucaaggacaaccccggcguccaccccgccaccuucgccgcccacaccgcccccgccuacuaccccuacggccaguuccaguacggcgaccccggccgccccaagaacgccacccgcgaguccaccuccacccucaaggccuggcucaacgagcaccgcaagaaccccuaccccaccaagggcgagaagaucaugcucgccaucaucaccaagaugacccucacccaggucuccaccugguucgccaacgcccgccgccgccucaagaaggagaacaaggucaccuggggcgcccgcuccaaggaccaggaggacggcgcccucuucggcuccgacaccgagggcgaccccgagaaggccgaggacgacgaggagaucgaccucgaguccaucgacaucgacaagaucgacgagcacgacggcgaccaguccaacgaggacgacgaggacaaggccgaggccccccacgcccccgccgcccccuccgcccucgcccgcgaccagggcuccccccucgccgccgccgacguccucaagccccaggacuccccccucggccucgccaaggaggcccccgagcccggcuccacccgccuccucucccccggcgccgccgccggcggccuccagggcgccccccacggcaagcccaagaucuggucccucgccgagaccgccaccucccccgacggcgcccccaaggccuccccccccccccccgccggccaccccggcgcccacggccccuccgccggcgccccccuccagcaccccgccuuccuccccucccacggccucuacaccugccacaucggcaaguucuccaacuggaccaacuccgccuuccucgcccagggcucccuccucaacaugcgcuccuuccucggcgucggcgccccccacgccgccccccacggcccccaccuccccgcccccccccccccccagccccccgucgccaucgcccccggcgcccucaacggcgacaaggccuccguccgcuccucccccacccuccccgagcgcgaccucgucccccgccccgacucccccgcccagcagcucaagucccccuuccagcccguccgcgacaacucccucgccccccaggagggcaccccccgcauccucgccgcccuccccuccgccuga

SEQ ID NO: 44760 - RNA, 1416 nt, Artificial Sequence
  derived and/or modified sequence opt2 from IRX2__Homo_sapiens__NP_150366
auguccuacccccagggcuaccucuaccaggcccccggcucccucgcccucuacuccugccccgccuacggcgccuccgcccucgccgccccccgcuccgaggagcucgcccgcuccgccuccggcuccgccuucucccccuaccccggcuccgccgccuucaccgcccaggccgccaccggcuucggcuccccccuccaguacuccgccgacgccgccgccgccgccgccggcuuccccuccuacaugggcgcccccuacgacgcccacaccaccggcaugaccggcgccaucuccuaccaccccuacggcuccgccgccuaccccuaccagcucaacgaccccgccuaccgcaagaacgccacccgcgacgccaccgccacccucaaggccuggcucaacgagcaccgcaagaaccccuaccccaccaagggcgagaagaucaugcucgccaucaucaccaagaugacccucacccaggucuccaccugguucgccaacgcccgccgccgccucaagaaggagaacaagaugaccugggccccccgcaacaaguccgaggacgaggacgaggacgagggcgacgccacccgcuccaaggacgagucccccgacaaggcccaggagggcaccgagaccuccgccgaggacgagggcaucucccuccacgucgacucccucaccgaccacuccugcuccgccgaguccgacggcgagaagcuccccugccgcgccggcgacccccucugcgaguccggcuccgagugcaaggacaaguacgacgaccucgaggacgacgaggacgacgacgaggagggcgagcgcggccucgccccccccaagcccgucaccuccuccccccucaccggccucgaggccccccuccucucccccccccccgaggccgccccccgcggcggccgcaagaccccccagggcucccgcaccucccccggcgcccccccccccgccuccaagcccaagcucuggucccucgccgagaucgccaccuccgaccucaagcagcccucccucggccccggcugcggcccccccggccuccccgccgccgccgcccccgccuccaccggcgccccccccggcggcucccccuaccccgccuccccccuccucggccgcccccucuacuacaccucccccuucuacggcaacuacaccaacuacggcaaccucaacgccgcccuccagggccagggccuccuccgcuacaacuccgccgccgccgcccccggcgaggcccuccacaccgcccccaaggccgccuccgacgccggcaaggccggcgcccacccccucgagucccacuaccgcucccccggcggcggcuacgagcccaagaaggacgccuccgagggcugcaccgucgucggcggcggcguccagcccuaccucuga

SEQ ID NO: 44761 - RNA, 1506 nt, Artificial Sequence
  derived and/or modified sequence opt2 from IRX3__Homo_sapiens__NP_077312
auguccuucccccagcucggcuaccaguacauccgcccccucuaccccuccgagcgccccggcgccgccggcggcuccggcggcuccgccggcgcccgcggcggccucggcgccggcgccuccgagcucaacgccuccggcucccucuccaacguccucuccuccgucuacggcgcccccuacgccgccgccgccgccgccgccgccgcccagggcuacggcgccuuccuccccuacgccgccgagcuccccaucuucccccagcucggcgcccaguacgagcucaaggacucccccggcguccagcaccccgccgccgccgccgccuucccccacccccaccccgccuucuaccccuacggccaguaccaguucggcgaccccucccgccccaagaacgccacccgcgaguccaccuccacccucaaggccuggcucaacgagcaccgcaagaaccccuaccccaccaagggcgagaagaucaugcucgccaucaucaccaagaugacccucacccaggucuccaccugguucgccaacgcccgccgccgccucaagaaggagaacaagaugaccugggccccccgcucccgcaccgacgaggagggcaacgccuacggcuccgagcgcgaggaggaggacgaggaggaggacgaggaggacggcaagcgcgagcucgagcucgaggaggaggagcucggcggcgaggaggaggacaccggcggcgagggccucgccgacgacgacgaggacgaggagaucgaccucgagaaccucgacggcgccgccaccgagcccgagcucucccucgccggcgccgcccgccgcgacggcgaccucggccucggccccaucuccgacuccaagaacuccgacuccgaggacuccuccgagggccucgaggaccgcccccuccccguccucucccucgcccccgcccccccccccgucgccgucgccucccccucccuccccuccccccccgucucccucgaccccugcgcccccgcccccgcccccgccuccgcccuccagaagcccaagaucuggucccucgccgagaccgccaccucccccgacaacccccgccgcuccccccccggcgccggcggcuccccccccggcgccgccgucgcccccuccgcccuccagcucucccccgccgccgccgccgccgccgcccaccgccucgucuccgccccccucggcaaguuccccgccuggaccaaccgccccuuccccggccccccccccggcccccgccuccacccccucucccuccucggcuccgcccccccccaccuccucggccuccccggcgccgccggccaccccgccgccgccgccgccuucgcccgccccgccgagcccgagggcggcaccgaccgcugcuccgcccucgaggucgagaagaagcuccucaagaccgccuuccagcccgucccccgccgcccccagaaccaccucgacgccgcccucguccucuccgcccucuccuccuccuga

SEQ ID NO: 44762 - RNA, 1560 nt, Artificial Sequence
  derived and/or modified sequence opt2 from IRX4__Homo_sapiens__NP_057442
auguccuacccccaguucggcuaccccuacuccuccgccccccaguuccucauggccaccaacucccucuccaccugcugcgaguccggcggccgcacccucgccgacuccggccccgccgccuccgcccaggcccccgucuacugccccgucuacgagucccgccuccucgccaccgcccgccacgagcucaacuccgccgccgcccucggcgucuacggcggccccuacggcggcucccagggcuacggcaacuacgucaccuacggcuccgaggccuccgccuucuacucccucaacuccuucgacuccaaggacggcuccggcuccgcccacggcggccucgcccccgccgccgccgccuacuaccccuacgagcccgcccucggccaguaccccuacgaccgcuacggcaccauggacuccggcacccgccgcaagaacgccacccgcgagaccaccuccacccucaaggccuggcuccaggagcaccgcaagaaccccuaccccaccaagggcgagaagaucaugcucgccaucaucaccaagaugacccucacccaggucuccaccugguucgccaacgcccgccgccgccucaagaaggagaacaagaugaccuggcccccccgcaacaagugcgccgacgagaagcgccccuacgccgagggcgaggaggaggagggcggcgaggaggaggcccgcgaggagccccucaaguccuccaagaacgccgagcccgucggcaaggaggagaaggagcucgagcucuccgaccucgacgacuucgacccccucgaggccgagccccccgccugcgagcucaagccccccuuccacucccucgacggcggccucgagcgcguccccgccgcccccgacggccccgucaaggaggccuccggcgcccuccgcaugucccucgccgccggcggcggcgccgcccucgacgaggaccucgagcgcgcccgcuccugccuccgcuccgccgccgccggccccgagccccuccccggcgccgagggcggcccccaggucugcgaggccaagcucggcuucguccccgccggcgccuccgccggccucgaggccaagccccgcaucuggucccucgcccacaccgccaccgccgccgccgccgccgccaccucccucucccagaccgaguuccccuccugcaugcucaagcgccagggccccgccgcccccgccgccgucuccuccgcccccgccaccucccccuccgucgcccucccccacuccggcgcccucgaccgccaccaggacucccccgucaccucccuccgcaacugggucgacggcgucuuccacgaccccauccuccgccacuccacccucaaccaggccugggccaccgccaagggcgcccuccucgaccccggcccccucggccgcucccucggcgccggcgccaacguccucaccgccccccucgcccgcgccuucccccccgccgucccccaggacgcccccgccgccggcgccgcccgcgagcuccucgcccuccccaaggccggcggcaagcccuucugcgccuga

SEQ ID NO: 44763 - RNA, 1449 nt, Artificial Sequence
  derived and/or modified sequence opt2 from IRX5__Homo_sapiens__NP_001239126
auguccuacccccagggcuaccucuaccagcccuccgccucccucgcccucuacuccugccccgccuacuccaccuccgucaucuccggcccccgcaccgacgagcucggccgcuccuccuccggcuccgccuucucccccuacgccggcuccaccgccuucaccgcccccucccccggcuacaacucccaccuccaguacggcgccgaccccgccgccgccgccgccgccgccuucuccuccuacgucggcucccccuacgaccacacccccggcauggccggcucccucggcuaccaccccuacgccgccccccucggcuccuaccccuacggcgaccccgccuaccgcaagaacgccacccgcgacgccaccgccacccucaaggccuggcucaacgagcaccgcaagaaccccuaccccaccaagggcgagaagaucaugcucgccaucaucaccaagaugacccucacccaggucuccaccugguucgccaacgcccgccgccgccucaagaaggagaacaagaugaccuggaccccccgcaaccgcuccgaggacgaggaggaggaggagaacaucgaccucgagaagaacgacgaggacgagccccagaagcccgaggacaagggcgaccccgagggccccgaggccggcgccgagcagaaggccgccuccggcugcgagcgccuccagggcccccccacccccgccggcaaggagaccgagggcucccucuccgacuccgacuucaaggagccccccuccgagggccgccucgacgcccuccagggccccccccgcaccggcggccccucccccgccggccccgccgccgcccgccucgccgaggaccccgccccccacuaccccgccggcgcccccgcccccggcccccaccccgccgccggcgaggucccccccggccccggcggccccuccgucauccacucccccccccccccccccccccccgccguccucgccaagcccaagcucuggucccucgccgagaucgccaccuccuccgacaaggucaaggacggcggcggcggcaacgagggcucccccugcccccccugccccggccccaucgccggccaggcccucggcggcucccgcgccucccccgcccccgcccccucccgcucccccuccgcccagugccccuuccccggcggcaccguccucucccgcccccucuacuacaccgcccccuucuaccccggcuacaccaacuacggcuccuucggccaccuccacggccaccccggccccggccccggccccaccaccggccccggcucccacuucaacggccucaaccagaccguccucaaccgcgccgacgcccucgccaaggaccccaagaugcuccgcucccagucccagcucgaccucugcaaggacucccccuacgagcucaagaagggcauguccgacaucuga

SEQ ID NO: 44764 - RNA, 429 nt, Artificial Sequence
  derived and/or modified sequence opt2 from ISCU__Homo_sapiens__NP_055116
augguccucaucgacauguccgucgaccucuccacccaggucgucgaccacuacgagaacccccgcaacgucggcucccucgacaagaccuccaagaacgucggcaccggccucgucggcgcccccgccugcggcgacgucaugaagcuccagauccaggucgacgagaagggcaagaucgucgacgcccgcuucaagaccuucggcugcggcuccgccaucgccuccuccucccucgccaccgagugggucaagggcaagaccgucgaggaggcccucaccaucaagaacaccgacaucgccaaggagcucugccucccccccgucaagcuccacugcuccaugcucgccgaggacgccaucaaggccgcccucgccgacuacaagcucaagcaggagcccaagaagggcgaggccgagaagaaguga

SEQ ID NO: 44765 - RNA, 546 nt, Artificial Sequence
  derived and/or modified sequence opt2 from ISG20__Homo_sapiens__NP_001290163
auggccggcucccgcgaggucgucgccauggacugcgagauggucggccucggcccccaccgcgaguccggccucgcccgcugcucccucgucaacguccacggcgccguccucuacgacaaguucauccgccccgagggcgagaucaccgacuaccgcacccgcgucuccggcgucaccccccagcacauggucggcgccacccccuucgccgucgcccgccucgagauccuccagcuccucaagggcaagcucgucgucggccacgaccucaagcacgacuuccaggcccucaaggaggacauguccggcuacaccaucuacgacaccuccaccgaccgccuccucuggcgcgaggccaagcucgaccacugccgccgcgucucccuccgcguccucuccgagcgccuccuccacaaguccauccagaacucccuccucggccacuccuccgucgaggacgcccgcgccaccauggagcucuaccagaucucccagcgcauccgcgcccgccgcggccucccccgccucgccgucuccgacuga

SEQ ID NO: 44766 - RNA, 1050 nt, Artificial Sequence
  derived and/or modified sequence opt2 from ISL1__Homo_sapiens__NP_002193
augggcgacaugggcgacccccccaagaagaagcgccucaucucccucugcgucggcugcggcaaccagauccacgaccaguacauccuccgcgucucccccgaccucgaguggcacgccgccugccucaagugcgccgagugcaaccaguaccucgacgaguccugcaccugcuucguccgcgacggcaagaccuacugcaagcgcgacuacauccgccucuacggcaucaagugcgccaagugcuccaucggcuucuccaagaacgacuucgucaugcgcgcccgcuccaaggucuaccacaucgagugcuuccgcugcgucgccugcucccgccagcucauccccggcgacgaguucgcccuccgcgaggacggccucuucugccgcgccgaccacgacgucgucgagcgcgccucccucggcgccggcgacccccucuccccccuccaccccgcccgcccccuccagauggccgccgagcccaucuccgcccgccagcccgcccuccgcccccacguccacaagcagcccgagaagaccacccgcguccgcaccguccucaacgagaagcagcuccacacccuccgcaccugcuacgccgccaacccccgccccgacgcccucaugaaggagcagcucgucgagaugaccggccucuccccccgcgucauccgcgucugguuccagaacaagcgcugcaaggacaagaagcgcuccaucaugaugaagcagcuccagcagcagcagcccaacgacaagaccaacauccagggcaugaccggcacccccauggucgccgccucccccgagcgccacgacggcggccuccaggccaaccccgucgagguccaguccuaccagccccccuggaagguccucuccgacuucgcccuccaguccgacaucgaccagcccgccuuccagcagcucgucaacuucuccgagggcggccccggcuccaacuccaccggcuccgaggucgccuccauguccucccagcuccccgacacccccaacuccauggucgccucccccaucgaggccuga

SEQ ID NO: 44767 - RNA, 1395 nt, Artificial Sequence
  derived and/or modified sequence opt2 from ISM1__Homo_sapiens__NP_543016
augguccgccucgccgccgagcuccuccuccuccucggccuccuccuccucacccuccacaucaccguccuccgcggcuccggcgccgccgacggccccgacgccgccgccggcaacgccucccaggcccagcuccagaacaaccucaacgucggcuccgacaccaccuccgagaccuccuucucccucuccaaggaggccccccgcgagcaccucgaccaccaggccgcccaccagcccuucccccgcccccgcuuccgccaggagaccggccaccccucccuccagcgcgacuucccccgcuccuuccuccucgaccuccccaacuuccccgaccucuccaaggccgacaucaacggccagaaccccaacauccaggucaccaucgaggucgucgacggccccgacuccgaggccgacaaggaccagcaccccgagaacaagcccuccugguccguccccucccccgacuggcgcgccugguggcagcgcucccucucccucgcccgcgccaacuccggcgaccaggacuacaaguacgacuccaccuccgacgacuccaacuuccucaaccccccccgcggcugggaccacaccgcccccggccaccgcaccuucgagaccaaggaccagcccgaguacgacuccaccgacggcgagggcgacuggucccucugguccgucugcuccgucaccugcggcaacggcaaccagaagcgcacccgcuccugcggcuacgccugcaccgccaccgagucccgcaccugcgaccgccccaacugccccggcaucgaggacaccuuccgcaccgccgccaccgaggucucccuccucgccggcuccgaggaguucaacgccaccaagcucuucgaggucgacaccgacuccugcgagcgcuggauguccugcaaguccgaguuccucaagaaguacaugcacaaggucaugaacgaccuccccuccugccccugcuccuaccccaccgaggucgccuacuccaccgccgacaucuucgaccgcaucaagcgcaaggacuuccgcuggaaggacgccuccggccccaaggagaagcucgagaucuacaagcccaccgcccgcuacugcauccgcuccaugcucucccucgaguccaccacccucgccgcccagcacugcugcuacggcgacaacaugcagcucaucacccgcggcaagggcgccggcacccccaaccucaucuccaccgaguucuccgccgagcuccacuacaaggucgacguccuccccuggaucaucugcaagggcgacuggucccgcuacaacgaggcccgcccccccaacaacggccagaagugcaccgagucccccuccgacgaggacuacaucaagcaguuccaggaggcccgcgaguacuga

SEQ ID NO: 44768 - RNA, 879 nt, Artificial Sequence
  derived and/or modified sequence opt2 from ISM2__Homo_sapiens__NP_872315
augcgcgcccuccgcgaccgcgccggccuccuccucugcguccuccuccucgccgcccuccucgaggccgcccucggccuccccgucaagaagccccgccuccgcggcccccgccccggcucccucacccgccucgccgaggucuccgccucccccgacccccgcccccucaaggaggaggaggaggccccccuccucccccgcacccaccuccaggccgagccccaccagcacggcugcuggaccgucaccgagcccgccgccaugacccccggcaacgccacccccccccgcacccccgaggucaccccccuccgccucgagcuccagaagcuccccggccucgccaacaccacccucuccacccccaaccccgacacccaggccuccgccucccccgacccccgcccccuccgcgaggaggaggaggcccgccuccucccccgcacccaccuccaggccgagcuccaccagcacggcugcuggaccgucaccgagcccgccgcccucacccccggcaacgccacccccccccgcacccaggaggucaccccccuccuccucgagcuccagaagcuccccgagcucguccacgccacccucuccacccccaaccccgacaaccagaccaugucccuccgccgcuccggcguccccggccuccccgccgucggcaccgccgcccucgccuccucccgcggccucggccccgucgccauggccgcccuccccccccgccccguccccgucaccugcccccccguccucgcccuccgcacccgcacccccugggccucccccguccgcuccggcuccuccuggcccgccaugcuccgcaccugcaugaucaagauguggaccgccguccgcuccggcuga

SEQ ID NO: 44769 - RNA, 1356 nt, Artificial Sequence
  derived and/or modified sequence opt2 from ISPD__Homo_sapiens__NP_001094896
auggaggccggcccccccggcuccgcccgccccgccgagcccggccccugccucuccggccagcgcggcgccgaccacaccgccuccgccucccuccaguccgucgccggcaccgagcccggccgccacccccaggccgucgccgccguccuccccgccggcggcugcggcgagcgcaugggcguccccacccccaagcaguucugccccauccucgagcgcccccucaucuccuacacccuccaggcccucgagcgcgucugcuggaucaaggacaucgucgucgccgucaccggcgagaacauggaggucaugaaguccaucauccagaaguaccagcacaagcgcaucucccucgucgaggccggcgucacccgccaccgcuccaucuucaacggccucaaggcccucgccgaggaccagaucaacuccaagcucuccaagcccgaggucgucaucauccacgacgccguccgccccuucgucgaggagggcguccuccucaaggucgucaccgccgccaaggagcacggcgccgccggcgccauccgcccccucgucuccaccgucgucucccccuccgccgacggcugccucgacuacucccucgagcgcgcccgccaccgcgccuccgagaugccccaggccuuccucuucgacgucaucuacgaggccuaccagcagugcuccgacuacgaccucgaguucggcaccgagugccuccagcucgcccucaaguacugcugcaccaaggccaagcucgucgagggcucccccgaccucuggaaggucaccuacaagcgcgaccucuacgccgccgaguccaucaucaaggagcgcaucucccaggagaucugcgucgucauggacaccgaggaggacaacaagcacgucggccaccuccucgaggagguccucaaguccgagcucaaccacgucaaggucaccuccgaggcccucggccacgccggccgccaccuccagcagaucauccucgaccagugcuacaacuucgucugcgucaacgucaccaccuccgacuuccaggagacccagaagcuccucuccaugcucgaggaguccucccucugcauccucuaccccgucgucgucgucuccguccacuuccucgacuucaagcucgucccccccucccagaagauggagaaccucaugcagauccgcgaguucgccaaggaggucaaggagcgcaacauccuccucuacggccuccucaucuccuacccccaggacgaccagaagcuccaggagucccuccgccagggcgccaucaucaucgccucccucaucaaggagcgcaacuccggccucaucggccagcuccucaucgccuga

SEQ ID NO: 44770 - RNA, 1101 nt, Artificial Sequence
  derived and/or modified sequence opt2 from IST1__Homo_sapiens__NP_001257904
augcucggcuccggcuucaaggccgagcgccuccgcgucaaccuccgccucgucaucaaccgccucaagcuccucgagaagaagaagaccgagcucgcccagaaggcccgcaaggagaucgccgacuaccucgccgccggcaaggacgagcgcgcccgcauccgcgucgagcacaucauccgcgaggacuaccucgucgaggccauggagauccucgagcucuacugcgaccuccuccucgcccgcuucggccucauccaguccaugaaggagcucgacuccggccucgccgaguccgucuccacccucaucugggccgccccccgccuccaguccgaggucgccgagcucaagaucgucgccgaccagcucugcgccaaguacuccaaggaguacggcaagcucugccgcaccaaccagaucggcaccgucaacgaccgccucaugcacaagcucuccgucgaggccccccccaagauccucgucgagcgcuaccucaucgagaucgccaagaacuacaacguccccuacgagcccgacuccgucgucauggccgaggccccccccggcgucgagaccgaccucaucgacgucggcuucaccgacgacgucaagaagggcggccccggccgcggcggcuccggcggcuucaccgcccccgucggcggccccgacggcaccguccccaugcccaugcccaugcccaugcccaugcccuccgccaacacccccuucuccuacccccuccccaagggccccuccgacuucaacggccuccccaugggcaccuaccaggccuuccccaacauccaccccccccagauccccgccaccccccccuccuacgaguccgucgacgacaucaacgccgacaagaacaucuccuccgcccagaucgucggccccggccccaagcccgaggccuccgccaagcuccccucccgccccgccgacaacuacgacaacuucguccuccccgagcuccccuccguccccgacacccuccccaccgccuccgccggcgccuccaccuccgccuccgaggacaucgacuucgacgaccucucccgccgcuucgaggagcucaagaagaagaccuga

SEQ ID NO: 44771 - RNA, 738 nt, Artificial Sequence
  derived and/or modified sequence opt2 from ISX__Homo_sapiens__NP_001290437
augugcgccgaggucggccccgcccucugccgcggcauggagcgcaacucccucggcugcugcgaggcccccaagaagcucucccucuccuucuccaucgaggccauccucaagcgccccgcccgccgcuccgacauggaccgccccgagggccccggcgaggagggccccggcgaggccgccgccuccggcuccggccucgagaagccccccaaggaccagccccaggagggccgcaaguccaagcgccgcguccgcaccaccuucaccaccgagcagcuccacgagcucgagaagaucuuccacuucacccacuaccccgacguccacauccgcucccagcucgccgcccgcaucaaccuccccgaggcccgcguccagaucugguuccagaaccagcgcgccaaguggcgcaagcaggagaagaucggcaaccucggcgccccccagcagcucuccgaggccuccgucgcccuccccaccaaccucgacgucgccggccccaccuggaccuccaccgcccuccgccgccucgccccccccaccuccugcugccccuccgcccaggaccagcucgccuccgccugguuccccgccuggaucacccuccuccccgcccaccccugggagacccagcccguccccggccuccccauccaccagaccugcauccccguccucugcauccucccccccccccaccccaaguggggcuccaucugcgccaccuccaccuga

SEQ ID NO: 44772 - RNA, 1515 nt, Artificial Sequence
  derived and/or modified sequence opt2 from ISYNA1__Homo_sapiens__NP_001164409
auggaggccgccgcccaguucuucgucgagucccccgacgucgucuacggccccgaggccaucgaggcccaguacgaguaccgcaccacccgcgucucccgcgagggcggcguccucaaggaggccaacuacuacggcucccucacccaggccggcaccgucucccucggccucgacgccgagggccaggaggucuucguccccuucuccgccguccuccccauggucgcccccaacgaccucgucuucgacggcugggacaucuccucccucaaccucgccgaggccaugcgccgcgccaagguccucgacuggggccuccaggagcagcucuggccccacauggaggcccuccgcccccgccccuccgucuacauccccgaguucaucgccgccaaccaguccgcccgcgccgacaaccucauccccggcucccgcgcccagcagcucgagcagauccgccgcgacauccgcgacuuccgcuccuccgccggccucgacaaggucaucguccucuggaccgccaacaccgagcgcuucugcgaggucauccccggccucaacgacaccgccgagaaccuccuccgcaccaucgagcucggccucgaggucucccccuccacccucuucgccgucgccuccauccucgagggcugcgccuuccucaacggcuccccccagaacacccucguccccggcgcccucgagcucgccuggcagcaccgcgucuucgucggcggcgacgacuucaaguccggccagaccaaggucaaguccguccucgucgacuuccucaucggcuccggccucaagaccauguccaucgucuccuacaaccaccucggcaacaacgacggcgagaaccucuccgccccccuccaguuccgcuccaaggaggucuccaaguccaacgucgucgacgacaugguccaguccaaccccguccucuacacccccggcgaggagcccgaccacugcgucgucaucaaguacguccccuacgucggcgacuccaagcgcgcccucgacgaguacaccuccgagcucaugcucggcggcaccaacacccucguccuccacaacaccugcgaggacucccuccucgccgcccccaucaugcucgaccucgcccuccucaccgagcucugccagcgcgucuccuucugcaccgacauggaccccgagccccagaccuuccaccccguccucucccuccucuccuuccucuucaaggccccccucgucccccccggcucccccgucgucaacgcccucuuccgccagcgcuccugcaucgagaacauccuccgcgccugcgucggccuccccccccagaaccacaugcuccucgagcacaagauggagcgccccggccccucccucaagcgcgucggccccgucgccgccaccuaccccaugcucaacaagaagggccccguccccgccgccaccaacggcugcaccggcgacgccaacggccaccuccaggaggagccccccaugcccaccaccuga

SEQ ID NO: 44773 - RNA, 2712 nt, Artificial Sequence
  derived and/or modified sequence opt2 from ITCH__Homo_sapiens__NP_001244066
auguccgacuccggcucccagcucggcuccaugggcucccucaccaugaagucccagcuccagaucaccgucaucuccgccaagcucaaggagaacaagaagaacugguucggccccucccccuacgucgaggucaccgucgacggccaguccaagaagaccgagaagugcaacaacaccaacucccccaaguggaagcagccccucaccgucaucgucacccccgucuccaagcuccacuuccgcgucuggucccaccagacccucaaguccgacguccuccucggcaccgccgcccucgacaucuacgagacccucaaguccaacaacaugaagcucgaggaggucgucgucacccuccagcucggcggcgacaaggagcccaccgagaccaucggcgaccucuccaucugccucgacggccuccagcucgaguccgaggucgucaccaacggcgagaccaccugcuccgagaacggcgucucccucugccucccccgccucgagugcaacuccgccaucuccgcccacugcaaccucugccuccccggccucuccgacucccccaucuccgccucccgcgucgccggcuucaccggcgccucccagaacgacgacggcucccgcuccaaggacgagacccgcgucuccaccaacggcuccgacgaccccgaggacgccggcgccggcgagaaccgccgcgucuccggcaacaacucccccucccucuccaacggcggcuucaagcccucccgccccccccgccccucccgcccccccccccccaccccccgccgccccgccuccgucaacggcucccccuccgccaccuccgaguccgacggcuccuccaccggcucccucccccccaccaacaccaacaccaacaccuccgagggcgccaccuccggccucaucaucccccucaccaucuccggcggcuccggcccccgcccccucaaccccgucacccaggccccccucccccccggcugggagcagcgcgucgaccagcacggccgcgucuacuacgucgaccacgucgagaagcgcaccaccugggaccgccccgagccccucccccccggcugggagcgccgcgucgacaacaugggccgcaucuacuacgucgaccacuucacccgcaccaccaccuggcagcgccccacccucgaguccguccgcaacuacgagcaguggcagcuccagcgcucccagcuccagggcgccaugcagcaguucaaccagcgcuucaucuacggcaaccaggaccucuucgccaccucccaguccaaggaguucgacccccucggcccccucccccccggcugggagaagcgcaccgacuccaacggccgcgucuacuucgucaaccacaacacccgcaucacccagugggaggacccccgcucccagggccagcucaacgagaagccccuccccgagggcugggagaugcgcuucaccgucgacggcauccccuacuucgucgaccacaaccgccgcaccaccaccuacaucgacccccgcaccggcaaguccgcccucgacaacggcccccagaucgccuacguccgcgacuucaaggccaagguccaguacuuccgcuucuggugccagcagcucgccaugccccagcacaucaagaucaccgucacccgcaagacccucuucgaggacuccuuccagcagaucauguccuucuccccccaggaccuccgccgccgccucugggucaucuuccccggcgaggagggccucgacuacggcggcgucgcccgcgagugguucuuccuccucucccacgagguccucaaccccauguacugccucuucgaguacgccggcaaggacaacuacugccuccagaucaaccccgccuccuacaucaaccccgaccaccucaaguacuuccgcuucaucggccgcuucaucgccauggcccucuuccacggcaaguucaucgacaccggcuucucccuccccuucuacaagcgcauccucaacaagcccgucggccucaaggaccucgaguccaucgaccccgaguucuacaacucccucaucugggucaaggagaacaacaucgaggagugcgaccucgagauguacuucuccgucgacaaggagauccucggcgagaucaagucccacgaccucaagcccaacggcggcaacauccucgucaccgaggagaacaaggaggaguacauccgcauggucgccgaguggcgccucucccgcggcgucgaggagcagacccaggccuucuucgagggcuucaacgagauccucccccagcaguaccuccaguacuucgacgccaaggagcucgagguccuccucugcggcaugcaggagaucgaccucaacgacuggcagcgccacgccaucuaccgccacuacgcccgcaccuccaagcagaucaugugguucuggcaguucgucaaggagaucgacaacgagaagcgcaugcgccuccuccaguucgucaccggcaccugccgccuccccgucggcggcuucgccgaccucaugggcuccaacggcccccagaaguucugcaucgagaaggucggcaaggagaacuggcucccccgcucccacaccugcuucaaccgccucgaccucccccccuacaaguccuacgagcagcucaaggagaagcuccucuucgccaucgaggagaccgagggcuucggccaggaguga

SEQ ID NO: 44774 - RNA, 1395 nt, Artificial Sequence
  derived and/or modified sequence opt2 from ITFG1__Homo_sapiens__NP_001291931
auggacguccuccucaccuaccuccccaagaacuacgccaaguccgagcucggcgccgucaucuucuggggccagaaccagacccucgaccccaacaacaugaccauccucaaccgcaccuuccaggacgagccccucaucauggacuucaacggcgaccucauccccgacaucuucggcaucaccaacgaguccaaccagccccagauccuccucggcggcaaccucuccuggcaccccgcccucaccaccaccuccaagaugcgcaucccccacucccacgccuucaucgaccucaccgaggacuucaccgccgaccucuuccucaccacccucaacgccaccaccuccaccuuccaguucgagaucugggagaaccucgacggcaacuucuccgucuccaccauccucgagaagccccagaacaugauggucgucggccaguccgccuucgccgacuucgacggcgacggccacauggaccaccuccuccccggcugcgaggacaagaacugccagaaguccaccaucuaccucguccgcuccggcaugaagcaguggguccccguccuccaggacuucuccaacaagggcacccucuggggcuucguccccuucgucgacgagcagcagcccaccgagauccccauccccaucacccuccacaucggcgacuacaacauggacggcuaccccgacgcccucgucauccucaagaacaccuccggcuccaaccagcaggccuuccuccucgagaacguccccugcaacaacgccuccugcgaggaggcccgccgcauguucaaggucuacugggagcucaccgaccucaaccagaucaaggacgccauggucgccaccuucuucgacaucuacgaggacggcauccucgacaucgucguccucuccaagggcuacaccaagaacgacuucgccauccacacccucaagaacaacuucgaggccgacgccuacuucgucaaggucaucguccucuccggccucugcuccaacgacugcccccgcaagaucacccccuucggcgucaaccagcccggccccuacaucauguacaccaccgucgacgccaacggcuaccucaagaacggcuccgccggccagcucucccaguccgcccaccucgcccuccagcuccccuacaacguccucggccucggccgcuccgccaacuuccucgaccaccucuacgucggcaucccccgccccuccggcgagaaguccauccgcaagcaggaguggaccgccaucauccccaacucccagcucaucgucauccccuacccccacaacgucccccgcuccucccaccgcugccucugcuuccaccucggcaacaacuggcacuucacccucgccggcaaggagucccgcuga

SEQ ID NO: 44775 - RNA, 1659 nt, Artificial Sequence
  derived and/or modified sequence opt2 from ITFG3__Homo_sapiens__NP_114428
augcucgaccacaaggaccucgaggccgagauccacccccucaagaacgaggagcgcaagucccaggagaaccucggcaaccccuccaagaacgaggacaacgucaaguccgcccccccccagucccgccucucccgcugccgcgccgccgccuucuuccucucccucuuccucugccucuucgucgucuucgucgucuccuucgucauccccugccccgaccgccccgccucccagcgcauguggcgcaucgacuacuccgccgccgucaucuacgacuuccucgccgucgacgacaucaacggcgaccgcauccaggacguccucuuccucuacaagaacaccaacuccuccaacaacuucucccgcuccugcgucgacgagggcuucuccucccccugcaccuucgccgccgccgucuccggcgccaacggcuccacccucugggagcgccccgucgcccaggacgucgcccucgucgagugcgccgucccccagccccgcggcuccgaggcccccuccgccugcauccucgucggccgccccuccuccuucaucgccgucaaccucuucaccggcgagacccucuggaaccacuccuccuccuucuccggcaacgccuccauccucuccccccuccuccagguccccgacgucgacggcgacggcgcccccgaccuccucguccucacccaggagcgcgaggaggucuccggccaccucuacuccggcuccaccggccaccagaucggccuccgcggcucccucggcgucgacggcgaguccggcuuccuccuccacgucacccgcaccggcgcccacuacauccucuuccccugcgccuccucccucugcggcugcuccgucaagggccucuacgagaaggucaccggcuccggcggccccuucaaguccgacccccacugggaguccaugcucaacgccaccacccgccgcaugcucucccacuccuccggcgccguccgcuaccucaugcacguccccggcaacgccggcgccgacguccuccucgucggcuccgaggccuucguccuccucgacggccaggagcucaccccccgcuggacccccaaggccgcccacguccuccgcaagcccaucuucggccgcuacaagcccgacacccucgccgucgccgucgagaacggcaccggcaccgaccgccagauccucuuccucgaccucggcaccggcgccguccucugcucccucgcccuccccucccuccccggcggcccccucuccgccucccuccccaccgccgaccaccgcuccgccuucuucuucuggggccuccacgagcucggcuccaccuccgagaccgagaccggcgaggcccgccacucccucuacauguuccaccccacccucccccgcguccuccucgagcucgccaacgucuccacccacaucgucgccuucgacgccguccucuucgagcccucccgccacgccgccuacauccuccucaccggccccgccgacuccgaggcccccggccucgucuccgucaucaagcacaagguccgcgaccucguccccuccucccgcgucguccgccucggcgagggcggccccgacuccgaccaggccauccgcgaccgcuucucccgccuccgcuaccaguccgaggccuga

SEQ ID NO: 44776 - RNA, 3111 nt, Artificial Sequence
  derived and/or modified sequence opt2 from ITGA10__Homo_sapiens__NP_001289969
augaacaucacccacgccuacucccagggccaccagaagcucaaccucgacaccgucuccuacaacaugcucggcgucgacuccgacggcugccccaccuacauggacgucgucaucguccucgacggcuccaacuccaucuaccccugguccgagguccagaccuuccuccgccgccucgucggcaagcucuucaucgaccccgagcagauccaggucggccucguccaguacggcgagucccccguccacgaguggucccucggcgacuuccgcaccaaggaggaggucguccgcgccgccaagaaccucucccgccgcgagggccgcgagaccaagaccgcccaggccaucauggucgccugcaccgagggcuucucccagucccacggcggccgccccgaggccgcccgccuccucgucgucgucaccgacggcgagucccacgacggcgaggagcuccccgccgcccucaaggccugcgaggccggccgcgucacccgcuacggcaucgccguccucggccacuaccuccgccgccagcgcgaccccuccuccuuccuccgcgagauccgcaccaucgccuccgaccccgacgagcgcuucuucuucaacgucaccgacgaggccgcccucaccgacaucgucgacgcccucggcgaccgcaucuucggccucgagggcucccacgccgagaacgaguccuccuucggccucgagaugucccagaucggcuucuccacccaccgccucaaggacggcauccucuucggcauggucggcgccuacgacuggggcggcuccguccucuggcucgagggcggccaccgccucuuccccccccgcauggcccucgaggacgaguucccccccgcccuccagaaccacgccgccuaccucggcuacuccgucuccuccaugcuccuccgcggcggccgccgccucuuccucuccggcgccccccgcuuccgccaccgcggcaaggucaucgccuuccagcucaagaaggacggcgccguccgcgucgcccagucccuccagggcgagcagaucggcuccuacuucggcuccgagcucugcccccucgacaccgaccgcgacggcaccaccgacguccuccucgucgccgcccccauguuccucggcccccagaacaaggagaccggccgcgucuacgucuaccucgucggccagcagucccuccucacccuccagggcacccuccagcccgagcccccccaggacgcccgcuucggcuucgccaugggcgcccuccccgaccucaaccaggacggcuucgccgacgucgccgucggcgccccccucgaggacggccaccagggcgcccucuaccucuaccacggcacccaguccggcguccgcccccaccccgcccagcgcaucgccgccgccuccaugccccacgcccucuccuacuucggccgcuccgucgacggccgccucgaccucgacggcgacgaccucgucgacgucgccgucggcgcccagggcgccgccauccuccucuccucccgccccaucguccaccucacccccucccucgaggucaccccccaggccaucuccgucguccagcgcgacugccgccgccgcggccaggaggccgucugccucaccgccgcccucugcuuccaggucaccucccgcacccccggccgcugggaccaccaguucuacaugcgcuucaccgccucccucgacgaguggaccgccggcgcccgcgccgccuucgacggcuccggccagcgccucuccccccgccgccuccgccucuccgucggcaacgucaccugcgagcagcuccacuuccacguccucgacaccuccgacuaccuccgccccgucgcccucaccgucaccuucgcccucgacaacaccaccaagcccggccccguccucaacgagggcucccccaccuccauccagaagcucguccccuucuccaaggacugcggccccgacaacgagugcgucaccgaccucguccuccaggucaacauggacauccgcggcucccgcaaggcccccuucgucguccgcggcggccgccgcaagguccucgucuccaccacccucgagaaccgcaaggagaacgccuacaacaccucccucucccucaucuucucccgcaaccuccaccucgccucccucaccccccagcgcgagucccccaucaaggucgagugcgccgcccccuccgcccacgcccgccucugcuccgucggccaccccgucuuccagaccggcgccaaggucaccuuccuccucgaguucgaguucuccugcuccucccuccucucccaggucuucgucaagcucaccgccuccuccgacucccucgagcgcaacggcacccuccaggacaacaccgcccagaccuccgccuacauccaguacgagccccaccuccucuucuccuccgaguccacccuccaccgcuacgagguccaccccuacggcacccuccccgucggccccggccccgaguucaagaccacccuccgcguccagaaccucggcugcuacgucgucuccggccucaucaucuccgcccuccuccccgccgucgcccacggcggcaacuacuuccucucccucucccaggucaucaccaacaacgccuccugcaucguccagaaccucaccgagccccccggcccccccguccaccccgaggagcuccagcacaccaaccgccucaacggcuccaacacccagugccaggucguccgcugccaccucggccagcucgccaagggcaccgaggucuccgucggccuccuccgccucguccacaacgaguucuuccgccgcgccaaguucaagucccucaccgucgucuccaccuucgagcucggcaccgaggagggcuccguccuccagcucaccgaggccucccgcugguccgagucccuccucgaggucguccagacccgccccauccucaucucccucuggauccucaucggcuccguccucggcggccuccuccuccucgcccuccucgucuucugccucuggaagcucggcuucuucgcccacaagaagauccccgaggaggagaagcgcgaggagaagcucgagcaguga

SEQ ID NO: 44777 - RNA, 3567 nt, Artificial Sequence
  derived and/or modified sequence opt2 from ITGA11__Homo_sapiens__NP_001004439
auggaccucccccgcggccucgucgucgccugggcccucucccucuggcccggcuucaccgacaccuucaacauggacacccgcaagccccgcgucauccccggcucccgcaccgccuucuucggcuacaccguccagcagcacgacaucuccggcaacaaguggcucgucgucggcgccccccucgagaccaacggcuaccagaagaccggcgacgucuacaagugccccgucauccacggcaacugcaccaagcucaaccucggccgcgucacccucuccaacgucuccgagcgcaaggacaacaugcgccucggccucucccucgccaccaaccccaaggacaacuccuuccucgccugcuccccccucuggucccacgagugcggcuccuccuacuacaccaccggcaugugcucccgcgucaacuccaacuuccgcuucuccaagaccgucgcccccgcccuccagcgcugccagaccuacauggacaucgucaucguccucgacggcuccaacuccaucuaccccugggucgagguccagcacuuccucaucaacauccucaagaaguucuacaucggccccggccagauccaggucggcgucguccaguacggcgaggacgucguccacgaguuccaccucaacgacuaccgcuccgucaaggacgucgucgaggccgccucccacaucgagcagcgcggcggcaccgagacccgcaccgccuucggcaucgaguucgcccgcuccgaggccuuccagaagggcggccgcaagggcgccaagaaggucaugaucgucaucaccgacggcgagucccacgacucccccgaccucgagaaggucauccagcaguccgagcgcgacaacgucacccgcuacgccgucgccguccucggcuacuacaaccgccgcggcaucaaccccgagaccuuccucaacgagaucaaguacaucgccuccgaccccgacgacaagcacuucuucaacgucaccgacgaggccgcccucaaggacaucgucgacgcccucggcgaccgcaucuucucccucgagggcaccaacaagaacgagaccuccuucggccucgagaugucccagaccggcuucuccucccacgucgucgaggacggcguccuccucggcgccgucggcgccuacgacuggaacggcgccguccucaaggagaccuccgccggcaaggucaucccccuccgcgaguccuaccucaaggaguuccccgaggagcucaagaaccacggcgccuaccucggcuacaccgucaccuccgucgucuccucccgccagggccgcgucuacgucgccggcgccccccgcuucaaccacaccggcaaggucauccucuucaccaugcacaacaaccgcucccucaccauccaccaggccaugcgcggccagcagaucggcuccuacuucggcuccgagaucaccuccgucgacaucgacggcgacggcgucaccgacguccuccucgucggcgcccccauguacuucaacgagggccgcgagcgcggcaaggucuacgucuacgagcuccgccagaaccucuucgucuacaacggcacccucaaggacucccacuccuaccagaacgcccgcuucggcuccuccaucgccuccguccgcgaccucaaccaggacuccuacaacgacgucgucgucggcgccccccucgaggacaaccacgccggcgccaucuacaucuuccacggcuuccgcggcuccauccucaagacccccaagcagcgcaucaccgccuccgagcucgccaccggccuccaguacuucggcugcuccauccacggccagcucgaccucaacgaggacggccucaucgaccucgccgucggcgcccucggcaacgccgucauccucuggucccgccccgucguccagaucaacgccucccuccacuucgagcccuccaagaucaacaucuuccaccgcgacugcaagcgcuccggccgcgacgccaccugccucgccgccuuccucugcuucacccccaucuuccucgccccccacuuccagaccaccaccgucggcauccgcuacaacgccaccauggacgagcgccgcuacaccccccgcgcccaccucgacgagggcggcgaccgcuucaccaaccgcgccguccuccucuccuccggccaggagcucugcgagcgcaucaacuuccacguccucgacaccgccgacuacgucaagcccgucaccuucuccgucgaguacucccucgaggaccccgaccacggccccaugcucgacgacggcuggcccaccacccuccgcgucuccguccccuucuggaacggcugcaacgaggacgagcacugcguccccgaccucguccucgacgcccgcuccgaccuccccaccgccauggaguacugccagcgcguccuccgcaagcccgcccaggacugcuccgccuacacccucuccuucgacaccaccgucuucaucaucgaguccacccgccagcgcgucgccgucgaggccacccucgagaaccgcggcgagaacgccuacuccaccguccucaacaucucccaguccgccaaccuccaguucgccucccucauccagaaggaggacuccgacggcuccaucgagugcgucaacgaggagcgccgccuccagaagcaggucugcaacgucuccuaccccuucuuccgcgccaaggccaaggucgccuuccgccucgacuucgaguucuccaaguccaucuuccuccaccaccucgagaucgagcucgccgccggcuccgacuccaacgagcgcgacuccaccaaggaggacaacgucgccccccuccgcuuccaccucaaguacgaggccgacguccucuucacccgcuccuccucccucucccacuacgaggucaagcccaacuccucccucgagcgcuacgacggcaucggcccccccuucuccugcaucuuccgcauccagaaccucggccucuuccccauccacggcaugaugaugaagaucaccauccccaucgccacccgcuccggcaaccgccuccucaagcuccgcgacuuccucaccgacgaggccaacaccuccugcaacaucuggggcaacuccaccgaguaccgccccacccccgucgaggaggaccuccgccgcgccccccagcucaaccacuccaacuccgacgucgucuccaucaacugcaacauccgccucguccccaaccaggagaucaacuuccaccuccucggcaaccucuggcuccgcucccucaaggcccucaaguacaaguccaugaagaucauggucaacgccgcccuccagcgccaguuccacucccccuucaucuuccgcgaggaggaccccucccgccagaucgucuucgagaucuccaagcaggaggacuggcagguccccaucuggaucaucgucggcuccacccucggcggccuccuccuccucgcccuccucguccucgcccucuggaagcucggcuucuuccgcuccgcccgccgccgccgcgagcccggccucgaccccacccccaagguccucgaguga

SEQ ID NO: 44778 - RNA, 3540 nt, Artificial Sequence
  derived and/or modified sequence opt2 from ITGA1__Homo_sapiens__NP_852478
auggccccccgcccccgcgcccgccccggcgucgccgucgccugcugcuggcuccucaccgucguccuccgcugcugcgucuccuucaacgucgacgucaagaacuccaugaccuucuccggccccgucgaggacauguucggcuacaccguccagcaguacgagaacgaggagggcaaguggguccucaucggcuccccccucgucggccagcccaagaaccgcaccggcgacgucuacaagugccccgucggccgcggcgagucccuccccugcgucaagcucgaccuccccgucaacaccuccauccccaacgucaccgaggucaaggagaacaugaccuucggcuccacccucgucaccaaccccaacggcggcuuccucgccugcggcccccucuacgccuaccgcugcggccaccuccacuacaccaccggcaucugcuccgacgucucccccaccuuccaggucgucaacuccaucgcccccguccaggagugcuccacccagcucgacaucgucaucguccucgacggcuccaacuccaucuaccccugggacuccgucaccgccuuccucaacgaccuccucgagcgcauggacaucggccccaagcagacccaggucggcaucguccaguacggcgagaacgucacccacgaguucaaccucaacaaguacuccuccaccgaggagguccucgucgccgccaagaagaucguccagcgcggcggccgccagaccaugaccgcccucggcaucgacaccgcccgcaaggaggccuucaccgaggcccgcggcgcccgccgcggcgucaagaaggucauggucaucgucaccgacggcgagucccacgacaaccaccgccucaagaaggucauccaggacugcgaggacgagaacauccagcgcuucuccaucgccauccucggcuccuacaaccgcggcaaccucuccaccgagaaguucgucgaggagaucaaguccaucgccuccgagcccaccgagaagcacuucuucaacgucuccgacgagcucgcccucgucaccaucgucaagacccucggcgagcgcaucuucgcccucgaggccaccgccgaccaguccgccgccuccuucgagauggagaugucccagaccggcuucuccgcccacuacucccaggacugggucaugcucggcgccgucggcgccuacgacuggaacggcaccgucgucaugcagaaggccucccagaucaucaucccccgcaacaccaccuucaacgucgaguccaccaagaagaacgagccccucgccuccuaccucggcuacaccgucaacuccgccaccgccuccuccggcgacguccucuacaucgccggccagccccgcuacaaccacaccggccaggucaucaucuaccgcauggaggacggcaacaucaagauccuccagacccucuccggcgagcagaucggcuccuacuucggcuccauccucaccaccaccgacaucgacaaggacuccaacaccgacauccuccucgucggcgcccccauguacaugggcaccgagaaggaggagcagggcaaggucuacgucuacgcccucaaccagacccgcuucgaguaccagaugucccucgagcccaucaagcagaccugcugcuccucccgccagcacaacuccugcaccaccgagaacaagaacgagcccugcggcgcccgcuucggcaccgccaucgccgccgucaaggaccucaaccucgacggcuucaacgacaucgucaucggcgccccccucgaggacgaccacggcggcgccgucuacaucuaccacggcuccggcaagaccauccgcaaggaguacgcccagcgcauccccuccggcggcgacggcaagacccucaaguucuucggccaguccauccacggcgagauggaccucaacggcgacggccucaccgacgucaccaucggcggccucggcggcgccgcccucuucuggucccgcgacgucgccgucgucaaggucaccaugaacuucgagcccaacaaggucaacauccagaagaagaacugccacauggagggcaaggagaccgucugcaucaacgccaccgucugcuucgacgucaagcucaaguccaaggaggacaccaucuacgaggccgaccuccaguaccgcgucacccucgacucccuccgccagaucucccgcuccuucuucuccggcacccaggagcgcaagguccagcgcaacaucaccguccgcaaguccgagugcaccaagcacuccuucuacaugcucgacaagcacgacuuccaggacuccguccgcaucacccucgacuucaaccucaccgaccccgagaacggccccguccucgacgacucccuccccaacuccguccacgaguacauccccuucgccaaggacugcggcaacaaggagaagugcaucuccgaccucucccuccacgucgccaccaccgagaaggaccuccucaucguccgcucccagaacgacaaguucaacgucucccucaccgucaagaacaccaaggacuccgccuacaacacccgcaccaucguccacuacucccccaaccucgucuucuccggcaucgaggccauccagaaggacuccugcgaguccaaccacaacaucaccugcaaggucggcuaccccuuccuccgccgcggcgagauggucaccuucaagauccucuuccaguucaacaccuccuaccucauggagaacgucaccaucuaccucuccgccaccuccgacuccgaggagccccccgagacccucuccgacaacgucgucaacaucuccauccccgucaaguacgaggucggccuccaguucuacuccuccgccuccgaguaccacaucuccaucgccgccaacgagaccguccccgaggucaucaacuccaccgaggacaucggcaacgagaucaacaucuucuaccucauccgcaaguccggcuccuuccccaugcccgagcucaagcucuccaucuccuuccccaacaugaccuccaacggcuaccccguccucuaccccaccggccucuccuccuccgagaacgccaacugccgcccccacaucuucgaggaccccuucuccaucaacuccggcaagaagaugaccaccuccaccgaccaccucaagcgcggcaccauccucgacugcaacaccugcaaguucgccaccaucaccugcaaccucaccuccuccgacaucucccaggucaacgucucccucauccucuggaagcccaccuucaucaaguccuacuucuccucccucaaccucaccauccgcggcgagcuccgcuccgagaacgccucccucguccucuccuccuccaaccagaagcgcgagcucgccauccagaucuccaaggacggccuccccggccgcgucccccucugggucauccuccucuccgccuucgccggccuccuccuccucaugcuccucauccucgcccucuggaagaucggcuucuucaagcgcccccucaagaagaagauggagaaguga

SEQ ID NO: 44779 - RNA, 3120 nt, Artificial Sequence
  derived and/or modified sequence opt2 from ITGA2B__Homo_sapiens__NP_000410
auggcccgcgcccucugcccccuccaggcccucuggcuccucgaguggguccuccuccuccucggccccugcgccgccccccccgccugggcccucaaccucgaccccguccagcucaccuucuacgccggccccaacggcucccaguucggcuucucccucgacuuccacaaggacucccacggccgcgucgccaucgucgucggcgccccccgcacccucggccccucccaggaggagaccggcggcgucuuccucugccccuggcgcgccgagggcggccagugccccucccuccucuucgaccuccgcgacgagacccgcaacgucggcucccagacccuccagaccuucaaggcccgccagggccucggcgccuccgucgucuccugguccgacgucaucgucgccugcgcccccuggcagcacuggaacguccucgagaagaccgaggaggccgagaagacccccgucggcuccugcuuccucgcccagcccgaguccggccgccgcgccgaguacucccccugccgcggcaacacccucucccgcaucuacgucgagaacgacuucuccugggacaagcgcuacugcgaggccggcuucuccuccgucgucacccaggccggcgagcucguccucggcgcccccggcggcuacuacuuccucggccuccucgcccaggcccccgucgccgacaucuucuccuccuaccgccccggcauccuccucuggcacgucuccucccagucccucuccuucgacuccuccaaccccgaguacuucgacggcuacuggggcuacuccgucgccgucggcgaguucgacggcgaccucaacaccaccgaguacgucgucggcgcccccaccugguccuggacccucggcgccgucgagauccucgacuccuacuaccagcgccuccaccgccuccgcggcgagcagauggccuccuacuucggccacuccgucgccgucaccgacgucaacggcgacggccgccacgaccuccucgucggcgccccccucuacauggagucccgcgccgaccgcaagcucgccgaggucggccgcgucuaccucuuccuccagccccgcggcccccacgcccucggcgcccccucccuccuccucaccggcacccagcucuacggccgcuucggcuccgccaucgccccccucggcgaccucgaccgcgacggcuacaacgacaucgccgucgccgcccccuacggcggccccuccggccgcggccagguccucgucuuccucggccaguccgagggccuccgcucccgccccucccagguccucgacucccccuuccccaccggcuccgccuucggcuucucccuccgcggcgccgucgacaucgacgacaacggcuaccccgaccucaucgucggcgccuacggcgccaaccaggucgccgucuaccgcgcccagcccgucgucaaggccuccguccagcuccucguccaggacucccucaaccccgccgucaaguccugcguccucccccagaccaagacccccgucuccugcuucaacauccagaugugcgucggcgccaccggccacaacaucccccagaagcucucccucaacgccgagcuccagcucgaccgccagaagccccgccagggccgccgcguccuccuccucggcucccagcaggccggcaccacccucaaccucgaccucggcggcaagcacucccccaucugccacaccaccauggccuuccuccgcgacgaggccgacuuccgcgacaagcucucccccaucguccucucccucaacgucucccucccccccaccgaggccggcauggcccccgccgucguccuccacggcgacacccacguccaggagcagacccgcaucguccucgacugcggcgaggacgacgucugcgucccccagcuccagcucaccgccuccgucaccggcuccccccuccucgucggcgccgacaacguccucgagcuccagauggacgccgccaacgagggcgagggcgccuacgaggccgagcucgccguccaccucccccagggcgcccacuacaugcgcgcccucuccaacgucgagggcuucgagcgccucaucugcaaccagaagaaggagaacgagacccgcgucguccucugcgagcucggcaaccccaugaagaagaacgcccagaucggcaucgccaugcucgucuccgucggcaaccucgaggaggccggcgaguccgucuccuuccagcuccagauccgcuccaagaacucccagaaccccaacuccaagaucguccuccucgacguccccguccgcgccgaggcccaggucgagcuccgcggcaacuccuuccccgccucccucgucgucgccgccgaggagggcgagcgcgagcagaacucccucgacuccuggggccccaaggucgagcacaccuacgagcuccacaacaacggccccggcaccgucaacggccuccaccucuccauccaccuccccggccagucccagcccuccgaccuccucuacauccucgacauccagccccagggcggccuccagugcuucccccagccccccgucaacccccucaaggucgacuggggccuccccauccccucccccucccccauccaccccgcccaccacaagcgcgaccgccgccagaucuuccuccccgagcccgagcagcccucccgccuccaggaccccguccucgucuccugcgacuccgcccccugcaccgucguccagugcgaccuccaggagauggcccgcggccagcgcgccauggucaccguccucgccuuccucuggcuccccucccucuaccagcgcccccucgaccaguucguccuccagucccacgccugguucaacgucuccucccuccccuacgccguccccccccucucccucccccgcggcgaggcccaggucuggacccagcuccuccgcgcccucgaggagcgcgccauccccaucugguggguccucgucggcguccucggcggccuccuccuccucaccauccucguccucgccauguggaaggucggcuucuucaagcgcaaccgccccccccucgaggaggacgacgaggagggcgaguga

SEQ ID NO: 44780 - RNA, 3546 nt, Artificial Sequence
  derived and/or modified sequence opt2 from ITGA2__Homo_sapiens__NP_002194
augggccccgagcgcaccggcgccgccccccucccccuccuccucguccucgcccucucccagggcauccucaacugcugccucgccuacaacgucggccuccccgaggccaagaucuucuccggccccuccuccgagcaguucggcuacgccguccagcaguucaucaaccccaagggcaacuggcuccucgucggcucccccugguccggcuuccccgagaaccgcaugggcgacgucuacaagugccccgucgaccucuccaccgccaccugcgagaagcucaaccuccagaccuccaccuccauccccaacgucaccgagaugaagaccaacaugucccucggccucauccucacccgcaacaugggcaccggcggcuuccucaccugcggcccccucugggcccagcagugcggcaaccaguacuacaccaccggcgucugcuccgacaucucccccgacuuccagcucuccgccuccuucucccccgccacccagcccugccccucccucaucgacgucgucgucgucugcgacgaguccaacuccaucuaccccugggacgccgucaagaacuuccucgagaaguucguccagggccucgacaucggccccaccaagacccaggucggccucauccaguacgccaacaacccccgcgucgucuucaaccucaacaccuacaagaccaaggaggagaugaucgucgccaccucccagaccucccaguacggcggcgaccucaccaacaccuucggcgccauccaguacgcccgcaaguacgccuacuccgccgccuccggcggccgccgcuccgccaccaaggucauggucgucgucaccgacggcgagucccacgacggcuccaugcucaaggccgucaucgaccagugcaaccacgacaacauccuccgcuucggcaucgccguccucggcuaccucaaccgcaacgcccucgacaccaagaaccucaucaaggagaucaaggccaucgccuccauccccaccgagcgcuacuucuucaacgucuccgacgaggccgcccuccucgagaaggccggcacccucggcgagcagaucuucuccaucgagggcaccguccagggcggcgacaacuuccagauggagaugucccaggucggcuucuccgccgacuacuccucccagaacgacauccucaugcucggcgccgucggcgccuucggcugguccggcaccaucguccagaagaccucccacggccaccucaucuuccccaagcaggccuucgaccagauccuccaggaccgcaaccacuccuccuaccucggcuacuccgucgccgccaucuccaccggcgaguccacccacuucgucgccggcgccccccgcgccaacuacaccggccagaucguccucuacuccgucaacgagaacggcaacaucaccgucauccaggcccaccgcggcgaccagaucggcuccuacuucggcuccguccucugcuccgucgacgucgacaaggacaccaucaccgacguccuccucgucggcgcccccauguacauguccgaccucaagaaggaggagggccgcgucuaccucuucaccaucaaggagggcauccucggccagcaccaguuccucgagggccccgagggcaucgagaacacccgcuucggcuccgccaucgccgcccucuccgacaucaacauggacggcuucaacgacgucaucgucggcuccccccucgagaaccagaacuccggcgccgucuacaucuacaacggccaccagggcaccauccgcaccaaguacucccagaagauccucggcuccgacggcgccuuccgcucccaccuccaguacuucggccgcucccucgacggcuacggcgaccucaacggcgacuccaucaccgacgucuccaucggcgccuucggccaggucguccagcucuggucccaguccaucgccgacgucgccaucgaggccuccuucacccccgagaagaucacccucgucaacaagaacgcccagaucauccucaagcucugcuucuccgccaaguuccgccccaccaagcagaacaaccaggucgccaucgucuacaacaucacccucgacgccgacggcuucuccucccgcgucaccucccgcggccucuucaaggagaacaacgagcgcugccuccagaagaacauggucgucaaccaggcccaguccugccccgagcacaucaucuacauccaggagcccuccgacgucgucaacucccucgaccuccgcgucgacaucucccucgagaaccccggcaccucccccgcccucgaggccuacuccgagaccgccaaggucuucuccauccccuuccacaaggacugcggcgaggacggccucugcaucuccgaccucguccucgacguccgccagauccccgccgcccaggagcagcccuucaucgucuccaaccagaacaagcgccucaccuucuccgucacccucaagaacaagcgcgaguccgccuacaacaccggcaucgucgucgacuucuccgagaaccucuucuucgccuccuucucccuccccgucgacggcaccgaggucaccugccaggucgccgccucccagaaguccgucgccugcgacgucggcuaccccgcccucaagcgcgagcagcaggucaccuucaccaucaacuucgacuucaaccuccagaaccuccagaaccaggccucccucuccuuccaggcccucuccgagucccaggaggagaacaaggccgacaaccucgucaaccucaagaucccccuccucuacgacgccgagauccaccucacccgcuccaccaacaucaacuucuacgagaucuccuccgacggcaacguccccuccaucguccacuccuucgaggacgucggccccaaguucaucuucucccucaaggucaccaccggcuccguccccgucuccauggccaccgucaucauccacaucccccaguacaccaaggagaagaacccccucauguaccucaccggcguccagaccgacaaggccggcgacaucuccugcaacgccgacaucaacccccucaagaucggccagaccuccuccuccgucuccuucaaguccgagaacuuccgccacaccaaggagcucaacugccgcaccgccuccugcuccaacgucaccugcuggcucaaggacguccacaugaagggcgaguacuucgucaacgucaccacccgcaucuggaacggcaccuucgccuccuccaccuuccagaccguccagcucaccgccgccgccgagaucaacaccuacaaccccgagaucuacgucaucgaggacaacaccgucaccaucccccucaugaucaugaagcccgacgagaaggccgagguccccaccggcgucaucaucggcuccaucaucgccggcauccuccuccuccucgcccucgucgccauccucuggaagcucggcuucuucaagcgcaaguacgagaagaugaccaagaaccccgacgagaucgacgagaccaccgagcucuccuccuga

SEQ ID NO: 44781 - RNA, 3156 nt, Artificial Sequence
  derived and/or modified sequence opt2 from ITGA3__Homo_sapiens__NP_002195
augggccccggccccucccgcgccccccgcgccccccgccucaugcucugcgcccucgcccucauggucgccgccggcggcugcgucgucuccgccuucaaccucgacacccgcuuccucgucgucaaggaggccggcaaccccggcucccucuucggcuacuccgucgcccuccaccgccagaccgagcgccagcagcgcuaccuccuccucgccggcgccccccgcgagcucgccguccccgacggcuacaccaaccgcaccggcgccgucuaccucugcccccucaccgcccacaaggacgacugcgagcgcaugaacaucaccgucaagaacgaccccggccaccacaucaucgaggacauguggcucggcgucaccgucgccucccagggccccgccggccgcguccucgucugcgcccaccgcuacacccagguccucugguccggcuccgaggaccagcgccgcauggucggcaagugcuacguccgcggcaacgaccucgagcucgacuccuccgacgacuggcagaccuaccacaacgagaugugcaacuccaacaccgacuaccucgagaccggcaugugccagcucggcaccuccggcggcuucacccagaacaccgucuacuucggcgcccccggcgccuacaacuggaagggcaacuccuacaugauccagcgcaaggagugggaccucuccgaguacuccuacaaggaccccgaggaccagggcaaccucuacaucggcuacaccaugcaggucggcuccuucauccuccaccccaagaacaucaccaucgucaccggcgccccccgccaccgccacaugggcgccgucuuccuccucucccaggaggccggcggcgaccuccgccgccgccagguccucgagggcucccaggucggcgccuacuucggcuccgccaucgcccucgccgaccucaacaacgacggcuggcaggaccuccucgucggcgcccccuacuacuucgagcgcaaggaggaggucggcggcgccaucuacgucuucaugaaccaggccggcaccuccuuccccgcccaccccucccuccuccuccacggccccuccggcuccgccuucggccucuccgucgccuccaucggcgacaucaaccaggacggcuuccaggacaucgccgucggcgcccccuucgagggccucggcaaggucuacaucuaccacuccuccuccaagggccuccuccgccagccccagcaggucauccacggcgagaagcucggccuccccggccucgccaccuucggcuacucccucuccggccagauggacgucgacgagaacuucuaccccgaccuccucgucggcucccucuccgaccacaucguccuccuccgcgcccgccccgucaucaacaucguccacaagacccucgucccccgccccgccguccucgaccccgcccucugcaccgccaccuccugcguccaggucgagcucugcuucgccuacaaccaguccgccggcaaccccaacuaccgccgcaacaucacccucgccuacacccucgaggccgaccgcgaccgccgccccccccgccuccgcuucgccggcuccgaguccgccgucuuccacggcuucuucuccaugcccgagaugcgcugccagaagcucgagcuccuccucauggacaaccuccgcgacaagcuccgccccaucaucaucuccaugaacuacucccucccccuccgcaugcccgaccgcccccgccucggccuccgcucccucgacgccuaccccauccucaaccaggcccaggcccucgagaaccacaccgagguccaguuccagaaggagugcggccccgacaacaagugcgaguccaaccuccagaugcgcgccgccuucgucuccgagcagcagcagaagcucucccgccuccaguacucccgcgacguccgcaagcuccuccucuccaucaacgucaccaacacccgcaccuccgagcgcuccggcgaggacgcccacgaggcccuccucacccucgucgucccccccgcccuccuccucuccuccguccgcccccccggcgccugccaggccaacgagaccaucuucugcgagcucggcaaccccuucaagcgcaaccagcgcauggagcuccucaucgccuucgaggucaucggcgucacccuccacacccgcgaccuccagguccagcuccagcucuccaccuccucccaccaggacaaccucuggcccaugauccucacccuccucgucgacuacacccuccagaccucccucuccauggucaaccaccgccuccaguccuucuucggcggcaccgucaugggcgaguccggcaugaagaccgucgaggacgucggcuccccccucaaguacgaguuccaggucggccccaugggcgagggccucgucggccucggcacccucguccucggccucgaguggcccuacgaggucuccaacggcaaguggcuccucuaccccaccgagaucaccguccacggcaacggcuccuggcccugccgcccccccggcgaccucaucaacccccucaaccucacccucuccgaccccggcgaccgccccuccuccccccagcgccgccgccgccagcucgaccccggcggcggccagggccccccccccgucacccucgccgccgccaagaaggccaaguccgagaccguccucaccugcgccaccggccgcgcccacugcgucuggcucgagugccccauccccgacgcccccgucgucaccaacgucaccgucaaggcccgcgucuggaacuccaccuucaucgaggacuaccgcgacuucgaccgcguccgcgucaacggcugggccacccucuuccuccgcaccuccauccccaccaucaacauggagaacaagaccaccugguucuccgucgacaucgacuccgagcucgucgaggagcuccccgccgagaucgagcucuggcucguccucgucgccgucggcgccggccuccuccuccucggccucaucauccuccuccucuggaagugcggcuucuucaagcgcgcccgcacccgcgcccucuacgaggccaagcgccagaaggccgagaugaagucccagcccuccgagaccgagcgccucaccgacgacuacuga

SEQ ID NO: 44782 - RNA, 3099 nt, Artificial Sequence
  derived and/or modified sequence opt2 from ITGA4__Homo_sapiens__NP_000876
auggccugggaggcccgccgcgagcccggcccccgccgcgccgccguccgcgagaccgucaugcuccuccucugccucggcguccccaccggccgccccuacaacgucgacaccgaguccgcccuccucuaccagggcccccacaacacccucuucggcuacuccgucguccuccacucccacggcgccaaccgcuggcuccucgucggcgcccccaccgccaacuggcucgccaacgccuccgucaucaaccccggcgccaucuaccgcugccgcaucggcaagaaccccggccagaccugcgagcagcuccagcucggcucccccaacggcgagcccugcggcaagaccugccucgaggagcgcgacaaccaguggcucggcgucacccucucccgccagcccggcgagaacggcuccaucgucaccugcggccaccgcuggaagaacaucuucuacaucaagaacgagaacaagcuccccaccggcggcugcuacggcgucccccccgaccuccgcaccgagcucuccaagcgcaucgcccccugcuaccaggacuacgucaagaaguucggcgagaacuucgccuccugccaggccggcaucuccuccuucuacaccaaggaccucaucgucaugggcgcccccggcuccuccuacuggaccggcucccucuucgucuacaacaucaccaccaacaaguacaaggccuuccucgacaagcagaaccaggucaaguucggcuccuaccucggcuacuccgucggcgccggccacuuccgcucccagcacaccaccgaggucgucggcggcgccccccagcacgagcagaucggcaaggccuacaucuucuccaucgacgagaaggagcucaacauccuccacgagaugaagggcaagaagcucggcuccuacuucggcgccuccgucugcgccgucgaccucaacgccgacggcuucuccgaccuccucgucggcgcccccaugcaguccaccauccgcgaggagggccgcgucuucgucuacaucaacuccggcuccggcgccgucaugaacgccauggagaccaaccucgucggcuccgacaaguacgccgcccgcuucggcgaguccaucgucaaccucggcgacaucgacaacgacggcuucgaggacgucgccaucggcgccccccaggaggacgaccuccagggcgccaucuacaucuacaacggccgcgccgacggcaucuccuccaccuucucccagcgcaucgagggccuccagaucuccaagucccucuccauguucggccaguccaucuccggccagaucgacgccgacaacaacggcuacgucgacgucgccgucggcgccuuccgcuccgacuccgccguccuccuccgcacccgccccgucgucaucgucgacgccucccucucccaccccgaguccgucaaccgcaccaaguucgacugcgucgagaacggcuggcccuccgucugcaucgaccucacccucugcuucuccuacaagggcaaggagguccccggcuacaucguccucuucuacaacaugucccucgacgucaaccgcaaggccgagucccccccccgcuucuacuucuccuccaacggcaccuccgacgucaucaccggcuccauccaggucuccucccgcgaggccaacugccgcacccaccaggccuucaugcgcaaggacguccgcgacauccucacccccauccagaucgaggccgccuaccaccucggcccccacgucaucuccaagcgcuccaccgaggaguuccccccccuccagcccauccuccagcagaagaaggagaaggacaucaugaagaagaccaucaacuucgcccgcuucugcgcccacgagaacugcuccgccgaccuccaggucuccgccaagaucggcuuccucaagccccacgagaacaagaccuaccucgccgucggcuccaugaagacccucaugcucaacgucucccucuucaacgccggcgacgacgccuacgagaccacccuccacgucaagcuccccgucggccucuacuucaucaagauccucgagcucgaggagaagcagaucaacugcgaggucaccgacaacuccggcgucguccagcucgacugcuccaucggcuacaucuacgucgaccaccucucccgcaucgacaucuccuuccuccucgacgucuccucccucucccgcgccgaggaggaccucuccaucaccguccacgccaccugcgagaacgaggaggagauggacaaccucaagcacucccgcgucaccgucgccaucccccucaaguacgaggucaagcucaccguccacggcuucgucaaccccaccuccuucgucuacggcuccaacgacgagaacgagcccgagaccugcauggucgagaagaugaaccucaccuuccacgucaucaacaccggcaacuccauggcccccaacgucuccgucgagaucaugguccccaacuccuucuccccccagaccgacaagcucuucaacauccucgacguccagaccaccaccggcgagugccacuucgagaacuaccagcgcgucugcgcccucgagcagcagaaguccgccaugcagacccucaagggcaucguccgcuuccucuccaagaccgacaagcgccuccucuacugcaucaaggccgacccccacugccucaacuuccucugcaacuucggcaagauggaguccggcaaggaggccuccguccacauccagcucgagggccgccccuccauccucgagauggacgagaccuccgcccucaaguucgagauccgcgccaccggcuuccccgagcccaacccccgcgucaucgagcucaacaaggacgagaacgucgcccacguccuccucgagggccuccaccaccagcgccccaagcgcuacuucaccaucgucaucaucuccuccucccuccuccucggccucaucguccuccuccucaucuccuacgucauguggaaggccggcuucuucaagcgccaguacaaguccauccuccaggaggagaaccgccgcgacuccugguccuacaucaacuccaaguccaacgacgacuga

SEQ ID NO: 44783 - RNA, 3150 nt, Artificial Sequence
  derived and/or modified sequence opt2 from ITGA5__Homo_sapiens__NP_002196
augggcucccgcacccccgaguccccccuccacgccguccagcuccgcuggggcccccgccgccgccccccccuccucccccuccuccuccuccuccuccccccccccccccgcgucggcggcuucaaccucgacgccgaggcccccgccguccucuccggcccccccggcuccuucuucggcuucuccgucgaguucuaccgccccggcaccgacggcgucuccguccucgucggcgcccccaaggccaacaccucccagcccggcguccuccagggcggcgccgucuaccucugccccuggggcgccucccccacccagugcacccccaucgaguucgacuccaagggcucccgccuccucgaguccucccucuccuccuccgagggcgaggagcccgucgaguacaagucccuccagugguucggcgccaccguccgcgcccacggcuccuccauccucgccugcgccccccucuacuccuggcgcaccgagaaggagccccucuccgaccccgucggcaccugcuaccucuccaccgacaacuucacccgcauccucgaguacgcccccugccgcuccgacuucuccugggccgccggccagggcuacugccagggcggcuucuccgccgaguucaccaagaccggccgcgucguccucggcggccccggcuccuacuucuggcagggccagauccucuccgccacccaggagcagaucgccgaguccuacuaccccgaguaccucaucaaccucguccagggccagcuccagacccgccaggccuccuccaucuacgacgacuccuaccucggcuacuccgucgccgucggcgaguucuccggcgacgacaccgaggacuucgucgccggcguccccaagggcaaccucaccuacggcuacgucaccauccucaacggcuccgacauccgcucccucuacaacuucuccggcgagcagauggccuccuacuucggcuacgccgucgccgccaccgacgucaacggcgacggccucgacgaccuccucgucggcgccccccuccucauggaccgcacccccgacggccgcccccaggaggucggccgcgucuacgucuaccuccagcaccccgccggcaucgagcccacccccacccucacccucaccggccacgacgaguucggccgcuucggcuccucccucaccccccucggcgaccucgaccaggacggcuacaacgacgucgccaucggcgcccccuucggcggcgagacccagcagggcgucgucuucgucuuccccggcggccccggcggccucggcuccaagcccucccagguccuccagccccucugggccgccucccacacccccgacuucuucggcuccgcccuccgcggcggccgcgaccucgacggcaacggcuaccccgaccucaucgucggcuccuucggcgucgacaaggccgucgucuaccgcggccgccccaucgucuccgccuccgccucccucaccaucuuccccgccauguucaaccccgaggagcgcuccugcucccucgagggcaaccccgucgccugcaucaaccucuccuucugccucaacgccuccggcaagcacgucgccgacuccaucggcuucaccgucgagcuccagcucgacuggcagaagcagaagggcggcguccgccgcgcccucuuccucgccucccgccaggccacccucacccagacccuccucauccagaacggcgcccgcgaggacugccgcgagaugaagaucuaccuccgcaacgaguccgaguuccgcgacaagcucucccccauccacaucgcccucaacuucucccucgacccccaggcccccgucgacucccacggccuccgccccgcccuccacuaccaguccaagucccgcaucgaggacaaggcccagauccuccucgacugcggcgaggacaacaucugcguccccgaccuccagcucgaggucuucggcgagcagaaccacgucuaccucggcgacaagaacgcccucaaccucaccuuccacgcccagaacgucggcgagggcggcgccuacgaggccgagcuccgcgucaccgccccccccgaggccgaguacuccggccucguccgccaccccggcaacuucuccucccucuccugcgacuacuucgccgucaaccagucccgccuccucgucugcgaccucggcaaccccaugaaggccggcgccucccucuggggcggccuccgcuucaccgucccccaccuccgcgacaccaagaagaccauccaguucgacuuccagauccucuccaagaaccucaacaacucccaguccgacgucgucuccuuccgccucuccgucgaggcccaggcccaggucacccucaacggcgucuccaagcccgaggccguccucuuccccgucuccgacuggcacccccgcgaccagccccagaaggaggaggaccucggccccgccguccaccacgucuacgagcucaucaaccagggccccuccuccaucucccagggcguccucgagcucuccugcccccaggcccucgagggccagcagcuccucuacgucacccgcgucaccggccucaacugcaccaccaaccaccccaucaaccccaagggccucgagcucgaccccgagggcucccuccaccaccagcagaagcgcgaggcccccucccgcuccuccgccuccuccggcccccagauccucaagugccccgaggccgagugcuuccgccuccgcugcgagcucggcccccuccaccagcaggagucccagucccuccagcuccacuuccgcgucugggccaagaccuuccuccagcgcgagcaccagcccuucucccuccagugcgaggccgucuacaaggcccucaagaugcccuaccgcauccucccccgccagcucccccagaaggagcgccaggucgccaccgccguccaguggaccaaggccgagggcuccuacggcgucccccucuggaucaucauccucgccauccucuucggccuccuccuccucggccuccucaucuacauccucuacaagcucggcuucuucaagcgcucccuccccuacggcaccgccauggagaaggcccagcucaagccccccgccaccuccgacgccuga

SEQ ID NO: 44784 - RNA, 3222 nt, Artificial Sequence
  derived and/or modified sequence opt2 from ITGA6__Homo_sapiens__NP_000201
auggccgccgccggccagcucugccuccucuaccucuccgccggccuccucucccgccucggcgccgccuucaaccucgacacccgcgaggacaacgucauccgcaaguacggcgaccccggcucccucuucggcuucucccucgccaugcacuggcagcuccagcccgaggacaagcgccuccuccucgucggcgccccccgcgccgaggcccucccccuccagcgcgccaaccgcaccggcggccucuacuccugcgacaucaccgcccgcggccccugcacccgcaucgaguucgacaacgacgccgaccccaccuccgaguccaaggaggaccaguggaugggcgucaccguccagucccagggccccggcggcaaggucgucaccugcgcccaccgcuacgagaagcgccagcacgucaacaccaagcaggagucccgcgacaucuucggccgcugcuacguccucucccagaaccuccgcaucgaggacgacauggacggcggcgacugguccuucugcgacggccgccuccgcggccacgagaaguucggcuccugccagcagggcgucgccgccaccuucaccaaggacuuccacuacaucgucuucggcgcccccggcaccuacaacuggaagggcaucguccgcgucgagcagaagaacaacaccuucuucgacaugaacaucuucgaggacggccccuacgaggucggcggcgagaccgagcacgacgagucccucguccccguccccgccaacuccuaccucggcuucucccucgacuccggcaagggcaucgucuccaaggacgagaucaccuucgucuccggcgccccccgcgccaaccacuccggcgccgucguccuccucaagcgcgacaugaaguccgcccaccuccuccccgagcacaucuucgacggcgagggccucgccuccuccuucggcuacgacgucgccgucgucgaccucaacaaggacggcuggcaggacaucgucaucggcgccccccaguacuucgaccgcgacggcgaggucggcggcgccgucuacgucuacaugaaccagcagggccgcuggaacaacgucaagcccauccgccucaacggcaccaaggacuccauguucggcaucgccgucaagaacaucggcgacaucaaccaggacggcuaccccgacaucgccgucggcgcccccuacgacgaccucggcaaggucuucaucuaccacggcuccgccaacggcaucaacaccaagcccacccagguccucaagggcaucucccccuacuucggcuacuccaucgccggcaacauggaccucgaccgcaacuccuaccccgacgucgccgucggcucccucuccgacuccgucaccaucuuccgcucccgccccgucaucaacauccagaagaccaucaccgucacccccaaccgcaucgaccuccgccagaagaccgccugcggcgcccccuccggcaucugccuccaggucaaguccugcuucgaguacaccgccaaccccgccggcuacaaccccuccaucuccaucgucggcacccucgaggccgagaaggagcgccgcaaguccggccucuccucccgcguccaguuccgcaaccagggcuccgagcccaaguacacccaggagcucacccucaagcgccagaagcagaaggucugcauggaggagacccucuggcuccaggacaacauccgcgacaagcuccgccccauccccaucaccgccuccgucgagauccaggagcccuccucccgccgccgcgucaacucccuccccgagguccuccccauccucaacuccgacgagcccaagaccgcccacaucgacguccacuuccucaaggagggcugcggcgacgacaacgucugcaacuccaaccucaagcucgaguacaaguucugcacccgcgagggcaaccaggacaaguucuccuaccuccccauccagaagggcguccccgagcucguccucaaggaccagaaggacaucgcccucgagaucaccgucaccaacucccccuccaacccccgcaaccccaccaaggacggcgacgacgcccacgaggccaagcucaucgccaccuuccccgacacccucaccuacuccgccuaccgcgagcuccgcgccuuccccgagaagcagcucuccugcgucgccaaccagaacggcucccaggccgacugcgagcucggcaaccccuucaagcgcaacuccaacgucaccuucuaccucguccucuccaccaccgaggucaccuucgacacccccgaccucgacaucaaccucaagcucgagaccaccuccaaccaggacaaccucgcccccaucaccgccaaggccaaggucgucaucgagcuccuccucuccgucuccggcgucgccaagcccucccaggucuacuucggcggcaccgucgucggcgagcaggccaugaaguccgaggacgaggucggcucccucaucgaguacgaguuccgcgucaucaaccucggcaagccccucaccaaccucggcaccgccacccucaacauccaguggcccaaggagaucuccaacggcaaguggcuccucuaccucgucaaggucgaguccaagggccucgagaaggucaccugcgagccccagaaggagaucaacucccucaaccucaccgagucccacaacucccgcaagaagcgcgagaucaccgagaagcagaucgacgacaaccgcaaguucucccucuucgccgagcgcaaguaccagacccucaacugcuccgucaacgucaacugcgucaacauccgcugcccccuccgcggccucgacuccaaggccucccucauccuccgcucccgccucuggaacuccaccuuccucgaggaguacuccaagcucaacuaccucgacauccucaugcgcgccuucaucgacgucaccgccgccgccgagaacauccgccuccccaacgccggcacccagguccgcgucaccgucuuccccuccaagaccgucgcccaguacuccggcguccccugguggaucauccucgucgccauccucgccggcauccucaugcucgcccuccucgucuucauccucuggaagugcggcuucuucaagcgcaacaagaaggaccacuacgacgccaccuaccacaaggccgagauccacgcccagcccuccgacaaggagcgccucaccuccgacgccuga

SEQ ID NO: 44785 - RNA, 3426 nt, Artificial Sequence
  derived and/or modified sequence opt2 from ITGA7__Homo_sapiens__NP_001138468
auggccggcgcccgcucccgcgaccccuggggcgccuccggcaucugcuaccucuucggcucccuccucgucgagcuccucuucucccgcgccgucgccuucaaccucgacgucaugggcgcccuccgcaaggagggcgagcccggcucccucuucggcuucuccgucgcccuccaccgccagcuccagccccgcccccaguccuggcuccucgucggcgccccccaggcccucgcccuccccggccagcaggccaaccgcaccggcggccucuucgccugcccccucucccucgaggagaccgacugcuaccgcgucgacaucgaccagggcgccgacaugcagaaggaguccaaggagaaccaguggcucggcgucuccguccgcucccagggccccggcggcaagaucgucaccugcgcccaccgcuacgaggcccgccagcgcgucgaccagauccucgagacccgcgacaugaucggccgcugcuucguccucucccaggaccucgccauccgcgacgagcucgacggcggcgaguggaaguucugcgagggccgcccccagggccacgagcaguucggcuucugccagcagggcaccgccgccgccuucucccccgacucccacuaccuccucuucggcgcccccggcaccuacaacuggaagggcaccgcccgcgucgagcucugcgcccagggcuccgccgaccucgcccaccucgacgacggccccuacgaggccggcggcgagaaggagcaggacccccgccucauccccguccccgccaacuccuacuucggcuucuccaucgacuccggcaagggccucguccgcgccgaggagcucuccuucgucgccggcgccccccgcgccaaccacaagggcgccgucgucauccuccgcaaggacuccgccucccgccucguccccgaggucaugcucuccggcgagcgccucaccuccggcuucggcuacucccucgccgucgccgaccucaacuccgacggcuggcccgaccucaucgucggcgcccccuacuucuucgagcgccaggaggagcucggcggcgccgucuacgucuaccucaaccagggcggccacugggccggcaucuccccccuccgccucugcggcucccccgacuccauguucggcaucucccucgccguccucggcgaccucaaccaggacggcuuccccgacaucgccgucggcgcccccuucgacggcgacggcaaggucuucaucuaccacggcuccucccucggcgucgucgccaagcccucccagguccucgagggcgaggccgucggcaucaaguccuucggcuacucccucuccggcucccucgacauggacggcaaccaguaccccgaccuccucgucggcucccucgccgacaccgccguccucuuccgcgcccgccccauccuccacgucucccacgaggucuccaucgccccccgcuccaucgaccucgagcagcccaacugcgccggcggccacuccgucugcgucgaccuccgcgucugcuucuccuacaucgccguccccuccuccuacucccccaccgucgcccucgacuacguccucgacgccgacaccgaccgccgccuccgcggccaggucccccgcgucaccuuccucucccgcaaccucgaggagcccaagcaccaggccuccggcaccgucuggcucaagcaccagcacgaccgcgucugcggcgacgccauguuccagcuccaggagaacgucaaggacaagcuccgcgccaucgucgucacccucuccuacucccuccagaccccccgccuccgccgccaggcccccggccagggccucccccccgucgcccccauccucaacgcccaccagcccuccacccagcgcgccgagauccacuuccucaagcagggcugcggcgaggacaagaucugccaguccaaccuccagcucguccgcgcccgcuucugcacccgcgucuccgacaccgaguuccagccccuccccauggacgucgacggcaccaccgcccucuucgcccucuccggccagcccgucaucggccucgagcucauggucaccaaccuccccuccgaccccgcccagccccaggccgacggcgacgacgcccacgaggcccagcuccucgucaugcuccccgacucccuccacuacuccggcguccgcgcccucgaccccgccgagaagccccucugccucuccaacgagaacgccucccacgucgagugcgagcucggcaaccccaugaagcgcggcgcccaggucaccuucuaccucauccucuccaccuccggcaucuccaucgagaccaccgagcucgaggucgagcuccuccucgccaccaucuccgagcaggagcuccaccccgucuccgcccgcgcccgcgucuucaucgagcucccccucuccaucgccggcauggccaucccccagcagcucuucuucuccggcgucguccgcggcgagcgcgccaugcaguccgagcgcgacgucggcuccaaggucaaguacgaggucaccgucuccaaccagggccagucccuccgcacccucggcuccgccuuccucaacaucauguggccccacgagaucgccaacggcaaguggcuccucuaccccaugcaggucgagcucgagggcggccagggccccggccagaagggccucugcuccccccgccccaacauccuccaccucgacgucgacucccgcgaccgccgccgccgcgagcucgagccccccgagcagcaggagcccggcgagcgccaggagcccuccauguccugguggcccgucuccuccgccgagaagaagaagaacaucacccucgacugcgcccgcggcaccgccaacugcgucgucuucuccugcccccucuacuccuucgaccgcgccgccguccuccacgucuggggccgccucuggaacuccaccuuccucgaggaguacuccgccgucaagucccucgaggucaucguccgcgccaacaucaccgucaaguccuccaucaagaaccucaugcuccgcgacgccuccaccgucauccccgucauggucuaccucgaccccauggccgucgucgccgagggcguccccuggugggucauccuccucgccguccucgccggccuccucguccucgcccuccucguccuccuccucuggaagaugggcuucuucaagcgcgccaagcaccccgaggccaccgucccccaguaccacgccgucaagaucccccgcgaggaccgccagcaguucaaggaggagaagaccggcaccauccuccgcaacaacuggggcuccccccgccgcgagggccccgacgcccaccccauccucgccgccgacggccaccccgagcucggccccgacggccaccccggccccggcaccgccuga

SEQ ID NO: 44786 - RNA, 3147 nt, Artificial Sequence
  derived and/or modified sequence opt2 from ITGA8__Homo_sapiens__NP_001278423
augucccccggcgccucccgcggcccccgcggcucccaggccccccucaucgccccccucugcugcgccgccgccgcccucggcaugcuccucuggucccccgccugccaggccuucaaccucgacgucgagaagcucaccgucuacuccggccccaagggcuccuacuucggcuacgccgucgacuuccacauccccgacgcccgcaccgccuccguccucgucggcgcccccaaggccaacaccucccagcccgacaucgucgagggcggcgccgucuacuacugccccuggcccgccgagggcuccgcccagugccgccagauccccuucgacaccaccaacaaccgcaagauccgcgucaacggcaccaaggagcccaucgaguucaaguccaaccagugguucggcgccaccgucaaggcccacaagggcaaggucgucgccugcgccccccucuaccacuggcgcacccucaagcccacccccgagaaggaccccgucggcaccugcuacgucgccauccagaacuucuccgccuacgccgaguucucccccugccgcaacuccaacgccgaccccgagggccagggcuacugccaggccggcuucucccucgacuucuacaagaacggcgaccucaucgucggcggccccggcuccuucuacuggcagggccaggucaucaccgccuccgucgccgacaucaucgccaacuacuccuucaaggacauccuccgcaagcucgccggcgagaagcagaccgaggucgcccccgccuccuacgacgacuccuaccucgagcucgucgccggcaucccccgcggcgcccagaacuucggcuacgucuccaucaucaacuccaccgacaugaccuucauccagaacuucaccggcgagcagauggccuccuacuucggcuacaccgucgucgucuccgacgucaacuccgacggccucgacgacguccucgucggcgccccccucuucauggagcgcgaguucgaguccaacccccgcgaggucggccagaucuaccucuaccuccaggucuccucccuccucuuccgcgacccccagauccucaccggcaccgagaccuucggccgcuucggcuccgccauggcccaccucggcgaccucaaccaggacggcuacaacgacaucgccaucggcguccccuucgccggcaaggaccagcgcggcaagguccucaucuacaacggcaacaaggacggccucaacaccaagcccucccagguccuccagggcgucugggccucccacgccguccccuccggcuucggcuucacccuccgcggcgacuccgacaucgacaagaacgacuaccccgaccucaucgucggcgccuucggcaccggcaaggucgccgucuaccgcgcccgccccgucgucaccgucgacgcccagcuccuccuccaccccaugaucaucaaccucgagaacaagaccugccagguccccgacuccaugaccuccgccgccugcuucucccuccgcgucugcgccuccgucaccggccaguccaucgccaacaccaucguccucauggccgagguccagcucgacucccucaagcagaagggcgccaucaagcgcacccucuuccucgacaaccaccaggcccaccgcgucuucccccucgucaucaagcgccagaagucccaccagugccaggacuucaucgucuaccuccgcgacgagaccgaguuccgcgacaagcucucccccaucaacaucucccucaacuacucccucgacgaguccaccuucaaggagggccucgaggucaagcccauccucaacuacuaccgcgagaacaucgucuccgagcaggcccacauccucgucgacugcggcgaggacaaccucugcguccccgaccucaagcucuccgcccgccccgacaagcaccaggucaucaucggcgacgagaaccaccucaugcucaucaucaacgcccgcaacgagggcgagggcgccuacgaggccgagcucuucgucaugauccccgaggaggccgacuacgucggcaucgagcgcaacaacaagggcuuccgcccccucuccugcgaguacaagauggagaacgucacccgcauggucgucugcgaccucggcaaccccauggucuccggcaccaacuacucccucggccuccgcuucgccgucccccgccucgagaagaccaacauguccaucaacuucgaccuccagauccgcuccuccaacaaggacaaccccgacuccaacuucgucucccuccagaucaacaucaccgccgucgcccaggucgagauccgcggcgucucccaccccccccagaucguccuccccauccacaacugggagcccgaggaggagccccacaaggaggaggaggucggcccccucgucgagcacaucuacgagcuccacaacaucggccccuccaccaucuccgacaccauccucgaggucggcuggcccuucuccgcccgcgacgaguuccuccucuacaucuuccacauccagacccucggcccccuccagugccagcccaaccccaacaucaacccccaggacaucaagcccgccgccucccccgaggacacccccgagcucuccgccuuccuccgcaacuccaccaucccccaccucguccgcaagcgcgacguccacgucgucgaguuccaccgccagucccccgccaagauccucaacugcaccaacaucgagugccuccagaucuccugcgccgucggccgccucgagggcggcgaguccgccguccucaagguccgcucccgccucugggcccacaccuuccuccagcgcaagaacgaccccuacgcccucgccucccucgucuccuucgaggucaagaagaugcccuacaccgaccagcccgccaagcuccccgagggcuccaucgucaucaagaccuccgucaucugggccacccccaacgucuccuucuccaucccccucugggucaucauccucgccauccuccucggccuccucguccucgccauccucacccucgcccucuggaagugcggcuucuucgaccgcgcccgccccccccaggaggacaugaccgaccgcgagcagcucaccaacgacaagacccccgaggccuga

SEQ ID NO: 44787 - RNA, 3108 nt, Artificial Sequence
  derived and/or modified sequence opt2 from ITGA9__Homo_sapiens__NP_002198
augggcggccccgccgccccccgcggcgccggccgccuccgcgcccuccuccucgcccucgucgucgccggcauccccgccggcgccuacaaccucgacccccagcgccccguccacuuccagggccccgccgacuccuucuucggcuacgccguccucgagcacuuccacgacaacacccgcuggguccucgucggcgcccccaaggccgacuccaaguacucccccuccgucaagucccccggcgccgucuucaagugccgcguccacaccaaccccgaccgccgcugcaccgagcucgacauggcccgcggcaagaaccgcggcaccuccugcggcaagaccugccgcgaggaccgcgacgacgaguggaugggcgucucccucgcccgccagcccaaggccgacggccgcguccucgccugcgcccaccgcuggaagaacaucuacuacgaggccgaccacauccucccccacggcuucugcuacaucauccccuccaaccuccaggccaagggccgcacccucauccccugcuacgaggaguacaagaagaaguacggcgaggagcacggcuccugccaggccggcaucgccggcuucuucaccgaggagcucgucgucaugggcgcccccggcuccuucuacugggccggcaccaucaagguccucaaccucaccgacaacaccuaccucaagcucaacgacgaggucaucaugaaccgccgcuacaccuaccucggcuacgccgucaccgccggccacuucucccaccccuccaccaucgacgucgucggcggcgccccccaggacaagggcaucggcaaggucuacaucuuccgcgccgaccgccgcuccggcacccucaucaagaucuuccaggccuccggcaagaagaugggcuccuacuucggcuccucccucugcgccgucgaccucaacggcgacggccucuccgaccuccucgucggcgcccccauguucuccgagauccgcgacgagggccaggucaccgucuacaucaaccgcggcaacggcgcccucgaggagcagcucgcccucaccggcgacggcgccuacaacgcccacuucggcgaguccaucgccucccucgacgaccucgacaacgacggcuuccccgacgucgccaucggcgcccccaaggaggacgacuucgccggcgccgucuacaucuaccacggcgacgccggcggcaucgucccccaguacuccaugaagcucuccggccagaagaucaaccccguccuccgcauguucggccaguccaucuccggcggcaucgacauggacggcaacggcuaccccgacgucaccgucggcgccuucauguccgacuccgucguccuccuccgcgcccgccccgucaucaccgucgacgucuccaucuuccuccccggcuccaucaacaucaccgccccccagugccacgacggccagcagcccgucaacugccucaacgucaccaccugcuucuccuuccacggcaagcacguccccggcgagaucggccucaacuacguccucauggccgacgucgccaagaaggagaagggccagaugccccgcgucuacuucguccuccucggcgagaccaugggccaggucaccgagaagcuccagcucaccuacauggaggagaccugccgccacuacgucgcccacgucaagcgccgcguccaggacgucaucucccccaucgucuucgaggccgccuacucccucuccgagcacgucaccggcgaggaggagcgcgagcuccccccccucacccccguccuccgcuggaagaagggccagaagaucgcccagaagaaccagaccgucuucgagcgcaacugccgcuccgaggacugcgccgccgaccuccagcuccagggcaagcuccuccucuccuccauggacgagaagacccucuaccucgcccucggcgccgucaagaacaucucccucaacaucuccaucuccaaccucggcgacgacgccuacgacgccaacgucuccuucaacgucucccgcgagcucuucuucaucaacauguggcagaaggaggagaugggcaucuccugcgagcuccucgaguccgacuuccucaagugcuccgucggcuuccccuucaugcgcuccaaguccaaguacgaguucuccgucaucuucgacaccucccaccucuccggcgaggaggagguccucuccuucaucgucaccgcccaguccggcaacaccgagcgcuccgagucccuccacgacaacacccucguccucauggucccccucaugcacgaggucgacaccuccaucaccggcaucaugucccccaccuccuucgucuacggcgaguccgucgacgccgccaacuucauccagcucgacgaccucgagugccacuuccagcccaucaacaucacccuccaggucuacaacaccggccccuccacccuccccggcuccuccgucuccaucuccuuccccaaccgccucuccuccggcggcgccgagauguuccacguccaggagauggucgucggccaggagaagggcaacugcuccuuccagaagaaccccacccccugcaucaucccccaggagcaggagaacaucuuccacaccaucuucgccuucuucaccaaguccggccgcaagguccucgacugcgagaagcccggcaucuccugccucaccgcccacugcaacuucuccgcccucgccaaggaggagucccgcaccaucgacaucuacaugcuccucaacaccgagauccucaagaaggacuccuccuccgucauccaguucaugucccgcgccaaggucaaggucgaccccgcccuccgcgucgucgagaucgcccacggcaaccccgaggaggucaccgucgucuucgaggcccuccacaaccucgagccccgcggcuacgucgucggcuggaucaucgccaucucccuccucgucggcauccucaucuuccuccuccucgccguccuccucuggaagaugggcuucuuccgccgccgcuacaaggagaucaucgaggccgagaagaaccgcaaggagaacgaggacuccugggacuggguccagaagaaccaguga

SEQ ID NO: 44788 - RNA, 3486 nt, Artificial Sequence
  derived and/or modified sequence opt2 from ITGAD__Homo_sapiens__NP_005344
augaccuucggcaccguccuccuccucuccguccucgccuccuaccacggcuucaaccucgacgucgaggagcccaccaucuuccaggaggacgccggcggcuucggccaguccgucguccaguucggcggcucccgccucgucgucggcgccccccucgaggucgucgccgccaaccagaccggccgccucuacgacugcgccgccgccaccggcaugugccagcccaucccccuccacauccgccccgaggccgucaacaugucccucggccucacccucgccgccuccaccaacggcucccgccuccucgccugcggccccacccuccaccgcgucugcggcgagaacuccuacuccaagggcuccugccuccuccucggcucccgcugggagaucauccagaccguccccgacgccacccccgagugcccccaccaggagauggacaucgucuuccucaucgacggcuccggcuccaucgaccagaacgacuucaaccagaugaagggcuucguccaggccgucaugggccaguucgagggcaccgacacccucuucgcccucaugcaguacuccaaccuccucaagauccacuucaccuucacccaguuccgcaccucccccucccagcagucccucgucgaccccaucguccagcucaagggccucaccuucaccgccaccggcauccucaccgucgucacccagcucuuccaccacaagaacggcgcccgcaaguccgccaagaagauccucaucgucaucaccgacggccagaaguacaaggacccccucgaguacuccgacgucaucccccaggccgagaaggccggcaucauccgcuacgccaucggcgucggccacgccuuccagggccccaccgcccgccaggagcucaacaccaucuccuccgcccccccccaggaccacgucuucaaggucgacaacuucgccgcccucggcuccauccagaagcagcuccaggagaagaucuacgccgucgagggcacccagucccgcgccuccuccuccuuccagcacgagaugucccaggagggcuucuccaccgcccucaccauggacggccucuuccucggcgccgucggcuccuucuccugguccggcggcgccuuccucuacccccccaacaugucccccaccuucaucaacaugucccaggagaacgucgacaugcgcgacuccuaccucggcuacuccaccgagcucgcccucuggaagggcguccagaaccucguccucggcgccccccgcuaccagcacaccggcaaggccgucaucuucacccaggucucccgccaguggcgcaagaaggccgaggucaccggcacccagaucggcuccuacuucggcgccucccucugcuccgucgacgucgacuccgacggcuccaccgaccucauccucaucggcgccccccacuacuacgagcagacccgcggcggccaggucuccgucugcccccucccccgcggccgcguccaguggcagugcgacgccguccuccgcggcgagcagggccaccccuggggccgcuucggcgccgcccucaccguccucggcgacgucaacgaggacaagcucaucgacgucgccaucggcgcccccggcgagcaggagaaccgcggcgccgucuaccucuuccacggcgccuccgaguccggcaucucccccucccacucccagcgcaucgccuccucccagcucuccccccgccuccaguacuucggccaggcccucuccggcggccaggaccucacccaggacggccucauggaccucgccgucggcgcccgcggccagguccuccuccuccgcucccuccccguccucaaggucggcgucgccaugcgcuucucccccgucgaggucgccaaggccgucuaccgcugcugggaggagaagcccuccgcccucgaggccggcgacgccaccgucugccucaccauccagaaguccucccucgaccagcucggcgacauccaguccuccguccgcuucgaccucgcccucgaccccggccgccucaccucccgcgccaucuucaacgagaccaagaaccccacccucacccgccgcaagacccucggccucggcauccacugcgagacccucaagcuccuccuccccgacugcgucgaggacgucgucucccccaucauccuccaccucaacuucucccucguccgcgagcccauccccuccccccagaaccuccgccccguccucgccgucggcucccaggaccucuucaccgccucccuccccuucgagaagaacugcggccaggacggccucugcgagggcgaccucggcgucacccucuccuucuccggccuccagacccucaccgucggcuccucccucgagcucaacgucaucgucaccgucuggaacgccggcgaggacuccuacggcaccgucgucucccucuacuaccccgccggccucucccaccgccgcgucuccggcgcccagaagcagccccaccaguccgcccuccgccucgccugcgagaccguccccaccgaggacgagggccuccgcuccucccgcugcuccgucaaccaccccaucuuccacgagggcuccaacggcaccuucaucgucaccuucgacgucuccuacaaggccacccucggcgaccgcaugcucaugcgcgccuccgccuccuccgagaacaacaaggccuccuccuccaaggccaccuuccagcucgagcuccccgucaaguacgccgucuacaccaugaucucccgccaggaggaguccaccaaguacuucaacuucgccaccuccgacgagaagaagaugaaggaggccgagcaccgcuaccgcgucaacaaccucucccagcgcgaccucgccaucuccaucaacuucuggguccccguccuccucaacggcgucgccgucugggacgucgucauggaggcccccucccagucccuccccugcgucuccgagcgcaagcccccccagcacuccgacuuccucacccagaucucccgcucccccaugcucgacugcuccaucgccgacugccuccaguuccgcugcgacguccccuccuucuccguccaggaggagcucgacuucacccucaagggcaaccucuccuucggcuggguccgcgagacccuccagaagaagguccucgucgucuccgucgccgagaucaccuucgacaccuccgucuacucccagcuccccggccaggaggccuucaugcgcgcccagauggagaugguccucgaggaggacgaggucuacaacgccauccccaucaucaugggcuccuccgucggcgcccuccuccuccucgcccucaucaccgccacccucuacaagcucggcuucuucaagcgccacuacaaggagaugcucgaggacaagcccgaggacaccgccaccuucuccggcgacgacuucuccugcgucgcccccaacgucccccucuccuga

SEQ ID NO: 44789 - RNA, 3540 nt, Artificial Sequence
  derived and/or modified sequence opt2 from ITGAE__Homo_sapiens__NP_002199
auguggcucuuccacacccuccucugcaucgccucccucgcccuccucgccgccuucaacgucgacgucgcccgccccuggcucacccccaagggcggcgcccccuucguccucuccucccuccuccaccaggaccccuccaccaaccagaccuggcuccucgucaccuccccccgcaccaagcgcacccccggcccccuccaccgcugcucccucguccaggacgagauccucugccaccccgucgagcacguccccauccccaagggccgccaccgcggcgucaccgucguccgcucccaccacggcguccucaucugcauccagguccucguccgccgcccccacucccucuccuccgagcucaccggcaccugcucccuccucggccccgaccuccgcccccaggcccaggccaacuucuucgaccucgagaaccuccucgaccccgacgcccgcgucgacaccggcgacugcuacuccaacaaggagggcggcggcgaggacgacgucaacaccgcccgccagcgccgcgcccucgagaaggaggaggaggaggacaaggaggaggaggaggacgaggaggaggaggaggccggcaccgagaucgccaucauccucgacggcuccggcuccaucgacccccccgacuuccagcgcgccaaggacuucaucuccaacaugaugcgcaacuucuacgagaagugcuucgagugcaacuucgcccucguccaguacggcggcgucauccagaccgaguucgaccuccgcgacucccaggacgucauggccucccucgcccgcguccagaacaucacccaggucggcuccgucaccaagaccgccuccgccaugcagcacguccucgacuccaucuucaccuccucccacggcucccgccgcaaggccuccaaggucauggucguccucaccgacggcggcaucuucgaggacccccucaaccucaccaccgucaucaacucccccaagaugcagggcgucgagcgcuucgccaucggcgucggcgaggaguucaaguccgcccgcaccgcccgcgagcucaaccucaucgccuccgaccccgacgagacccacgccuucaaggucaccaacuacauggcccucgacggccuccucuccaagcuccgcuacaacaucaucuccauggagggcaccgucggcgacgcccuccacuaccagcucgcccagaucggcuucuccgcccagauccucgacgagcgccagguccuccucggcgccgucggcgccuucgacugguccggcggcgcccuccucuacgacacccgcucccgccgcggccgcuuccucaaccagaccgccgccgccgccgccgacgccgaggccgcccaguacuccuaccucggcuacgccgucgccguccuccacaagaccugcucccucuccuacaucgccggcgccccccgcuacaagcaccacggcgccgucuucgagcuccagaaggagggccgcgaggccuccuuccuccccguccucgagggcgagcagaugggcuccuacuucggcuccgagcucugccccgucgacaucgacauggacggcuccaccgacuuccuccucgucgccgcccccuucuaccacguccacggcgaggagggccgcgucuacgucuaccgccucuccgagcaggacggcuccuucucccucgcccgcauccucuccggccaccccggcuucaccaacgcccgcuucggcuucgccauggccgccaugggcgaccucucccaggacaagcucaccgacgucgccaucggcgccccccucgagggcuucggcgccgacgacggcgccuccuucggcuccgucuacaucuacaacggccacugggacggccucuccgccucccccucccagcgcauccgcgccuccaccgucgcccccggccuccaguacuucggcauguccauggccggcggcuucgacaucuccggcgacggccucgccgacaucaccgucggcacccucggccaggccgucgucuuccgcucccgccccgucguccgccucaaggucuccauggccuucacccccuccgcccuccccaucggcuucaacggcgucgucaacguccgccucugcuucgagaucuccuccgucaccaccgccuccgaguccggccuccgcgaggcccuccucaacuucacccucgacgucgacgucggcaagcagcgccgccgccuccagugcuccgacguccgcuccugccucggcugccuccgcgagugguccuccggcucccagcucugcgaggaccuccuccucaugcccaccgagggcgagcucugcgaggaggacugcuucuccaacgccuccgucaaggucuccuaccagcuccagacccccgagggccagaccgaccacccccagcccauccucgaccgcuacaccgagcccuucgccaucuuccagcuccccuacgagaaggccugcaagaacaagcucuucugcgucgccgagcuccagcucgccaccaccgucucccagcaggagcucgucgucggccucaccaaggagcucacccucaacaucaaccucaccaacuccggcgaggacuccuacaugaccuccauggcccucaacuacccccgcaaccuccagcucaagcgcaugcagaagccccccucccccaacauccagugcgacgacccccagcccgucgccuccguccucaucaugaacugccgcaucggccaccccguccucaagcgcuccuccgcccacgucuccgucgucuggcagcucgaggagaacgccuuccccaaccgcaccgccgacaucaccgucaccgucaccaacuccaacgagcgccgcucccucgccaacgagacccacacccuccaguuccgccacggcuucgucgccguccucuccaagcccuccaucauguacgucaacaccggccagggccucucccaccacaaggaguuccucuuccacguccacggcgagaaccucuucggcgccgaguaccagcuccagaucugcguccccaccaagcuccgcggccuccaggucgucgccgucaagaagcucacccgcacccaggccuccaccgucugcaccuggucccaggagcgcgccugcgccuacuccuccguccagcacgucgaggaguggcacuccgucuccugcgucaucgccuccgacaaggagaacgucaccgucgccgccgagaucuccugggaccacuccgaggagcuccucaaggacgucaccgagcuccagauccucggcgagaucuccuucaacaagucccucuacgagggccucaacgccgagaaccaccgcaccaagaucaccgucgucuuccucaaggacgagaaguaccacucccuccccaucaucaucaagggcuccgucggcggccuccucguccucaucgucauccucgucauccucuucaagugcggcuucuucaagcgcaaguaccagcagcucaaccucgaguccauccgcaaggcccagcucaaguccgagaaccuccucgaggaggagaacuga

SEQ ID NO: 44790 - RNA, 3261 nt, Artificial Sequence
  derived and/or modified sequence opt2 from ITGAL__Homo_sapiens__NP_001107852
augaaggacuccugcaucaccgucauggccauggcccuccucuccggcuucuucuucuucgcccccgccuccuccuacaaccucgacguccgcggcgcccgcuccuucucccccccccgcgccggccgccacuucggcuaccgcguccuccaggucggcaacggcgucaucgucggcgcccccggcgagggcaacuccaccggcucccucuaccagugccaguccggcaccggccacugccuccccgucacccuccgcggcuccaacuacaccuccaaguaccucggcaugacccucgccaccgaccccaccgacggcuccauccucuucgccgccguccaguucuccaccuccuacaagaccgaguucgacuucuccgacuacgucaagcgcaaggaccccgacgcccuccucaagcacgucaagcacaugcuccuccucaccaacaccuucggcgccaucaacuacgucgccaccgaggucuuccgcgaggagcucggcgcccgccccgacgccaccaagguccucaucaucaucaccgacggcgaggccaccgacuccggcaacaucgacgccgccaaggacaucauccgcuacaucaucggcaucggcaagcacuuccagaccaaggagucccaggagacccuccacaaguucgccuccaagcccgccuccgaguucgucaagauccucgacaccuucgagaagcucaaggaccucuucaccgagcuccagaagaagaucuacgucaucgagggcaccuccaagcaggaccucaccuccuucaacauggagcucuccuccuccggcaucuccgccgaccucucccgcggccacgccgucgucggcgccgucggcgccaaggacugggccggcggcuuccucgaccucaaggccgaccuccaggacgacaccuucaucggcaacgagccccucacccccgagguccgcgccggcuaccucggcuacaccgucaccuggcuccccucccgccagaagaccucccuccucgccuccggcgccccccgcuaccagcacaugggccgcguccuccucuuccaggagccccagggcggcggccacuggucccagguccagaccauccacggcacccagaucggcuccuacuucggcggcgagcucugcggcgucgacgucgaccaggacggcgagaccgagcuccuccucaucggcgccccccucuucuacggcgagcagcgcggcggccgcgucuucaucuaccagcgccgccagcucggcuucgaggaggucuccgagcuccagggcgaccccggcuacccccucggccgcuucggcgaggccaucaccgcccucaccgacaucaacggcgacggccucgucgacgucgccgucggcgccccccucgaggagcagggcgccgucuacaucuucaacggccgccacggcggccucuccccccagcccucccagcgcaucgagggcacccagguccucuccggcauccagugguucggccgcuccauccacggcgucaaggaccucgagggcgacggccucgccgacgucgccgucggcgccgagucccagaugaucguccucuccucccgccccgucgucgacauggucacccucauguccuucucccccgccgagauccccguccacgaggucgagugcuccuacuccaccuccaacaagaugaaggagggcgucaacaucaccaucugcuuccagaucaagucccucaucccccaguuccagggccgccucgucgccaaccucaccuacacccuccagcucgacggccaccgcacccgccgccgcggccucuuccccggcggccgccacgagcuccgccgcaacaucgccgucaccaccuccauguccugcaccgacuucuccuuccacuuccccgucugcguccaggaccucaucucccccaucaacgucucccucaacuucucccucugggaggaggagggcaccccccgcgaccagcgcgccggcaaggacaucccccccauccuccgccccucccuccacuccgagaccugggagauccccuucgagaagaacugcggcgaggacaagaagugcgaggccaaccuccgcgucuccuucucccccgcccgcucccgcgcccuccgccucaccgccuucgccucccucuccgucgagcucucccucuccaaccucgaggaggacgccuacuggguccagcucgaccuccacuucccccccggccucuccuuccgcaaggucgagaugcucaagccccacucccagauccccgucuccugcgaggagcuccccgaggagucccgccuccucucccgcgcccucuccugcaacgucuccucccccaucuucaaggccggccacuccgucgcccuccagaugauguucaacacccucgucaacuccuccuggggcgacuccgucgagcuccacgccaacgucaccugcaacaacgaggacuccgaccuccucgaggacaacuccgccaccaccaucauccccauccucuaccccaucaacauccucauccaggaccaggaggacuccacccucuacgucuccuucacccccaagggccccaagauccaccaggucaagcacauguaccagguccgcauccagcccuccauccacgaccacaacauccccacccucgaggccgucgucggcgucccccagccccccuccgagggccccaucacccaccagugguccguccagauggagccccccguccccugccacuacgaggaccucgagcgccuccccgacgccgccgagcccugccuccccggcgcccucuuccgcugccccgucgucuuccgccaggagauccucguccaggucaucggcacccucgagcucgucggcgagaucgaggccuccuccauguucucccucugcuccucccucuccaucuccuucaacuccuccaagcacuuccaccucuacggcuccaacgccucccucgcccaggucgucaugaaggucgacgucgucuacgagaagcagaugcucuaccucuacguccucuccggcaucggcggccuccuccuccuccuccucaucuucaucguccucuacaaggucggcuucuucaagcgcaaccucaaggagaagauggaggccggccgcggcguccccaacggcauccccgccgaggacuccgagcagcucgccuccggccaggaggccggcgaccccggcugccucaagccccuccacgagaaggacuccgaguccggcggcggcaaggacuga

SEQ ID NO: 44791 - RNA, 3459 nt, Artificial Sequence
  derived and/or modified sequence opt2 from ITGAM__Homo_sapiens__NP_000623
auggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccaguga

SEQ ID NO: 44792 - RNA, 3009 nt, Artificial Sequence
  derived and/or modified sequence opt2 from ITGAV__Homo_sapiens__NP_001138471
augcuccucggcacccuccuccucauccucuacauccucaugcucugccgcauguuccuccucgucggcgcccccaaggccaacaccacccagcccggcaucgucgagggcggccagguccucaagugcgacugguccuccacccgccgcugccagcccaucgaguucgacgccaccggcaaccgcgacuacgccaaggacgacccccucgaguucaagucccaccagugguucggcgccuccguccgcuccaagcaggacaagauccucgccugcgccccccucuaccacuggcgcaccgagaugaagcaggagcgcgagcccgucggcaccugcuuccuccaggacggcaccaagaccgucgaguacgcccccugccgcucccaggacaucgacgccgacggccagggcuucugccagggcggcuucuccaucgacuucaccaaggccgaccgcguccuccucggcggccccggcuccuucuacuggcagggccagcucaucuccgaccaggucgccgagaucgucuccaaguacgaccccaacgucuacuccaucaaguacaacaaccagcucgccacccgcaccgcccaggccaucuucgacgacuccuaccucggcuacuccgucgccgucggcgacuucaacggcgacggcaucgacgacuucgucuccggcgucccccgcgccgcccgcacccucggcauggucuacaucuacgacggcaagaacauguccucccucuacaacuucaccggcgagcagauggccgccuacuucggcuucuccgucgccgccaccgacaucaacggcgacgacuacgccgacgucuucaucggcgccccccucuucauggaccgcggcuccgacggcaagcuccaggaggucggccaggucuccgucucccuccagcgcgccuccggcgacuuccagaccaccaagcucaacggcuucgaggucuucgcccgcuucggcuccgccaucgccccccucggcgaccucgaccaggacggcuucaacgacaucgccaucgccgcccccuacggcggcgaggacaagaagggcaucgucuacaucuucaacggccgcuccaccggccucaacgccguccccucccagauccucgagggccagugggccgcccgcuccaugccccccuccuucggcuacuccaugaagggcgccaccgacaucgacaagaacggcuaccccgaccucaucgucggcgccuucggcgucgaccgcgccauccucuaccgcgcccgccccgucaucaccgucaacgccggccucgaggucuaccccuccauccucaaccaggacaacaagaccugcucccuccccggcaccgcccucaaggucuccugcuucaacguccgcuucugccucaaggccgacggcaagggcguccucccccgcaagcucaacuuccaggucgagcuccuccucgacaagcucaagcagaagggcgccauccgccgcgcccucuuccucuacucccgcucccccucccacuccaagaacaugaccaucucccgcggcggccucaugcagugcgaggagcucaucgccuaccuccgcgacgaguccgaguuccgcgacaagcucacccccaucaccaucuucauggaguaccgccucgacuaccgcaccgccgccgacaccaccggccuccagcccauccucaaccaguucacccccgccaacaucucccgccaggcccacauccuccucgacugcggcgaggacaacgucugcaagcccaagcucgaggucuccgucgacuccgaccagaagaagaucuacaucggcgacgacaacccccucacccucaucgucaaggcccagaaccagggcgagggcgccuacgaggccgagcucaucgucuccaucccccuccaggccgacuucaucggcgucguccgcaacaacgaggcccucgcccgccucuccugcgccuucaagaccgagaaccagacccgccaggucgucugcgaccucggcaaccccaugaaggccggcacccagcuccucgccggccuccgcuucuccguccaccagcaguccgagauggacaccuccgucaaguucgaccuccagauccaguccuccaaccucuucgacaaggucucccccgucgucucccacaaggucgaccucgccguccucgccgccgucgagauccgcggcgucuccucccccgaccacaucuuccuccccauccccaacugggagcacaaggagaaccccgagaccgaggaggacgucggccccgucguccagcacaucuacgagcuccgcaacaacggccccuccuccuucuccaaggccaugcuccaccuccaguggcccuacaaguacaacaacaacacccuccucuacauccuccacuacgacaucgacggccccaugaacugcaccuccgacauggagaucaacccccuccgcaucaagaucuccucccuccagaccaccgagaagaacgacaccgucgccggccagggcgagcgcgaccaccucaucaccaagcgcgaccucgcccucuccgagggcgacauccacacccucggcugcggcgucgcccagugccucaagaucgucugccaggucggccgccucgaccgcggcaaguccgccauccucuacgucaagucccuccucuggaccgagaccuucaugaacaaggagaaccagaaccacuccuacucccucaaguccuccgccuccuucaacgucaucgaguuccccuacaagaaccuccccaucgaggacaucaccaacuccacccucgucaccaccaacgucaccuggggcauccagcccgcccccaugcccguccccgucugggucaucauccucgccguccucgccggccuccuccuccucgccguccucgucuucgucauguaccgcaugggcuucuucaagcgcguccgccccccccaggaggagcaggagcgcgagcagcuccagccccacgagaacggcgagggcaacuccgagaccuga

SEQ ID NO: 44793 - RNA, 3492 nt, Artificial Sequence
  derived and/or modified sequence opt2 from ITGAX__Homo_sapiens__NP_000878
augacccgcacccgcgccgcccuccuccucuucaccgcccucgccaccucccucggcuucaaccucgacaccgaggagcucaccgccuuccgcgucgacuccgccggcuucggcgacuccgucguccaguacgccaacuccugggucgucgucggcgccccccagaagaucaccgccgccaaccagaccggcggccucuaccagugcggcuacuccaccggcgccugcgagcccaucggccuccaggucccccccgaggccgucaacaugucccucggccucucccucgccuccaccaccucccccucccagcuccucgccugcggccccaccguccaccacgagugcggccgcaacauguaccucaccggccucugcuuccuccucggccccacccagcucacccagcgccuccccgucucccgccaggagugcccccgccaggagcaggacaucgucuuccucaucgacggcuccggcuccaucuccucccgcaacuucgccaccaugaugaacuucguccgcgccgucaucucccaguuccagcgccccuccacccaguucucccucaugcaguucuccaacaaguuccagacccacuucaccuucgaggaguuccgccgcuccuccaacccccucucccuccucgccuccguccaccagcuccagggcuucaccuacaccgccaccgccauccagaacgucguccaccgccucuuccacgccuccuacggcgcccgccgcgacgccgccaagauccucaucgucaucaccgacggcaagaaggagggcgacucccucgacuacaaggacgucauccccauggccgacgccgccggcaucauccgcuacgccaucggcgucggccucgccuuccagaaccgcaacuccuggaaggagcucaacgacaucgccuccaagcccucccaggagcacaucuucaaggucgaggacuucgacgcccucaaggacauccagaaccagcucaaggagaagaucuucgccaucgagggcaccgagaccaccuccuccuccuccuucgagcucgagauggcccaggagggcuucuccgccgucuucacccccgacggccccguccucggcgccgucggcuccuucaccugguccggcggcgccuuccucuacccccccaacaugucccccaccuucaucaacaugucccaggagaacgucgacaugcgcgacuccuaccucggcuacuccaccgagcucgcccucuggaagggcguccagucccucguccucggcgccccccgcuaccagcacaccggcaaggccgucaucuucacccaggucucccgccaguggcgcaugaaggccgaggucaccggcacccagaucggcuccuacuucggcgccucccucugcuccgucgacgucgacuccgacggcuccaccgaccucguccucaucggcgccccccacuacuacgagcagacccgcggcggccaggucuccgucugcccccucccccgcggcuggcgccgcugguggugcgacgccguccucuacggcgagcagggccaccccuggggccgcuucggcgccgcccucaccguccucggcgacgucaacggcgacaagcucaccgacgucgucaucggcgcccccggcgaggaggagaaccgcggcgccgucuaccucuuccacggcguccucggccccuccaucucccccucccacucccagcgcaucgccggcucccagcucuccucccgccuccaguacuucggccaggcccucuccggcggccaggaccucacccaggacggccucgucgaccucgccgucggcgcccgcggccagguccuccuccuccgcacccgccccguccucugggucggcgucuccaugcaguucauccccgccgagaucccccgcuccgccuucgagugccgcgagcaggucgucuccgagcagacccucguccaguccaacaucugccucuacaucgacaagcgcuccaagaaccuccucggcucccgcgaccuccaguccuccgucacccucgaccucgcccucgaccccggccgccucuccccccgcgccaccuuccaggagaccaagaaccgcucccucucccgcguccgcguccucggccucaaggcccacugcgagaacuucaaccuccuccuccccuccugcgucgaggacuccgucacccccaucacccuccgccucaacuucacccucgucggcaagccccuccucgccuuccgcaaccuccgccccaugcucgccgccgacgcccagcgcuacuucaccgccucccuccccuucgagaagaacugcggcgccgaccacaucugccaggacaaccucggcaucuccuucuccuuccccggccucaagucccuccucgucggcuccaaccucgagcucaacgccgaggucauggucuggaacgacggcgaggacuccuacggcaccaccaucaccuucucccaccccgccggccucuccuaccgcuacgucgccgagggccagaagcagggccagcuccgcucccuccaccucaccugcgacuccgcccccgucggcucccagggcaccugguccaccuccugccgcaucaaccaccucaucuuccgcggcggcgcccagaucaccuuccucgccaccuucgacgucucccccaaggccguccucggcgaccgccuccuccucaccgccaacgucuccuccgagaacaacaccccccgcaccuccaagaccaccuuccagcucgagcuccccgucaaguacgccgucuacaccgucgucuccucccacgagcaguucaccaaguaccucaacuucuccgaguccgaggagaaggagucccacgucgccaugcaccgcuaccaggucaacaaccucggccagcgcgaccuccccgucuccaucaacuucuggguccccgucgagcucaaccaggaggccgucuggauggacgucgaggucucccacccccagaaccccucccuccgcugcuccuccgagaagaucgccccccccgccuccgacuuccucgcccacauccagaagaaccccguccucgacugcuccaucgccggcugccuccgcuuccgcugcgacguccccuccuucuccguccaggaggagcucgacuucacccucaagggcaaccucuccuucggcuggguccgccagauccuccagaagaaggucuccgucgucuccgucgccgagaucaccuucgacaccuccgucuacucccagcuccccggccaggaggccuucaugcgcgcccagaccaccaccguccucgagaaguacaagguccacaaccccaccccccucaucgucggcuccuccaucggcggccuccuccuccucgcccucaucaccgccguccucuacaaggucggcuucuucaagcgccaguacaaggagaugauggaggaggccaacggccagaucgcccccgagaacggcacccagacccccuccccccccuccgagaaguga

SEQ ID NO: 44794 - RNA, 603 nt, Artificial Sequence
  derived and/or modified sequence opt2 from ITGB1BP1__Homo_sapiens__NP_004754
auguuccgcaagggcaagaagcgccacuccuccuccuccucccaguccuccgagaucuccaccaaguccaaguccgucgacuccucccucggcggccucucccgcuccuccaccgucgccucccucgacaccgacuccaccaaguccuccggccaguccaacaacaacuccgacaccugcgccgaguuccgcaucaaguacgucggcgccaucgagaagcucaagcucuccgagggcaagggccucgagggcccccucgaccucaucaacuacaucgacgucgcccagcaggacggcaagcuccccuucgucccccccgaggaggaguucaucaugggcgucuccaaguacggcaucaaggucuccaccuccgaccaguacgacguccuccaccgccacgcccucuaccucaucauccgcauggucugcuacgacgacggccucggcgccggcaagucccuccucgcccucaagaccaccgacgccuccaacgaggaguacucccucugggucuaccagugcaacucccucgagcaggcccaggccaucugcaagguccucuccaccgccuucgacuccguccucaccuccgagaagcccuga

SEQ ID NO: 44795 - RNA, 2406 nt, Artificial Sequence
  derived and/or modified sequence opt2 from ITGB1__Homo_sapiens__NP_391988
augaaccuccagcccaucuucuggaucggccucaucuccuccgucugcugcgucuucgcccagaccgacgagaaccgcugccucaaggccaacgccaaguccugcggcgagugcauccaggccggccccaacugcggcuggugcaccaacuccaccuuccuccaggagggcaugcccaccuccgcccgcugcgacgaccucgaggcccucaagaagaagggcugcccccccgacgacaucgagaacccccgcggcuccaaggacaucaagaagaacaagaacgucaccaaccgcuccaagggcaccgccgagaagcucaagcccgaggacaucacccagauccagccccagcagcucguccuccgccuccgcuccggcgagccccagaccuucacccucaaguucaagcgcgccgaggacuaccccaucgaccucuacuaccucauggaccucuccuacuccaugaaggacgaccucgagaacgucaagucccucggcaccgaccucaugaacgagaugcgccgcaucaccuccgacuuccgcaucggcuucggcuccuucgucgagaagaccgucaugcccuacaucuccaccacccccgccaagcuccgcaaccccugcaccuccgagcagaacugcaccucccccuucuccuacaagaacguccucucccucaccaacaagggcgaggucuucaacgagcucgucggcaagcagcgcaucuccggcaaccucgacucccccgagggcggcuucgacgccaucaugcaggucgccgucugcggcucccucaucggcuggcgcaacgucacccgccuccucgucuucuccaccgacgccggcuuccacuucgccggcgacggcaagcucggcggcaucguccuccccaacgacggccagugccaccucgagaacaacauguacaccaugucccacuacuacgacuaccccuccaucgcccaccucguccagaagcucuccgagaacaacauccagaccaucuucgccgucaccgaggaguuccagcccgucuacaaggagcucaagaaccucauccccaaguccgccgucggcacccucuccgccaacuccuccaacgucauccagcucaucaucgacgccuacaacucccucuccuccgaggucauccucgagaacggcaagcucuccgagggcgucaccaucuccuacaaguccuacugcaagaacggcgucaacggcaccggcgagaacggccgcaagugcuccaacaucuccaucggcgacgagguccaguucgagaucuccaucaccuccaacaagugccccaagaaggacuccgacuccuucaagauccgcccccucggcuucaccgaggaggucgaggucauccuccaguacaucugcgagugcgagugccaguccgagggcauccccgagucccccaagugccacgagggcaacggcaccuucgagugcggcgccugccgcugcaacgagggccgcgucggccgccacugcgagugcuccaccgacgaggucaacuccgaggacauggacgccuacugccgcaaggagaacuccuccgagaucugcuccaacaacggcgagugcgucugcggccagugcgucugccgcaagcgcgacaacaccaacgagaucuacuccggcaaguucugcgagugcgacaacuucaacugcgaccgcuccaacggccucaucugcggcggcaacggcgucugcaagugccgcgucugcgagugcaaccccaacuacaccggcuccgccugcgacugcucccucgacaccuccaccugcgaggccuccaacggccagaucugcaacggccgcggcaucugcgagugcggcgucugcaagugcaccgaccccaaguuccagggccagaccugcgagaugugccagaccugccucggcgucugcgccgagcacaaggagugcguccagugccgcgccuucaacaagggcgagaagaaggacaccugcacccaggagugcuccuacuucaacaucaccaaggucgagucccgcgacaagcucccccagcccguccagcccgaccccgucucccacugcaaggagaaggacgucgacgacugcugguucuacuucaccuacuccgucaacggcaacaacgaggucaugguccacgucgucgagaaccccgagugccccaccggccccgacaucauccccaucgucgccggcgucgucgccggcaucguccucaucggccucgcccuccuccucaucuggaagcuccucaugaucauccacgaccgccgcgaguucgccaaguucgagaaggagaagaugaacgccaagugggacacccaggagaaccccaucuacaagucccccaucaacaacuucaagaaccccaacuacggccgcaaggccggccucuga

SEQ ID NO: 44796 - RNA, 2310 nt, Artificial Sequence
  derived and/or modified sequence opt2 from ITGB2__Homo_sapiens__NP_000202
augcucggccuccgccccccccuccucgcccucgucggccuccucucccucggcugcguccucucccaggagugcaccaaguucaaggucuccuccugccgcgagugcaucgaguccggccccggcugcaccuggugccagaagcucaacuucaccggccccggcgaccccgacuccauccgcugcgacacccgcccccagcuccucaugcgcggcugcgccgccgacgacaucauggaccccaccucccucgccgagacccaggaggaccacaacggcggccagaagcagcucuccccccagaaggucacccucuaccuccgccccggccaggccgccgccuucaacgucaccuuccgccgcgccaagggcuaccccaucgaccucuacuaccucauggaccucuccuacuccaugcucgacgaccuccgcaacgucaagaagcucggcggcgaccuccuccgcgcccucaacgagaucaccgaguccggccgcaucggcuucggcuccuucgucgacaagaccguccuccccuucgucaacacccaccccgacaagcuccgcaaccccugccccaacaaggagaaggagugccagccccccuucgccuuccgccacguccucaagcucaccaacaacuccaaccaguuccagaccgaggucggcaagcagcucaucuccggcaaccucgacgcccccgagggcggccucgacgccaugaugcaggucgccgccugccccgaggagaucggcuggcgcaacgucacccgccuccucgucuucgccaccgacgacggcuuccacuucgccggcgacggcaagcucggcgccauccucacccccaacgacggccgcugccaccucgaggacaaccucuacaagcgcuccaacgaguucgacuaccccuccgucggccagcucgcccacaagcucgccgagaacaacauccagcccaucuucgccgucaccucccgcauggucaagaccuacgagaagcucaccgagaucauccccaaguccgccgucggcgagcucuccgaggacuccuccaacgucguccaccucaucaagaacgccuacaacaagcucuccucccgcgucuuccucgaccacaacgcccuccccgacacccucaaggucaccuacgacuccuucugcuccaacggcgucacccaccgcaaccagccccgcggcgacugcgacggcguccagaucaacguccccaucaccuuccaggucaaggucaccgccaccgagugcauccaggagcaguccuucgucauccgcgcccucggcuucaccgacaucgucaccguccagguccucccccagugcgagugccgcugccgcgaccagucccgcgaccgcucccucugccacggcaagggcuuccucgagugcggcaucugccgcugcgacaccggcuacaucggcaagaacugcgagugccagacccagggccgcuccucccaggagcucgagggcuccugccgcaaggacaacaacuccaucaucugcuccggccucggcgacugcgucugcggccagugccucugccacaccuccgacguccccggcaagcucaucuacggccaguacugcgagugcgacaccaucaacugcgagcgcuacaacggccaggucugcggcggccccggccgcggccucugcuucugcggcaagugccgcugccaccccggcuucgagggcuccgccugccagugcgagcgcaccaccgagggcugccucaacccccgccgcgucgagugcuccggccgcggccgcugccgcugcaacgucugcgagugccacuccggcuaccagcucccccucugccaggagugccccggcugccccucccccugcggcaaguacaucuccugcgccgagugccucaaguucgagaagggccccuucggcaagaacugcuccgccgccugccccggccuccagcucuccaacaaccccgucaagggccgcaccugcaaggagcgcgacuccgagggcugcugggucgccuacacccucgagcagcaggacggcauggaccgcuaccucaucuacgucgacgagucccgcgagugcgucgccggccccaacaucgccgccaucgucggcggcaccgucgccggcaucguccucaucggcauccuccuccucgucaucuggaaggcccucauccaccucuccgaccuccgcgaguaccgccgcuucgagaaggagaagcucaagucccaguggaacaacgacaacccccucuucaaguccgccaccaccaccgucaugaaccccaaguucgccgaguccuga

SEQ ID NO: 44797 - RNA, 2367 nt, Artificial Sequence
  derived and/or modified sequence opt2 from ITGB3__Homo_sapiens__NP_000203
augcgcgcccgcccccgcccccgcccccucugggccaccguccucgcccucggcgcccucgccggcgucggcgucggcggccccaacaucugcaccacccgcggcgucuccuccugccagcagugccucgccgucucccccaugugcgccuggugcuccgacgaggcccucccccucggcuccccccgcugcgaccucaaggagaaccuccucaaggacaacugcgcccccgaguccaucgaguuccccgucuccgaggcccgcguccucgaggaccgcccccucuccgacaagggcuccggcgacuccucccaggucacccaggucuccccccagcgcaucgcccuccgccuccgccccgacgacuccaagaacuucuccauccagguccgccaggucgaggacuaccccgucgacaucuacuaccucauggaccucuccuacuccaugaaggacgaccucugguccauccagaaccucggcaccaagcucgccacccagaugcgcaagcucaccuccaaccuccgcaucggcuucggcgccuucgucgacaagcccgucucccccuacauguacaucuccccccccgaggcccucgagaaccccugcuacgacaugaagaccaccugccuccccauguucggcuacaagcacguccucacccucaccgaccaggucacccgcuucaacgaggaggucaagaagcaguccgucucccgcaaccgcgacgcccccgagggcggcuucgacgccaucaugcaggccaccgucugcgacgagaagaucggcuggcgcaacgacgccucccaccuccucgucuucaccaccgacgccaagacccacaucgcccucgacggccgccucgccggcaucguccagcccaacgacggccagugccacgucggcuccgacaaccacuacuccgccuccaccaccauggacuaccccucccucggccucaugaccgagaagcucucccagaagaacaucaaccucaucuucgccgucaccgagaacgucgucaaccucuaccagaacuacuccgagcucauccccggcaccaccgucggcguccucuccauggacuccuccaacguccuccagcucaucgucgacgccuacggcaagauccgcuccaaggucgagcucgagguccgcgaccuccccgaggagcucucccucuccuucaacgccaccugccucaacaacgaggucauccccggccucaaguccugcaugggccucaagaucggcgacaccgucuccuucuccaucgaggccaagguccgcggcugcccccaggagaaggagaaguccuucaccaucaagcccgucggcuucaaggacucccucaucguccaggucaccuucgacugcgacugcgccugccaggcccaggccgagcccaacucccaccgcugcaacaacggcaacggcaccuucgagugcggcgucugccgcugcggccccggcuggcucggcucccagugcgagugcuccgaggaggacuaccgccccucccagcaggacgagugcuccccccgcgagggccagcccgucugcucccagcgcggcgagugccucugcggccagugcgucugccacuccuccgacuucggcaagaucaccggcaaguacugcgagugcgacgacuucuccugcguccgcuacaagggcgagaugugcuccggccacggccagugcuccugcggcgacugccucugcgacuccgacuggaccggcuacuacugcaacugcaccacccgcaccgacaccugcauguccuccaacggccuccucugcuccggccgcggcaagugcgagugcggcuccugcgucugcauccagcccggcuccuacggcgacaccugcgagaagugccccaccugccccgacgccugcaccuucaagaaggagugcgucgagugcaagaaguucgaccgcggcgcccuccacgacgagaacaccugcaaccgcuacugccgcgacgagaucgaguccgucaaggagcucaaggacaccggcaaggacgccgucaacugcaccuacaagaacgaggacgacugcgucguccgcuuccaguacuacgaggacuccuccggcaaguccauccucuacgucgucgaggagcccgagugccccaagggccccgacauccucgucguccuccucuccgucaugggcgccauccuccucaucggccucgccgcccuccucaucuggaagcuccucaucaccauccacgaccgcaaggaguucgccaaguucgaggaggagcgcgcccgcgccaagugggacaccgccaacaacccccucuacaaggaggccaccuccaccuucaccaacaucaccuaccgcggcaccuga

SEQ ID NO: 44798 - RNA, 5469 nt, Artificial Sequence
  derived and/or modified sequence opt2 from ITGB4__Homo_sapiens__NP_000204
auggccggcccccgccccucccccugggcccgccuccuccucgccgcccucaucuccgucucccucuccggcacccucgccaaccgcugcaagaaggcccccgucaaguccugcaccgagugcguccgcgucgacaaggacugcgccuacugcaccgacgagauguuccgcgaccgccgcugcaacacccaggccgagcuccucgccgccggcugccagcgcgaguccaucgucgucauggaguccuccuuccagaucaccgaggagacccagaucgacaccacccuccgccgcucccagauguccccccagggccuccgcguccgccuccgccccggcgaggagcgccacuucgagcucgaggucuucgagccccucgagucccccgucgaccucuacauccucauggacuucuccaacuccauguccgacgaccucgacaaccucaagaagaugggccagaaccucgcccgcguccucucccagcucaccuccgacuacaccaucggcuucggcaaguucgucgacaaggucuccgucccccagaccgacaugcgccccgagaagcucaaggagcccuggcccaacuccgacccccccuucuccuucaagaacgucaucucccucaccgaggacgucgacgaguuccgcaacaagcuccagggcgagcgcaucuccggcaaccucgacgcccccgagggcggcuucgacgccauccuccagaccgccgucugcacccgcgacaucggcuggcgccccgacuccacccaccuccucgucuucuccaccgaguccgccuuccacuacgaggccgacggcgccaacguccucgccggcaucaugucccgcaacgacgagcgcugccaccucgacaccaccggcaccuacacccaguaccgcacccaggacuaccccuccguccccacccucguccgccuccucgccaagcacaacaucauccccaucuucgccgucaccaacuacuccuacuccuacuacgagaagcuccacaccuacuuccccgucuccucccucggcguccuccaggaggacuccuccaacaucgucgagcuccucgaggaggccuucaaccgcauccgcuccaaccucgacauccgcgcccucgacuccccccgcggccuccgcaccgaggucaccuccaagauguuccagaagacccgcaccggcuccuuccacauccgccgcggcgaggucggcaucuaccagguccagcuccgcgcccucgagcacgucgacggcacccacgucugccagcuccccgaggaccagaagggcaacauccaccucaagcccuccuucuccgacggccucaagauggacgccggcaucaucugcgacgucugcaccugcgagcuccagaaggagguccgcuccgcccgcugcuccuucaacggcgacuucgucugcggccagugcgucugcuccgagggcugguccggccagaccugcaacugcuccaccggcucccucuccgacauccagcccugccuccgcgagggcgaggacaagcccugcuccggccgcggcgagugccagugcggccacugcgucugcuacggcgagggccgcuacgagggccaguucugcgaguacgacaacuuccagugcccccgcaccuccggcuuccucugcaacgaccgcggccgcugcuccaugggccagugcgucugcgagcccggcuggaccggccccuccugcgacugcccccucuccaacgccaccugcaucgacuccaacggcggcaucugcaacggccgcggccacugcgagugcggccgcugccacugccaccagcagucccucuacaccgacaccaucugcgagaucaacuacuccgccauccaccccggccucugcgaggaccuccgcuccugcguccagugccaggccuggggcaccggcgagaagaagggccgcaccugcgaggagugcaacuucaaggucaagauggucgacgagcucaagcgcgccgaggaggucgucguccgcugcuccuuccgcgacgaggacgacgacugcaccuacuccuacaccauggagggcgacggcgcccccggccccaacuccaccguccucguccacaagaagaaggacugcccccccggcuccuucugguggcucaucccccuccuccuccuccuccucccccuccucgcccuccuccuccuccucugcuggaaguacugcgccugcugcaaggccugccucgcccuccuccccugcugcaaccgcggccacauggucggcuucaaggaggaccacuacaugcuccgcgagaaccucauggccuccgaccaccucgacacccccaugcuccgcuccggcaaccucaagggccgcgacgucguccgcuggaaggucaccaacaacaugcagcgccccggcuucgccacccacgccgccuccaucaaccccaccgagcucguccccuacggccucucccuccgccucgcccgccucugcaccgagaaccuccucaagcccgacacccgcgagugcgcccagcuccgccaggaggucgaggagaaccucaacgaggucuaccgccagaucuccggcguccacaagcuccagcagaccaaguuccgccagcagcccaacgccggcaagaagcaggaccacaccaucgucgacaccguccucauggccccccgcuccgccaagcccgcccuccucaagcucaccgagaagcaggucgagcagcgcgccuuccacgaccucaaggucgcccccggcuacuacacccucaccgccgaccaggacgcccgcggcauggucgaguuccaggagggcgucgagcucgucgacguccgcgucccccucuucauccgccccgaggacgacgacgagaagcagcuccucgucgaggccaucgacguccccgccggcaccgccacccucggccgccgccucgucaacaucaccaucaucaaggagcaggcccgcgacgucgucuccuucgagcagcccgaguucuccgucucccgcggcgaccaggucgcccgcauccccgucauccgccgcguccucgacggcggcaagucccaggucuccuaccgcacccaggacggcaccgcccagggcaaccgcgacuacauccccgucgagggcgagcuccucuuccagcccggcgaggccuggaaggagcuccaggucaagcuccucgagcuccaggaggucgacucccuccuccgcggccgccagguccgccgcuuccacguccagcucuccaaccccaaguucggcgcccaccucggccagccccacuccaccaccaucaucauccgcgaccccgacgagcucgaccgcuccuucaccucccagaugcucuccucccagccccccccccacggcgaccucggcgccccccagaaccccaacgccaaggccgccggcucccgcaagauccacuucaacuggcucccccccuccggcaagcccaugggcuaccgcgucaaguacuggauccagggcgacuccgaguccgaggcccaccuccucgacuccaagguccccuccgucgagcucaccaaccucuaccccuacugcgacuacgagaugaaggucugcgccuacggcgcccagggcgagggccccuacuccucccucgucuccugccgcacccaccaggagguccccuccgagcccggccgccucgccuucaacgucgucuccuccaccgucacccagcucuccugggccgagcccgccgagaccaacggcgagaucaccgccuacgaggucugcuacggccucgucaacgacgacaaccgccccaucggccccaugaagaagguccucgucgacaaccccaagaaccgcaugcuccucaucgagaaccuccgcgagucccagcccuaccgcuacaccgucaaggcccgcaacggcgccggcuggggccccgagcgcgaggccaucaucaaccucgccacccagcccaagcgccccauguccauccccaucauccccgacauccccaucgucgacgcccaguccggcgaggacuacgacuccuuccucauguacuccgacgacguccuccgcucccccuccggcucccagcgccccuccgucuccgacgacaccggcugcggcuggaaguucgagccccuccucggcgaggagcucgaccuccgccgcgucaccuggcgccucccccccgagcucaucccccgccucuccgccuccuccggccgcuccuccgacgccgaggccccccacggcccccccgacgacggcggcgccggcggcaagggcggcucccucccccgcuccgccacccccggcccccccggcgagcaccucgucaacggccgcauggacuucgccuuccccggcuccaccaacucccuccaccgcaugaccaccaccuccgccgccgccuacggcacccaccucuccccccacgucccccaccgcguccucuccaccuccuccacccucacccgcgacuacaacucccucacccgcuccgagcacucccacuccaccacccucccccgcgacuacuccacccucaccuccgucuccucccacgacucccgccucaccgccggcguccccgacacccccacccgccucgucuucuccgcccucggccccaccucccuccgcgucuccuggcaggagccccgcugcgagcgcccccuccagggcuacuccgucgaguaccagcuccucaacggcggcgagcuccaccgccucaacauccccaaccccgcccagaccuccgucgucgucgaggaccuccuccccaaccacuccuacgucuuccgcguccgcgcccagucccaggagggcuggggccgcgagcgcgagggcgucaucaccaucgagucccagguccacccccaguccccccucugcccccuccccggcuccgccuucacccucuccacccccuccgcccccggcccccucgucuucaccgcccucucccccgacucccuccagcucuccugggagcgcccccgccgccccaacggcgacaucgucggcuaccucgucaccugcgagauggcccagggcggcggccccgccaccgccuuccgcgucgacggcgacucccccgagucccgccucaccguccccggccucuccgagaacguccccuacaaguucaagguccaggcccgcaccaccgagggcuucggccccgagcgcgagggcaucaucaccaucgagucccaggacggcggccccuucccccagcucggcucccgcgccggccucuuccagcacccccuccaguccgaguacuccuccaucaccaccacccacaccuccgccaccgagcccuuccucgucgacggccucacccucggcgcccagcaccucgaggccggcggcucccucacccgccacgucacccaggaguucgucucccgcacccucaccaccuccggcacccucuccacccacauggaccagcaguucuuccagaccuga

SEQ ID NO: 44799 - RNA, 2400 nt, Artificial Sequence
  derived and/or modified sequence opt2 from ITGB5__Homo_sapiens__NP_002204
augccccgcgcccccgccccccucuacgccugccuccucggccucugcgcccuccucccccgccucgccggccucaacaucugcaccuccggcuccgccaccuccugcgaggagugccuccucauccaccccaagugcgccuggugcuccaaggaggacuucggcuccccccgcuccaucaccucccgcugcgaccuccgcgccaaccucgucaagaacggcugcggcggcgagaucgagucccccgccuccuccuuccacguccuccgcucccucccccucuccuccaagggcuccggcuccgccggcugggacgucauccagaugaccccccaggagaucgccgucaaccuccgccccggcgacaagaccaccuuccagcuccagguccgccaggucgaggacuaccccgucgaccucuacuaccucauggaccucucccucuccaugaaggacgaccucgacaacauccgcucccucggcaccaagcucgccgaggagaugcgcaagcucaccuccaacuuccgccucggcuucggcuccuucgucgacaaggacaucucccccuucuccuacaccgccccccgcuaccagaccaaccccugcaucggcuacaagcucuuccccaacugcguccccuccuucggcuuccgccaccuccucccccucaccgaccgcgucgacuccuucaacgaggagguccgcaagcagcgcgucucccgcaaccgcgacgcccccgagggcggcuucgacgccguccuccaggccgccgucugcaaggagaagaucggcuggcgcaaggacgcccuccaccuccucgucuucaccaccgacgacgucccccacaucgcccucgacggcaagcucggcggccucguccagccccacgacggccagugccaccucaacgaggccaacgaguacaccgccuccaaccagauggacuaccccucccucgcccuccucggcgagaagcucgccgagaacaacaucaaccucaucuucgccgucaccaagaaccacuacaugcucuacaagaacuucaccgcccucauccccggcaccaccgucgagauccucgacggcgacuccaagaacaucauccagcucaucaucaacgccuacaacuccauccgcuccaaggucgagcucuccgucugggaccagcccgaggaccucaaccucuucuucaccgccaccugccaggacggcgucuccuaccccggccagcgcaagugcgagggccucaagaucggcgacaccgccuccuucgaggucucccucgaggcccgcuccugccccucccgccacaccgagcacgucuucgcccuccgccccgucggcuuccgcgacucccucgaggucggcgucaccuacaacugcaccugcggcugcuccgucggccucgagcccaacuccgcccgcugcaacggcuccggcaccuacgucugcggccucugcgagugcucccccggcuaccucggcacccgcugcgagugccaggacggcgagaaccaguccgucuaccagaaccucugccgcgaggccgagggcaagccccucugcuccggccgcggcgacugcuccugcaaccagugcuccugcuucgaguccgaguucggcaagaucuacggccccuucugcgagugcgacaacuucuccugcgcccgcaacaagggcguccucugcuccggccacggcgagugccacugcggcgagugcaagugccacgccggcuacaucggcgacaacugcaacugcuccaccgacaucuccaccugccgcggccgcgacggccagaucugcuccgagcgcggccacugccucugcggccagugccagugcaccgagcccggcgccuucggcgagaugugcgagaagugccccaccugccccgacgccugcuccaccaagcgcgacugcgucgagugccuccuccuccacuccggcaagcccgacaaccagaccugccacucccucugccgcgacgaggucaucaccugggucgacaccaucgucaaggacgaccaggaggccguccucugcuucuacaagaccgccaaggacugcgucaugauguucaccuacgucgagcuccccuccggcaaguccaaccucaccguccuccgcgagcccgagugcggcaacacccccaacgccaugaccauccuccucgccgucgucggcuccauccuccucgucggccucgcccuccucgccaucuggaagcuccucgucaccauccacgaccgccgcgaguucgccaaguuccaguccgagcgcucccgcgcccgcuacgagauggccuccaacccccucuaccgcaagcccaucuccacccacaccgucgacuucaccuucaacaaguucaacaaguccuacaacggcaccgucgacuga

SEQ ID NO: 44800 - RNA, 2367 nt, Artificial Sequence
  derived and/or modified sequence opt2 from ITGB6__Homo_sapiens__NP_000879
augggcaucgagcuccucugccucuucuuccucuuccucggccgcaacgaccacguccagggcggcugcgcccucggcggcgccgagaccugcgaggacugccuccucaucggcccccagugcgccuggugcgcccaggagaacuucacccaccccuccggcgucggcgagcgcugcgacacccccgccaaccuccucgccaagggcugccagcucaacuucaucgagaaccccgucucccaggucgagauccucaagaacaagccccucuccgucggccgccagaagaacuccuccgacaucguccagaucgccccccagucccucauccucaagcuccgccccggcggcgcccagacccuccagguccacguccgccagaccgaggacuaccccgucgaccucuacuaccucauggaccucuccgccuccauggacgacgaccucaacaccaucaaggagcucggcucccgccucuccaaggagauguccaagcucaccuccaacuuccgccucggcuucggcuccuucgucgagaagcccgucucccccuucgucaagaccacccccgaggagaucgccaaccccugcuccuccauccccuacuucugccuccccaccuucggcuucaagcacauccucccccucaccaacgacgccgagcgcuucaacgagaucgucaagaaccagaagaucuccgccaacaucgacacccccgagggcggcuucgacgccaucaugcaggccgccgucugcaaggagaagaucggcuggcgcaacgacucccuccaccuccucgucuucgucuccgacgccgacucccacuucggcauggacuccaagcucgccggcaucgucauccccaacgacggccucugccaccucgacuccaagaacgaguacuccauguccaccguccucgaguaccccaccaucggccagcucaucgacaagcucguccagaacaacguccuccucaucuucgccgucacccaggagcagguccaccucuacgagaacuacgccaagcucauccccggcgccaccgucggccuccuccagaaggacuccggcaacauccuccagcucaucaucuccgccuacgaggagcuccgcuccgaggucgagcucgagguccucggcgacaccgagggccucaaccucuccuucaccgccaucugcaacaacggcacccucuuccagcaccagaagaagugcucccacaugaaggucggcgacaccgccuccuucuccgucaccgucaacaucccccacugcgagcgccgcucccgccacaucaucaucaagcccgucggccucggcgacgcccucgagcuccucgucucccccgagugcaacugcgacugccagaaggaggucgaggucaacuccuccaagugccaccacggcaacggcuccuuccagugcggcgucugcgccugccaccccggccacaugggcccccgcugcgagugcggcgaggacaugcucuccaccgacuccugcaaggaggcccccgaccaccccuccugcuccggccgcggcgacugcuacugcggccagugcaucugccaccucucccccuacggcaacaucuacggccccuacugccagugcgacaacuucuccugcguccgccacaagggccuccucugcggcggcaacggcgacugcgacugcggcgagugcgucugccgcuccggcuggaccggcgaguacugcaacugcaccaccuccaccgacuccugcgucuccgaggacggcguccucugcuccggccgcggcgacugcgucugcggcaagugcgucugcaccaaccccggcgccuccggccccaccugcgagcgcugccccaccugcggcgaccccugcaacuccaagcgcuccugcaucgagugccaccucuccgccgccggccaggcccgcgaggagugcgucgacaagugcaagcucgccggcgccaccaucuccgaggaggaggacuucuccaaggacggcuccgucuccugcucccuccagggcgagaacgagugccucaucaccuuccucaucaccaccgacaacgagggcaagaccaucauccacuccaucaacgagaaggacugccccaagccccccaacauccccaugaucaugcucggcgucucccucgccauccuccucaucggcgucguccuccucugcaucuggaagcuccucgucuccuuccacgaccgcaaggaggucgccaaguucgaggccgagcgcuccaaggccaaguggcagaccggcaccaacccccucuaccgcggcuccaccuccaccuucaagaacgucaccuacaagcaccgcgagaagcagaaggucgaccucuccaccgacugcuga

SEQ ID NO: 44801 - RNA, 2397 nt, Artificial Sequence
  derived and/or modified sequence opt2 from ITGB7__Homo_sapiens__NP_000880
auggucgcccuccccaugguccucguccuccuccucguccucucccgcggcgaguccgagcucgacgccaagauccccuccaccggcgacgccaccgaguggcgcaacccccaccucuccaugcucggcuccugccagcccgcccccuccugccagaagugcauccucucccaccccuccugcgccuggugcaagcagcucaacuucaccgccuccggcgaggccgaggcccgccgcugcgcccgccgcgaggagcuccucgcccgcggcugcccccucgaggagcucgaggagccccgcggccagcaggagguccuccaggaccagccccucucccagggcgcccgcggcgagggcgccacccagcucgccccccagcgcguccgcgucacccuccgccccggcgagccccagcagcuccagguccgcuuccuccgcgccgagggcuaccccgucgaccucuacuaccucauggaccucuccuacuccaugaaggacgaccucgagcgcguccgccagcucggccacgcccuccucguccgccuccaggaggucacccacuccguccgcaucggcuucggcuccuucgucgacaagaccguccuccccuucgucuccaccguccccuccaagcuccgccaccccugccccacccgccucgagcgcugccagucccccuucuccuuccaccacguccucucccucaccggcgacgcccaggccuucgagcgcgaggucggccgccaguccgucuccggcaaccucgacucccccgagggcggcuucgacgccauccuccaggccgcccucugccaggagcagaucggcuggcgcaacgucucccgccuccucgucuucaccuccgacgacaccuuccacaccgccggcgacggcaagcucggcggcaucuucaugcccuccgacggccacugccaccucgacuccaacggccucuacucccgcuccaccgaguucgacuaccccuccgucggccaggucgcccaggcccucuccgccgccaacauccagcccaucuucgccgucaccuccgccgcccuccccgucuaccaggagcucuccaagcucauccccaaguccgccgucggcgagcucuccgaggacuccuccaacgucguccagcucaucauggacgccuacaacucccucuccuccaccgucacccucgagcacuccucccucccccccggcguccacaucuccuacgagucccagugcgagggccccgagaagcgcgagggcaaggccgaggaccgcggccagugcaaccacguccgcaucaaccagaccgucaccuucugggucucccuccaggccacccacugccuccccgagccccaccuccuccgccuccgcgcccucggcuucuccgaggagcucaucgucgagcuccacacccucugcgacugcaacugcuccgacacccagccccaggccccccacugcuccgacggccagggccaccuccagugcggcgucugcuccugcgcccccggccgccucggccgccucugcgagugcuccgucgccgagcucuccucccccgaccucgaguccggcugccgcgcccccaacggcaccggcccccucugcuccggcaagggccacugccagugcggccgcugcuccugcuccggccaguccuccggccaccucugcgagugcgacgacgccuccugcgagcgccacgagggcauccucugcggcggcuucggccgcugccagugcggcgucugccacugccacgccaaccgcaccggccgcgccugcgagugcuccggcgacauggacuccugcaucucccccgagggcggccucugcuccggccacggccgcugcaagugcaaccgcugccagugccucgacggcuacuacggcgcccucugcgaccagugccccggcugcaagacccccugcgagcgccaccgcgacugcgccgagugcggcgccuuccgcaccggcccccucgccaccaacugcuccaccgccugcgcccacaccaacgucacccucgcccucgcccccauccucgacgacggcuggugcaaggagcgcacccucgacaaccagcucuucuucuuccucgucgaggacgacgcccgcggcaccgucguccuccgcguccgcccccaggagaagggcgccgaccacacccaggccaucguccucggcugcgucggcggcaucgucgccgucggccucggccucguccucgccuaccgccucuccgucgagaucuacgaccgccgcgaguacucccgcuucgagaaggagcagcagcagcucaacuggaagcaggacuccaacccccucuacaaguccgccaucaccaccaccaucaacccccgcuuccaggaggccgacucccccacccucuga

SEQ ID NO: 44802 - RNA, 2310 nt, Artificial Sequence
  derived and/or modified sequence opt2 from ITGB8__Homo_sapiens__NP_002205
augugcggcuccgcccucgccuucuucaccgccgccuucgucugccuccagaacgaccgccgcggccccgccuccuuccucugggccgccugggucuucucccucguccucggccucggccagggcgaggacaaccgcugcgccuccuccaacgccgccuccugcgcccgcugccucgcccucggccccgagugcggcuggugcguccaggaggacuucaucuccggcggcucccgcuccgagcgcugcgacaucgucuccaaccucaucuccaagggcugcuccgucgacuccaucgaguaccccuccguccacgucaucauccccaccgagaacgagaucaacacccaggucacccccggcgaggucuccauccagcuccgccccggcgccgaggccaacuucaugcucaagguccacccccucaagaaguaccccgucgaccucuacuaccucgucgacgucuccgccuccaugcacaacaacaucgagaagcucaacuccgucggcaacgaccucucccgcaagauggccuucuucucccgcgacuuccgccucggcuucggcuccuacgucgacaagaccgucucccccuacaucuccauccaccccgagcgcauccacaaccagugcuccgacuacaaccucgacugcaugcccccccacggcuacauccacguccucucccucaccgagaacaucaccgaguucgagaaggccguccaccgccagaagaucuccggcaacaucgacacccccgagggcggcuucgacgccaugcuccaggccgccgucugcgagucccacaucggcuggcgcaaggaggccaagcgccuccuccucgucaugaccgaccagaccucccaccucgcccucgacuccaagcucgccggcaucgucguccccaacgacggcaacugccaccucaagaacaacgucuacgucaaguccaccaccauggagcaccccucccucggccagcucuccgagaagcucaucgacaacaacaucaacgucaucuucgccguccagggcaagcaguuccacugguacaaggaccuccucccccuccuccccggcaccaucgccggcgagaucgaguccaaggccgccaaccucaacaaccucgucgucgaggccuaccagaagcucaucuccgaggucaagguccaggucgagaaccagguccagggcaucuacuucaacaucaccgccaucugccccgacggcucccgcaagcccggcauggagggcugccgcaacgucaccuccaacgacgagguccucuucaacgucaccgucaccaugaagaagugcgacgucaccggcggcaagaacuacgccaucaucaagcccaucggcuucaacgagaccgccaagauccacauccaccgcaacugcuccugccagugcgaggacaaccgcggccccaagggcaagugcgucgacgagaccuuccucgacuccaagugcuuccagugcgacgagaacaagugccacuucgacgaggaccaguucuccuccgaguccugcaagucccacaaggaccagcccgucugcuccggccgcggcgucugcgucugcggcaagugcuccugccacaagaucaagcucggcaaggucuacggcaaguacugcgagaaggacgacuucuccugccccuaccaccacggcaaccucugcgccggccacggcgagugcgaggccggccgcugccagugcuucuccggcugggagggcgaccgcugccagugccccuccgccgccgcccagcacugcgucaacuccaagggccaggucugcuccggccgcggcaccugcgucugcggccgcugcgagugcaccgacccccgcuccaucggccgcuucugcgagcacugccccaccugcuacaccgccugcaaggagaacuggaacugcaugcagugccuccacccccacaaccucucccaggccauccucgaccagugcaagaccuccugcgcccucauggagcagcagcacuacgucgaccagaccuccgagugcuucuccucccccuccuaccuccgcaucuucuucaucaucuucaucgucaccuuccucaucggccuccucaagguccucaucauccgccaggucauccuccaguggaacuccaacaagaucaaguccuccuccgacuaccgcgucuccgccuccaagaaggacaagcucauccuccaguccgucugcacccgcgccgucaccuaccgccgcgagaagcccgaggagaucaagauggacaucuccaagcucaacgcccacgagaccuuccgcugcaacuucuga

SEQ ID NO: 44803 - RNA, 1062 nt, Artificial Sequence
  derived and/or modified sequence opt2 from ITGBL1__Homo_sapiens__NP_001258683
augugcaagaacucccaggacaucaucugcuccaacgccggcaccugccacugcggccgcugcaagugcgacaacuccgacggcuccggccucgucuacggcaaguucugcgagugcgacgaccgcgagugcaucgacgacgagaccgaggagaucugcggcggccacggcaagugcuacugcggcaacugcuacugcaaggccggcuggcacggcgacaagugcgaguuccagugcgacaucacccccugggaguccaagcgccgcugcaccucccccgacggcaagaucugcuccaaccgcggcaccugcgucugcggcgagugcaccugccacgacgucgaccccaccggcgacuggggcgacauccacggcgacaccugcgagugcgacgagcgcgacugccgcgccgucuacgaccgcuacuccgacgacuucugcuccggccacggccagugcaacugcggccgcugcgacugcaaggccggcugguacggcaagaagugcgagcacccccaguccugcacccucuccgccgaggaguccauccgcaagugccagggcuccuccgaccuccccugcuccggccgcggcaagugcgagugcggcaagugcaccugcuacccccccggcgaccgccgcgucuacggcaagaccugcgagugcgacgaccgccgcugcgaggaccucgacggcgucgucugcggcggccacggcaccugcuccugcggccgcugcgucugcgagcgcggcugguucggcaagcucugccagcacccccgcaagugcaacaugaccgaggagcaguccaagaaccucugcgaguccgccgacggcauccucugcuccggcaagggcuccugccacugcggcaagugcaucugcuccgccgaggagugguacaucuccggcgaguucugcgacugcgacgaccgcgacugcgacaagcacgacggccucaucugcaccggcaacggcaucugcuccugcggcaacugcgagugcugggacggcuggaacggcaacgccugcgagaucuggcucggcuccgaguaccccuga

SEQ ID NO: 44804 - RNA, 2736 nt, Artificial Sequence
  derived and/or modified sequence opt2 from ITIH1__Homo_sapiens__NP_002206
auggacggcgccaugggcccccgcggccuccuccucugcauguaccucgucucccuccucauccuccaggccaugcccgcccucggcuccgccaccggccgcuccaaguccuccgagaagcgccaggccgucgacaccgccgucgacggcgucuucauccgcucccucaaggucaacugcaaggucaccucccgcuucgcccacuacgucgucaccucccaggucgucaacaccgccaacgaggcccgcgaggucgccuucgaccucgagauccccaagaccgccuucaucuccgacuucgccgucaccgccgacggcaacgccuucaucggcgacaucaaggacaaggucaccgccuggaagcaguaccgcaaggccgccaucuccggcgagaacgccggccucguccgcgccuccggccgcaccauggagcaguucaccauccaccucaccgucaacccccaguccaaggucaccuuccagcucaccuacgaggagguccucaagcgcaaccacaugcaguacgagaucgucaucaaggucaagcccaagcagcucguccaccacuucgagaucgacgucgacaucuucgagccccagggcaucuccaagcucgacgcccaggccuccuuccuccccaaggagcucgccgcccagaccaucaagaaguccuucuccggcaagaagggccacguccucuuccgccccaccgucucccagcagcaguccugccccaccugcuccaccucccuccucaacggccacuucaaggucaccuacgacgucucccgcgacaagaucugcgaccuccucgucgccaacaaccacuucgcccacuucuucgccccccagaaccucaccaacaugaacaagaacgucgucuucgucaucgacaucuccggcuccaugcgcggccagaaggucaagcagaccaaggaggcccuccucaagauccucggcgacaugcagcccggcgacuacuucgaccucguccucuucggcacccgcguccaguccuggaagggcucccucguccaggccuccgaggccaaccuccaggccgcccaggacuucguccgcggcuucucccucgacgaggccaccaaccucaacggcggccuccuccgcggcaucgagauccucaaccagguccaggagucccuccccgagcucuccaaccacgccuccauccucaucaugcucaccgacggcgaccccaccgagggcgucaccgaccgcucccagauccucaagaacguccgcaacgccauccgcggccgcuucccccucuacaaccucggcuucggccacaacgucgacuucaacuuccucgaggucauguccauggagaacaacggccgcgcccagcgcaucuacgaggaccacgacgccacccagcagcuccagggcuucuacucccaggucgccaagccccuccucgucgacgucgaccuccaguacccccaggacgccguccucgcccucacccagaaccaccacaagcaguacuacgagggcuccgagaucgucgucgccggccgcaucgccgacaacaagcaguccuccuucaaggccgacguccaggcccacggcgagggccaggaguucuccaucaccugccucgucgacgaggaggagaugaagaagcuccuccgcgagcgcggccacaugcucgagaaccacgucgagcgccucugggccuaccucaccauccaggagcuccucgccaagcgcaugaaggucgaccgcgaggagcgcgccaaccucuccucccaggcccuccagaugucccucgacuacggcuucgucaccccccucaccuccauguccauccgcggcauggccgaccaggacggccucaagcccaccaucgacaagcccuccgaggacucccccccccucgagaugcucggcccccgccgcaccuucguccucuccgcccuccagcccucccccacccacuccuccuccaacacccagcgccuccccgaccgcgucaccggcgucgacaccgacccccacuucaucauccacgucccccagaaggaggacacccucugcuucaacaucaacgaggagcccggcgucauccucucccucguccaggaccccaacaccggcuucuccgucaacggccagcucaucggcaacaaggcccgcucccccggccagcacgacggcaccuacuucggccgccucggcaucgccaaccccgccaccgacuuccagcucgaggucaccccccagaacaucacccucaaccccggcuucggcggccccgucuucuccuggcgcgaccaggccguccuccgccaggacggcgucgucgucaccaucaacaagaagcgcaaccucgucgucuccgucgacgacggcggcaccuucgaggucguccuccaccgcgucuggaagggcuccuccguccaccaggacuuccucggcuucuacguccucgacucccaccgcauguccgcccgcacccacggccuccucggccaguucuuccaccccaucggcuucgaggucuccgacauccaccccggcuccgaccccaccaagcccgacgccaccauggucguccgcaaccgccgccucaccgucacccgcggccuccagaaggacuacuccaaggaccccuggcacggcgccgaggucuccugcugguucauccacaacaacggcgccggccucaucgacggcgccuacaccgacuacaucguccccgacaucuucuga

SEQ ID NO: 44805 - RNA, 2841 nt, Artificial Sequence
  derived and/or modified sequence opt2 from ITIH2__Homo_sapiens__NP_002207
augaagcgccucaccugcuucuucaucugcuucuuccucuccgaggucuccggcuucgagauccccaucaacggccucuccgaguucgucgacuacgaggaccucgucgagcucgcccccggcaaguuccagcucgucgccgagaaccgccgcuaccagcgcucccuccccggcgaguccgaggagaugauggaggaggucgaccaggucacccucuacuccuacaagguccaguccaccaucaccucccgcauggccaccaccaugauccaguccaaggucgucaacaacuccccccagccccagaacgucgucuucgacguccagauccccaagggcgccuucaucuccaacuucuccaugaccgucgacggcaagaccuuccgcuccuccaucaaggagaagaccgucggccgcgcccucuacgcccaggcccgcgccaagggcaagaccgccggccucguccgcuccuccgcccucgacauggagaacuuccgcaccgaggucaacguccuccccggcgccaagguccaguucgagcuccacuaccaggaggucaaguggcgcaagcucggcuccuacgagcaccgcaucuaccuccagcccggccgccucgccaagcaccucgaggucgacgucugggucaucgagccccagggccuccgcuuccuccacguccccgacaccuucgagggccacuucgacggcguccccgucaucuccaagggccagcagaaggcccacgucuccuucaagcccaccgucgcccagcagcgcaucugccccaacugccgcgagaccgccgucgacggcgagcucgucguccucuacgacgucaagcgcgaggagaaggccggcgagcucgaggucuucaacggcuacuucguccacuucuucgcccccgacaaccucgaccccauccccaagaacauccucuucgucaucgacgucuccggcuccauguggggcgucaagaugaagcagaccgucgaggccaugaagaccauccucgacgaccuccgcgccgaggaccacuucuccgucaucgacuucaaccagaacauccgcaccuggcgcaacgaccucaucuccgccaccaagacccaggucgccgacgccaagcgcuacaucgagaagauccagcccuccggcggcaccaacaucaacgaggcccuccuccgcgccaucuucauccucaacgaggccaacaaccucggccuccucgaccccaacuccgucucccucaucauccucgucuccgacggcgaccccaccgucggcgagcucaagcucuccaagauccagaagaacgucaaggagaacauccaggacaacaucucccucuucucccucggcaugggcuucgacgucgacuacgacuuccucaagcgccucuccaacgagaaccacggcaucgcccagcgcaucuacggcaaccaggacaccuccucccagcucaagaaguucuacaaccaggucuccaccccccuccuccgcaacguccaguucaacuacccccacaccuccgucaccgacgucacccagaacaacuuccacaacuacuucggcggcuccgagaucgucgucgccggcaaguucgaccccgccaagcucgaccagaucgaguccgucaucaccgccaccuccgccaacacccagcucguccucgagacccucgcccagauggacgaccuccaggacuuccucuccaaggacaagcacgccgaccccgacuucacccgcaagcucugggccuaccucaccaucaaccagcuccucgccgagcgcucccucgcccccaccgccgccgccaagcgccgcaucacccgcuccauccuccagaugucccucgaccaccacaucgucaccccccucaccucccucgucaucgagaacgaggccggcgacgagcgcaugcucgccgacgcccccccccaggaccccuccugcugcuccggcgcccucuacuacggcuccaaggucguccccgacuccacccccuccugggccaaccccucccccacccccgucaucuccaugcucgcccagggcucccagguccucgaguccaccccccccccccacgucaugcgcgucgagaacgacccccacuucaucaucuaccuccccaagucccagaagaacaucugcuucaacaucgacuccgagcccggcaagauccucaaccucgucuccgaccccgaguccggcaucgucgucaacggccagcucgucggcgccaagaagcccaacaacggcaagcucuccaccuacuucggcaagcucggcuucuacuuccaguccgaggacaucaagaucgagaucuccaccgagaccaucacccucucccacggcuccuccaccuucucccucuccugguccgacaccgcccaggucaccaaccagcgcguccagaucuccgucaagaaggagaaggucgucaccaucacccucgacaaggagauguccuucuccguccuccuccaccgcgucuggaagaagcaccccgucaacgucgacuuccucggcaucuacaucccccccaccaacaaguucucccccaaggcccacggccucaucggccaguucaugcaggagcccaagauccacaucuucaacgagcgccccggcaaggaccccgagaagcccgaggccuccauggaggucaagggccagaagcucaucaucacccgcggccuccagaaggacuaccgcaccgaccucgucuucggcaccgacgucaccugcugguucguccacaacuccggcaagggcuucaucgacggccacuacaaggacuacuucgucccccagcucuacuccuuccucaagcgccccuga

SEQ ID NO: 44806 - RNA, 2673 nt, Artificial Sequence
  derived and/or modified sequence opt2 from ITIH3__Homo_sapiens__NP_002208
auggccuucgccugguggcccugccucauccucgcccuccucuccucccucgccgccuccggcuucccccgcucccccuuccgccuccucggcaagcgcucccuccccgagggcgucgccaacggcaucgaggucuacuccaccaagaucaacuccaaggucaccucccgcuucgcccacaacgucgucaccaugcgcgccgucaaccgcgccgacaccgccaaggaggucuccuucgacgucgagcuccccaagaccgccuucaucaccaacuucacccucaccaucgacggcgucaccuaccccggcaacgucaaggagaaggaggucgccaagaagcaguacgagaaggccgucucccagggcaagaccgccggccucgucaaggccuccggccgcaagcucgagaaguucaccgucuccgucaacgucgccgccggcuccaaggucaccuucgagcucaccuacgaggagcuccucaagcgccacaagggcaaguacgagauguaccucaagguccagcccaagcagcucgucaagcacuucgagaucgaggucgacaucuucgagccccagggcaucuccaugcucgacgccgaggccuccuucaucaccaacgaccuccucggcuccgcccucaccaaguccuucuccggcaagaagggccacgucuccuucaagcccucccucgaccagcagcgcuccugccccaccugcaccgacucccuccucaacggcgacuucaccaucaccuacgacgucaaccgcgagucccccggcaacguccagaucgucaacggcuacuucguccacuucuucgccccccagggccuccccgucguccccaagaacgucgccuucgucaucgacaucuccggcuccauggccggccgcaagcucgagcagaccaaggaggcccuccuccgcauccucgaggacaugcaggaggaggacuaccucaacuucauccucuucuccggcgacgucuccaccuggaaggagcaccucguccaggccacccccgagaaccuccaggaggcccgcaccuucgucaaguccauggaggacaagggcaugaccaacaucaacgacggccuccuccgcggcaucuccaugcucaacaaggcccgcgaggagcaccgcauccccgagcgcuccaccuccaucgucaucaugcucaccgacggcgacgccaacgucggcgagucccgccccgagaagauccaggagaacguccgcaacgccaucggcggcaaguucccccucuacaaccucggcuucggcaacaaccucaacuacaacuuccucgagaacauggcccucgagaaccacggcuucgcccgccgcaucuacgaggacuccgacgccgaccuccagcuccagggcuucuacgaggaggucgccaacccccuccucaccggcgucgagauggaguaccccgagaacgccauccucgaccucacccagaacaccuaccagcacuucuacgacggcuccgagaucgucgucgccggccgccucgucgacgaggacaugaacuccuucaaggccgacgucaagggccacggcgccaccaacgaccucaccuucaccgaggaggucgacaugaaggagauggagaaggcccuccaggagcgcgacuacaucuucggcaacuacaucgagcgccucugggccuaccucaccaucgagcagcuccucgagaagcgcaagaacgcccacggcgaggagaaggagaaccucaccgcccgcgcccucgaccucucccucaaguaccacuucgucaccccccucaccuccauggucgucaccaagcccgaggacaacgaggacgagcgcgccaucgccgacaagcccggcgaggacgccgaggccacccccgucucccccgccauguccuaccucaccuccuaccagcccccccagaaccccuacuacuacgucgacggcgacccccacuucaucauccagauccccgagaaggacgacgcccucugcuucaacaucgacgaggcccccggcaccguccuccgccucauccaggacgccgucaccggccucaccgucaacggccagaucaccggcgacaagcgcggcucccccgacuccaagacccgcaagaccuacuucggcaagcucggcaucgccaacgcccagauggacuuccaggucgaggucaccaccgagaagaucacccucuggaaccgcgccguccccuccaccuucuccuggcucgacaccgucaccgucacccaggacggccucuccaugaugaucaaccgcaagaacauggucgucuccuucggcgacggcgucaccuucgucgucguccuccaccaggucuggaagaagcaccccguccaccgcgacuuccucggcuucuacgucgucgacucccaccgcauguccgcccagacccacggccuccucggccaguucuuccagcccuucgacuucaaggucuccgacauccgccccggcuccgaccccaccaagcccgacgccacccucgucgucaagaaccaccagcucaucgucacccgcggcucccagaaggacuaccgcaaggacgccuccaucggcaccaaggucgucugcugguucguccacaacaacggcgagggccucaucgacggcguccacaccgacuacaucguccccaaccucuucuga

SEQ ID NO: 44807 - RNA, 2703 nt, Artificial Sequence
  derived and/or modified sequence opt2 from ITIH4__Homo_sapiens__NP_001159921
augaagcccccccgccccguccgcaccugcuccaagguccucguccuccucucccuccucgccauccaccagaccaccaccgccgagaagaacggcaucgacaucuacucccucaccgucgacucccgcgucuccucccgcuucgcccacaccgucgucaccucccgcgucgucaaccgcgccaacaccguccaggaggccaccuuccagauggagcuccccaagaaggccuucaucaccaacuucuccaugaucaucgacggcaugaccuaccccggcaucaucaaggagaaggccgaggcccaggcccaguacuccgccgccgucgccaagggcaaguccgccggccucgucaaggccaccggccgcaacauggagcaguuccaggucuccgucuccgucgcccccaacgccaagaucaccuucgagcucgucuacgaggagcuccucaagcgccgccucggcgucuacgagcuccuccucaagguccgcccccagcagcucgucaagcaccuccagauggacauccacaucuucgagccccagggcaucuccuuccucgagaccgaguccaccuucaugaccaaccagcucgucgacgcccucaccaccuggcagaacaagaccaaggcccacauccgcuucaagcccacccucucccagcagcagaagucccccgagcagcaggagaccguccucgacggcaaccucaucauccgcuacgacgucgaccgcgccaucuccggcggcuccauccagaucgagaacggcuacuucguccacuacuucgcccccgagggccucaccaccaugcccaagaacgucgucuucgucaucgacaaguccggcuccauguccggccgcaagauccagcagacccgcgaggcccucaucaagauccucgacgaccucuccccccgcgaccaguucaaccucaucgucuucuccaccgaggccacccaguggcgccccucccucguccccgccuccgccgagaacgucaacaaggcccgcuccuucgccgccggcauccaggcccucggcggcaccaacaucaacgacgccaugcucauggccguccagcuccucgacuccuccaaccaggaggagcgccuccccgagggcuccgucucccucaucauccuccucaccgacggcgaccccaccgucggcgagaccaacccccgcuccauccagaacaacguccgcgaggccgucuccggccgcuacucccucuucugccucggcuucggcuucgacgucuccuacgccuuccucgagaagcucgcccucgacaacggcggccucgcccgccgcauccacgaggacuccgacuccgcccuccagcuccaggacuucuaccaggaggucgccaacccccuccucaccgccgucaccuucgaguaccccuccaacgccgucgaggaggucacccagaacaacuuccgccuccucuucaagggcuccgagauggucgucgccggcaagcuccaggaccgcggccccgacguccucaccgccaccgucuccggcaagcuccccacccagaacaucaccuuccagaccgaguccuccgucgccgagcaggaggccgaguuccagucccccaaguacaucuuccacaacuucauggagcgccucugggccuaccucaccauccagcagcuccucgagcagaccgucuccgccuccgacgccgaccagcaggcccuccgcaaccaggcccucaaccucucccucgccuacuccuucgucaccccccucaccuccauggucgucaccaagcccgacgaccaggagcagucccaggucgccgagaagcccauggagggcgagucccgcaaccgcaacguccacuccgccggcgccgccggcucccgcaugaacuuccgccccggcguccucuccucccgccagcucggccuccccggcccccccgacguccccgaccacgccgccuaccaccccuuccgccgccucgccauccuccccgccuccgccccccccgccaccuccaaccccgaccccgccgucucccgcgucaugaacaugaagaucgaggagaccaccaugaccacccagacccccgcccccauccaggcccccuccgccauccucccccuccccggccaguccgucgagcgccucugcgucgacccccgccaccgccagggccccgucaaccuccucuccgaccccgagcagggcgucgaggucaccggccaguacgagcgcgagaaggccggcuucuccuggaucgaggucaccuucaagaacccccucgucuggguccacgccucccccgagcacgucgucgucacccgcaaccgccgcuccuccgccuacaaguggaaggagacccucuucuccgucaugcccggccucaagaugaccauggacaagaccggccuccuccuccucuccgaccccgacaaggucaccaucggccuccucuucugggacggccgcggcgagggccuccgccuccuccuccgcgacaccgaccgcuucuccucccacgucggcggcacccucggccaguucuaccaggagguccucuggggcucccccgccgccuccgacgacggccgccgcacccuccgcguccagggcaacgaccacuccgccacccgcgagcgccgccucgacuaccaggagggcccccccggcgucgagaucuccugcugguccgucgagcucuga

SEQ ID NO: 44808 - RNA, 2109 nt, Artificial Sequence
  derived and/or modified sequence opt2 from ITIH5__Homo_sapiens__NP_001001851
augcuccuccuccucggccucugccucggccucucccucugcgucggcucccaggaggaggcccaguccuggggccacuccuccgagcaggacggccuccgcgucccccgccagguccgccuccuccagcgccucaagaccaagccccucaugaccgaguucuccgucaaguccaccaucaucucccgcuacgccuucaccaccgucuccugccgcaugcucaaccgcgccuccgaggaccaggacaucgaguuccagaugcagauccccgccgccgccuucaucaccaacuucaccaugcucaucggcgacaaggucuaccagggcgagaucaccgagcgcgagaagaaguccggcgaccgcgucaaggagaagcgcaacaagaccaccgaggagaacggcgagaagggcaccgagaucuuccgcgccuccgccgucauccccuccaaggacaaggccgccuucuuccucuccuacgaggagcuccuccagcgccgccucggcaaguacgagcacuccaucuccguccgcccccagcagcucuccggccgccucuccgucgacgucaacauccucgaguccgccggcaucgccucccucgagguccucccccuccacaacucccgccagcgcggcuccggccgcggcgaggacgacuccggccccccccccuccaccgucaucaaccagaacgagaccuucgccaacaucaucuucaagcccaccgucguccagcaggcccgcaucgcccagaacggcauccucggcgacuucaucauccgcuacgacgucaaccgcgagcaguccaucggcgacauccagguccucaacggcuacuucguccacuacuucgcccccaaggaccuccccccccuccccaagaacgucgucuucguccucgacuccuccgccuccauggucggcaccaagcuccgccagaccaaggacgcccucuucaccauccuccacgaccuccgcccccaggaccgcuucuccaucaucggcuucuccaaccgcaucaaggucuggaaggaccaccucaucuccgucacccccgacuccauccgcgacggcaaggucuacauccaccacaugucccccaccggcggcaccgacaucaacggcgcccuccagcgcgccauccgccuccucaacaaguacgucgcccacuccggcaucggcgaccgcuccgucucccucaucgucuuccucaccgacggcaagcccaccgucggcgagacccacacccucaagauccucaacaacacccgcgaggccgcccgcggccaggucugcaucuucaccaucggcaucggcaacgacgucgacuuccgccuccucgagaagcucucccucgagaacugcggccucacccgccgcguccacgaggaggaggacgccggcucccagcucaucggcuucuacgacgagauccgcaccccccuccucuccgacauccgcaucgacuacccccccuccuccgucguccaggccaccaagacccucuuccccaacuacuucaacggcuccgagaucaucaucgccggcaagcucgucgaccgcaagcucgaccaccuccacgucgaggucaccgccuccaacuccaagaaguucaucauccucaagaccgacguccccguccgcccccagaaggccggcaaggacgucaccggcuccccccgccccggcggcgacggcgagggcgacaccaaccacaucgagcgccucugguccuaccucaccaccaaggagcuccucuccuccuggcuccaguccgacgacgagcccgagaaggagcgccuccgccagcgcgcccaggcccucgccgucuccuaccgcuuccucacccccuucaccuccaugaagcuccgcggccccgucccccgcauggacggccucgaggaggcccacggcauguccgccgccaugggccccgagcccgucguccaguccguccgcggcgccggcacccagcccggcccccuccucaagaagcccuaccagccccgcaucaagaucuccaagaccuccguccgcggcuuccgccgcgaggagcagaucuucuccaacgucaugaaguuccccuucgccuccauccucgagcucuga

SEQ ID NO: 44809 - RNA, 1863 nt, Artificial Sequence
  derived and/or modified sequence opt2 from ITK__Homo_sapiens__NP_005537
augaacaacuucauccuccucgaggagcagcucaucaagaagucccagcagaagcgccgcaccucccccuccaacuucaagguccgcuucuucguccucaccaaggccucccucgccuacuucgaggaccgccacggcaagaagcgcacccucaagggcuccaucgagcucucccgcaucaagugcgucgagaucgucaaguccgacaucuccauccccugccacuacaaguaccccuuccaggucguccacgacaacuaccuccucuacgucuucgcccccgaccgcgagucccgccagcgcuggguccucgcccucaaggaggagacccgcaacaacaacucccucguccccaaguaccaccccaacuucuggauggacggcaaguggcgcugcugcucccagcucgagaagcucgccaccggcugcgcccaguacgaccccaccaagaacgccuccaagaagccccucccccccacccccgaggacaaccgccgcccccucugggagcccgaggagaccgucgucaucgcccucuacgacuaccagaccaacgacccccaggagcucgcccuccgccgcaacgaggaguacugccuccucgacuccuccgagauccacugguggcgcguccaggaccgcaacggccacgagggcuacguccccuccuccuaccucgucgagaagucccccaacaaccucgagaccuacgagugguacaacaaguccaucucccgcgacaaggccgagaagcuccuccucgacaccggcaaggagggcgccuucaugguccgcgacucccgcaccgccggcaccuacaccgucuccgucuucaccaaggccgucgucuccgagaacaaccccugcaucaagcacuaccacaucaaggagaccaacgacaaccccaagcgcuacuacgucgccgagaaguacgucuucgacuccaucccccuccucaucaacuaccaccagcacaacggcggcggccucgucacccgccuccgcuaccccgucugcuucggccgccagaaggcccccgucaccgccggccuccgcuacggcaagugggucaucgaccccuccgagcucaccuucguccaggagaucggcuccggccaguucggccucguccaccucggcuacuggcucaacaaggacaaggucgccaucaagaccauccgcgagggcgccauguccgaggaggacuucaucgaggaggccgaggucaugaugaagcucucccaccccaagcucguccagcucuacggcgucugccucgagcaggcccccaucugccucgucuucgaguucauggagcacggcugccucuccgacuaccuccgcacccagcgcggccucuucgccgccgagacccuccucggcaugugccucgacgucugcgagggcauggccuaccucgaggaggccugcgucauccaccgcgaccucgccgcccgcaacugccucgucggcgagaaccaggucaucaaggucuccgacuucggcaugacccgcuucguccucgacgaccaguacaccuccuccaccggcaccaaguuccccgucaagugggccucccccgaggucuucuccuucucccgcuacuccuccaaguccgacgucugguccuucggcguccucaugugggaggucuucuccgagggcaagauccccuacgagaaccgcuccaacuccgaggucgucgaggacaucuccaccggcuuccgccucuacaagccccgccucgccuccacccacgucuaccagaucaugaaccacugcuggaaggagcgccccgaggaccgccccgccuucucccgccuccuccgccagcucgccgagaucgccgaguccggccucuga

SEQ ID NO: 44810 - RNA, 942 nt, Artificial Sequence
  derived and/or modified sequence opt2 from ITLN1__Homo_sapiens__NP_060095
augaaccagcucuccuuccuccucuuccucaucgccaccacccgcggcugguccaccgacgaggccaacaccuacuucaaggaguggaccugcuccuccucccccucccucccccgcuccugcaaggagaucaaggacgagugccccuccgccuucgacggccucuacuuccuccgcaccgagaacggcgucaucuaccagaccuucugcgacaugaccuccggcggcggcggcuggacccucgucgccuccguccacgagaacgacaugcgcggcaagugcaccgucggcgaccgcugguccucccagcagggcuccaaggccgucuaccccgagggcgacggcaacugggccaacuacaacaccuucggcuccgccgaggccgccaccuccgacgacuacaagaaccccggcuacuacgacauccaggccaaggaccucggcaucuggcacguccccaacaagucccccaugcagcacuggcgcaacuccucccuccuccgcuaccgcaccgacaccggcuuccuccagacccucggccacaaccucuucggcaucuaccagaaguaccccgucaaguacggcgagggcaagugcuggaccgacaacggccccgucauccccgucgucuacgacuucggcgacgcccagaagaccgccuccuacuacucccccuacggccagcgcgaguucaccgccggcuucguccaguuccgcgucuucaacaacgagcgcgccgccaacgcccucugcgccggcaugcgcgucaccggcugcaacaccgagcaccacugcaucggcggcggcggcuacuuccccgaggccuccccccagcagugcggcgacuucuccggcuucgacugguccggcuacggcacccacgucggcuacuccuccucccgcgagaucaccgaggccgccguccuccucuucuaccgcuga

SEQ ID NO: 44811 - RNA, 978 nt, Artificial Sequence
  derived and/or modified sequence opt2 from ITLN2__Homo_sapiens__XP_011507512
augcucuccaugcuccgcaccaugacccgccucugcuuccuccucuucuucuccgucgccaccuccggcugcuccgccgccgccgccuccucccucgagaugcucucccgcgaguucgagaccugcgccuucuccuucuccucccucccccgcuccugcaaggagaucaaggagcgcugccacuccgccggcgacggccucuacuuccuccgcaccaagaacggcgucgucuaccagaccuucugcgacaugaccuccggcggcggcggcuggacccucgucgccuccguccacgagaacgacaugcgcggcaagugcaccgucggcgaccgcugguccucccagcagggcaacaaggccgacuaccccgagggcgacggcaacugggccaacuacaacaccuucggcuccgccgaggccgccaccuccgacgacuacaagaaccccggcuacuacgacauccaggccaaggaccucggcaucuggcacguccccaacaagucccccaugcagcacuggcgcaacuccgcccuccuccgcuaccgcaccaacaccggcuuccuccagcgccucggccacaaccucuucggcaucuaccagaaguaccccgucaaguaccgcuccggcaagugcuggaacgacaacggccccgccauccccgucgucuacgacuucggcgacgccaagaagaccgccuccuacuacucccccuacggccagcgcgaguucgucgccggcuucguccaguuccgcgucuucaacaacgagcgcgccgccaacgcccucugcgccggcaucaaggucaccggcugcaacaccgagcaccacugcaucggcggcggcggcuucuucccccagggcaagccccgccagugcggcgacuucuccgccuucgacugggacggcuacggcacccacgucaaguccuccugcucccgcgagaucaccgaggccgccguccuccucuucuaccgcuga

SEQ ID NO: 44812 - RNA, 660 nt, Artificial Sequence
  derived and/or modified sequence opt2 from ITM2A__Homo_sapiens__NP_001165052
auggucaagaucgccuucaacacccccaccgccguccagaaggaggaggcccgccaggacgucgaggcccuccucucccgcaccguccgcacccagauccucaccggcaaguccaccaucuaccgcggcgagaugugcuucuucgacuccgaggaccccgccaacucccuccgcggcggcgagcccaacuuccuccccgucaccgaggaggccgacauccgcgaggacgacaacaucgccaucaucgacguccccguccccuccuucuccgacuccgaccccgccgccaucauccacgacuucgagaagggcaugaccgccuaccucgaccuccuccucggcaacugcuaccucaugccccucaacaccuccaucgucaugccccccaagaaccucgucgagcucuucggcaagcucgccuccggccgcuaccucccccagaccuacgucguccgcgaggaccucgucgccgucgaggagauccgcgacgucuccaaccucggcaucuucaucuaccagcucugcaacaaccgcaaguccuuccgccuccgccgccgcgaccuccuccucggcuucaacaagcgcgccaucgacaagugcuggaagauccgccacuuccccaacgaguucaucgucgagaccaagaucugccaggaguga

SEQ ID NO: 44813 - RNA, 801 nt, Artificial Sequence
  derived and/or modified sequence opt2 from ITM2B__Homo_sapiens__NP_068839
auggucaaggucaccuucaacuccgcccucgcccagaaggaggccaagaaggacgagcccaaguccggcgaggaggcccucaucaucccccccgacgccgucgccgucgacugcaaggaccccgacgacgucguccccgucggccagcgccgcgccuggugcuggugcaugugcuucggccucgccuucaugcucgccggcgucauccucggcggcgccuaccucuacaaguacuucgcccuccagcccgacgacgucuacuacugcggcaucaaguacaucaaggacgacgucauccucaacgagcccuccgccgacgcccccgccgcccucuaccagaccaucgaggagaacaucaagaucuucgaggaggaggaggucgaguucaucuccguccccguccccgaguucgccgacuccgaccccgccaacaucguccacgacuucaacaagaagcucaccgccuaccucgaccucaaccucgacaagugcuacgucaucccccucaacaccuccaucgucaugcccccccgcaaccuccucgagcuccucaucaacaucaaggccggcaccuaccucccccaguccuaccucauccacgagcacauggucaucaccgaccgcaucgagaacaucgaccaccucggcuucuucaucuaccgccucugccacgacaaggagaccuacaagcuccagcgccgcgagaccaucaagggcauccagaagcgcgaggccuccaacugcuucgccauccgccacuucgagaacaaguucgccgucgagacccucaucugcuccuga

SEQ ID NO: 44814 - RNA, 663 nt, Artificial Sequence
  derived and/or modified sequence opt2 from ITM2C__Homo_sapiens__NP_001012532
auggucaagaucuccuuccagcccgccgucgccggcaucaagggcgacaaggccgacaaggccuccgccuccgcccccgcccccgccuccgccaccgagauccuccucacccccgcccgccucgcccgcgacaacuucuuccgcugcggcguccucuacgaggacucccucuccucccagguccgcacccagauggagcucgaggaggacgucaagaucuaccucgacgagaacuacgagcgcaucaacguccccgucccccaguucggcggcggcgaccccgccgacaucauccacgacuuccagcgcggccucaccgccuaccacgacaucucccucgacaagugcuacgucaucgagcucaacaccaccaucguccuccccccccgcaacuucugggagcuccucaugaacgucaagcgcggcaccuaccucccccagaccuacaucauccaggaggagauggucgucaccgagcacgucuccgacaaggaggcccucggcuccuucaucuaccaccucugcaacggcaaggacaccuaccgccuccgccgccgcgccacccgccgccgcaucaacaagcgcggcgccaagaacugcaacgccauccgccacuucgagaacaccuucgucgucgagacccucaucugcggcgucgucuga

SEQ ID NO: 44815 - RNA, 462 nt, Artificial Sequence
  derived and/or modified sequence opt2 from ITPA__Homo_sapiens__NP_001254552
auggccgccucccucgucggcaagaagaucgucuucgucaccggcaacgccaagaagcucgaggagguccagggccccguccucgucgaggacaccugccucugcuucaacgcccucggcggccuccccggccccuacaucaagugguuccucgagaagcucaagcccgagggccuccaccagcuccucgccggcuucgaggacaaguccgccuacgcccucugcaccuucgcccucuccaccggcgaccccucccagcccguccgccucuuccgcggccgcaccuccggccgcaucgucgccccccgcggcugccaggacuucggcugggaccccugcuuccagcccgacggcuacgagcagaccuacgccgagaugcccaaggccgagaagaacgccgucucccaccgcuuccgcgcccuccucgagcuccaggaguacuucggcucccucgccgccuga

SEQ ID NO: 44816 - RNA, 1245 nt, Artificial Sequence
  derived and/or modified sequence opt2 from ITPK1__Homo_sapiens__NP_001136065
augcagaccuuccucaagggcaagcgcgucggcuacuggcucuccgagaagaagaucaagaagcucaacuuccaggccuucgccgagcucugccgcaagcgcggcauggaggucguccagcucaaccucucccgccccaucgaggagcagggcccccucgacgucaucauccacaagcucaccgacgucauccucgaggccgaccagaacgacucccagucccucgagcucguccaccgcuuccaggaguacaucgacgcccaccccgagaccaucguccucgacccccuccccgccauccgcacccuccucgaccgcuccaaguccuacgagcucauccgcaagaucgaggccuacauggaggacgaccgcaucugcuccccccccuucauggagcucaccucccucugcggcgacgacaccaugcgccuccucgagaagaacggccucaccuuccccuucaucugcaagacccgcgucgcccacggcaccaacucccacgagauggccaucgucuucaaccaggagggccucaacgccauccagccccccugcgucguccagaacuucaucaaccacaacgccguccucuacaaggucuucgucgucggcgaguccuacaccgucguccagcgccccucccucaagaacuucuccgccggcaccuccgaccgcgaguccaucuucuucaacucccacaacgucuccaagcccgaguccuccuccguccucaccgagcucgacaagaucgagggcgucuucgagcgccccuccgacgaggucauccgcgagcucucccgcgcccuccgccaggcccucggcgucucccucuucggcaucgacaucaucaucaacaaccagaccggccagcacgccgucaucgacaucaacgccuuccccggcuacgagggcgucuccgaguucuucaccgaccuccucaaccacaucgccaccguccuccagggccaguccaccgccauggccgccaccggcgacgucgcccuccuccgccacuccaagcuccucgccgagcccgccggcggccucgucggcgagcgcaccugcuccgccucccccggcugcugcggcuccaugaugggccaggacgcccccuggaaggccgaggccgacgccggcggcaccgccaagcucccccaccagcgccucggcugcaacgccggcgucucccccuccuuccagcagcacugcgucgccucccucgccaccaaggccuccucccaguga

SEQ ID NO: 44817 - RNA, 1386 nt, Artificial Sequence
  derived and/or modified sequence opt2 from ITPKA__Homo_sapiens__NP_002211
augacccuccccggcggccccaccggcauggcccgccccggcggcgcccgccccugcucccccggccucgagcgcgccccccgccgcuccgucggcgagcuccgccuccucuucgaggcccgcugcgccgccgucgccgccgccgccgccgccggcgagccccgcgcccgcggcgccaagcgccgcggcggccagguccccaacggccucccccgcgccccccccgcccccgucaucccccagcucaccgucaccgccgaggagcccgacgucccccccaccucccccggcccccccgagcgcgagcgcgacugccuccccgccgccggcuccucccaccuccagcagccccgccgccucuccaccuccuccgucuccuccaccggcuccuccucccuccucgaggacuccgaggacgaccuccucuccgacuccgagucccgcucccgcggcaacguccagcucgaggccggcgaggacgucggccagaagaaccacuggcagaagauccgcaccauggucaaccuccccgucaucucccccuucaagaagcgcuacgccuggguccagcucgccggccacaccggcuccuucaaggccgccggcaccuccggccucauccucaagcgcugcuccgagcccgagcgcuacugccucgcccgccucauggccgacgcccuccgcggcugcguccccgccuuccacggcgucgucgagcgcgacggcgaguccuaccuccagcuccaggaccuccucgacggcuucgacggccccugcguccucgacugcaagaugggcguccgcaccuaccucgaggaggagcucaccaaggcccgcgagcgccccaagcuccgcaaggacauguacaagaagaugcucgccgucgaccccgaggcccccaccgaggaggagcacgcccagcgcgccgucaccaagccccgcuacaugcaguggcgcgagggcaucuccuccuccaccacccucggcuuccgcaucgagggcaucaagaaggccgacggcuccugcuccaccgacuucaagaccacccgcucccgcgagcagguccuccgcgucuucgaggaguucguccagggcgacgaggagguccuccgccgcuaccucaaccgccuccagcagauccgcgacacccucgaggucuccgaguucuuccgccgccacgaggucaucggcuccucccuccucuucguccacgaccacugccaccgcgccggcgucuggcucaucgacuucggcaagaccaccccccuccccgacggccagauccucgaccaccgccgccccugggaggagggcaaccgcgaggacggcuaccuccucggccucgacaaccucaucggcauccucgccucccucgccgagcgcuga

SEQ ID NO: 44818 - RNA, 2052 nt, Artificial Sequence
  derived and/or modified sequence opt2 from ITPKC__Homo_sapiens__XP_006723467
augcgccgcugccccugccgcggcucccucaacgaggccgaggccggcgcccuccccgccgccgcccgcaugggccucgaggccccccgcggcggccgccgccgccagcccggccagcagcgccccggccccggcgccggcgcccccgccggccgccccgagggcggcggccccugggcccgcaccgagggcuccucccuccacuccgagcccgagcgcgccggccucggccccgcccccggcaccgaguccccccaggccgaguucuggaccgacggccagaccgagcccgccgccgccggccucggcgucgagaccgagcgccccaagcagaagaccgagcccgaccgcuccucccuccgcacccaccucgagugguccugguccgagcucgagaccaccugccucuggaccgagaccggcaccgacggccucuggaccgacccccaccgcuccgaccuccaguuccagcccgaggaggccucccccuggacccagcccggcguccacggccccuggaccgagcucgagacccacggcucccagacccagcccgagcgcgucaaguccugggccgacaaccucuggacccaccagaacuccuccucccuccagacccaccccgagggcgccugccccuccaaggagcccuccgccgacggcuccuggaaggagcucuacaccgacggcucccgcacccagcaggacaucgagggccccuggaccgagcccuacaccgacggcucccagaagaagcaggacaccgaggccgcccgcaagcagcccggcaccggcggcuuccagauccagcaggacaccgacggcuccuggacccagcccuccaccgacggcucccagaccgcccccggcaccgacugccuccucggcgagcccgaggacggcccccucgaggagcccgagcccggcgagcuccucacccaccucuacucccaccucaagugcuccccccucugccccgucccccgccucaucaucacccccgagacccccgagcccgaggcccagcccgucggcccccccucccgcgucgagggcggcuccggcggcuucuccuccgccuccuccuucgacgaguccgaggacgacgucgucgccggcggcggcggcgccuccgaccccgaggaccgcuccggcuccaagcccuggaagaagcucaagaccguccucaaguacucccccuucgucgucuccuuccgcaagcacuaccccuggguccagcucuccggccacgccggcaacuuccaggccggcgaggacggccgcauccucaagcgcuucugccagugcgagcagcgcucccucgagcagcucaugaaggacccccuccgccccuucguccccgccuacuacggcaugguccuccaggacggccagaccuucaaccagauggaggaccuccucgccgacuucgagggccccuccaucauggacugcaagaugggcucccgcaccuaccucgaggaggagcucgucaaggcccgcgagcgcccccgcccccgcaaggacauguacgagaagauggucgccgucgaccccggcgcccccacccccgaggagcacgcccagggcgccgucaccaagccccgcuacaugcaguggcgcgagaccauguccuccaccuccacccucggcuuccgcaucgagggcaucaagaaggccgacggcaccugcaacaccaacuucaagaagacccaggcccucgagcaggucaccaagguccucgaggacuucgucgacggcgaccacgucauccuccagaaguacgucgccugccucgaggagcuccgcgaggcccucgagaucucccccuucuucaagacccacgaggucgucggcuccucccuccucuucguccacgaccacaccggccucgccaaggucuggaugaucgacuucggcaagaccgucgcccuccccgaccaccagacccucucccaccgccuccccugggccgagggcaaccgcgaggacggcuaccucuggggccucgacaacaugaucugccuccuccagggccucgcccaguccuga

SEQ ID NO: 44819 - RNA, 8133 nt, Artificial Sequence
  derived and/or modified sequence opt2 from ITPR1__Homo_sapiens__NP_001093422
auguccgacaagauguccuccuuccuccacaucggcgacaucugcucccucuacgccgagggcuccaccaacggcuucaucuccacccucggccucgucgacgaccgcugcgucguccagcccgagaccggcgaccucaacaacccccccaagaaguuccgcgacugccucuucaagcucugccccaugaaccgcuacuccgcccagaagcaguucuggaaggccgccaagcccggcgccaacuccaccaccgacgccguccuccucaacaagcuccaccacgccgccgaccucgagaagaagcagaacgagaccgagaaccgcaagcuccucggcaccgucauccaguacggcaacgucauccagcuccuccaccucaaguccaacaaguaccucaccgucaacaagcgccuccccgcccuccucgagaagaacgccaugcgcgucacccucgacgaggccggcaacgagggcuccugguucuacauccagcccuucuacaagcuccgcuccaucggcgacuccgucgucaucggcgacaaggucguccucaaccccgucaacgccggccagccccuccacgccuccucccaccagcucgucgacaaccccggcugcaacgaggucaacuccgucaacugcaacaccuccuggaagaucguccucuucaugaagugguccgacaacaaggacgacauccucaagggcggcgacgucguccgccucuuccacgccgagcaggagaaguuccucaccugcgacgagcaccgcaagaagcagcacgucuuccuccgcaccaccggccgccaguccgccaccuccgccaccuccuccaaggcccucugggaggucgaggucguccagcacgaccccugccgcggcggcgccggcuacuggaacucccucuuccgcuucaagcaccucgccaccggccacuaccucgccgccgaggucgaccccgacuucgaggaggagugccucgaguuccagcccuccgucgaccccgaccaggacgccucccgcucccgccuccgcaacgcccaggagaagauggucuacucccucgucuccguccccgagggcaacgacaucuccuccaucuucgagcucgaccccaccacccuccgcggcggcgacucccucgucccccgcaacuccuacguccgccuccgccaccucugcaccaacaccuggguccacuccaccaacauccccaucgacaaggaggaggagaagcccgucaugcucaagaucggcaccucccccgucaaggaggacaaggaggccuucgccaucguccccgucucccccgccgagguccgcgaccucgacuucgccaacgacgccuccaagguccucggcuccaucgccggcaagcucgagaagggcaccaucacccagaacgagcgccgcuccgucaccaagcuccucgaggaccucgucuacuucgucaccggcggcaccaacuccggccaggacguccucgaggucgucuucuccaagcccaaccgcgagcgccagaagcucaugcgcgagcagaacauccucaagcagaucuucaagcuccuccaggcccccuucaccgacugcggcgacggccccaugcuccgccucgaggagcucggcgaccagcgccacgcccccuuccgccacaucugccgccucugcuaccgcguccuccgccacucccagcaggacuaccgcaagaaccaggaguacaucgccaagcaguucggcuucaugcagaagcagaucggcuacgacguccucgccgaggacaccaucaccgcccuccuccacaacaaccgcaagcuccucgagaagcacaucaccgccgccgagaucgacaccuucgucucccucguccgcaagaaccgcgagccccgcuuccucgacuaccucuccgaccucugcgucuccaugaacaaguccauccccgucacccaggagcucaucugcaaggccguccucaaccccaccaacgccgacauccucaucgagaccaagcucguccucucccgcuucgaguucgagggcgucuccuccaccggcgagaacgcccucgaggccggcgaggacgaggaggaggucuggcucuucuggcgcgacuccaacaaggagauccgcuccaaguccguccgcgagcucgcccaggacgccaaggagggccagaaggaggaccgcgacguccucuccuacuaccgcuaccagcucaaccucuucgcccgcaugugccucgaccgccaguaccucgccaucaacgagaucuccggccagcucgacgucgaccucauccuccgcugcauguccgacgagaaccuccccuacgaccuccgcgccuccuucugccgccucaugcuccacaugcacgucgaccgcgacccccaggagcaggucacccccgucaaguacgcccgccucugguccgagauccccuccgagaucgccaucgacgacuacgacuccuccggcgccuccaaggacgagaucaaggagcgcuucgcccagaccauggaguucgucgaggaguaccuccgcgacgucgucugccagcgcuuccccuucuccgacaaggagaagaacaagcucaccuucgaggucgucaaccucgcccgcaaccucaucuacuucggcuucuacaacuucuccgaccuccuccgccucaccaagauccuccucgccauccucgacugcguccacgucaccaccaucuuccccaucuccaagauggccaagggcgaggagaacaagggcuccaacgucaugcgcuccauccacggcgucggcgagcucaugacccaggucguccuccgcggcggcggcuuccuccccaugacccccauggccgccgcccccgagggcaacgucaagcaggccgagcccgagaaggaggacaucauggucauggacaccaagcucaagaucaucgagauccuccaguucauccucaacguccgccucgacuaccgcaucuccugccuccucugcaucuucaagcgcgaguucgacgaguccaacucccagaccuccgagaccuccuccggcaacuccucccaggagggccccuccaacguccccggcgcccucgacuucgagcacaucgaggagcaggccgagggcaucuucggcggcuccgaggagaacaccccccucgaccucgacgaccacggcggccgcaccuuccuccgcguccuccuccaccucaccaugcacgacuaccccccccucgucuccggcgcccuccagcuccucuuccgccacuucucccagcgccaggagguccuccaggccuucaagcagguccagcuccucgucaccucccaggacgucgacaacuacaagcagaucaagcaggaccucgaccagcuccgcuccaucgucgagaaguccgagcucugggucuacaagggccagggccccgacgagaccauggacggcgccuccggcgagaacgagcacaagaagaccgaggagggcaacaacaagccccagaagcacgaguccaccuccuccuacaacuaccgcgucgucaaggagauccucauccgccucuccaagcucugcguccaggaguccgccuccguccgcaagucccgcaagcagcagcagcgccuccuccgcaacaugggcgcccacgccgucguccucgagcuccuccagauccccuacgagaaggccgaggacaccaagaugcaggagaucaugcgccucgcccacgaguuccuccagaacuucugcgccggcaaccagcagaaccaggcccuccuccacaagcacaucaaccucuuccucaaccccggcauccucgaggccgucaccaugcagcacaucuucaugaacaacuuccagcucugcuccgagaucaacgagcgcgucguccagcacuucguccacugcaucgagacccacggccgcaacguccaguacaucaaguuccuccagaccaucgucaaggccgagggcaaguucaucaagaagugccaggacauggucauggccgagcucgucaacuccggcgaggacguccucgucuucuacaacgaccgcgccuccuuccagacccucauccagaugaugcgcuccgagcgcgaccgcauggacgagaacuccccccucauguaccacauccaccucgucgagcuccucgccgucugcaccgagggcaagaacgucuacaccgagaucaagugcaacucccuccucccccucgacgacaucguccgcgucgucacccacgaggacugcauccccgaggucaagaucgccuacaucaacuuccucaaccacugcuacgucgacaccgaggucgagaugaaggagaucuacaccuccaaccacauguggaagcucuucgagaacuuccucgucgacaucugccgcgccugcaacaacaccuccgaccgcaagcacgccgacuccauccucgagaaguacgucaccgagaucgucauguccaucgucaccaccuucuucuccucccccuucuccgaccaguccaccacccuccagacccgccagcccgucuucguccagcuccuccagggcgucuuccgcgucuaccacugcaacuggcucaugcccucccagaaggccuccgucgaguccugcauccgcguccucuccgacgucgccaagucccgcgccaucgccauccccgucgaccucgacucccaggucaacaaccucuuccucaagucccacuccaucguccagaagaccgccaugaacuggcgccucuccgcccgcaacgccgcccgccgcgacuccguccucgccgccucccgcgacuaccgcaacaucaucgagcgccuccaggacaucgucuccgcccucgaggaccgccuccgcccccucguccaggccgagcucuccguccucgucgacguccuccaccgccccgagcuccucuuccccgagaacaccgacgcccgccgcaagugcgaguccggcggcuucaucugcaagcucaucaagcacaccaagcagcuccucgaggagaacgaggagaagcucugcaucaagguccuccagacccuccgcgagaugaugaccaaggaccgcggcuacggcgagaagggcgaggcccuccgccagguccucgucaaccgcuacuacggcaacguccgccccuccggccgccgcgagucccucaccuccuucggcaacggcccccucuccgccggcggccccggcaagcccggcggcggcggcggcggcuccggcuccuccuccaugucccgcggcgagaugucccucgccgagguccagugccaccucgacaaggagggcgccuccaaccucgucaucgaccucaucaugaacgccuccuccgaccgcgucuuccacgaguccauccuccucgccaucgcccuccucgagggcggcaacaccaccauccagcacuccuucuucugccgccucaccgaggacaagaaguccgagaaguucuucaaggucuucuacgaccgcaugaaggucgcccagcaggagaucaaggccaccgucaccgucaacaccuccgaccucggcaacaagaagaaggacgacgaggucgaccgcgacgcccccucccgcaagaaggccaaggagcccaccacccagaucaccgaggagguccgcgaccagcuccucgaggccuccgccgccacccgcaaggccuucaccaccuuccgccgcgaggccgaccccgacgaccacuaccagcccggcgagggcacccaggccaccgccgacaaggccaaggacgaccucgagauguccgccgucaucaccaucaugcagcccauccuccgcuuccuccagcuccucugcgagaaccacaaccgcgaccuccagaacuuccuccgcugccagaacaacaagaccaacuacaaccucgucugcgagacccuccaguuccucgacugcaucugcggcuccaccaccggcggccucggccuccucggccucuacaucaacgagaagaacgucgcccucaucaaccagacccucgagucccucaccgaguacugccagggccccugccacgagaaccagaacugcaucgccacccacgaguccaacggcaucgacaucaucaccgcccucauccucaacgacaucaacccccucggcaagaagcgcauggaccucguccucgagcucaagaacaacgccuccaagcuccuccucgccaucauggagucccgccacgacuccgagaacgccgagcgcauccucuacaacaugcgccccaaggagcucgucgaggucaucaagaaggccuacaugcagggcgaggucgaguucgaggacggcgagaacggcgaggacggcgccgccuccccccgcaacgucggccacaacaucuacauccucgcccaccagcucgcccgccacaacaaggagcuccaguccaugcucaagcccggcggccaggucgacggcgacgaggcccucgaguucuacgccaagcacaccgcccagaucgagaucguccgccucgaccgcaccauggagcagaucgucuuccccguccccuccaucugcgaguuccucaccaaggaguccaagcuccgcaucuacuacaccaccgagcgcgacgagcagggcuccaagaucaacgacuucuuccuccgcuccgaggaccucuucaacgagaugaacuggcagaagaagcuccgcgcccagcccguccucuacuggugcgcccgcaacauguccuucugguccuccaucuccuucaaccucgccguccucaugaaccuccucgucgccuucuucuaccccuucaagggcguccgcggcggcacccucgagccccacugguccggccuccucuggaccgccaugcucaucucccucgccaucgucaucgcccuccccaagccccacggcauccgcgcccucaucgccuccaccauccuccgccucaucuucuccgucggccuccagcccacccucuuccuccucggcgccuucaacgucugcaacaagaucaucuuccucauguccuucgucggcaacugcggcaccuucacccgcggcuaccgcgccaugguccucgacgucgaguuccucuaccaccuccucuaccucgucaucugcgccaugggccucuucguccacgaguucuucuacucccuccuccucuucgaccucgucuaccgcgaggagacccuccucaacgucaucaaguccgucacccgcaacggccgcuccaucauccucaccgccguccucgcccucauccucgucuaccucuucuccaucgucggcuaccucuucuucaaggacgacuucauccucgaggucgaccgccuccccaacgagaccgccguccccgagaccggcgagucccucgccuccgaguuccucuucuccgacgucugccgcgucgaguccggcgagaacugcuccucccccgccccccgcgaggagcucguccccgccgaggagaccgagcaggacaaggagcacaccugcgagacccuccucaugugcaucgucaccguccucucccacggccuccgcuccggcggcggcgucggcgacguccuccgcaagcccuccaaggaggagccccucuucgccgcccgcgucaucuacgaccuccucuucuucuucauggucaucaucaucguccucaaccucaucuucggcgucaucaucgacaccuucgccgaccuccgcuccgagaagcagaagaaggaggagauccucaagaccaccugcuucaucugcggccucgagcgcgacaaguucgacaacaagaccgucaccuucgaggagcacaucaaggaggagcacaacauguggcacuaccucugcuucaucguccucgucaaggucaaggacuccaccgaguacaccggccccgaguccuacgucgccgagaugaucaaggagcgcaaccucgacugguucccccgcaugcgcgccaugucccucgucuccuccgacuccgagggcgagcagaacgagcuccgcaaccuccaggagaagcucgaguccaccaugaagcucgucaccaaccucuccggccagcucuccgagcucaaggaccagaugaccgagcagcgcaagcagaagcagcgcaucggccuccucggccaccccccccacaugaacgucaacccccagcagcccgccuga

SEQ ID NO: 44820 - RNA, 8106 nt, Artificial Sequence
  derived and/or modified sequence opt2 from ITPR2__Homo_sapiens__NP_002214
augaccgagaagauguccuccuuccucuacaucggcgacaucgucucccucuacgccgagggcuccgucaacggcuucaucuccacccucggccucgucgacgaccgcugcgucguccaccccgaggccggcgaccucgccaacccccccaagaaguuccgcgacugccucuucaaggucugccccaugaaccgcuacuccgcccagaagcaguacuggaaggccaagcaggccaagcagggcaaccacaccgaggccgcccuccucaagaagcuccagcacgccgccgagcucgagcagaagcagaacgaguccgagaacaagaagcuccucggcgagaucgucaaguacuccaacgucauccagcuccuccacaucaaguccaacaaguaccucaccgucaacaagcgccuccccgcccuccucgagaagaacgccaugcgcgucucccucgacgccgccggcaacgagggcuccugguucuacauccaccccuucuggaagcuccgcuccgagggcgacaacaucgucgucggcgacaaggucguccucaugcccgucaacgccggccagccccuccacgccuccaacaucgagcuccucgacaaccccggcugcaaggaggucaacgccgucaacugcaacaccuccuggaagaucacccucuucaugaaguacuccuccuaccgcgaggacguccucaagggcggcgacgucguccgccucuuccacgccgagcaggagaaguuccucaccugcgacgaguacgagaagaagcagcacaucuuccuccgcaccacccuccgccaguccgccaccuccgccaccuccuccaaggcccucugggagaucgaggucguccaccacgaccccugccgcggcggcgccggccaguggaacucccucuuccgcuucaagcaccucgccaccggcaacuaccucgccgccgagcucaaccccgacuaccgcgacgcccagaacgagggcaagaacguccgcgacggcgucccccccaccuccaagaagaagcgccaggccggcgagaagaucauguacacccucgucuccgucccccacggcaacgacaucgccucccucuucgagcucgacgccaccacccuccagcgcgccgacugccucgucccccgcaacuccuacguccgccuccgccaccucugcaccaacaccugggucaccuccaccuccauccccaucgacaccgacgaggagcgccccgucaugcucaagaucggcaccugccagaccaaggaggacaaggaggccuucgccaucgucuccgucccccucuccgagguccgcgaccucgacuucgccaacgacgccaacaagguccucgccaccaccgucaagaagcucgagaacggcaccaucacccagaacgagcgccgcuucgucaccaagcuccucgaggaccucaucuucuucgucgccgacguccccaacaacggccaggagguccucgacgucgucaucaccaagcccaaccgcgagcgccagaagcucaugcgcgagcagaacauccucgcccaggucuucggcauccucaaggcccccuucaaggagaaggccggcgagggcuccaugcuccgccucgaggaccucggcgaccagcgcuacgcccccuacaaguacaugcuccgccucugcuaccgcguccuccgccacucccagcaggacuaccgcaagaaccaggaguacaucgccaagaacuucugcgucaugcagucccagaucggcuacgacauccucgccgaggacaccaucaccgcccuccuccacaacaaccgcaagcuccucgagaagcacaucaccgccaaggagaucgagaccuucgucucccuccuccgccgcaaccgcgagccccgcuuccucgacuaccucuccgaccucugcgucuccaacaccaccgccauccccgucacccaggagcucaucugcaaguucaugcucucccccggcaacgccgacauccucauccagaccaaggucgucuccaugcaggccgacaaccccauggaguccuccauccucuccgacgacaucgacgacgaggaggucuggcucuacuggaucgacuccaacaaggagccccacggcaaggccauccgccaccucgcccaggaggccaaggagggcaccaaggccgaccucgagguccucaccuacuaccgcuaccagcucaaccucuucgcccgcaugugccucgaccgccaguaccucgccaucaaccagaucuccacccagcucuccgucgaccucauccuccgcugcgucuccgacgagucccuccccuucgaccuccgcgccuccuucugccgccucaugcuccacaugcacgucgaccgcgacccccaggaguccgucguccccguccgcuacgcccgccucuggaccgagauccccaccaagaucaccauccacgaguacgacuccaucaccgacuccucccgcaacgacaugaagcgcaaguucgcccucaccauggaguucgucgaggaguaccucaaggaggucgucaaccagcccuuccccuucggcgacaaggagaagaacaagcucaccuucgaggucguccaccucgcccgcaaccucaucuacuucggcuucuacuccuucuccgagcuccuccgccucacccgcacccuccucgccauccucgacaucguccaggcccccauguccuccuacuucgagcgccucuccaaguuccaggacggcggcaacaacgucaugcgcaccauccacggcgucggcgagaugaugacccagaugguccucucccgcggcuccaucuuccccauguccguccccgacgucccccccuccauccaccccuccaagcagggcucccccaccgagcacgaggacgucaccgucauggacaccaagcucaagaucaucgagauccuccaguucauccucuccguccgccucgacuaccgcaucuccuacaugcucuccaucuacaagaaggaguucggcgaggacaacgacaacgccgagaccuccgccuccggcucccccgacacccuccuccccuccgccaucguccccgacaucgacgagaucgccgcccaggccgagaccauguucgccggccgcaaggagaagaaccccguccagcucgacgacgagggcggccgcaccuuccuccgcguccucauccaccucaucaugcacgacuaccccccccuccucuccggcgcccuccagcuccucuucaagcacuucucccagcgcgccgagguccuccaggccuucaagcagguccagcuccucgucuccaaccaggacgucgacaacuacaagcagaucaaggccgaccucgaccagcuccgccucaccgucgagaaguccgagcucugggucgagaaguccuccaacuacgagaacggcgagaucggcgagucccaggucaagggcggcgaggagcccaucgaggaguccaacauccucucccccguccaggacggcaccaagaagccccagaucgacuccaacaaguccaacaacuaccgcaucgucaaggagauccucauccgccucuccaagcucugcguccagaacaagaagugccgcaaccagcaccagcgccuccucaagaacaugggcgcccacuccgucguccucgaccuccuccagauccccuacgagaagaacgacgagaagaugaacgaggucaugaaccucgcccacaccuuccuccagaacuucugccgcggcaacccccagaaccagguccuccuccacaagcaccucaaccucuuccucacccccggccuccucgaggccgagaccaugcgccacaucuucaugaacaacuaccaccucugcaacgagaucuccgagcgcgucguccagcacuucguccacugcaucgagacccacggccgccacgucgaguaccuccgcuuccuccagaccaucgucaaggccgacggcaaguacgucaagaagugccaggacauggucaugaccgagcucaucaacggcggcgaggacguccucaucuucuacaacgaccgcgccuccuuccccauccuccuccacaugaugugcuccgagcgcgaccgcggcgacgaguccggcccccucgccuaccacaucacccucgucgagcuccucgccgccugcaccgagggcaagaacgucuacaccgagaucaagugcaacucccuccucccccucgacgacaucguccgcgucgucacccacgacgacugcauccccgaggucaagaucgccuacgucaacuucgucaaccacugcuacgucgacaccgaggucgagaugaaggagaucuacaccuccaaccacaucuggaagcucuucgagaacuuccucgucgacauggcccgcgucugcaacaccaccaccgaccgcaagcacgccgacaucuuccucgagaagugcgucaccgaguccaucaugaacaucgucuccggcuucuucaacucccccuucuccgacaacuccaccucccuccagacccaccagcccgucuucauccagcuccuccaguccgccuuccgcaucuacaacugcaccuggcccaaccccgcccagaaggccuccgucgaguccugcauccgcacccucgccgaggucgccaagaaccgcggcaucgccauccccgucgaccucgacucccaggucaacacccucuucaugaagucccacuccaacaugguccagcgcgccgccaugggcuggcgccucuccgcccgcuccggcccccgcuucaaggaggcccucggcggccccgccugggacuaccgcaacaucaucgagaagcuccaggacgucgucgccucccucgagcaccaguucucccccaugaugcaggccgaguucuccguccucgucgacguccucuacucccccgagcuccucuuccccgagggcuccgacgcccgcauccgcugcggcgccuucauguccaagcucaucaaccacaccaagaagcucauggagaaggaggagaagcucugcaucaagauccuccagacccuccgcgagaugcucgagaagaaggacuccuucgucgaggagggcaacacccuccgcaagauccuccucaaccgcuacuucaagggcgacuacuccaucggcgucaacggccaccucuccggcgccuacuccaagaccgcccaggucggcggcuccuucuccggccaggacuccgacaagaugggcaucuccauguccgacauccagugccuccucgacaaggagggcgccuccgagcucgucaucgacgucaucgucaacaccaagaacgaccgcaucuucuccgagggcaucuuccucggcaucgcccuccucgagggcggcaacacccagacccaguacuccuucuaccagcagcuccacgagcagaagaaguccgagaaguucuucaagguccucuacgaccgcaugaaggccgcccagaaggagauccgcuccaccgucaccgucaacaccaucgaccucggcaacaagaagcgcgacgacgacaacgagcucaugaccuccggcccccgcaugcgcguccgcgacuccacccuccaccucaaggagggcaugaagggccagcucaccgaggccuccuccgccaccuccaaggccuacugcgucuaccgccgcgagauggaccccgagaucgacaucaugugcaccggccccgaggccggcaacaccgaggagaaguccgccgaggaggucaccaugucccccgccaucgccaucaugcagcccauccuccgcuuccuccagcuccucugcgagaaccacaaccgcgagcuccagaacuuccuccgcaaccagaacaacaagaccaacuacaaccucgucugcgagacccuccaguuccucgacugcaucugcggcuccaccaccggcggccucggccuccucggccucuacaucaacgagaagaacgucgcccucgucaaccagaaccucgagucccucaccgaguacugccagggccccugccacgagaaccagaccugcaucgccacccacgaguccaacggcaucgacaucaucaucgcccucauccucaacgacaucaacccccucggcaaguaccgcauggaccucguccuccagcucaagaacaacgccuccaagcuccuccucgccaucauggagucccgccacgacuccgagaacgccgagcgcauccucuucaacaugcgcccccgcgagcucgucgacgucaugaagaacgccuacaaccagggccucgagugcgaccacggcgacgacgagggcggcgacgacggcgucucccccaaggacgucggccacaacaucuacauccucgcccaccagcucgcccgccacaacaagcuccuccagcagaugcucaagcccggcuccgaccccgacgagggcgacgaggcccucaaguacuacgccaaccacaccgcccagaucgagaucguccgccacgaccgcaccauggagcagaucgucuuccccguccccaacaucugcgaguaccucacccgcgaguccaagugccgcgucuucaacaccaccgagcgcgacgagcagggcuccaaggucaacgacuucuuccagcagaccgaggaccucuacaacgagaugaaguggcagaagaagauccgcaacaaccccgcccucuucugguucucccgccacaucucccucuggggcuccaucuccuucaaccucgccgucuucaucaaccucgccgucgcccucuucuaccccuucggcgacgacggcgacgagggcacccucuccccccucuucuccguccuccucuggaucgccgucgccaucugcaccuccaugcucuucuucuucuccaagcccgucggcauccgccccuuccucgucuccaucaugcuccgcuccaucuacaccaucggccucggccccacccucauccuccucggcgccgccaaccucugcaacaagaucgucuuccucgucuccuucgucggcaaccgcggcaccuucacccgcggcuaccgcgccgucauccucgacauggccuuccucuaccacgucgccuacguccucgucugcaugcucggccucuucguccacgaguucuucuacuccuuccuccucuucgaccucgucuaccgcgaggagacccuccucaacgucaucaaguccgucacccgcaacggccgcuccaucauccucaccgccguccucgcccucauccucgucuaccucuucuccaucaucggcuuccucuuccucaaggacgacuucaccauggaggucgaccgccucaagaaccgcacccccgucaccggcucccaccagguccccaccaugacccucaccaccaugauggaggccugcgccaaggagaacugcucccccaccauccccgccuccaacaccgccgacgaggaguacgaggacggcaucgagcgcaccugcgacacccuccucaugugcaucgucaccguccucaaccagggccuccgcaacggcggcggcgucggcgacguccuccgccgccccuccaaggacgagccccucuucgccgcccgcgucgucuacgaccuccucuucuacuucaucgucaucaucaucguccucaaccucaucuucggcgucaucaucgacaccuucgccgaccuccgcuccgagaagcagaagaaggaggagauccucaagaccaccugcuucaucugcggccucgagcgcgacaaguucgacaacaagaccgucuccuucgaggagcacaucaaguccgagcacaacauguggcacuaccucuacuucaucguccucgucaaggucaaggaccccaccgaguacaccggccccgaguccuacgucgcccagaugaucgucgagaagaaccucgacugguucccccgcaugcgcgccaugucccucgucuccaacgagggcgacuccgagcagaacgagauccgcucccuccaggagaagcucgaguccaccaugucccucgucaagcagcucuccggccagcucgccgagcucaaggagcagaugaccgagcagcgcaagaacaagcagcgccucggcuuccucggcuccaacaccccccacgucaaccaccacaugcccccccacuga

SEQ ID NO: 44821 - RNA, 8016 nt, Artificial Sequence
  derived and/or modified sequence opt2 from ITPR3__Homo_sapiens__NP_002215
auguccgagauguccuccuuccuccacaucggcgacaucgucucccucuacgccgagggcuccgucaacggcuucaucuccacccucggccucgucgacgaccgcugcgucgucgagcccgccgccggcgaccucgacaacccccccaagaaguuccgcgacugccucuucaaggucugccccaugaaccgcuacuccgcccagaagcaguacuggaaggccaagcagaccaagcaggacaaggagaagaucgccgacgucguccuccuccagaagcuccagcacgccgcccagauggagcagaagcagaacgacaccgagaacaagaagguccacggcgacgucgucaaguacggcuccgucauccagcuccuccacaugaaguccaacaaguaccucaccgucaacaagcgccuccccgcccuccucgagaagaacgccaugcgcgucacccucgacgccaccggcaacgagggcuccuggcucuucauccagcccuucuggaagcuccgcuccaacggcgacaacgucgucgucggcgacaaggucauccucaaccccgucaacgccggccagccccuccacgccuccaacuacgagcucuccgacaacgccggcugcaaggaggucaacuccgucaacugcaacaccuccuggaagaucaaccucuucaugcaguuccgcgaccaccucgaggagguccucaagggcggcgacgucguccgccucuuccacgccgagcaggagaaguuccucaccugcgacgaguacaagggcaagcuccaggucuuccuccgcaccacccuccgccaguccgccaccuccgccaccuccuccaacgcccucugggaggucgaggucguccaccacgaccccugccgcggcggcgccggccacuggaacggccucuaccgcuucaagcaccucgccaccggcaacuaccucgccgccgaggagaaccccuccuacaagggcgacgccuccgaccccaaggccgccggcaugggcgcccagggccgcaccggccgccgcaacgccggcgagaagaucaaguacugccucgucgccgucccccacggcaacgacaucgccucccucuucgagcucgaccccaccacccuccagaagaccgacuccuucgucccccgcaacuccuacguccgccuccgccaccucugcaccaacaccuggauccaguccaccaacguccccaucgacaucgaggaggagcgccccauccgccucaugcucggcaccugccccaccaaggaggacaaggaggccuucgccaucgucuccguccccgucuccgagauccgcgaccucgacuucgccaacgacgccuccuccaugcucgccuccgccgucgagaagcucaacgagggcuucaucucccagaacgaccgccgcuucgucauccagcuccucgaggaccucgucuucuucgucuccgacguccccaacaacggccagaacguccucgacaucauggucaccaagcccaaccgcgagcgccagaagcucaugcgcgagcagaacauccucaagcaggucuucggcauccucaaggcccccuuccgcgagaagggcggcgagggcccccucguccgccucgaggagcucuccgaccagaagaacgcccccuaccagcacauguuccgccucugcuaccgcguccuccgccacucccaggaggacuaccgcaagaaccaggagcacaucgccaagcaguucggcaugaugcagucccagaucggcuacgacauccucgccgaggacaccaucaccgcccuccuccacaacaaccgcaagcuccucgagaagcacaucaccaagaccgaggucgagaccuucgucucccucguccgcaagaaccgcgagccccgcuuccucgacuaccucuccgaccucugcgucuccaaccacaucgccauccccgucacccaggagcucaucugcaagugcguccucgaccccaagaacuccgacauccucauccgcaccgagcuccgccccgucaaggagauggcccagucccacgaguaccucuccaucgaguacuccgaggaggaggucuggcucaccuggaccgacaagaacaacgagcaccacgagaaguccguccgccagcucgcccaggaggcccgcgccggcaacgcccacgacgagaacguccucuccuacuaccgcuaccagcucaagcucuucgcccgcaugugccucgaccgccaguaccucgccaucgacgagaucucccagcagcucggcgucgaccucaucuuccucugcauggccgacgagaugcuccccuucgaccuccgcgccuccuucugccaccucaugcuccacguccacgucgaccgcgacccccaggagcucgucacccccgucaaguucgcccgccucuggaccgagauccccaccgccaucaccaucaaggacuacgacuccaaccucaacgccucccgcgacgacaagaagaacaaguucgccaacaccauggaguucgucgaggacuaccucaacaacgucgucuccgaggccguccccuucgccaacgaggagaagaacaagcucaccuucgaggucgucucccucgcccacaaccucaucuacuucggcuucuacuccuucuccgagcuccuccgccucacccgcacccuccucggcaucaucgacugcguccagggcccccccgccaugcuccaggccuacgaggaccccggcggcaagaacguccgccgcuccauccagggcgucggccacaugauguccaccaugguccucucccgcaagcaguccgucuucuccgcccccucccucuccgccggcgccuccgccgccgagccccucgaccgcuccaaguucgaggagaacgaggacaucgucgucauggagaccaagcucaagauccucgagauccuccaguucauccucaacguccgccucgacuaccgcaucuccuaccuccucuccgucuucaagaaggaguucgucgaggucuuccccaugcaggacuccggcgccgacggcaccgcccccgccuucgacuccaccaccgccaacaugaaccucgaccgcaucggcgagcaggccgaggccauguucggcgucggcaagaccuccuccaugcucgaggucgacgacgagggcggccgcauguuccuccgcguccucauccaccucaccaugcacgacuacgccccccucgucuccggcgcccuccagcuccucuucaagcacuucucccagcgccaggaggccaugcacaccuucaagcagguccagcuccucaucuccgcccaggacgucgagaacuacaaggucaucaaguccgagcucgaccgccuccgcaccauggucgagaaguccgagcucugggucgacaagaagggcuccggcaagggcgaggaggucgaggccggcgccgccaaggacaagaaggagcgccccaccgacgaggagggcuuccuccacccccccggcgagaaguccuccgagaacuaccagaucgucaagggcauccucgagcgccucaacaagaugugcggcgucggcgagcagaugcgcaagaagcagcagcgccuccucaagaacauggacgcccacaaggucaugcucgaccuccuccagauccccuacgacaagggcgacgccaagaugauggagauccuccgcuacacccaccaguuccuccagaaguucugcgccggcaaccccggcaaccaggcccuccuccacaagcaccuccaccucuuccucacccccggccuccucgaggccgagaccaugcagcacaucuuccucaacaacuaccagcucugcuccgagaucuccgagcccguccuccagcacuucguccaccuccucgccacccacggccgccacguccaguaccucgacuuccuccacaccgucaucaaggccgagggcaaguacgucaagaagugccaggacaugaucaugaccgagcucaccaacgccggcgacgacgucgucgucuucuacaacgacaaggccucccucgcccaccuccucgacaugaugaaggccgcccgcgacggcgucgaggaccacuccccccucauguaccacaucucccucgucgaccuccucgccgccugcgccgagggcaagaacgucuacaccgagaucaagugcaccucccuccucccccucgaggacgucgucuccgucgucacccacgaggacugcaucaccgaggucaagauggccuacgucaacuucgucaaccacugcuacgucgacaccgaggucgagaugaaggagaucuacaccuccaaccacaucuggacccucuucgagaacuucacccucgacauggcccgcgucugcuccaagcgcgagaagcgcgucgccgaccccacccucgagaaguacguccucuccgucguccucgacaccaucaacgccuucuucuccucccccuucuccgagaacuccaccucccuccagacccaccagaccaucgucguccagcuccuccaguccaccacccgccuccucgagugccccuggcuccagcagcagcacaagggcuccgucgaggccugcauccgcacccucgccauggucgccaagggccgcgccauccuccuccccauggaccucgacgcccacaucuccuccaugcucuccuccggcgccuccugcgccgccgccgcccagcgcaacgccuccuccuacaaggccaccacccgcgccuucccccgcgucacccccaccgccaaccagugggacuacaagaacaucaucgagaagcuccaggacaucaucaccgcccucgaggagcgccucaagccccucguccaggccgagcucuccguccucgucgacguccuccacuggcccgagcuccucuuccucgagggcuccgaggccuaccagcgcugcgaguccggcggcuuccucuccaagcucauccagcacaccaaggaccucauggaguccgaggagaagcucugcaucaagguccuccgcacccuccagcagaugcuccucaagaagaccaaguacggcgaccgcggcaaccagcuccgcaagaugcuccuccagaacuaccuccagaaccgcaaguccaccucccgcggcgaccuccccgaccccaucggcaccggccucgaccccgacugguccgccaucgccgccacccagugccgccucgacaaggagggcgccaccaagcucgucugcgaccucaucaccuccaccaagaacgagaagaucuuccaggaguccaucggccucgccauccaccuccucgacggcggcaacaccgagauccagaaguccuuccacaaccucaugauguccgacaagaaguccgagcgcuucuucaagguccuccacgaccgcaugaagcgcgcccagcaggagaccaaguccaccgucgccgucaacaugaacgaccucggcucccagccccacgaggaccgcgagcccgucgaccccaccaccaagggccgcgucgccuccuucuccauccccggcuccuccucccgcuacucccucggccccucccuccgccgcggccacgaggucuccgagcgcguccaguccuccgagaugggcaccuccguccucaucaugcagcccauccuccgcuuccuccagcuccucugcgagaaccacaaccgcgaccuccagaacuuccuccgcugccagaacaacaagaccaacuacaaccucgucugcgagacccuccaguuccucgacaucaugugcggcuccaccaccggcggccucggccuccucggccucuacaucaacgaggacaacgucggccucgucauccagacccucgagacccucaccgaguacugccagggccccugccacgagaaccagaccugcaucgucacccacgaguccaacggcaucgacaucaucaccgcccucauccucaacgacaucuccccccucugcaaguaccgcauggaccucguccuccagcucaaggacaacgccuccaagcuccuccucgcccucauggagucccgccacgacuccgagaacgccgagcgcauccucaucucccuccgcccccaggagcucgucgacgucaucaagaaggccuaccuccaggaggaggagcgcgagaacuccgaggucuccccccgcgaggucggccacaacaucuacauccucgcccuccagcucucccgccacaacaagcagcuccagcaccuccucaagcccgucaagcgcauccaggaggaggaggccgagggcaucuccuccaugcucucccucaacaacaagcagcucucccagaugcucaaguccuccgcccccgcccaggaggaggaggaggacccccucgccuacuacgagaaccacaccucccagaucgagaucguccgccaggaccgcuccauggagcagaucgucuuccccguccccggcaucugccaguuccucaccgaggagaccaagcaccgccucuucaccaccaccgagcaggacgagcagggcuccaaggucuccgacuucuucgaccaguccuccuuccuccacaacgagauggaguggcagcgcaagcuccgcuccaugccccucaucuacugguucucccgccgcaugacccucuggggcuccaucuccuucaaccucgccgucuucaucaacaucaucaucgccuucuucuaccccuacauggagggcgccuccaccggcguccucgacuccccccucaucucccuccucuucuggauccucaucugcuucuccaucgccgcccucuucaccaagcgcuacuccauccgcccccucaucgucgcccucauccuccgcuccaucuacuaccucggcaucggccccacccucaacauccucggcgcccucaaccucaccaacaagaucgucuucgucgucuccuucgucggcaaccgcggcaccuucauccgcggcuacaaggccauggucauggacauggaguuccucuaccacgucggcuacauccucaccuccguccucggccucuucgcccacgagcucuucuacuccauccuccucuucgaccucaucuaccgcgaggagacccucuucaacgucaucaaguccgucacccgcaacggccgcuccauccuccucaccgcccuccucgcccucauccucgucuaccucuucuccaucgucggcuuccucuuccucaaggacgacuucauccucgaggucgaccgccuccccaacaaccacuccaccgccuccccccucggcaugccccacggcgccgccgccuucgucgacaccugcuccggcgacaagauggacugcgucuccggccucuccguccccgagguccucgaggaggaccgcgagcucgacuccaccgagcgcgccugcgacacccuccucaugugcaucgucaccgucaugaaccacggccuccgcaacggcggcggcgucggcgacauccuccgcaagcccuccaaggacgagucccucuuccccgcccgcgucgucuacgaccuccucuucuucuucaucgucaucaucaucguccucaaccucaucuucggcgucaucaucgacaccuucgccgaccuccgcuccgagaagcagaagaaggaggagauccucaagaccaccugcuucaucugcggccucgagcgcgacaaguucgacaacaagaccgucuccuucgaggagcacaucaagcucgagcacaacauguggaacuaccucuacuucaucguccucguccgcgucaagaacaagaccgacuacaccggccccgaguccuacgucgcccagaugaucaagaacaagaaccucgacugguucccccgcaugcgcgccaugucccucgucuccaacgagggcgagggcgagcagaacgagauccgcauccuccaggacaagcucaacuccaccaugaagcucgucucccaccucaccgcccagcucaacgagcucaaggagcagaugaccgagcagcgcaagcgccgccagcgccucggcuucgucgacguccagaacugcaucucccgcuga

SEQ ID NO: 44822 - RNA, 3663 nt, Artificial Sequence
  derived and/or modified sequence opt2 from ITSN1__Homo_sapiens__NP_001001132
auggcccaguuccccacccccuucggcggcucccucgacaucugggccaucaccgucgaggagcgcgccaagcacgaccagcaguuccacucccucaagcccaucuccggcuucaucaccggcgaccaggcccgcaacuucuucuuccaguccggccucccccagcccguccucgcccagaucugggcccucgccgacaugaacaacgacggccgcauggaccaggucgaguucuccaucgccaugaagcucaucaagcucaagcuccagggcuaccagcuccccuccgcccucccccccgucaugaagcagcagcccgucgccaucuccuccgcccccgccuucggcaugggcggcaucgccuccaugcccccccucaccgccgucgcccccguccccaugggcuccauccccgucgucggcaugucccccacccucgucuccuccguccccaccgccgccguccccccccucgccaacggcgccccccccgucauccagccccuccccgccuucgcccaccccgccgccacccuccccaaguccuccuccuucucccgcuccggccccggcucccagcucaacaccaagcuccagaaggcccaguccuucgacgucgccuccgucccccccgucgccgagugggccgucccccaguccucccgccucaaguaccgccagcucuucaacucccacgacaagaccauguccggccaccucaccggcccccaggcccgcaccauccucaugcaguccucccucccccaggcccagcucgccuccaucuggaaccucuccgacaucgaccaggacggcaagcucaccgccgaggaguucauccucgccaugcaccucaucgacgucgccauguccggccagccccucccccccguccucccccccgaguacaucccccccuccuuccgccgcguccgcuccggcuccggcaucuccgucaucuccuccaccuccgucgaccagcgccuccccgaggagcccguccucgaggacgagcagcagcagcucgagaagaagcuccccgucaccuucgaggacaagaagcgcgagaacuucgagcgcggcaaccucgagcucgagaagcgccgccaggcccuccucgagcagcagcgcaaggagcaggagcgccucgcccagcucgagcgcgccgagcaggagcgcaaggagcgcgagcgccaggagcaggagcgcaagcgccagcucgagcucgagaagcagcucgagaagcagcgcgagcucgagcgccagcgcgaggaggagcgccgcaaggagaucgagcgccgcgaggccgccaagcgcgagcucgagcgccagcgccagcucgagugggagcgcaaccgccgccaggagcuccucaaccagcgcaacaaggagcaggaggacaucgucguccucaaggccaagaagaagacccucgaguucgagcucgaggcccucaacgacaagaagcaccagcucgagggcaagcuccaggacauccgcugccgccucaccacccagcgccaggagaucgaguccaccaacaagucccgcgagcuccgcaucgccgagaucacccaccuccagcagcagcuccaggagucccagcagaugcucggccgccucauccccgagaagcagauccucaacgaccagcucaagcagguccagcagaacucccuccaccgcgacucccucgucacccucaagcgcgcccucgaggccaaggagcucgcccgccagcaccuccgcgaccagcucgacgaggucgagaaggagacccgcuccaagcuccaggagaucgacaucuucaacaaccagcucaaggagcuccgcgagauccacaacaagcagcagcuccagaagcagaaguccauggaggccgagcgccucaagcagaaggagcaggagcgcaagaucaucgagcucgagaagcagaaggaggaggcccagcgccgcgcccaggagcgcgacaagcaguggcucgagcacguccagcaggaggacgagcaccagcgcccccgcaagcuccacgaggaggagaagcucaagcgcgaggaguccgucaagaagaaggacggcgaggagaagggcaagcaggaggcccaggacaagcucggccgccucuuccaccagcaccaggagcccgccaagcccgccguccaggcccccugguccaccgccgagaagggcccccucaccaucuccgcccaggagaacgucaaggucgucuacuaccgcgcccucuaccccuucgagucccgcucccacgacgagaucaccauccagcccggcgacaucgucauggucaagggcgagugggucgacgagucccagaccggcgagcccggcuggcucggcggcgagcucaagggcaagaccggcugguuccccgccaacuacgccgagaagauccccgagaacgagguccccgcccccgucaagcccgucaccgacuccaccuccgcccccgcccccaagcucgcccuccgcgagacccccgccccccucgccgucaccuccuccgagcccuccaccacccccaacaacugggccgacuucuccuccaccuggcccaccuccaccaacgagaagcccgagaccgacaacugggacgccugggccgcccagcccucccucaccguccccuccgccggccagcuccgccagcgcuccgccuucacccccgccaccgccaccggcuccucccccucccccguccucggccagggcgagaaggucgagggccuccaggcccaggcccucuaccccuggcgcgccaagaaggacaaccaccucaacuucaacaagaacgacgucaucaccguccucgagcagcaggacauguggugguucggcgagguccagggccagaagggcugguuccccaaguccuacgucaagcucaucuccggccccauccgcaaguccaccuccauggacuccggcuccuccgagucccccgccucccucaagcgcgucgccucccccgccgccaagcccgucgucuccggcgaggaguucaucgccauguacaccuacgaguccuccgagcagggcgaccucaccuuccagcagggcgacgucauccucgucaccaagaaggacggcgacugguggaccggcaccgucggcgacaaggccggcgucuuccccuccaacuacguccgccucaaggacuccgagggcuccggcaccgccggcaagaccggcucccucggcaagaagcccgagaucgcccaggucaucgccuccuacaccgccaccggccccgagcagcucacccucgcccccggccagcucauccucauccgcaagaagaaccccggcggcuggugggagggcgagcuccaggcccgcggcaagaagcgccagaucggcugguuccccgccaacuacgucaagcuccucucccccggcaccuccaagaucacccccaccgagccccccaaguccaccgcccucgccgccgucugccaggucaucggcauguacgacuacaccgcccagaacgacgacgagcucgccuucaacaagggccagaucaucaacguccucaacaaggaggaccccgacugguggaagggcgaggucaacggccaggucggccucuuccccuccaacuacgucaagcucaccaccgacauggaccccucccagcaguga

SEQ ID NO: 44823 - RNA, 5094 nt, Artificial Sequence
  derived and/or modified sequence opt2 from ITSN2__Homo_sapiens__NP_006268
augauggcccaguuccccaccgccaugaacggcggccccaacaugugggccaucaccuccgaggagcgcaccaagcacgaccgccaguucgacaaccucaagcccuccggcggcuacaucaccggcgaccaggcccgcaacuucuuccuccaguccggccuccccgcccccguccucgccgagaucugggcccucuccgaccucaacaaggacggcaagauggaccagcaggaguucuccaucgccaugaagcucaucaagcucaagcuccagggccagcagcuccccgucguccucccccccaucaugaagcagccccccauguucuccccccucaucuccgcccgcuucggcaugggcuccaugcccaaccucuccaucccccagccccucccccccgccgcccccaucaccucccucuccuccgccaccuccggcaccaaccuccccccccucaugaugcccaccccccucguccccuccgucuccaccuccucccuccccaacggcaccgccucccucauccagccccuccccauccccuacuccuccuccacccucccccacggcuccuccuacucccucaugaugggcggcuucggcggcgccuccauccagaaggcccagucccucaucgaccucggcuccuccuccuccaccuccuccaccgccucccucuccggcaacucccccaagaccggcaccuccgagugggccgucccccagcccacccgccucaaguaccgccagaaguucaacacccucgacaaguccauguccggcuaccucuccggcuuccaggcccgcaacgcccuccuccaguccaaccucucccagacccagcucgccaccaucuggacccucgccgacgucgacggcgacggccagcucaaggccgaggaguucauccucgccaugcaccucaccgacauggccaaggccggccagccccucccccucacccucccccccgagcucgucccccccuccuuccgcggcggcaagcagaucgacuccaucaacggcacccuccccuccuaccagaagaugcaggaggaggagccccagaagaagcuccccgucaccuucgaggacaagcgcaaggccaacuacgagcgcggcaacauggagcucgagaagcgccgccaggcccucauggagcagcagcagcgcgaggccgagcgcaaggcccagaaggagaaggaggagugggagcgcaagcagcgcgagcuccaggagcaggaguggaagaagcagcucgagcucgagaagcgccucgagaagcagcgcgagcucgagcgccagcgcgaggaggagcgccgcaaggacaucgagcgccgcgaggccgccaagcaggagcucgagcgccagcgccgccucgagugggagcgcauccgccgccaggagcuccucaaccagaagaaccgcgagcaggaggagaucguccgccucaacuccaagaagaagaaccuccaccucgagcucgaggcccucaacggcaagcaccagcagaucuccggccgccuccaggacguccgccucaagaagcagacccagaagaccgagcucgagguccucgacaagcagugcgaccucgagaucauggagaucaagcagcuccagcaggagcuccaggaguaccagaacaagcucaucuaccucguccccgagaagcagcuccucaacgagcgcaucaagaacaugcaguucuccaacacccccgacuccggcgucucccuccuccacaagaagucccucgagaaggaggagcucugccagcgccucaaggagcagcucgacgcccucgagaaggagaccgccuccaagcucuccgagauggacuccuucaacaaccagcucaagugcggcaacauggacgacuccguccuccagugccuccucucccuccucuccugccucaacaaccucuuccuccuccucaaggagcuccgcgagaccuacaacacccagcagcucgcccucgagcagcucuacaagaucaagcgcgacaagcucaaggagaucgagcgcaagcgccucgagcucaugcagaagaagaagcucgaggacgaggccgcccgcaaggccaagcagggcaaggagaaccucuggaaggagaaccuccgcaaggaggaggaggagaagcagaagcgccuccaggaggagaagacccaggagaagauccaggaggaggagcgcaaggccgaggagaagcagcgcaaggacaaggacacccucaaggccgaggagaagaagcgcgagaccgccuccguccucgucaacuaccgcgcccucuaccccuucgaggcccgcaaccacgacgagauguccuucaacuccggcgacaucauccaggucgacgagaagaccgucggcgagcccggcuggcucuacggcuccuuccagggcaacuucggcugguuccccugcaacuacgucgagaagaugcccuccuccgagaacgagaaggccgucucccccaagaaggcccuccucccccccaccgucucccucuccgccaccuccaccuccuccgagccccucuccuccaaccagcccgccuccgucaccgacuaccagaacgucuccuucuccaaccucaccgucaacaccuccuggcagaagaaguccgccuucacccgcaccgucucccccggcuccgucucccccauccacggccagggccaggucgucgagaaccucaaggcccaggcccucugcuccuggaccgccaagaaggacaaccaccucaacuucuccaagcacgacaucaucaccguccucgagcagcaggagaacuggugguucggcgagguccacggcggccgcggcugguuccccaaguccuacgucaagaucauccccggcuccgaggucaagcgcgaggagcccgaggcccucuacgccgccgucaacaagaagcccaccuccgccgccuacuccgucggcgaggaguacaucgcccucuaccccuacuccuccgucgagcccggcgaccucaccuucaccgagggcgaggagauccucgucacccagaaggacggcgagugguggaccggcuccaucggcgaccgcuccggcaucuuccccuccaacuacgucaagcccaaggaccaggaguccuucggcuccgccuccaaguccggcgccuccaacaagaagcccgagaucgcccaggucaccuccgccuacgucgccuccggcuccgagcagcucucccucgcccccggccagcucauccucauccucaagaagaacaccuccggcugguggcagggcgagcuccaggcccgcggcaagaagcgccagaagggcugguuccccgccucccacgucaagcuccucggccccuccuccgagcgcgccacccccgccuuccaccccgucugccaggucaucgccauguacgacuacgccgccaacaacgaggacgagcucuccuucuccaagggccagcucaucaacgucaugaacaaggacgaccccgacugguggcagggcgagaucaacggcgucaccggccucuuccccuccaacuacgucaagaugaccaccgacuccgaccccucccagcaguggugcgccgaccuccagacccucgacaccaugcagcccaucgagcgcaagcgccagggcuacauccacgagcucauccagaccgaggagcgcuacauggccgaccuccagcucgucgucgaggucuuccagaagcgcauggccgaguccggcuuccucaccgagggcgagauggcccucaucuucgucaacuggaaggagcucaucauguccaacaccaagcuccucaaggcccuccgcguccgcaagaagaccggcggcgagaagaugcccguccagaugaucggcgacauccucgccgccgagcucucccacaugcaggccuacauccgcuucugcuccugccagcucaacggcgccgcccuccuccagcagaagaccgacgaggacaccgacuucaaggaguuccucaagaagcucgccuccgacccccgcugcaagggcaugccccucuccuccuuccuccucaagcccaugcagcgcaucacccgcuacccccuccucauccgcuccauccucgagaacacccccgagucccacgccgaccacuccucccucaagcucgcccucgagcgcgccgaggagcucugcucccaggucaacgagggcguccgcgagaaggagaacuccgaccgccucgaguggauccaggcccacguccagugcgagggccucgccgagcagcucaucuucaacucccucaccaacugccucggcccccgcaagcuccuccacuccggcaagcucuacaagaccaaguccaacaaggagcuccacggcuuccucuucaacgacuuccuccuccucaccuacauggucaagcaguucgccgucuccuccggcuccgagaagcucuucuccuccaaguccaacgcccaguucaagauguacaagacccccaucuuccucaacgagguccucgucaagcuccccaccgaccccuccuccgacgagcccgucuuccacaucucccacaucgaccgcgucuacacccuccgcaccgacaacaucaacgagcgcaccgccuggguccagaagaucaaggccgccuccgagcaguacaucgacaccgagaagaagaagcgcgagaaggccuaccaggcccgcucccagaagaccuccggcaucggccgccucaugguccacgucaucgaggccaccgagcucaaggccugcaagcccaacggcaaguccaaccccuacugcgagaucuccaugggcucccaguccuacaccacccgcaccauccaggacacccucaaccccaaguggaacuucaacugccaguucuucaucaaggaccucuaccaggacguccucugccucacccucuucgaccgcgaccaguucucccccgacgacuuccucggccgcaccgagauccccgucgccaagauccgcaccgagcaggaguccaagggccccaugacccgccgccuccuccuccacgagguccccaccggcgaggucuggguccgcuucgaccuccagcucuucgagcagaagacccuccucuga

SEQ ID NO: 44824 - RNA, 1191 nt, Artificial Sequence
  derived and/or modified sequence opt2 from IVD__Homo_sapiens__NP_001152980
auggccgagauggccaccgccacccgccuccucggcuggcgcgucgccuccuggcgccuccgccccccccucgccggcuucgucucccagcgcgcccacucccuccuccccgucgacgacgccaucaacggccucuccgaggagcagcgccaggaguucuggaagcagcucggcaaccucggcguccucggcaucaccgcccccguccaguacggcggcuccggccucggcuaccucgagcacguccucgucauggaggagaucucccgcgccuccggcgccgucggccucuccuacggcgcccacuccaaccucugcaucaaccagcucguccgcaacggcaacgaggcccagaaggagaaguaccuccccaagcucaucuccggcgaguacaucggcgcccucgccauguccgagcccaacgccggcuccgacgucgucuccaugaagcucaaggccgagaagaagggcaaccacuacauccucaacggcaacaaguucuggaucaccaacggccccgacgccgacguccucaucgucuacgccaagaccgaccucgccgccguccccgccucccgcggcaucaccgccuucaucgucgagaagggcaugcccggcuucuccaccuccaagaagcucgacaagcucggcaugcgcggcuccaacaccugcgagcucaucuucgaggacugcaagauccccgccgccaacauccucggccacgagaacaagggcgucuacguccucauguccggccucgaccucgagcgccucguccucgccggcggcccccucggccucaugcaggccguccucgaccacaccauccccuaccuccacguccgcgaggccuucggccagaagaucggccacuuccagcucaugcagggcaagauggccgacauguacacccgccucauggccugccgccaguacgucuacaacgucgccaaggccugcgacgagggccacugcaccgccaaggacugcgccggcgucauccucuacuccgccgagugcgccacccaggucgcccucgacggcauccagugcuucggcggcaacggcuacaucaacgacuuccccaugggccgcuuccuccgcgacgccaagcucuacgagaucggcgccggcaccuccgagguccgccgccucgucaucggccgcgccuucaacgccgacuuccacuga

SEQ ID NO: 44825 - RNA, 1758 nt, Artificial Sequence
  derived and/or modified sequence opt2 from IVL__Homo_sapiens__XP_006711363
augucccagcagcacacccuccccgucacccucucccccgcccucucccaggagcuccucaagaccguccccccccccgucaacacccaccaggagcagaugaagcagcccaccccccuccccccccccugccagaagguccccgucgagcuccccgucgagguccccuccaagcaggaggagaagcacaugaccgccgucaagggccuccccgagcaggagugcgagcagcagcagaaggagccccaggagcaggagcuccagcagcagcacugggagcagcacgaggaguaccagaaggccgagaaccccgagcagcagcucaagcaggagaagacccagcgcgaccagcagcucaacaagcagcucgaggaggagaagaagcuccucgaccagcagcucgaccaggagcucgucaagcgcgacgagcagcucggcaugaagaaggagcagcuccucgagcuccccgagcagcaggagggccaccucaagcaccucgagcagcaggagggccagcucaagcaccccgagcagcaggagggccagcucgagcuccccgagcagcaggagggccagcucgagcuccccgagcagcaggagggccagcucgagcuccccgagcagcaggagggccagcucgagcuccccgagcagcaggagggccagcucgagcuccccgagcagcaggagggccagcucgagcucccccagcagcaggagggccagcucgagcucuccgagcagcaggagggccagcucgagcucuccgagcagcaggagggccagcucaagcaccucgagcaccaggagggccagcucgagguccccgaggagcagaugggccagcucaaguaccucgagcagcaggagggccagcucaagcaccucgaccagcaggagaagcagcccgagcuccccgagcagcagaugggccagcucaagcaccucgagcagcaggagggccagcccaagcaccucgagcagcaggagggccagcucgagcagcucgaggagcaggagggccagcucaagcaccucgagcagcaggagggccagcucgagcaccucgagcaccaggagggccagcucggccuccccgagcagcagguccuccagcucaagcagcucgagaagcagcagggccagcccaagcaccucgaggaggaggagggccagcucaagcaccucguccagcaggagggccagcucaagcaccucguccagcaggagggccagcucgagcagcaggagcgccaggucgagcaccucgagcagcaggucggccagcucaagcaccucgaggagcaggagggccagcucaagcaccucgagcagcagcagggccagcucgagguccccgagcagcaggucggccagcccaagaaccucgagcaggaggagaagcagcucgagcuccccgagcagcaggagggccaggucaagcaccucgagaagcaggaggcccagcucgagcuccccgagcagcaggucggccagcccaagcaccucgagcagcaggagaagcaccucgagcaccccgagcagcaggacggccagcucaagcaccucgagcagcaggagggccagcucaaggaccucgagcagcagaagggccagcucgagcagcccgucuucgcccccgcccccggccagguccaggacauccagcccgcccuccccaccaagggcgagguccuccuccccgucgagcaccagcagcagaagcaggagguccaguggccccccaagcacaaguga

SEQ ID NO: 44826 - RNA, 1929 nt, Artificial Sequence
  derived and/or modified sequence opt2 from IVNS1ABP__Homo_sapiens__NP_006460
augauccccaacggcuaccucauguucgaggacgagaacuucaucgaguccuccgucgccaagcucaacgcccuccgcaaguccggccaguucugcgacguccgccuccaggucugcggccacgagaugcucgcccaccgcgccguccucgccugcugcucccccuaccucuucgagaucuucaacuccgacuccgacccccacggcaucucccacgucaaguucgacgaccucaaccccgaggccgucgagguccuccucaacuacgccuacaccgcccagcucaaggccgacaaggagcucgucaaggacgucuacuccgccgccaagaagcucaagauggaccgcgucaagcaggucugcggcgacuaccuccucucccgcauggacgucaccuccugcaucuccuaccgcaacuucgccuccugcaugggcgacucccgccuccucaacaaggucgacgccuacauccaggagcaccuccuccagaucuccgaggaggaggaguuccucaagcucccccgccucaagcucgaggucaugcucgaggacaacgucugccuccccuccaacggcaagcucuacaccaaggucaucaacuggguccagcgcuccaucugggagaacggcgacucccucgaggagcucauggaggagguccagacccucuacuacuccgccgaccacaagcuccucgacggcaaccuccucgacggccaggccgaggucuucggcuccgacgacgaccacauccaguucguccagaagaagcccccccgcgagaacggccacaagcagaucuccuccuccuccaccggcugccucuccucccccaacgccaccguccagucccccaagcacgaguggaagaucgucgccuccgagaagaccuccaacaacaccuaccucugccucgccguccucgacggcaucuucugcgucaucuuccuccacggccgcaacuccccccaguccucccccaccuccacccccaagcucuccaagucccucuccuucgagaugcagcaggacgagcucaucgagaagcccaugucccccaugcaguacgcccgcuccggccucggcaccgccgagaugaacggcaagcucaucgccgccggcggcuacaaccgcgaggagugccuccgcaccgucgagugcuacaacccccacaccgaccacugguccuuccucgcccccaugcgcaccccccgcgcccgcuuccagauggccguccucaugggccagcucuacgucgucggcggcuccaacggccacuccgacgaccucuccugcggcgagauguacgacuccaacaucgacgacuggauccccguccccgagcuccgcaccaaccgcugcaacgccggcgucugcgcccucaacggcaagcucuacaucgucggcggcuccgaccccuacggccagaagggccucaagaacugcgacgucuucgaccccgucaccaagcucuggaccuccugcgccccccucaacauccgccgccaccaguccgccgucugcgagcucggcggcuaccucuacaucaucggcggcgccgaguccuggaacugccucaacaccgucgagcgcuacaaccccgagaacaacaccuggacccucaucgcccccaugaacgucgcccgccgcggcgccggcgucgccguccucaacggcaagcucuucgucugcggcggcuucgacggcucccacgccaucuccugcgucgagauguacgaccccacccgcaacgaguggaagaugaugggcaacaugaccuccccccgcuccaacgccggcaucgccaccgucggcaacaccaucuacgccgucggcggcuucgacggcaacgaguuccucaacaccgucgaggucuacaaccucgaguccaacgaguggucccccuacaccaagaucuuccaguucuga

SEQ ID NO: 44827 - RNA, 882 nt, Artificial Sequence
  derived and/or modified sequence opt2 from IYD__Homo_sapiens__NP_001158166
auguacuuccucacccccauccucgucgccauccucugcauccucgucgucuggaucuucaagaacgccgaccgcuccauggagaagaagaagggcgagccccgcacccgcgccgaggcccgccccugggucgacgaggaccucaaggacuccuccgaccuccaccaggccgaggaggacgccgacgaguggcaggaguccgaggagaacgucgagcacauccccuucucccacaaccacuaccccgagaaggagauggucaagcgcucccaggaguucuacgagcuccucaacaagcgccgcuccguccgcuucaucuccaacgagcagguccccauggaggucaucgacaacgucauccgcaccgccggcaccgcccccuccggcgcccacaccgagcccuggaccuucgucgucgucaaggaccccgacgucaagcacaagauccgcaagaucaucgaggaggaggaggagaucaacuacaugaagcgcaugggccaccgcugggucaccgaccucaagaagcuccgcaccaacuggaucaaggaguaccucgacaccgcccccauccucauccucaucuucaagcagguccacggcuucgccgccaacggcaagaagaagguccacuacuacaacgagaucuccgucuccaucgccugcggcauccuccucgccgcccuccaggucaacaacggcaucaccaugcgccaccagaccgcccgccaccgccaccucaucgagggccccggccgcuccuccgaggccugcuccaagcucuccucccagggcugccccgagugccgcuccggcgacugccacuaccacuccucccagcucuggcccuccaccgagggcgcccccggccccccccgcaccuga

SEQ ID NO: 44828 - RNA, 1131 nt, Artificial Sequence
  derived and/or modified sequence opt2 from IZUMO1__Homo_sapiens__XP_005258850
auguccguccuccuccucuccgucuggggcgaguccacccuccccaacggccuccgcgagcucugcgcccccgccgccaugggcccccacuucacccuccucugcgccgcccucgccggcugccuccuccccgccgagggcugcgucaucugcgaccccuccgucguccucgcccucaagucccucgagaaggacuaccuccccggccaccucgacgccaagcaccacaaggccaugauggagcgcgucgagaacgccgucaaggacuuccaggagcucucccucaacgaggacgccuacaugggcgucgucgacgaggccacccuccagaagggcuccuggucccuccucaaggaccucaagcgcaucaccgacuccgacgucaagggcgaccucuucgucaaggagcucuucuggaugcuccaccuccagaaggagaccuucgccaccuacgucgcccgcuuccagaaggaggccuacugccccaacaagugcggcgucaugcuccagacccucaucuggugcaagaacugcaagaaggagguccacgccugccgcaaguccuacgacugcggcgagcgcaacgucgaggucccccagauggaggacaugauccucgacugcgagcucaacuggcaccaggccuccgagggccucaccgacuacuccuucuaccgcgucuggggcaacaacaccgagacccucgucuccaagggcaaggaggccacccucaccaagcccauggucggccccgaggacgccggcuccuaccgcugcgagcucggcuccgucaacuccucccccgccaccaucaucaacuuccacgucaccguccuccccaagaugaucaaggaggagaagcccucccccaacaucgucacccccggcgaggccaccaccgaguccuccaucucccuccagccccuccagcccgagaagaugcucgccucccgccuccucggccuccucaucugcggcucccucgcccucaucaccggccucaccuucgccaucuuccgccgccgcaaggucaucgacuucaucaaguccucccucuucggccucggcuccggcgccgccgagcagacccagguccccaaggagaaggccaccgacucccgccagcaguga

SEQ ID NO: 44829 - RNA, 2493 nt, Artificial Sequence
  derived and/or modified sequence opt2 from JADE1__Homo_sapiens__NP_001274366
augaagcgcggccgccuccccuccuccuccgaggacuccgacgacaacggcucccucuccaccaccuggucccagaacucccgcucccagcaccgccgcuccuccugcucccgccacgaggaccgcaagcccuccgaggucuuccgcaccgaccucaucaccgccaugaagcuccacgacuccuaccagcucaaccccgacgaguacuacguccucgccgaccccuggcgccaggagugggagaagggcguccagguccccgucucccccggcaccaucccccagcccgucgcccgccccaagaaguacaucgucuccuccggcuccgagccccccgagcucggcuacgucgacauccgcacccucgccgacuccgucugccgcuacgaccucaacgacauggacgccgccuggcucgagcucaccaacgaggaguucaaggagaugggcaugcccgagcucgacgaguacaccauggagcgcguccucgaggaguucgagcagcgcugcuacgacaacaugaaccacgccaucgagaccgaggagggccucggcaucgaguacgacgaggacgucgucugcgacgucugccagucccccgacggcgaggacggcaacgagauggucuucugcgacaagugcaacaucugcguccaccaggccugcuacggcauccucaagguccccgagggcuccuggcucugccgcaccugcgcccucggcguccagcccaagugccuccucugccccaagaagggcggcgccaugaagcccacccgcuccggcaccaaguggguccacgucuccugcgcccucuggauccccgaggucuccaucggcucccccgagaagauggagcccaucaccaaggucucccacauccccuccucccgcugggcccucgucugcucccucugcaacgagaaguucggcgccuccauccagugcuccgucaagaacugccgcaccgccuuccacgucaccugcgccuucgaccgcggccucgagaugaagaccauccucgccgagaacgacgaggucaaguucaaguccuacugccccaagcacuccucccaccgcaagcccgaggagucccucggcaagggcgccgcccaggagaacggcgcccccgagugcuccccccgcaacccccucgagcccuucgccucccucgagcagaaccgcgaggaggcccaccgcgucuccguccgcaagcagaagcuccagcagcucgaggacgaguucuacaccuucgucaaccuccucgacgucgcccgcgcccuccgccuccccgaggaggucgucgacuuccucuaccaguacuggaagcucaagcgcaaggucaacuucaacaagccccucaucacccccaagaaggacgaggaggacaaccucgccaagcgcgagcaggacguccucuuccgccgccuccagcucuucacccaccuccgccaggaccucgagcgcguccgcaaccucaccuacauggucacccgccgcgagaagaucaagcgcuccgucugcaagguccaggagcagaucuucaaccucuacaccaagcuccucgagcaggagcgcgucuccggcguccccuccuccugcuccuccuccucccucgagaacaugcuccucuucaacucccccuccgucggccccgacgcccccaagaucgaggaccucaaguggcacuccgccuucuuccgcaagcagaugggcaccucccucguccacucccucaagaagccccacaagcgcgacccccuccagaacucccccggcuccgagggcaagacccuccucaagcagcccgaccucugcggccgccgcgagggcauggucguccccgaguccuuccucggccucgagaagaccuucgccgaggcccgccucaucuccgcccagcagaagaacggcgucgucaugcccgaccacggcaagcgccgcgacaaccgcuuccacugcgaccucaucaagggcgaccucaaggacaaguccuucaagcagucccacaagccccuccgcuccaccgacgucucccagcgccaccucgacaacacccgcgccgccaccucccccggcgucggccaguccgcccccggcacccgcaaggagaucguccccaagugcaacggcucccucaucaaggucaacuacaaccagaccgccgucaagguccccaccacccccgccucccccgucaagaacuggggcggcuuccgcauccccaagaagggcgagcgccagcagcagggcgaggcccacgacggcgccugccaccagcacuccgacuaccccuaccucggccucggccgcguccccgccaaggagcgcgccaaguccaagcucaaguccgacaacgagaacgacggcuacguccccgacgucgagauguccgacuccgaguccgaggccuccgagaagaagugcauccacaccuccuccaccaucucccgccgcaccgacaucauccgccgcuccauccucgccuccuga

SEQ ID NO: 44830 - RNA, 2553 nt, Artificial Sequence
  derived and/or modified sequence opt2 from JADE2__Homo_sapiens__NP_001276914
augguccccaccgccgccaucgccgucggcggcuacuuccucggcggcauggaggagaagcgccgcaaguacuccaucuccuccgacaacuccgacaccaccgacucccacgccaccuccaccuccgccucccgcugcuccaagcuccccuccuccaccaaguccggcuggccccgccagaacgagaagaagcccuccgaggucuuccgcaccgaccucaucaccgccaugaagauccccgacuccuaccagcucucccccgacgacuacuacauccucgccgaccccuggcgccaggagugggagaagggcguccagguccccgccggcgccgaggccauccccgagcccgucguccgcauccuccccccccucgagggcccccccgcccaggccucccccuccuccaccaugcucggcgagggcucccagcccgacuggcccggcggcucccgcuacgaccucgacgagaucgacgccuacuggcucgagcucaucaacuccgagcucaaggagauggagcgccccgagcucgacgagcucacccucgagcgcguccucgaggagcucgagacccucugccaccagaacauggcccgcgccaucgagacccaggagggccucggcaucgaguacgacgaggacgucgucugcgacgucugccgcucccccgagggcgaggacggcaacgagauggucuucugcgacaagugcaacgucugcguccaccaggccugcuacggcauccucaagguccccaccggcuccuggcucugccgcaccugcgcccucggcguccagcccaagugccuccucugccccaagcgcggcggcgcccucaagcccacccgcuccggcaccaaguggguccacgucuccugcgcccucuggauccccgaggucuccaucggcugccccgagaagauggagcccaucaccaagaucucccacauccccgccucccgcugggcccucuccugcucccucugcaaggagugcaccggcaccugcauccagugcuccaugcccuccugcgucaccgccuuccacgucaccugcgccuucgaccacggccucgagaugcgcaccauccucgccgacaacgacgaggucaaguucaaguccuucugccaggagcacuccgacggcggcccccgcaacgagcccaccuccgagcccaccgagcccucccaggccggcgaggaccucgagaaggucacccuccgcaagcagcgccuccagcagcucgaggaggacuucuacgagcucgucgagcccgccgaggucgccgagcgccucgaccucgccgaggcccucgucgacuucaucuaccaguacuggaagcucaagcgcaaggccaacgccaaccagccccuccucacccccaagaccgacgaggucgacaaccucgcccagcaggagcaggacguccucuaccgccgccucaagcucuucacccaccuccgccaggaccucgagcgcguccgcaaccucugcuacauggucacccgccgcgagcgcaccaagcacgccaucugcaagcuccaggagcagaucuuccaccuccagaugaagcucaucgagcaggaccucugccgcgagcgcuccggccgccgcgccaagggcaagaaguccgacuccaagcgcaagggcugcgagggcuccaagggcuccaccgagaagaaggagaaggucaaggccggccccgacuccguccucggccagcucgccggccucuccaccuccuuccccaucgacggcaccuucuucaacuccuggcucgcccaguccguccagaucaccgccgagaacauggccauguccgaguggccccucaacaacggccaccgcgaggaccccgcccccggccuccucuccgaggagcuccuccaggacgaggagacccuccucuccuucaugcgcgaccccucccuccgccccggcgaccccgcccgcaaggcccgcggccgcacccgccuccccgccaagaagaagcccccccccccccccccccaggacggccccggcucccgcaccacccccgacaaggcccccaagaagaccuggggccaggacgccggcuccggcaagggcggccagggcccccccacccgcaagcccccccgccgcaccuccucccaccuccccuccucccccgccgccggcgacugccccauccucgccacccccgaguccccccccccccucgcccccgagacccccgacgaggccgccuccgucgccgccgacuccgacguccagguccccggccccgccgccucccccaagccccucggccgccuccgccccccccgcgaguccaaggucacccgccgccuccccggcgcccgccccgacgccggcaugggcccccccuccgccgucgccgagcgccccaaggucucccuccacuucgacaccgagaccgacggcuacuucuccgacggcgagauguccgacuccgacgucgaggccgaggacggcggcguccagcgcggcccccgcgaggccggcgccgaggaggucguccgcaugggcguccucgccuccuga

SEQ ID NO: 44831 - RNA, 3657 nt, Artificial Sequence
  derived and/or modified sequence opt2 from JAG1__Homo_sapiens__NP_000205
augcgcuccccccgcacccgcggccgcuccggccgcccccucucccuccuccucgcccuccucugcgcccuccgcgccaaggucugcggcgccuccggccaguucgagcucgagauccucuccaugcagaacgucaacggcgagcuccagaacggcaacugcugcggcggcgcccgcaaccccggcgaccgcaagugcacccgcgacgagugcgacaccuacuucaaggucugccucaaggaguaccagucccgcgucaccgccggcggccccugcuccuucggcuccggcuccacccccgucaucggcggcaacaccuucaaccucaaggccucccgcggcaacgaccgcaaccgcaucguccuccccuucuccuucgccuggccccgcuccuacacccuccucgucgaggccugggacuccuccaacgacaccguccagcccgacuccaucaucgagaaggccucccacuccggcaugaucaaccccucccgccaguggcagacccucaagcagaacaccggcgucgcccacuucgaguaccagauccgcgucaccugcgacgacuacuacuacggcuucggcugcaacaaguucugccgcccccgcgacgacuucuucggccacuacgccugcgaccagaacggcaacaagaccugcauggagggcuggaugggccccgagugcaaccgcgccaucugccgccagggcugcucccccaagcacggcuccugcaagcuccccggcgacugccgcugccaguacggcuggcagggccucuacugcgacaagugcaucccccaccccggcugcguccacggcaucugcaacgagcccuggcagugccucugcgagaccaacuggggcggccagcucugcgacaaggaccucaacuacugcggcacccaccagcccugccucaacggcggcaccugcuccaacaccggccccgacaaguaccagugcuccugccccgagggcuacuccggccccaacugcgagaucgccgagcacgccugccucuccgaccccugccacaaccgcggcuccugcaaggagaccucccucggcuucgagugcgagugcucccccggcuggaccggccccaccugcuccaccaacaucgacgacugcucccccaacaacugcucccacggcggcaccugccaggaccucgucaacggcuucaagugcgucugccccccccaguggaccggcaagaccugccagcucgacgccaacgagugcgaggccaagcccugcgucaacgccaaguccugcaagaaccucaucgccuccuacuacugcgacugccuccccggcuggaugggccagaacugcgacaucaacaucaacgacugccucggccagugccagaacgacgccuccugccgcgaccucgucaacggcuaccgcugcaucugcccccccggcuacgccggcgaccacugcgagcgcgacaucgacgagugcgccuccaaccccugccucaacggcggccacugccagaacgagaucaaccgcuuccagugccucugccccaccggcuucuccggcaaccucugccagcucgacaucgacuacugcgagcccaaccccugccagaacggcgcccagugcuacaaccgcgccuccgacuacuucugcaagugccccgaggacuacgagggcaagaacugcucccaccucaaggaccacugccgcaccacccccugcgaggucaucgacuccugcaccgucgccauggccuccaacgacacccccgagggcguccgcuacaucuccuccaacgucugcggcccccacggcaagugcaagucccaguccggcggcaaguucaccugcgacugcaacaagggcuucaccggcaccuacugccacgagaacaucaacgacugcgaguccaaccccugccgcaacggcggcaccugcaucgacggcgucaacuccuacaagugcaucugcuccgacggcugggagggcgccuacugcgagaccaacaucaacgacugcucccagaaccccugccacaacggcggcaccugccgcgaccucgucaacgacuucuacugcgacugcaagaacggcuggaagggcaagaccugccacucccgcgacucccagugcgacgaggccaccugcaacaacggcggcaccugcuacgacgagggcgacgccuucaagugcaugugccccggcggcugggagggcaccaccugcaacaucgcccgcaacuccuccugccuccccaaccccugccacaacggcggcaccugcgucgucaacggcgaguccuucaccugcgucugcaaggagggcugggagggccccaucugcgcccagaacaccaacgacugcuccccccaccccugcuacaacuccggcaccugcgucgacggcgacaacugguaccgcugcgagugcgcccccggcuucgccggccccgacugccgcaucaacaucaacgagugccaguccucccccugcgccuucggcgccaccugcgucgacgagaucaacggcuaccgcugcgucugcccccccggccacuccggcgccaagugccaggaggucuccggccgccccugcaucaccaugggcuccgucauccccgacggcgccaagugggacgacgacugcaacaccugccagugccucaacggccgcaucgccugcuccaaggucuggugcggcccccgccccugccuccuccacaagggccacuccgagugccccuccggccaguccugcauccccauccucgacgaccagugcuucguccaccccugcaccggcgucggcgagugccgcuccuccucccuccagcccgucaagaccaagugcaccuccgacuccuacuaccaggacaacugcgccaacaucaccuucaccuucaacaaggagaugaugucccccggccucaccaccgagcacaucugcuccgagcuccgcaaccucaacauccucaagaacgucuccgccgaguacuccaucuacaucgccugcgagcccucccccuccgccaacaacgagauccacgucgccaucuccgccgaggacauccgcgacgacggcaaccccaucaaggagaucaccgacaagaucaucgaccucgucuccaagcgcgacggcaacuccucccucaucgccgccgucgccgagguccgcguccagcgccgcccccucaagaaccgcaccgacuuccucgucccccuccucuccuccguccucaccgucgccuggaucugcugccucgucaccgccuucuacuggugccuccgcaagcgccgcaagcccggcucccacacccacuccgccuccgaggacaacaccaccaacaacguccgcgagcagcucaaccagaucaagaaccccaucgagaagcacggcgccaacaccguccccaucaaggacuacgagaacaagaacuccaagauguccaagauccgcacccacaacuccgaggucgaggaggacgacauggacaagcaccagcagaaggcccgcuucgccaagcagcccgccuacacccucgucgaccgcgaggagaagccccccaacggcacccccaccaagcaccccaacuggaccaacaagcaggacaaccgcgaccucgaguccgcccagucccucaaccgcauggaguacaucgucuga

SEQ ID NO: 44832 - RNA, 3717 nt, Artificial Sequence
  derived and/or modified sequence opt2 from JAG2__Homo_sapiens__NP_002217
augcgcgcccagggccgcggccgccucccccgccgccuccuccuccuccucgcccucuggguccaggccgcccgccccaugggcuacuucgagcuccagcucuccgcccuccgcaacgucaacggcgagcuccucuccggcgccugcugcgacggcgacggccgcaccacccgcgccggcggcugcggccacgacgagugcgacaccuacguccgcgucugccucaaggaguaccaggccaaggucacccccaccggccccugcuccuacggccacggcgccacccccguccucggcggcaacuccuucuaccucccccccgccggcgccgccggcgaccgcgcccgcgcccgcgcccgcgccggcggcgaccaggaccccggccucgucgucauccccuuccaguucgccuggccccgcuccuucacccucaucgucgaggccugggacugggacaacgacaccacccccaacgaggagcuccucaucgagcgcgucucccacgccggcaugaucaaccccgaggaccgcuggaagucccuccacuucuccggccacgucgcccaccucgagcuccagauccgcguccgcugcgacgagaacuacuacuccgccaccugcaacaaguucugccgcccccgcaacgacuucuucggccacuacaccugcgaccaguacggcaacaaggccugcauggacggcuggaugggcaaggagugcaaggaggccgucugcaagcagggcugcaaccuccuccacggcggcugcaccguccccggcgagugccgcugcuccuacggcuggcagggccgcuucugcgacgagugcguccccuaccccggcugcguccacggcuccugcgucgagcccuggcagugcaacugcgagaccaacuggggcggccuccucugcgacaaggaccucaacuacugcggcucccaccaccccugcaccaacggcggcaccugcaucaacgccgagcccgaccaguaccgcugcaccugccccgacggcuacuccggccgcaacugcgagaaggccgagcacgccugcaccuccaaccccugcgccaacggcggcuccugccacgagguccccuccggcuucgagugccacugccccuccggcugguccggccccaccugcgcccucgacaucgacgagugcgccuccaaccccugcgccgccggcggcaccugcgucgaccaggucgacggcuucgagugcaucugccccgagcagugggucggcgccaccugccagcucgacgccaacgagugcgagggcaagcccugccucaacgccuucuccugcaagaaccucaucggcggcuacuacugcgacugcauccccggcuggaagggcaucaacugccacaucaacgucaacgacugccgcggccagugccagcacggcggcaccugcaaggaccucgucaacggcuaccagugcgucugcccccgcggcuucggcggccgccacugcgagcucgagcgcgacgagugcgccuccucccccugccacuccggcggccucugcgaggaccucgccgacggcuuccacugccacugcccccagggcuucuccggcccccucugcgaggucgacgucgaccucugcgagcccucccccugccgcaacggcgcccgcugcuacaaccucgagggcgacuacuacugcgccugccccgacgacuucggcggcaagaacugcuccgucccccgcgagcccugccccggcggcgccugccgcgucaucgacggcugcggcuccgacgccggccccggcaugcccggcaccgccgccuccggcgucugcggcccccacggccgcugcgucucccagcccggcggcaacuucuccugcaucugcgacuccggcuucaccggcaccuacugccacgagaacaucgacgacugccucggccagcccugccgcaacggcggcaccugcaucgacgaggucgacgccuuccgcugcuucugccccuccggcugggagggcgagcucugcgacaccaaccccaacgacugccuccccgaccccugccacucccgcggccgcugcuacgaccucgucaacgacuucuacugcgccugcgacgacggcuggaagggcaagaccugccacucccgcgaguuccagugcgacgccuacaccugcuccaacggcggcaccugcuacgacuccggcgacaccuuccgcugcgccugcccccccggcuggaagggcuccaccugcgccgucgccaagaacuccuccugccuccccaaccccugcgucaacggcggcaccugcgucggcuccggcgccuccuucuccugcaucugccgcgacggcugggagggccgcaccugcacccacaacaccaacgacugcaacccccuccccugcuacaacggcggcaucugcgucgacggcgucaacugguuccgcugcgagugcgcccccggcuucgccggccccgacugccgcaucaacaucgacgagugccaguccucccccugcgccuacggcgccaccugcgucgacgagaucaacggcuaccgcugcuccugcccccccggccgcgccggcccccgcugccaggaggucaucggcuucggccgcuccugcuggucccgcggcacccccuucccccacggcuccuccugggucgaggacugcaacuccugccgcugccucgacggccgccgcgacugcuccaaggucuggugcggcuggaagcccugccuccucgccggccagcccgaggcccucuccgcccagugcccccucggccagcgcugccucgagaaggcccccggccagugccuccgcccccccugcgaggccuggggcgagugcggcgccgaggagccccccuccacccccugccucccccgcuccggccaccucgacaacaacugcgcccgccucacccuccacuucaaccgcgaccacgucccccagggcaccaccgucggcgccaucugcuccggcauccgcucccuccccgccacccgcgccgucgcccgcgaccgccuccucguccuccucugcgaccgcgccuccuccggcgccuccgccgucgaggucgccgucuccuucucccccgcccgcgaccuccccgacuccucccucauccagggcgccgcccacgccaucgucgccgccaucacccagcgcggcaacuccucccuccuccucgccgucaccgaggucaaggucgagaccgucgucaccggcggcuccuccaccggccuccucguccccguccucugcggcgccuucuccguccucuggcucgccugcgucguccucugcgucugguggacccgcaagcgccgcaaggagcgcgagcgcucccgccucccccgcgaggaguccgccaacaaccagugggccccccucaaccccauccgcaaccccaucgagcgccccggcggccacaaggacguccucuaccagugcaagaacuucaccccccccccccgccgcgccgacgaggcccuccccggccccgccggccacgccgccguccgcgaggacgaggaggacgaggaccucggccgcggcgaggaggacucccucgaggccgagaaguuccucucccacaaguucaccaaggaccccggccgcucccccggccgccccgcccacugggccuccggccccaaggucgacaaccgcgccguccgcuccaucaacgaggcccgcuacgccggcaaggaguga

SEQ ID NO: 44833 - RNA, 552 nt, Artificial Sequence
  derived and/or modified sequence opt2 from JAGN1__Homo_sapiens__NP_115881
auggccucccgcgccggcccccgcgccgccggcaccgacggcuccgacuuccagcaccgcgagcgcgucgccaugcacuaccagauguccgucacccucaaguacgagaucaagaagcucaucuacguccaccucgucaucuggcuccuccucgucgccaagauguccgucggccaccuccgccuccucucccacgaccaggucgccaugcccuaccagugggaguaccccuaccuccucuccauccuccccucccuccucggccuccucuccuucccccgcaacaacaucuccuaccucguccucuccaugaucuccaugggccucuucuccaucgccccccucaucuacggcuccauggagauguuccccgccgcccagcagcucuaccgccacggcaaggccuaccgcuuccucuucggcuucuccgccgucuccaucauguaccucguccucguccucgccguccagguccacgccuggcagcucuacuacuccaagaagcuccucgacuccugguucaccuccacccaggagaagaagcacaaguga

SEQ ID NO: 44834 - RNA, 3399 nt, Artificial Sequence
  derived and/or modified sequence opt2 from JAK2__Homo_sapiens__NP_004963
augggcauggccugccucaccaugaccgagauggagggcaccuccaccuccuccaucuaccagaacggcgacaucuccggcaacgccaacuccaugaagcagaucgaccccguccuccaggucuaccucuaccacucccucggcaaguccgaggccgacuaccucaccuuccccuccggcgaguacgucgccgaggagaucugcaucgccgccuccaaggccugcggcaucacccccgucuaccacaacauguucgcccucauguccgagaccgagcgcaucugguacccccccaaccacgucuuccacaucgacgaguccacccgccacaacguccucuaccgcauccgcuucuacuucccccgcugguacugcuccggcuccaaccgcgccuaccgccacggcaucucccgcggcgccgaggccccccuccucgacgacuucgucauguccuaccucuucgcccaguggcgccacgacuucguccacggcuggaucaagguccccgucacccacgagacccaggaggagugccucggcauggccguccucgacaugaugcgcaucgccaaggagaacgaccagaccccccucgccaucuacaacuccaucuccuacaagaccuuccuccccaagugcauccgcgccaagauccaggacuaccacauccucacccgcaagcgcauccgcuaccgcuuccgccgcuucauccagcaguucucccagugcaaggccaccgcccgcaaccucaagcucaaguaccucaucaaccucgagacccuccaguccgccuucuacaccgagaaguucgaggucaaggagcccggcuccggccccuccggcgaggagaucuucgccaccaucaucaucaccggcaacggcggcauccaguggucccgcggcaagcacaaggaguccgagacccucaccgagcaggaccuccagcucuacugcgacuuccccaacaucaucgacgucuccaucaagcaggccaaccaggagggcuccaacgagucccgcgucgucaccauccacaagcaggacggcaagaaccucgagaucgagcucuccucccuccgcgaggcccucuccuucgucucccucaucgacggcuacuaccgccucaccgccgacgcccaccacuaccucugcaaggaggucgccccccccgccguccucgagaacauccaguccaacugccacggccccaucuccauggacuucgccaucuccaagcucaagaaggccggcaaccagaccggccucuacguccuccgcugcucccccaaggacuucaacaaguacuuccucaccuucgccgucgagcgcgagaacgucaucgaguacaagcacugccucaucaccaagaacgagaacgaggaguacaaccucuccggcaccaagaagaacuucuccucccucaaggaccuccucaacugcuaccagauggagaccguccgcuccgacaacaucaucuuccaguucaccaagugcugcccccccaagcccaaggacaaguccaaccuccucgucuuccgcaccaacggcgucuccgacguccccaccucccccacccuccagcgccccacccacaugaaccagauggucuuccacaagauccgcaacgaggaccucaucuucaacgagucccucggccagggcaccuucaccaagaucuucaagggcguccgccgcgaggucggcgacuacggccagcuccacgagaccgagguccuccucaagguccucgacaaggcccaccgcaacuacuccgaguccuucuucgaggccgccuccaugauguccaagcucucccacaagcaccucguccucaacuacggcgucugcgucugcggcgacgagaacauccucguccaggaguucgucaaguucggcucccucgacaccuaccucaagaagaacaagaacugcaucaacauccucuggaagcucgaggucgccaagcagcucgccugggccaugcacuuccucgaggagaacacccucauccacggcaacgucugcgccaagaacauccuccucauccgcgaggaggaccgcaagaccggcaacccccccuucaucaagcucuccgaccccggcaucuccaucaccguccuccccaaggacauccuccaggagcgcauccccugggucccccccgagugcaucgagaaccccaagaaccucaaccucgccaccgacaagugguccuucggcaccacccucugggagaucugcuccggcggcgacaagccccucuccgcccucgacucccagcgcaagcuccaguucuacgaggaccgccaccagcuccccgcccccaagugggccgagcucgccaaccucaucaacaacugcauggacuacgagcccgacuuccgccccuccuuccgcgccaucauccgcgaccucaacucccucuucacccccgacuacgagcuccucaccgagaacgacaugcuccccaacaugcgcaucggcgcccucggcuucuccggcgccuucgaggaccgcgaccccacccaguucgaggagcgccaccucaaguuccuccagcagcucggcaagggcaacuucggcuccgucgagaugugccgcuacgacccccuccaggacaacaccggcgaggucgucgccgucaagaagcuccagcacuccaccgaggagcaccuccgcgacuucgagcgcgagaucgagauccucaagucccuccagcacgacaacaucgucaaguacaagggcgucugcuacuccgccggccgccgcaaccucaagcucaucauggaguaccuccccuacggcucccuccgcgacuaccuccagaagcacaaggagcgcaucgaccacaucaagcuccuccaguacaccucccagaucugcaagggcauggaguaccucggcaccaagcgcuacauccaccgcgaccucgccacccgcaacauccucgucgagaacgagaaccgcgucaagaucggcgacuucggccucaccaagguccucccccaggacaaggaguacuacaaggucaaggagcccggcgagucccccaucuucugguacgcccccgagucccucaccgaguccaaguucuccgucgccuccgacgucugguccuucggcgucguccucuacgagcucuucaccuacaucgagaaguccaaguccccccccgccgaguucaugcgcaugaucggcaacgacaagcagggccagaugaucgucuuccaccucaucgagcuccucaagaacaacggccgccucccccgccccgacggcugccccgacgagaucuacaugaucaugaccgagugcuggaacaacaacgucaaccagcgccccuccuuccgcgaccucgcccuccgcgucgaccagauccgcgacaacauggccggcuga

SEQ ID NO: 44835 - RNA, 3504 nt, Artificial Sequence
  derived and/or modified sequence opt2 from JAK3__Homo_sapiens__XP_005259953
augaccgucgcccaggagaccaagggccccacccaggagggcgccgagugggacuucccccucgccgccucccgccucugcccccccuucgagucccccggcucccuccccgcccgccaggucgcccucauggccccccccuccgaggagaccccccucaucccccagcgcuccugcucccuccucuccaccgaggccggcgcccuccacguccuccuccccgcccgcggccccggccccccccagcgccucuccuucuccuucggcgaccaccucgccgaggaccucugcguccaggccgccaaggccuccggcauccuccccgucuaccacucccucuucgcccucgccaccgaggaccucuccugcugguucccccccucccacaucuucuccgucgaggacgccuccacccagguccuccucuaccgcauccgcuucuacuuccccaacugguucggccucgagaagugccaccgcuucggccuccgcaaggaccucgccuccgccauccucgaccuccccguccucgagcaccucuucgcccagcaccgcuccgaccucgucuccggccgccuccccgucggccucucccucaaggagcagggcgagugccucucccucgccguccucgaccucgcccgcauggcccgcgagcaggcccagcgccccggcgagcuccucaagaccgucuccuacaaggccugccucccccccucccuccgcgaccucauccagggccucuccuucgucacccgccgccgcauccgccgcaccguccgccgcgcccuccgccgcgucgccgccugccaggccgaccgccacucccucauggccaaguacaucauggaccucgagcgccucgaccccgccggcgccgccgagaccuuccacgucggccuccccggcgcccucggcggccacgacggccucggccuccuccgcgucgccggcgacggcggcaucgccuggacccagggcgagcaggagguccuccagcccuucugcgacuuccccgagaucgucgacaucuccaucaagcaggccccccgcgucggccccgccggcgagcaccgccucgucaccgucacccgcaccgacaaccagauccucgaggccgaguuccccggccuccccgaggcccucuccuucgucgcccucgucgacggcuacuuccgccucaccaccgacucccagcacuucuucugcaaggaggucgcccccccccgccuccucgaggaggucgccgagcagugccacggccccaucacccucgacuucgccaucaacaagcucaagaccggcggcucccgccccggcuccuacguccuccgccgcuccccccaggacuucgacuccuuccuccucaccgucugcguccagaacccccucggccccgacuacaagggcugccucauccgccgcucccccaccggcaccuuccuccucgucggccucucccgcccccacuccucccuccgcgagcuccucgccaccugcugggacggcggccuccacgucgacggcgucgccgucacccucaccuccugcugcaucccccgccccaaggagaaguccaaccucaucgucguccagcgcggccacuccccccccaccuccucccucguccagccccagucccaguaccagcucucccagaugaccuuccacaagauccccgccgacucccucgaguggcacgagaaccucggccacggcuccuucaccaagaucuaccgcggcugccgccacgaggucgucgacggcgaggcccgcaagaccgagguccuccucaaggucauggacgccaagcacaagaacugcauggaguccuuccucgaggccgccucccucaugucccaggucuccuaccgccaccucguccuccuccacggcgucugcauggccggcgacuccaccaugguccaggaguucguccaccucggcgccaucgacauguaccuccgcaagcgcggccaccucguccccgccuccuggaagcuccaggucgucaagcagcucgccuacgcccucaacuaccucgaggacaagggccucccccacggcaacgucuccgcccgcaagguccuccucgcccgcgagggcgccgacggcuccccccccuucaucaagcucuccgaccccggcgucucccccgccguccucucccucgagaugcucaccgaccgcauccccugggucgcccccgagugccuccgcgaggcccagacccucucccucgaggccgacaaguggggcuucggcgccaccgucugggaggucuucuccggcgucaccaugcccaucuccgcccucgaccccgccaagaagcuccaguucuacgaggaccgccagcagcuccccgcccccaaguggaccgagcucgcccuccucauccagcagugcauggccuacgagcccguccagcgccccuccuuccgcgccgucauccgcgaccucaacucccucaucuccuccgacuacgagcuccucuccgaccccacccccggcgcccucgccccccgcgacggccucuggaacggcgcccagcucuacgccugccaggaccccaccaucuucgaggagcgccaccucaaguacaucucccagcucggcaagggcaacuucggcuccgucgagcucugccgcuacgacccccucggcgacaacaccggcgcccucgucgccgucaagcagcuccagcacuccggccccgaccagcagcgcgacuuccagcgcgagauccagauccucaaggcccuccacuccgacuucaucgucaaguaccgcggcgucuccuacggccccggccgccagucccuccgccucgucauggaguaccuccccuccggcugccuccgcgacuuccuccagcgccaccgcgcccgccucgacgccucccgccuccuccucuacuccucccagaucugcaagggcauggaguaccucggcucccgccgcugcguccaccgcgaccucgccgcccgcaacauccucgucgaguccgaggcccacgucaagaucgccgacuucggccucgccaagcuccucccccucgacaaggacuacuacgucguccgcgagcccggccagucccccaucuucugguacgcccccgagucccucuccgacaacaucuucucccgccaguccgacgucugguccuucggcgucguccucuacgagcucuucaccuacugcgacaaguccugcucccccuccgccgaguuccuccgcaugaugggcugcgagcgcgacguccccgcccucugccgccuccucgagcuccucgaggagggccagcgccuccccgccccccccgccugccccgccgagguccacgagcucaugaagcucugcugggcccccuccccccaggaccgccccuccuucuccgcccucggcccccagcucgacaugcucugguccggcucccgcggcugcgagacccacgccuucaccgcccaccccgagggcaagcaccacucccucuccuucuccuga

SEQ ID NO: 44836 - RNA, 2496 nt, Artificial Sequence
  derived and/or modified sequence opt2 from JAKMIP1__Homo_sapiens__NP_001092903
auguccaagaagggccgcuccaagggcgagaagcccgagauggagaccgacgccguccagauggccaacgaggagcuccgcgccaagcucaccuccauccagaucgaguuccagcaggagaaguccaaggucggcaagcuccgcgagcgccuccaggaggccaagcucgagcgcgagcaggagcagcgccgccacaccgccuacaucuccgagcucaaggccaagcuccacgaggagaagaccaaggagcuccaggcccuccgcgagggccucauccgccagcacgagcaggaggccgcccgcaccgccaagaucaaggagggcgagcuccagcgccuccaggccacccucaacguccuccgcgacggcgccgccgacaaggucaagaccgcccuccucaccgaggcccgcgaggaggcccgccgcgccuucgacggcgagcgccuccgccuccagcaggagauccucgagcucaaggccgcccgcaagcaggccgaggaggcccucuccaacugcaugcaggccgacaagaccaaggccgccgaccuccgcgccgccuaccaggcccaccaggacgagguccaccgcaucaagcgcgagugcgagcgcgacauccgccgccucauggacgagaucaagggcaaggaccgcgucauccucgcccucgagaaggagcucggcguccaggccggccagacccagaagcuccuccuccagaaggaggcccucgacgagcagcucguccaggucaaggaggccgagcgccaccacuccucccccaagcgcgagcucccccccggcaucggcgacauggucgagcucaugggcguccaggaccagcacauggacgagcgcgacguccgccgcuuccagcucaagaucgccgagcucaacuccgucauccgcaagcucgaggaccgcaacacccuccucgccgacgagcgcaacgagcuccucaagcgcucccgcgagaccgagguccagcucaagccccucgucgagaagaacaagcgcaugaacaagaagaacgaggaccuccuccaguccauccagcgcauggaggagaagaucaagaaccucacccgcgagaacgucgagaugaaggagaagcucuccgcccaggccucccucaagcgccacaccucccucaacgaccucucccucacccgcgacgagcaggagaucgaguuccuccgccuccagguccucgagcagcagcacgucaucgacgaccucucccucgagcgcgagcgccuccuccgcuccaagcgccaccgcggcaagucccucaagccccccaagaagcacgucgucgagaccuucuucggcuucgacgaggaguccgucgacuccgagacccucuccgagaccuccuacaacaccgaccgcaccgaccgcacccccgccacccccgaggaggaccucgacgacgccaccgcccgcgaggaggccgaccuccgcuucugccagcucacccgcgaguaccaggcccuccagcgcgccuacgcccuccuccaggagcaggucggcggcacccucgacgccgagcgcgaggcccgcacccgcgagcagcuccaggccgaccuccuccgcugccaggccaagaucgaggaccucgagaagcuccucgucgagaagggccaggacuccaagugggucgaggagaagcagcuccucauccgcaccaaccaggaccuccucgagaagaucuaccgccucgagauggaggagaaccagcucaagaacgagaugcaggacgccaaggaccagaacgagcuccucgaguuccgcguccucgagcucgaggagcgcgagcgccgcucccccgccuucaaccuccagaucaccaccuuccccgagaaccacuccuccgcccuccagcucuucugccaccaggagggcgucaaggacgucaacgucuccgagcucaugaagaagcucgacauccucggcgacaacggcaaccuccgcaacgaggagcaggucgccaucauccaggccggcaccguccucgcccucugcgagaaguggcucaagcagaucgagggcaccgaggccgcccucacccagaagaugcucgaccucgagaaggagaaggaccucuucucccgccagaagggcuaccucgaggaggagcucgacuaccgcaagcaggcccucgaccaggccuaccucaagauccaggaccucgaggccacccucuacaccgcccuccagcaggagcccggccgccgcgccggcgaggcccucuccgagggccagcgcgaggaccuccaggccgccgucgagaagguccgccgccagauccuccgccagucccgcgaguucgacucccagauccuccgcgagcgcauggagcuccuccagcaggcccagcagcgcauccgcgagcucgaggacaagcucgaguuccagaagcgccaccucaaggagcucgaggagaaguuccucuuccucuuccucuucuucucccucgccuucauccucuggcccuga

SEQ ID NO: 44837 - RNA, 2400 nt, Artificial Sequence
  derived and/or modified sequence opt2 from JAKMIP2__Homo_sapiens__NP_001257863
auguccaagaagggccgcaacaagggcgagaagcccgaggcccucaucgucgcccuccaggccgccaacgaggaccuccgcaccaagcucaccgacauccagaucgagcuccaccaggagaaguccaaggucuccaagcucgagcgcgagaagacccaggaggccaagcgcauccgcgagcucgagcagcgcaagcacaccguccucgucaccgagcucaaggccaagcuccacgaggagaagaugaaggagcuccaggccguccgcgagaaccucaucaagcagcacgagcaggagaugucccgcaccgucaagguccgcgacggcgagauccagcgccucaaguccgcccucugcgcccuccgcgacggcuccuccgacaagguccgcaccgcccucaccaucgaggcccgcgaggaggcccgcaagcucuucgacaccgagcgccucaagcuccuccaggagaucgccgaccucaagaccgccaagaagcaggucgacgaggcccucuccaacaugauccaggccgacaagaucaaggccggcgaccuccgcuccgagcaccagucccaccaggaggccaucuccaagaucaagugggaguccgagcgcgacauccgccgccucauggacgagaucaaggccaaggaccgcaucaucuucucccucgagaaggagcucgagacccagaccggcuacguccagaagcuccagcuccagaaggaggcccucgacgagcagcucuuccucgucaaggaggccgagugcaacauguccucccccaagcgcgagauccccggccgcgccggcgacggcuccgagcacugcuccucccccgaccuccgccgcaaccagaagcgcaucgccgagcucaacgccaccauccgcaagcucgaggaccgcaacacccuccucggcgacgagcgcaacgagcuccucaagcgcguccgcgagaccgagaagcagugcaagccccuccucgagcgcaacaagugccucgccaagcgcaacgacgagcucauggucucccuccagcgcauggaggagaagcucaaggccgucaccaaggagaacuccgagaugcgcgagaagaucaccucccaccccccccucaagaagcucaagucccucaacgaccucgaccaggccaacgaggagcaggagaccgaguuccucaagcuccaggucaucgagcagcagaacaucaucgacgagcucacccgcgaccgcgagaagcucauccgccgccgcaagcaccgccgcuccuccaagcccaucaagcgccccguccucgaccccuucaucggcuacgacgaggacuccauggacuccgagaccuccuccauggccuccuuccgcaccgaccgcacccccgccacccccgacgacgaccucgacgagucccucgccgccgaggaguccgagcuccgcuuccgccagcucaccaaggaguaccaggcccuccagcgcgccuacgcccuccuccaggagcagaccggcggcaucaucgacgccgagcgcgaggccaaggcccaggagcagcuccaggccgagguccuccgcuacaaggccaagaucgaggaccucgaggccacccucgcccagaagggccagaucgagaagcaggaggccgagaaccaccgccuccagcaggagcuccaggacgcccgcgaccagaacgagcuccucgaguuccgcaaccucgagcucgaggagcgcgagcgccgcuccccccccuucaaccuccagauccaccccuucuccgacggcgucuccgcccuccagaucuacugcaugaaggagggcgucaaggacgucaacauccccgaccucaucaagcagcucgacauccucggcgacaacggcaaccuccgcaacgaggagcaggucgccaucauccaggccuccaccguccucucccucgccgagaaguggauccagcagaucgagggcgccgaggccgcccuccaccagaagaugauggagcucgaguccgacauggagcaguucugcaagaucaagggcuaccucgaggaggagcucgacuaccgcaagcaggcccucgaccaggccuacaugcgcauccaggagcucgaggccacccucuacaacgcccuccagcaggagaccgucaucaaguucggcgagcuccucuccgagaagcagcaggaggagcuccgcaccgccgucgagaagcuccgccgccagaugcuccgcaagucccgcgaguacgacugccagauccuccaggagcgcauggagcuccuccagcaggcccaccagcgcauccgcgaccucgaggacaagaccgacauccagaagcgccagaucaaggaccucgaggagaaguuccucuuccucuuccucuucuucucccucgccuucauccucuggcccuga

SEQ ID NO: 44838 - RNA, 2535 nt, Artificial Sequence
  derived and/or modified sequence opt2 from JAKMIP3__Homo_sapiens__XP_011537986
auguccaagcgcggcauguccucccgcgccaagggcgacaaggccgaggcccucgccgcccuccaggccgccaacgaggaccuccgcgccaagcucaccgacauccagaucgagcuccagcaggagaaguccaaggucuccaaggucgagcgcgagaagaaccaggagcuccgccagguccgcgagcacgagcagcacaagaccgccguccuccucaccgagcucaagaccaagcuccacgaggagaagaugaaggagcuccaggccguccgcgagacccuccuccgccagcacgaggccgagcuccuccgcgucaucaagaucaaggacaacgagaaccagcgccuccaggcccuccucuccgcccuccgcgacggcggccccgagaaggucaagaccguccuccucuccgaggccaaggaggaggccaagaagggcuucgaggucgagaaggucaagaugcagcaggagaucuccgagcucaagggcgccaagcgccaggucgaggaggcccucacccucgucauccaggccgacaagaucaaggccgccgagauccgcuccgucuaccaccuccaccaggaggagaucacccgcaucaagaaggagugcgagcgcgagauccgccgccucauggaggagaucaaguucaaggaccgcgccgucuucguccucgagcgcgagcucggcguccaggccggccacgcccagcgccuccagcuccagaaggaggcccucgacgagcagcucucccagguccgcgaggccgaccgccaccccggcuccccccgccgcgagcucccccacgccgccggcgccggcgacgccuccgaccacuccggcucccccgagcagcagcucgacgagaaggacgcccgccgcuuccagcucaagaucgccgagcucuccgccaucauccgcaagcucgaggaccgcaacgcccuccucuccgaggagcgcaacgagcuccucaagcgcguccgcgaggccgagucccaguacaagccccuccucgacaagaacaagcgccucucccgcaagaacgaggaccucucccacgcccuccgccgcauggagaacaagcucaaguucgucacccaggagaacaucgagaugcgccagcgcgccggcaucauccgccgccccuccucccucaacgaccucgaccagucccaggacgagcgcgaggucgacuuccucaagcuccagaucgucgagcagcagaaccucaucgacgagcucuccaagacccucgagaccgccggcuacgucaaguccguccucgagcgcgacaagcuccuccgcuuccgcaagcagcgcaagaagauggccaagcuccccaagcccgucgucgucgagaccuucuucggcuacgacgaggaggccucccucgaguccgacggcuccuccgucuccuaccagaccgaccgcaccgaccagacccccugcacccccgacgacgaccucgaggagggcauggccaaggaggagaccgagcuccgcuuccgccagcucaccauggaguaccaggcccuccagcgcgccuacgcccuccuccaggagcaggucggcggcacccucgacgccgagcgcgaggucaagacccgcgagcagcuccaggccgagguccagcgcgcccaggcccgcaucgaggaccucgagaaggcccucgccgagcagggccaggacaugaaguggaucgaggagaagcaggcccucuaccgccgcaaccaggagcucgucgagaagaucaagcagauggagaccgaggaggcccgccuccgccacgagguccaggacgcccgcgaccagaacgagcuccucgaguuccgcauccucgagcucgaggagcgcgagcgcaagucccccgccaucuccuuccaccacacccccuucgucgacggcaaguccccccuccaggucuacugcgaggccgagggcgucaccgacaucgucgucgccgagcucaugaagaagcucgacauccucggcgacaacgccaaccucaccaacgaggagcaggucgucgucauccaggcccgcaccguccucacccucgccgagaaguggcuccagcagaucgaggagaccgaggccgcccuccagcgcaagauggucgaccucgaguccgagaaggagcucuucuccaagcagaagggcuaccucgacgaggagcucgacuaccgcaagcaggcccucgaccaggccaacaagcacauccucgagcucgaggccaugcucuacgacgcccuccagcaggaggccggcgccaaggucgccgagcuccucuccgaggaggagcgcgagaagcucaaggucgccgucgagcaguggaagcgccaggucauguccgagcuccgcgagcgcgacgcccagauccuccgcgagcgcauggagcuccuccagcucgcccagcagcgcaucaaggagcucgaggagcgcaucgaggcccagaagcgccagaucaaggagcucgaggagaaguuccucuuccucuuccucuucuucucccucgccuucauccucugguccuga

SEQ ID NO: 44839 - RNA, 789 nt, Artificial Sequence
  derived and/or modified sequence opt2 from JAM2__Homo_sapiens__NP_001257336
auggcccgccgcucccgccaccgccuccuccuccuccuccuccgcuaccucgucgucgcccucggcuaccacaaggccuacggcuucuccgcccccaaggaccagcaggucgucaccgccgucgaguaccagggcgacuucaagaaccgcgccgagaugaucgacuucaacauccgcaucaagaacgucacccgcuccgacgccggcaaguaccgcugcgaggucuccgcccccuccgagcagggccagaaccucgaggaggacaccgucacccucgagguccucgucgcccccgccguccccuccugcgagguccccuccuccgcccucuccggcaccgucgucgagcuccgcugccaggacaaggagggcaaccccgcccccgaguacaccugguucaaggacggcauccgccuccucgagaacccccgccucggcucccaguccaccaacuccuccuacaccaugaacaccaagaccggcacccuccaguucaacaccgucuccaagcucgacaccggcgaguacuccugcgaggcccgcaacuccgucggcuaccgccgcugccccggcaagcgcaugcaggucgacgaccucaacaucuccggcaucaucgccgccgucgucgucgucgcccucgucaucuccgucugcggccucggcgucugcuacgcccagcgcaagggcuacuucuccaaggagaccuccuuccagaaguccaacuccuccuccaaggccaccaccauguccgagaacgacuucaagcacaccaaguccuucaucaucuga

SEQ ID NO: 44840 - RNA, 780 nt, Artificial Sequence
  derived and/or modified sequence opt2 from JAM3__Homo_sapiens__NP_001192258
auggcccuccgccgccccccccgccuccgccucugcgcccgccuccccgacuucuuccuccuccuccucuuccgcggcugccucaucggcgccgucaaccucaaguccuccaaccgcacccccgucguccaggaguucgaguccgucgagcucuccugcaucaucaccgacucccagaccuccgacccccgcaucgaguggaagaagauccaggacgagcagaccaccuacgucuucuucgacaacaagauccaggucaagcccgucacccccgucugccgcguccccaaggccguccccgucggcaagauggccacccuccacugccaggaguccgagggccacccccgcccccacuacuccugguaccgcaacgacgucccccuccccaccgacucccgcgccaacccccgcuuccgcaacuccuccuuccaccucaacuccgagaccggcacccucgucuucaccgccguccacaaggacgacuccggccaguacuacugcaucgccuccaacgacgccggcuccgcccgcugcgaggagcaggagauggaggucuacgaccucaacaucggcggcaucaucggcggcguccucgucguccucgccguccucgcccucaucacccucggcaucugcugcgccuaccgccgcggcuacuucaucaacaacaagcaggacggcgaguccuacaagaaccccggcaagcccgacggcgucaacuacauccgcaccgacgaggagggcgacuuccgccacaaguccuccuucgucaucuga

SEQ ID NO: 44841 - RNA, 3225 nt, Artificial Sequence
  derived and/or modified sequence opt2 from JARID2__Homo_sapiens__NP_001253969
auggucuacuucggcuccucccaggacgaggaggaggucgaggaggaggacgacgagaccgaggacgucaagaccgccaccaacaacgccuccuccuccugccaguccaccccccgcaagggcaagacccacaagcacguccacaacggccacgucuucaacggcuccucccgcuccacccgcgagaaggagcccguccagaagcacaaguccaaggaggccacccccgccaaggagaagcacuccgaccaccgcgccgacucccgccgcgagcaggccuccgccaaccaccccgccgccgcccccuccaccggcuccuccgccaagggccucgccgccacccaccaccaccccccccuccaccgcuccgcccaggaccuccgcaagcaggucuccaaggucaacggcgucacccgcauguccucccucggcgccggcgucaccuccgccaagaagaugcgcgagguccgccccucccccuccaagaccgucaaguacaccgccaccgucaccaagggcgccgucaccuacaccaaggccaagcgcgagcucgucaaggacaccaagcccaaccaccacaagcccuccuccgccgucaaccacaccaucuccggcaagaccgaguccuccaacgccaagacccgcaagcagguccucucccucggcggcgccuccaaguccaccggccccgccgucaacggccucaaggucuccggccgccucaaccccaaguccugcaccaaggaggucggcggccgccagcuccgcgagggccuccagcuccgcgagggccuccgcaacuccaagcgccgccucgaggaggcccaccaggccgagaagccccaguccccccccaagaagaugaagggcgccgccggccccgccgagggccccggcaagaaggcccccgccgagcgcggccuccucaacggccacgucaagaaggagguccccgagcgcucccucgagcgcaaccgccccaagcgcgccaccgccggcaaguccacccccggccgccaggcccacggcaaggccgacuccgccuccugcgagaaccgcuccaccucccagcccgaguccguccacaagccccaggacuccggcaaggccgagaagggcggcggcaaggccggcugggccgccauggacgagauccccguccuccgccccuccgccaaggaguuccacgacccccucaucuacaucgaguccguccgcgcccaggucgagaaguucggcaugugccgcgucauccccccccccgacuggcgccccgagugcaagcucaacgacgagaugcgcuucgucacccagauccagcacauccacaagcucggccgccgcuggggccccaacguccagcgccucgccugcaucaagaagcaccucaagucccagggcaucaccauggacgagcucccccucaucggcggcugcgagcucgaccucgccugcuucuuccgccucaucaacgagaugggcggcaugcagcaggucaccgaccucaagaaguggaacaagcucgccgacaugcuccgcaucccccgcaccgcccaggaccgccucgccaagcuccaggaggccuacugccaguaccuccucuccuacgacucccucucccccgaggagcaccgccgccucgagaaggagguccucauggagaaggagauccucgagaagcgcaagggcccccucgagggccacaccgagaacgaccaccacaaguuccacccccucccccgcuucgagcccaagaacggccucauccacggcgucgccccccgcaacggcuuccgcuccaagcucaaggaggucggccaggcccagcucaagaccggccgccgccgccucuucgcccaggagaaggaggucgucaaggaggaggaggaggacaagggcguccucaacgacuuccacaagugcaucuacaagggccgcuccgucucccucaccaccuucuaccgcaccgcccgcaacaucauguccaugugcuucuccaaggagcccgcccccgccgagaucgagcaggaguacuggcgccucgucgaggagaaggacugccacgucgccguccacugcggcaaggucgacaccaacacccacggcuccggcuuccccgucggcaaguccgagcccuucucccgccacggcuggaaccucaccguccuccccaacaacaccggcuccauccuccgccaccucggcgccguccccggcgucaccauccccuggcucaacaucggcauggucuucuccaccuccugcuggucccgcgaccagaaccaccuccccuacaucgacuaccuccacaccggcgccgacugcaucugguacugcauccccgccgaggaggagaacaagcucgaggacgucguccacacccuccuccaggccaacggcacccccggccuccagaugcucgaguccaacgucaugaucucccccgagguccucugcaaggagggcaucaagguccaccgcaccguccagcaguccggccaguucgucgucugcuuccccggcuccuucgucuccaaggucugcugcggcuacuccgucuccgagaccguccacuucgccaccacccaguggaccuccaugggcuucgagaccgccaaggagaugaagcgccgccacaucgccaagcccuucuccauggagaagcuccucuaccagaucgcccaggccgaggccaagaaggagaacggccccacccucuccaccaucuccgcccuccucgacgagcuccgcgacaccgagcuccgccagcgccgccagcucuucgaggccggccuccacuccuccgcccgcuacggcucccacgacggcuccuccaccgucgccgacggcaagaagaagccccgcaaguggcuccagcucgagaccuccgagcgccgcugccagaucugccagcaccucugcuaccucuccauggucguccaggagaacgagaacgucgucuucugccucgagugcgcccuccgccacgucgagaagcagaaguccugccgcggccucaagcucauguaccgcuacgacgaggagcagaucaucucccucgucaaccagaucugcggcaaggucuccggcaagaacggcuccaucgagaacugccucuccaagcccacccccaagcgcggcccccgcaagcgcgccaccgucgacgucccccccucccgccucuccgccuccuccuccuccaaguccgccuccuccuccuccuga

SEQ ID NO: 44842 - RNA, 732 nt, Artificial Sequence
  derived and/or modified sequence opt2 from JAZF1__Homo_sapiens__NP_778231
augaccggcaucgccgccgccuccuucuucuccaacaccugccgcuucggcggcugcggccuccacuuccccacccucgccgaccucaucgagcacaucgaggacaaccacaucgacaccgacccccgcguccucgagaagcaggagcuccagcagcccaccuacgucgcccucuccuacaucaaccgcuucaugaccgacgccgcccgccgcgagcaggagucccucaagaagaagauccagcccaagcucucccucacccucuccuccuccgucucccgcggcaacgucuccacccccccccgccacuccuccggcucccucaccccccccgucaccccccccaucacccccuccuccuccuuccgcuccuccacccccaccggcuccgaguacgacgaggaggaggucgacuacgaggaguccgacuccgacgaguccuggaccaccgaguccgccaucuccuccgaggccauccucuccuccaugugcaugaacggcggcgaggagaagcccuucgccugccccguccccggcugcaagaagcgcuacaagaacgucaacggcaucaaguaccacgccaagaacggccaccgcacccagauccgcguccgcaagcccuucaagugccgcugcggcaaguccuacaagaccgcccagggccuccgccaccacaccaucaacuuccacccccccgucuccgccgagaucauccgcaagaugcagcaguga

SEQ ID NO: 44843 - RNA, 492 nt, Artificial Sequence
  derived and/or modified sequence opt2 from JDP2__Homo_sapiens__XP_005267389
augaugcccggccagauccccgaccccuccgucaccaccggcucccuccccggccucggcccccucaccggccuccccuccuccgcccucaccgucgaggagcucaaguacgccgacauccgcaaccucggcgccaugaucgccccccuccacuuccucgaggucaagcucggcaagcgcccccagcccgucaaguccgagcucgacgaggaggaggagcgccgcaagcgccgccgcgagaagaacaaggucgccgccgcccgcugccgcaacaagaagaaggagcgcaccgaguuccuccagcgcgaguccgagcgccucgagcucaugaacgccgagcucaagacccagaucgaggagcucaagcaggagcgccagcagcucauccucaugcucaaccgccaccgccccaccugcaucguccgcaccgacuccgucaagacccccgaguccgagggcaacccccuccucgagcagcucgagaagaaguga

SEQ ID NO: 44844 - RNA, 7077 nt, Artificial Sequence
  derived and/or modified sequence opt2 from JMJD1C__Homo_sapiens__NP_001269877
augcagggccccuacucccucaacggcuaccgcguccgcgucuaccgccaggacuccgccacccagugguucaccggcaucaucacccaccacgaccucuucacccgcaccaugaucgucaugaacgaccagguccucgagccccagaacgucgaccccuccaugguccagaugaccuuccucgacgacgucguccacucccuccucaagggcgagaacaucggcaucaccucccgccgccgcucccgcgccaaccagaacgucaacgccguccacucccacuacacccgcgcccaggccaacuccccccgccccgccaugaacucccaggccgccguccccaagcagaacacccaccagcagcagcagcagcgcuccauccgccccaacaagcgcaagggcuccgacuccuccauccccgacgaggagaagaugaaggaggagaaguacgacuacaucucccgcggcgagaaccccaagggcaagaacaagcaccucaugaacaagcgccgcaagcccgaggaggacgagaagaagcucaacaugaagcgccuccgcaccgacaacgucuccgacuucuccgaguccuccgacuccgagaacuccaacaagcgcaucaucgacaacuccuccgagcagaagcccgagaacgagcucaagaacaagaacaccuccaagaucaacggcgaggagggcaagccccacaacaacgagaaggccggcgaggagacccucaagaacucccagccccccugggaccagauccaggaggacaagaagcacgaggaggccgagaagcgcaaguccgucgacacccagcuccaggaggacaugaucauccacuccuccgagcaguccaccgucuccgaccacaacuccaacgaccuccucccccaggagugcaacauggacaagacccacaccauggagcuccuccccaaggagaaguucgucucccgcccccccacccccaagugcgucaucgacaucaccaacgacaccaaccucgagaaggucgcccaggagaacuccuccaccuucggccuccagacccuccagaagauggaccccaacgucuccgacuccaagcacuccaucgccaacgccaaguuccucgagaccgccaagaaggacuccgaccaguccugggucuccgacgucgucaaggucgaccucacccaguccuccgucaccaacgccuccuccggcaacgaccaccucaacauggagaaggagaaguacgucuccuacaucuccccccucuccgccgucuccgucauggaggacaagcuccacaagcgcucccccccccccgagaccaucaaguccaagcucaacaccuccgucgacacccacaagaucaaguccucccccucccccgaggucgucaagcccaagaucacccacucccccgacuccgucaaguccaaggccaccuacgucaacucccaggccaccggcgagcgccgccucgccaacaagaucgagcacgagcucucccgcugcuccuuccaccccauccccacccgcuccuccacccucgagaccaccaaguccccccucaucaucgacaagaacgagcacuucaccgucuaccgcgaccccgcccucaucggcuccgagaccggcgccaaccacaucucccccuuccucucccagcaccccuucccccuccacuccuccucccaccgcaccugccucaaccccggcacccaccaccccgcccucacccccgccccccaccuccucgccggcuccuccucccagaccccccuccccaccaucaacacccacccccucaccuccggcccccaccacgccguccaccacccccaccuccuccccaccguccuccccggcguccccaccgccucccuccucggcggccacccccgccucgaguccgcccacgccuccucccucucccaccucgcccucgcccaccagcagcagcagcagcuccuccagcaccaguccccccaccuccucggccaggcccaccccuccgccuccuacaaccagcucggccucuaccccaucaucuggcaguaccccaacggcacccacgccuacuccggccucggccuccccuccuccaaguggguccaccccgagaacgccgucaacgccgaggccucccuccgccgcaacucccccucccccuggcuccaccagcccacccccgucaccuccgccgacggcaucggccuccucucccacauccccguccgccccuccuccgccgagccccaccgcccccucaagaucaccgcccacuccucccccccccucaccaagacccucgucgaccaccacaaggaggagcucgagcgcaaggccuucauggagccccuccgcuccgucgccuccaccuccgccaagaacgaccucgaccucaaccgcucccagaccggcaaggacugccaccuccaccgccacuucgucgaccccguccucaaccagcuccagcgccccccccaggagaccggcgagcgccucaacaaguacaaggaggagcaccgccgcauccuccaggaguccaucgacgucgcccccuucaccaccaagaucaagggccucgagggcgagcgcgagaacuacucccgcgucgccuccuccuccuccucccccaagucccacaucaucaagcaggacauggacgucgagcgcuccgucuccgaccucuacaagaugaagcacuccgucccccagucccucccccaguccaacuacuucaccacccucuccaacuccgucgucaacgagcccccccgcuccuaccccuccaaggaggucuccaacaucuacggcgacaagcaguccaacgcccucgccgccgccgccgccaacccccagacccucaccuccuucaucaccucccucuccaagccccccccccucaucaagcaccagcccgaguccgagggccucgucggcaagauccccgagcaccucccccaccagaucgccucccacuccgucaccaccuuccgcaacgacugccgcucccccacccaccucaccgucuccuccaccaacacccuccgcuccaugcccgcccuccaccgcgcccccgucuuccacccccccauccaccacucccucgagcgcaaggagggcuccuacuccucccucuccccccccacccucacccccgucaugcccgucaacgccggcggcaagguccaggagucccagaagccccccacccucauccccgagcccaaggacucccaggccaacuucaaguccuccuccgagcagucccucaccgagauguggcgccccaacaacaaccucuccaaggagaagaccgaguggcacgucgagaaguccuccggcaagcuccaggccgccauggccuccgucaucguccgccccuccuccuccaccaagaccgacuccaugcccgccaugcagcucgccuccaaggaccgcgucuccgagcgcuccuccgccggcgcccacaagaccgacugccucaagcucgccgaggccggcgagaccggccgcaucauccuccccaacgucaacuccgacuccguccacaccaaguccgagaagaacuuccaggccgucucccagggcuccguccccuccuccgucauguccgccgucaacaccaugugcaacaccaagaccgacgucaucaccuccgccgccgacaccaccuccgucuccuccuggggcggcuccgaggucaucuccucccucuccaacaccauccucgccuccaccuccuccgagugcgucuccuccaaguccgucucccagcccgucgcccagaagcaggagugcaaggucuccaccaccgcccccgucacccucgccuccuccaagaccggcuccgucguccagcccuccuccggcuucuccggcaccaccgacuucauccaccucaagaagcacaaggccgcccucgccgccgcccaguacaaguccuccaacgccuccgagaccgagcccaacgccaucaagaaccagacccucuccgccucccucccccucgacuccaccgucaucugcuccaccaucaacaaggccaacuccgucggcaacggccaggccucccagaccucccagcccaacuaccacaccaagcucaagaaggccuggcucacccgccacuccgaggaggacaagaacaccaacaagauggagaacuccggcaacuccgucuccgagaucaucaagcccugcuccgucaaccucaucgccuccaccuccuccgacauccagaacuccgucgacuccaagaucaucgucgacaaguacgucaaggacgacaaggucaaccgccgcaaggccaagcgcaccuacgaguccggcuccgaguccggcgacuccgacgaguccgaguccaaguccgagcagcgcaccaagcgccagcccaagcccaccuacaagaagaagcagaacgaccuccagaagcgcaagggcgagaucgaggaggaccucaagcccaacggcguccucucccgcuccgccaaggagcgcuccaagcucaagcuccaguccaacuccaacaccggcaucccccgcuccguccucaaggacuggcgcaaggucaagaagcucaagcagaccggcgaguccuuccuccaggacgacuccugcugcgagaucggccccaaccuccagaagugccgcgagugccgccucauccgcuccaagaagggcgaggagcccgcccacucccccgucuucugccgcuucuacuacuuccgccgccucuccuucuccaagaacggcgucguccgcaucgacggcuucuccucccccgaccaguacgacgacgaggccaugucccucuggacccacgagaacuucgaggacgacgagcucgacaucgagaccuccaaguacauccucgacaucaucggcgacaaguucugccagcucgucaccuccgagaagaccgcccucuccugggucaagaaggacgccaagaucgccuggaagcgcgccguccgcggcguccgcgagaugugcgacgccugcgaggccacccucuucaacauccacugggucugccagaagugcggcuucgucgucugccucgacugcuacaaggccaaggagcgcaaguccucccgcgacaaggagcucuacgccuggaugaagugcgucaagggccagccccacgaccacaagcaccucaugcccacccagaucauccccggcuccguccucaccgaccuccucgacgccaugcacacccuccgcgagaaguacggcaucaagucccacugccacugcaccaacaagcagaaccuccaggucggcaacuuccccaccaugaacggcgucucccagguccuccagaacguccucaaccacuccaacaagaucucccucugcaugcccgagucccagcagcagaacaccccccccaaguccgagaagaacggcggcuccucccccgaguccgacgucggcaccgacaacaagcucaccccccccgagucccaguccccccuccacuggcucgccgaccucgccgagcagaaggcccgcgaggagaagaaggagaacaaggagcucacccucgagaaccagaucaaggaggagcgcgagcaggacaacuccgagucccccaacggccgcaccuccccccucgucucccagaacaacgagcagggcuccacccuccgcgaccuccucaccaccaccgccggcaagcuccgcgucggcuccaccgacgccggcaucgccuucgcccccgucuacuccaugggcgcccccuccuccaaguccggccgcaccaugcccaacauccucgacgacaucaucgccuccgucgucgagaacaagaucccccccuccaagaccuccaagaucaacgucaagcccgagcucaaggaggagcccgaggaguccaucaucuccgccgucgacgagaacaacaagcucuacuccgacaucccccacuccuggaucugcgagaagcacauccucuggcucaaggacuacaagaacuccuccaacuggaagcucuucaaggagugcuggaagcagggccagcccgccgucgucuccggcguccacaagaagaugaacaucucccucuggaaggccgaguccaucucccucgacuucggcgaccaccaggccgaccuccucaacugcaaggacuccaucaucuccaacgccaacgucaaggaguucugggacggcuucgaggaggucuccaagcgccagaagaacaaguccggcgagaccgucguccucaagcucaaggacuggcccuccggcgaggacuucaagaccaugaugcccgcccgcuacgaggaccuccucaagucccucccccuccccgaguacugcaaccccgagggcaaguucaaccucgccucccaccuccccggcuucuucguccgccccgaccucggcccccgccucugcuccgccuacggcgucgucgccgccaaggaccacgacaucggcaccaccaaccuccacaucgaggucuccgacgucgucaacauccucgucuacgucggcaucgccaagggcaacggcauccucuccaaggccggcauccucaagaaguucgaggaggaggaccucgacgacauccuccgcaagcgccucaaggacuccuccgagauccccggcgcccucuggcacaucuacgccggcaaggacgucgacaagauccgcgaguuccuccagaagaucuccaaggagcagggccucgagguccuccccgagcacgaccccauccgcgaccaguccugguacgucaacaagaagcuccgccagcgccuccucgaggaguacggcguccgcaccugcacccucauccaguuccucggcgacgccaucguccuccccgccggcgcccuccaccagguccagaacuuccacuccugcauccaggucaccgaggacuucgucucccccgagcaccucgucgaguccuuccaccucacccaggagcuccgccuccucaaggaggagaucaacuacgacgacaagcuccaggucaagaacauccucuaccacgccgucaaggagaugguccgcgcccucaagauccacgaggacgaggucgaggacauggaggagaacuga

SEQ ID NO: 44845 - RNA, 1245 nt, Artificial Sequence
  derived and/or modified sequence opt2 from JMJD6__Homo_sapiens__NP_001074930
augaaccacaaguccaagaagcgcauccgcgaggccaagcgcuccgcccgccccgagcucaaggacucccucgacuggacccgccacaacuacuacgaguccuucucccucucccccgccgccgucgccgacaacgucgagcgcgccgacgcccuccagcucuccgucgaggaguucgucgagcgcuacgagcgccccuacaagcccgucguccuccucaacgcccaggagggcugguccgcccaggagaaguggacccucgagcgccucaagcgcaaguaccgcaaccagaaguucaagugcggcgaggacaacgacggcuacuccgucaagaugaagaugaaguacuacaucgaguacauggaguccacccgcgacgacuccccccucuacaucuucgacuccuccuacggcgagcaccccaagcgccgcaagcuccucgaggacuacaagguccccaaguucuucaccgacgaccucuuccaguacgccggcgagaagcgccgcccccccuaccgcugguucgucaugggccccccccgcuccggcaccggcauccacaucgacccccucggcaccuccgccuggaacgcccucguccagggccacaagcgcuggugccucuuccccaccuccaccccccgcgagcucaucaaggucacccgcgacgagggcggcaaccagcaggacgaggccaucaccugguucaacgucaucuacccccgcacccagcuccccaccuggccccccgaguucaagccccucgagauccuccagaagcccggcgagaccgucuucguccccggcggcugguggcacgucguccucaaccucgacaccaccaucgccaucacccagaacuucgccuccuccaccaacuuccccgucgucuggcacaagaccguccgcggccgccccaagcucucccgcaagugguaccgcauccucaagcaggagcaccccgagcucgccguccucgccgacuccgucgaccuccaggaguccaccggcaucgccuccgacuccuccuccgacuccuccuccuccuccuccuccuccuccuccgacuccgacuccgagugcgaguccggcuccgagggcgacggcaccguccaccgccgcaagaagcgccgcaccugcuccauggucggcaacggcgacaccaccucccaggacgacugcgucuccaaggagcgcuccuccucccgcauccgcgacaccugcggcggccgcgcccaccccuga

SEQ ID NO: 44846 - RNA, 2967 nt, Artificial Sequence
  derived and/or modified sequence opt2 from JMY__Homo_sapiens__NP_689618
auguccuucgcccucgaggagacccucgaguccgacugggucgccguccgcccccacgucuucgacgagcgcgagaagcacaaguucgucuucaucgucgccuggaacgagaucgagggcaaguucgccaucaccugccacaaccgcaccgcccagcgccagcgcuccggcucccgcgagcaggccggcgcccgcggcggcgccgaggccggcggcgccgccuccgacggcucccgcggccccggcucccccgccggccgcggccgccccgaggccaccgccuccgccacccucguccgcucccccggcccccgccgcuccuccgccugggccgagggcggcuccccccgcuccacccgcucccuccucggcgacccccgccuccgcucccccggcuccaagggcgccgagucccgccuccgcucccccguccgcgccaagcccauccccggccagaagaccuccgaggccgacgacgccgccggcgccgccgccgccgccgcccgccccgccccccgcgaggcccaggucuccuccguccgcaucgucuccgccuccggcaccgucuccgaggagaucgagguccucgagauggucaaggaggacgaggccccccucgcccucuccgacgccgagcagcccccccccgccaccgagcucgagucccccgccgaggagugcuccugggccggccucuucuccuuccaggaccuccgcgccguccaccagcagcucugcuccgucaacucccagcucgagcccugccuccccgucuuccccgaggagcccuccggcauguggaccguccucuucggcggcgcccccgagaugaccgagcaggagaucgacacccucugcuaccagcuccaggucuaccucggccacggccucgacaccugcggcuggaagauccucucccagguccucuucaccgagaccgacgaccccgaggaguacuacgagucccucuccgagcuccgccagaagggcuacgaggagguccuccagcgcgcccgcaagcgcauccaggagcuccucgacaagcacaagaacaccgaguccauggucgagcuccucgaccucuaccagauggaggacgaggccuacuccucccucgccgaggccaccaccgagcucuaccaguaccuccuccagcccuuccgcgacaugcgcgagcucgccaugcuccgccgccagcagaucaagaucuccauggagaacgacuaccucggcccccgccgcaucgagucccuccagaaggaggacgccgacuggcagcgcaaggcccacauggccguccucuccauccaggaccucaccgucaaguacuucgagaucaccgccaaggcccagaaggccgucuacgaccgcaugcgcgccgaccagaagaaguucggcaaggccuccugggccgccgccgccgagcgcauggagaagcuccaguacgccgucuccaaggagacccuccagaugaugcgcgccaaggagaucugccucgagcagcgcaagcacgcccucaaggaggagaugcagucccuccgcggcggcaccgaggccaucgcccgccucgaccagcucgaggccgacuacuacgaccuccagcuccagcucuacgagguccaguucgagauccucaagugcgaggagcuccuccucaccgcccagcucgaguccaucaagcgccucaucuccgagaagcgcgacgaggucgucuacuacgacaccuacgaguccauggaggccaugcucgagaaggaggagauggccgccuccgccuaccuccagcgcgaggagcuccagaagcuccagcagaaggcccgccagcucgaggcccgccgcggccgcgucuccgccaagaaguccuaccuccgcaacaagaaggagaucugcaucgccaagcacaacgagaagauccagcagcgcacccgcaucgaggacgaguaccgcacccaccacaccguccagcucaagcgcgagaagcuccacgacgaggaggagcgcaaguccgccugggucucccaggagcgccagcgcacccucgaccgccuccgcaccuucaagcagcgcuaccccggccaggucauccucaaguccacccgccuccgccucgcccacgcccgccgcaagggcgccgccucccccguccuccaggaggaccacugcgacucccuccccuccguccuccaggucgaggagaagaccgaggaggucggcgagggccgcgucaagcgcggccccucccagaccaccgagccccagucccucguccagcucgaggacaccucccucacccagcucgaggccaccucccucccccucuccggcgucaccuccgagcucccccccaccaucucccucccccuccucaacaacaaccucgagcccugcuccgucaccaucaacccccuccccuccccccucccccccaccccccccccccccccccccccccccccccccccccccccccccccccuccccgucgccaaggacuccggccccgagacccucgagaaggaccucccccgcaaggagggcaacgagaagcgcauccccaaguccgccuccgcccccuccgcccaccucuucgacuccucccagcucgucuccgcccgcaagaagcuccgcaagaccgccgagggccuccagcgccgccgcgucuccucccccauggacgagguccucgccucccucaagcgcggcuccuuccaccucaagaaggucgagcagcgcacccucccccccuuccccgacgaggacgacuccaacaacauccucgcccagauccgcaagggcgucaagcucaagaagguccagaaggacguccuccgcgaguccuucacccuccuccccgacaccgacccccucacccgcuccauccacgaggcccuccgccgcaucaaggaggccucccccgaguccgaggacgaggaggaggcccuccccugcaccgacugggagaacuga

SEQ ID NO: 44847 - RNA, 390 nt, Artificial Sequence
  derived and/or modified sequence opt2 from JPH2__Homo_sapiens__NP_787109
auguccggcggccgcuucgacuucgacgacggcggcgccuacugcggcggcugggagggcggcaaggcccacggccacggccucugcaccggccccaagggccagggcgaguacuccggcuccuggaacuucggcuucgaggucgccggcgucuacaccuggcccuccggcaacaccuucgagggcuacuggucccagggcaagcgccacggccucggcaucgagaccaagggccgcuggcucuacaagggcgaguggacccacggcuucaagggccgcuacggcauccgccaguccuccuccuccggcgccaaguacgagggcaccuggaacaacggccuccaggacggcuacggcaccgagaccuacgccgacggcggcaugugcuga

SEQ ID NO: 44848 - RNA, 561 nt, Artificial Sequence
  derived and/or modified sequence opt2 from JPH3__Homo_sapiens__NP_001258533
auguccuccggcggccgcuucaacuucgacgacggcggcuccuacugcggcggcugggaggacggcaaggcccacggccacggcgucugcaccggccccaagggccagggcgaguacaccggcuccuggucccacggcuucgagguccucggcgucuacaccuggcccuccggcaacaccuaccagggcaccugggcccagggcaagcgccacggcaucggccucgaguccaagggcaagugggucuacaagggcgaguggacccacggcuucaagggccgcuacggcguccgcgagugcgccggcaacggcgccaaguacgagggcaccugguccaacggccuccaggacggcuacggcaccgagaccuacuccgacggcgacgccaccgccuucggcgccgagcccggccccgaggcccgcgagcuccccgccgccgccgccgccgccgccgccgccgccgccgccgccguccgcugguuccucugccgcgagcccuggcccgcccuccagcuccccgccugccucgacucccccaucuccaccccccagugcaccuga

SEQ ID NO: 44849 - RNA, 1887 nt, Artificial Sequence
  derived and/or modified sequence opt2 from JPH4__Homo_sapiens__NP_115828
augucccccggcggcaaguucgacuucgacgacggcggcugcuacgucggcggcugggaggccggccgcgcccacggcuacggcgucugcaccggccccggcgcccagggcgaguacuccggcugcugggcccacggcuucgagucccucggcgucuucaccggccccggcggccacuccuaccagggccacuggcagcagggcaagcgcgagggccucggcgucgagcgcaagucccgcuggaccuaccgcggcgaguggcucggcggccucaagggccgcuccggcgucugggaguccgucuccggccuccgcuacgccggccucuggaaggacggcuuccaggacggcuacggcaccgagaccuacuccgacggcggcaccuaccagggccaguggcaggccggcaagcgccacggcuacggcguccgccaguccguccccuaccaccaggccgcccuccuccgcuccccccgccgcaccucccucgacuccggccacuccgacccccccacccccccccccccccucccccuccccggcgacgagggcggcucccccgccuccggcucccgcggcggcuucguccucgccggccccggcgacgccgacggcgccuccucccgcaagcgcacccccgccgccggcggcuucuuccgccgcucccuccuccucuccggccuccgcgccggcggccgccgcuccucccucggcuccaagcgcggcucccuccgcuccgaggucuccuccgaggucggcuccaccggcccccccggcuccgaggccuccggcccccccgccgccgccccccccgcccucaucgagggcuccgccaccgaggucuacgccggcgaguggcgcgccgaccgccgcuccggcuucggcgucucccagcgcuccaacggccuccgcuacgagggcgaguggcucggcaaccgccgccacggcuacggccgcaccacccgccccgacggcucccgcgaggagggcaaguacaagcgcaaccgccucguccacggcggccgcguccgcucccuccucccccucgcccuccgccgcggcaaggucaaggagaaggucgaccgcgccgucgagggcgcccgccgcgccgucuccgccgcccgccagcgccaggagaucgccgccgcccgcgccgccgacgcccuccucaaggccgucgccgccuccuccgucgccgagaaggccgucgaggccgcccgcauggccaagcucaucgcccaggaccuccagcccaugcucgaggcccccggccgccgcccccgccaggacuccgagggcuccgacaccgagccccucgacgaggacucccccggcgucuacgagaacggccucacccccuccgagggcucccccgagcuccccuccucccccgccuccucccgccagcccuggcgcccccccgccugccgcuccccccucccccccggcggcgaccagggccccuucuccucccccaaggccuggcccgaggaguggggcggcgccggcgcccaggccgaggagcucgccggcuacgaggccgaggacgaggccggcaugcagggccccggcccccgcgacggcuccccccuccucggcggcugcuccgacuccuccggcucccuccgcgaggaggagggcgaggacgaggagccccuccccccccuccgcgcccccgccggcaccgagcccgagcccaucgccaugcucguccuccgcggcuccuccucccgcggccccgacgccggcugccucaccgaggagcucggcgagcccgccgccaccgagcgccccgcccagcccggcgccgccaacccccucgucgucggcgccgucgcccuccucgaccucucccucgccuuccucuucucccagcuccucaccuga

SEQ ID NO: 44850 - RNA, 1671 nt, Artificial Sequence
  derived and/or modified sequence opt2 from JRK__Homo_sapiens__NP_001070995
auggccuccaagcccgccgccggcaagucccgcggcgagaagcgcaagcgcgucguccucacccucaaggagaagaucgacaucugcacccgccucgagaagggcgagucccgcaaggcccucaugcaggaguacaacgucggcauguccacccucuacgacauccgcgcccacaaggcccagcuccuccgcuucuucgccuccuccgacuccaacaaggcccucgagcagcgccgcacccuccacacccccaagcucgagcaccucgaccgcguccucuacgagugguuccucggcaagcgcuccgagggcguccccgucuccggccccaugcucaucgagaaggccaaggacuucuacgagcagaugcagcucaccgagcccugcgucuucuccggcggcuggcucuggcgcuucaaggcccgccacggcaucaagaagcucgacgccuccuccgagaagcaguccgccgaccaccaggccgccgagcaguucugcgccuucuuccgcucccucgccgccgagcacggccucuccgccgagcaggucuacaacgccgacgagaccggccucuucuggcgcugccuccccaaccccacccccgagggcggcgccguccccggccccaagcagggcaaggaccgccucaccguccucaugugcgccaacgccaccggcucccaccgccucaagccccucgccaucggcaagugcuccggcccccgcgccuucaagggcauccagcaccuccccgucgccuacaaggcccagggcaacgccugggucgacaaggagaucuucuccgacugguuccaccacaucuucguccccuccguccgcgagcacuuccgcaccaucggccuccccgaggacuccaaggccguccuccuccucgacuccucccgcgcccacccccaggaggccgagcucgucuccuccaacgucuucaccaucuuccuccccgccuccgucgccucccucguccagcccauggagcagggcauccgccgcgacuucaugcgcaacuucaucaacccccccgucccccuccagggcccccacgcccgcuacaacaugaacgacgccaucuucuccgucgccugcgccuggaacgccguccccucccacgucuuccgccgcgccuggcgcaagcucuggcccuccgucgccuucgccgagggcuccuccuccgaggaggagcucgaggccgagugcuuccccgucaagccccacaacaaguccuucgcccacauccucgagcucgucaaggagggcuccuccugccccggccagcuccgccagcgccaggccgccuccuggggcgucgccggccgcgaggccgagggcggccgcccccccgccgccaccucccccgccgaggucgucugguccuccgagaagacccccaaggccgaccaggacggccgcggcgaccccggcgagggcgaggaggucgccugggagcaggccgccgucgccuucgacgccguccuccgcuucgccgagcgccagcccugcuucuccgcccaggaggucggccagcuccgcgcccuccgcgccgucuuccgcucccagcagcaggagaccgucggccucgaggacgucgucgucaccucccccgaggagcucgccauccccaagugcugccucgaggccuccaccgagaccuga

SEQ ID NO: 44851 - RNA, 996 nt, Artificial Sequence
  derived and/or modified sequence opt2 from JSRP1__Homo_sapiens__NP_653217
auguccaugaccacccgcgccugggaggagcucgacggcggccucggcuccugccaggcccucgaggaccacuccgcccucgccgagacccaggaggaccgcgccuccgccaccccccgccucgccgacuccggcuccgucccccacgacucccaggucgccgagggccccuccgucgacacccgccccaagaagauggagaaggagcccgccgcccgcggcacccccggcaccggcaaggagcgccucaaggccggcgccuccccccgcuccguccccgcccgcaagaaggcccagaccgcccccccccuccagccccccccccccccccccgcccucuccgaggagcuccccuggggcgaccucucccucaacaagugccucguccucgccucccucgucgcccuccucggcuccgccuuccagcucugccgcgacgccguccccggcgaggccgcccuccaggcccgcguccccgagcccugggucccccccuccuccgccccccgcgagcccuccuccccccuccccaaguucgaggcccaggccccccccuccgccccccccgccccccgcgccgaggccgagguccgccccaagauccccggcucccgcgaggccgccgagaacgacgaggaggagcccggcgaggccaccggcgaggccguccgcgaggaccgcgucacccucgccgaccgcggccccaaggagcgcccccgccgcgagggcaagccccgcaaggagaagccccgcaaggaggagcgccccaagaaggagcgcccccgcaaggaggagcgcccccgcgccgcccgcgagccccgcgaggcccucccccagcgcugggagucccgcgagggcggccaccgccccugggcccgcgacucccgcgacgccgagccccgcaagaagcaggccugggucuccccccgccgccccgacgaggagcagcgccccggcucccgccagaagcuccgcgccggcaagggccgcgacuga

SEQ ID NO: 44852 - RNA, 441 nt, Artificial Sequence
  derived and/or modified sequence opt2 from JTB__Homo_sapiens__NP_006685
augcucgccggcgccggccgccccggccucccccagggccgccaccucugcuggcuccucugcgccuucacccucaagcucugccaggccgaggcccccguccaggaggagaagcucuccgccuccaccuccaaccuccccugcuggcucgucgaggaguucgucgucgccgaggagugcucccccugcuccaacuuccgcgccaagaccacccccgagugcggccccaccggcuacgucgagaagaucaccugcuccuccuccaagcgcaacgaguucaaguccugccgcuccgcccucauggagcagcgccucuucuggaaguucgagggcgccgucgucugcgucgcccucaucuucgccugccucgucaucauccgccagcgccagcucgaccgcaaggcccucgagaagguccgcaagcagaucgaguccaucuga

SEQ ID NO: 44853 - RNA, 1044 nt, Artificial Sequence
  derived and/or modified sequence opt2 from JUNB__Homo_sapiens__NP_002220
augugcaccaagauggagcagcccuucuaccacgacgacuccuacaccgccaccggcuacggccgcgcccccggcggccucucccuccacgacuacaagcuccucaagcccucccucgccgucaaccucgccgaccccuaccgcucccucaaggcccccggcgcccgcggccccggccccgagggcggcggcggcggcuccuacuucuccggccagggcuccgacaccggcgccucccucaagcucgccuccuccgagcucgagcgccucaucguccccaacuccaacggcgucaucaccaccacccccaccccccccggccaguacuucuacccccgcggcggcggcuccggcggcggcgccggcggcgccggcggcggcgucaccgaggagcaggagggcuucgccgacggcuucgucaaggcccucgacgaccuccacaagaugaaccacgucaccccccccaacgucucccucggcgccaccggcggcccccccgccggccccggcggcgucuacgccggccccgagcccccccccgucuacaccaaccucuccuccuacucccccgccuccgccuccuccggcggcgccggcgccgccgucggcaccggcuccuccuaccccaccaccaccaucuccuaccucccccacgccccccccuucgccggcggccaccccgcccagcucggccucggccgcggcgccuccaccuucaaggaggagccccagaccguccccgaggcccgcucccgcgacgccaccccccccgucucccccaucaacauggaggaccaggagcgcaucaaggucgagcgcaagcgccuccgcaaccgccucgccgccaccaagugccgcaagcgcaagcucgagcgcaucgcccgccucgaggacaaggucaagacccucaaggccgagaacgccggccucuccuccaccgccggccuccuccgcgagcaggucgcccagcucaagcagaaggucaugacccacgucuccaacggcugccagcuccuccucggcgucaagggccacgccuucuga

SEQ ID NO: 44854 - RNA, 1044 nt, Artificial Sequence
  derived and/or modified sequence opt2 from JUND__Homo_sapiens__NP_005345
auggagacccccuucuacggcgacgaggcccucuccggccucggcggcggcgccuccggcuccggcggcuccuucgccucccccggccgccucuuccccggcgccccccccaccgccgccgccggcuccaugaugaagaaggacgcccucacccucucccucuccgagcaggucgccgccgcccucaagcccgccgccgcccccccccccaccccccuccgcgccgacggcgcccccuccgccgccccccccgacggccuccucgccucccccgaccucggccuccucaagcucgccucccccgagcucgagcgccucaucauccaguccaacggccucgucaccaccacccccaccuccucccaguuccucuaccccaaggucgccgccuccgaggagcaggaguucgccgagggcuucgucaaggcccucgaggaccuccacaagcagaaccagcucggcgccggcgccgccgccgccgccgccgccgccgccgccggcggccccuccggcaccgccaccggcuccgccccccccggcgagcucgcccccgccgccgccgcccccgaggcccccgucuacgccaaccucuccuccuacgccggcggcgccggcggcgccggcggcgccgccaccgucgccuucgccgccgagcccguccccuucccccccccccccccccccggcgcccucggccccccccgccucgccgcccucaaggacgagccccagaccguccccgacguccccuccuucggcgagucccccccccucucccccaucgacauggacacccaggagcgcaucaaggccgagcgcaagcgccuccgcaaccgcaucgccgccuccaagugccgcaagcgcaagcucgagcgcaucucccgccucgaggagaaggucaagacccucaagucccagaacaccgagcucgccuccaccgccucccuccuccgcgagcaggucgcccagcucaagcagaagguccucucccacgucaacuccggcugccagcuccucccccagcaccagguccccgccuacuga

SEQ ID NO: 44855 - RNA, 2238 nt, Artificial Sequence
  derived and/or modified sequence opt2 from JUP__Homo_sapiens__XP_006721941
auggaggucaugaaccucauggagcagcccaucaaggucaccgaguggcagcagaccuacaccuacgacuccggcauccacuccggcgccaacaccugcguccccuccgucuccuccaagggcaucauggaggaggacgaggccugcggccgccaguacacccucaagaagaccaccaccuacacccagggcgucccccccucccagggcgaccucgaguaccagauguccaccaccgcccgcgccaagcgcguccgcgaggccaugugccccggcgucuccggcgaggacuccucccuccuccucgccacccaggucgagggccaggccaccaaccuccagcgccucgccgagcccucccagcuccucaaguccgccaucguccaccucaucaacuaccaggacgacgccgagcucgccacccgcgcccuccccgagcucaccaagcuccucaacgacgaggaccccgucgucgucaccaaggccgccaugaucgucaaccagcucuccaagaaggaggccucccgccgcgcccucaugggcuccccccagcucgucgccgccgucguccgcaccaugcagaacaccuccgaccucgacaccgcccgcugcaccaccuccauccuccacaaccucucccaccaccgcgagggccuccucgccaucuucaaguccggcggcauccccgcccucguccgcaugcucuccucccccgucgaguccguccucuucuacgccaucaccacccuccacaaccuccuccucuaccaggagggcgccaagauggccguccgccucgccgacggccuccagaagauggucccccuccucaacaagaacaaccccaaguuccucgccaucaccaccgacugccuccagcuccucgccuacggcaaccaggaguccaagcucaucauccucgccaacggcggcccccaggcccucguccagaucaugcgcaacuacuccuacgagaagcuccucuggaccaccucccgcguccucaagguccucuccgucugccccuccaacaagcccgccaucgucgaggccggcggcaugcaggcccucggcaagcaccucaccuccaacuccccccgccucguccagaacugccucuggacccuccgcaaccucuccgacgucgccaccaagcaggagggccucgaguccguccucaagauccucgucaaccagcucuccgucgacgacgucaacguccucaccugcgccaccggcacccucuccaaccucaccugcaacaacuccaagaacaagacccucgucacccagaacuccggcgucgaggcccucauccacgccauccuccgcgccggcgacaaggacgacaucaccgagcccgccgucugcgcccuccgccaccucaccucccgccaccccgaggccgagauggcccagaacuccguccgccucaacuacggcauccccgccaucgucaagcuccucaaccagcccaaccaguggccccucgucaaggccaccaucggccucauccgcaaccucgcccucugccccgccaaccacgccccccuccaggaggccgccgucaucccccgccucguccagcuccucgucaaggcccaccaggacgcccagcgccacgucgccgccggcacccagcagcccuacaccgacggcguccgcauggaggagaucgucgagggcugcaccggcgcccuccacauccucgcccgcgaccccaugaaccgcauggagaucuuccgccucaacaccaucccccucuucguccagcuccucuacuccuccgucgagaacauccagcgcgucgccgccggcguccucugcgagcucgcccaggacaaggaggccgccgacgccaucgacgccgagggcgccuccgccccccucauggagcuccuccacucccgcaacgagggcaccgccaccuacgccgccgccguccucuuccgcaucuccgaggacaagaaccccgacuaccgcaagcgcgucuccgucgagcucaccaacucccucuucaagcacgaccccgccgccugggaggccgcccaguccaugauccccaucaacgagcccuacggcgacgacauggacgccaccuaccgccccauguacuccuccgacgucccccucgacccccucgagaugcacauggacauggacggcgacuaccccaucgacaccuacuccgacggccuccgcccccccuaccccaccgccgaccacaugcucgccuga

SEQ ID NO: 44856 - RNA, 2043 nt, Artificial Sequence
  derived and/or modified sequence opt2 from KAL1__Homo_sapiens__NP_000207
augguccccggcguccccggcgccguccucacccucugccucuggcucgccgccuccuccggcugccucgccgccggccccggcgccgccgccgcccgccgccucgacgagucccucuccgccggcuccguccagcgcgcccgcugcgccucccgcugccucucccuccagaucacccgcaucuccgccuucuuccagcacuuccagaacaacggcucccucgucuggugccagaaccacaagcagugcuccaagugccucgagcccugcaaggaguccggcgaccuccgcaagcaccagugccaguccuucugcgagccccucuuccccaagaaguccuacgagugccucaccuccugcgaguuccucaaguacauccuccucgucaagcagggcgacugccccgcccccgagaaggccuccggcuucgccgccgccugcgucgaguccugcgaggucgacaacgagugcuccggcgucaagaagugcugcuccaacggcugcggccacaccugccagguccccaagacccucuacaagggcgucccccucaagccccgcaaggagcuccgcuucaccgagcuccaguccggccagcucgaggucaagugguccuccaaguucaacaucuccaucgagcccgucaucuacgucguccagcgccgcuggaacuacggcauccaccccuccgaggacgacgccacccacuggcagaccgucgcccagaccaccgacgagcgcguccagcucaccgacauccgccccucccgcugguaccaguuccgcgucgccgccgucaacguccacggcacccgcggcuucaccgcccccuccaagcacuuccgcuccuccaaggaccccuccgccccccccgcccccgccaaccuccgccucgccaacuccaccgucaacuccgacggcuccgucaccgucaccaucgucugggaccuccccgaggagcccgacauccccguccaccacuacaaggucuucugguccuggauggucuccuccaagucccucguccccaccaagaagaagcgccgcaagaccaccgacggcuuccagaacuccgucauccucgagaagcuccagcccgacugcgacuacgucgucgagcuccaggccaucaccuacuggggccagacccgccucaaguccgccaaggucucccuccacuucaccuccacccacgccaccaacaacaaggagcagcucgucaagacccgcaagggcggcauccagacccagcuccccuuccagcgccgccgccccacccgcccccucgaggucggcgcccccuucuaccaggacggccagcuccaggucaaggucuacuggaagaagaccgaggaccccaccgucaaccgcuaccacguccgcugguuccccgaggccugcgcccacaaccgcaccaccggcuccgaggccuccuccggcaugacccacgagaacuacaucauccuccaggaccucuccuucuccugcaaguacaaggucaccguccagcccauccgccccaagucccacuccaaggccgaggccgucuucuucaccaccccccccugcuccgcccucaagggcaagucccacaagcccgucggcugccucggcgaggccggccacguccucuccaagguccucgccaagcccgagaaccucuccgccuccuucaucguccaggacgucaacaucaccggccacuucuccuggaagauggccaaggccaaccucuaccagcccaugaccggcuuccaggucaccugggccgaggucaccaccgagucccgccagaacucccuccccaacuccaucaucucccagucccagauccuccccuccgaccacuacguccucaccguccccaaccuccgccccuccacccucuaccgccucgagguccagguccucacccccggcggcgagggccccgccaccaucaagaccuuccgcacccccgagcucccccccuccuccgcccaccgcucccaccucaagcaccgccacccccaccacuacaagcccucccccgagcgcuacuga

SEQ ID NO: 44857 - RNA, 8961 nt, Artificial Sequence
  derived and/or modified sequence opt2 from KALRN__Homo_sapiens__NP_001019831
augaccgaccgcuucugggaccagugguaccucugguaccuccgccuccuccgccuccucgaccgcggcuccuuccgcaacgacggccucaaggccuccgacguccuccccauccucaaggagaaggucgccuucgucuccggcggccgcgacaagcgcggcggccccauccucaccuuccccgcccgcuccaaccacgaccgcauccgccaggaggaccuccgcaagcucgucaccuaccucgccuccguccccuccgaggacgucugcaagcgcggcuucaccgucaucaucgacaugcgcggcuccaagugggaccucaucaagccccuccucaagacccuccaggaggccuuccccgccgagauccacgucgcccucaucaucaagcccgacaacuucuggcagaagcagaagaccaacuucggcuccuccaaguucaucuucgagaccuccauggucuccgucgagggccucaccaagcucgucgaccccucccagcucaccgaggaguucgacggcucccucgacuacaaccacgaggaguggaucgagcuccgccucucccucgaggaguucuucaacuccgccguccaccuccucucccgccucgaggaccuccaggagaugcucgcccgcaaggaguuccccgucgacgucgagggcucccgccgccucaucgacgagcacacccagcucaagaagaagguccucaaggcccccgucgaggagcucgaccgcgagggccagcgccuccuccagugcauccgcugcuccgacggcuucuccggccgcaacugcauccccggcuccgccgacuuccagucccucguccccaagaucaccucccuccucgacaagcuccacuccacccgccagcaccuccaccagauguggcacguccgcaagcucaagcucgaccagugcuuccagcuccgccucuucgagcaggacgccgagaagauguucgacuggaucucccacaacaaggagcucuuccuccagucccacaccgagaucggcgucuccuaccaguacgcccucgaccuccagacccagcacaaccacuucgccaugaacuccaugaacgccuacgucaacaucaaccgcaucauguccgucgccucccgccucuccgaggccggccacuacgccucccagcagaucaagcagaucuccacccagcucgaccaggaguggaaguccuucgccgccgcccucgacgagcgcuccaccauccucgccauguccgccgucuuccaccagaaggccgagcaguuccucuccggcgucgacgccuggugcaagaugugcuccgagggcggccuccccuccgagaugcaggaccucgagcucgccauccaccaccaccagacccucuacgagcaggucacccaggccuacaccgaggucucccaggacggcaaggcccuccucgacguccuccagcgcccccucucccccggcaacuccgagucccucaccgccaccgccaacuacuccaaggccguccaccagguccucgacgucguccacgagguccuccaccaccagcgccgccucgaguccaucuggcagcaccgcaagguccgccuccaccagcgccuccagcucugcgucuuccagcaggacguccagcagguccucgacuggaucgagaaccacggcgaggccuuccucuccaagcacaccggcgucggcaagucccuccaccgcgcccgcgcccuccagaagcgccacgacgacuucgaggaggucgcccagaacaccuacaccaacgccgacaagcuccucgaggccgccgagcagcucgcccagaccggcgagugcgaccccgaggagaucuacaaggccgcccgccaccucgagguccgcauccaggacuucguccgccgcgucgagcagcgcaagcuccuccucgacauguccgucuccuuccacacccacaccaaggagcucuggaccuggauggaggaccuccagaaggagaugcucgaggacgucugcgccgacuccgucgacgccguccaggagcucaucaagcaguuccagcagcagcagaccgccacccucgacgccacccucaacgucaucaaggagggcgaggaccucauccagcagcuccgcuccgccccccccucccucggcgagcccuccgaggcccgcgacuccgccgucuccaacaacaagaccccccacuccuccuccaucucccacaucgaguccguccuccagcagcucgacgacgcccagguccagauggaggagcucuuccacgagcgcaagaucaagcucgacaucuuccuccagcuccgcaucuucgagcaguacaccaucgaggucaccgccgagcucgacgccuggaacgaggaccuccuccgccagaugaacgacuucaacaccgaggaccucacccucgccgagcagcgccuccagcgccacaccgagcgcaagcucgccaugaacaacaugaccuucgaggucauccagcagggccaggaccuccaccaguacaucaccgagguccaggccuccggcaucgagcucaucugcgagaaggacaucgaccucgccgcccagguccaggagcuccucgaguuccuccacgagaagcagcacgagcucgagcucaacgccgagcagacccacaagcgccucgagcagugccuccagcuccgccaccuccaggccgaggucaagcagguccucggcuggauccgcaacggcgaguccaugcucaacgccucccucgucaacgccuccucccucuccgaggccgagcagcuccagcgcgagcacgagcaguuccagcucgccaucgagucccucuuccacgccaccucccuccagaagacccaccaguccgcccuccagguccagcagaaggccgagguccuccuccaggccggccacuacgacgccgacgccauccgcgagugcgccgagaaggucgcccuccacuggcagcagcucaugcucaagauggaggaccgccucaagcucgucaacgccuccgucgccuucuacaagaccuccgagcaggucugcuccguccucgagucccucgagcaggaguaccgccgcgacgaggacuggugcggcggccgcgacaagcucggccccgccgccgagaucgaccacgucaucccccucaucuccaagcaccucgagcagaaggaggccuuccucaaggccugcacccucgcccgccgcaacgccgaggucuuccucaaguacauccaccgcaacaacgucuccaugcccuccgucgccucccacacccgcggccccgagcagcaggucaaggccauccucuccgagcuccuccagcgcgagaaccgcguccuccacuucuggacccucaagaagcgccgccucgaccagugccagcaguacgucgucuucgagcgcuccgccaagcaggcccucgacuggauccaggagaccggcgaguucuaccucuccacccacaccuccaccggcgagaccaccgaggagacccaggagcuccucaaggaguacggcgaguuccgcguccccgccaagcagaccaaggagaaggucaagcuccucauccagcucgccgacuccuucgucgagaagggccacauccacgccaccgagauccgcaagugggucaccaccgucgacaagcacuaccgcgacuucucccuccgcaugggcaaguaccgcuacucccucgagaaggcccucggcgucaacaccgaggacaacaaggaccucgagcucgacaucauccccgccucccucuccgaccgcgaggucaagcuccgcgacgccaaccacgaggucaacgaggagaagcgcaaguccgcccgcaagaaggaguucaucauggccgagcuccuccagaccgagaaggccuacguccgcgaccuccacgagugccucgagaccuaccucugggagaugaccuccggcgucgaggagaucccccccggcauccucaacaaggagcacaucaucuucggcaacauccaggagaucuacgacuuccacaacaacaucuuccucaaggagcucgagaaguacgagcagcuccccgaggacgucggccacugcuucgucaccugggccgacaaguuccagauguacgucaccuacugcaagaacaagcccgacuccaaccagcucauccucgagcacgccggcaccuucuucgacgagauccagcagcgccacggccucgccaacuccaucuccuccuaccucaucaagcccguccagcgcaucaccaaguaccagcuccuccucaaggagcuccucaccugcugcgaggagggcaagggcgagcucaaggacggccucgaggucaugcucuccguccccaagaaggccaacgacgccaugcacgucuccaugcucgagggcuucgacgagaaccucgacguccagggcgagcucauccuccaggacgccuuccaggucugggaccccaagucccucauccgcaagggccgcgagcgccaccucuuccucuucgagaucucccucgucuucuccaaggagaucaaggacuccuccggccacaccaaguacgucuacaagaacaagcuccucaccuccgagcucggcgucaccgagcacgucgagggcgaccccugcaaguucgcccucugguccggccgcacccccuccuccgacaacaagaccguccucaaggccuccaacaucgagaccaagcaggaguggaucaagaacauccgcgaggucauccaggagcgcaucauccaccucaagggcgcccucaaggagccccuccagcuccccaagacccccgccaagcagcgcaacaacuccaagcgcgacggcgucgaggacaucgacucccagggcgacggcuccucccagcccgacaccaucuccaucgccucccgcaccucccagaacaccgucgacuccgacaagcucuccggcggcugcgagcucaccgucguccuccaggacuucuccgccggccacuccuccgagcucaccauccaggucggccagaccgucgagcuccucgagcgccccuccgagcgccccggcuggugccucguccgcaccaccgagcgcucccccccccucgagggccucguccccuccuccgcccucugcaucucccacucccgcuccuccgucgagauggacugcuucuucccccucgucaaggacgccuacucccacuccuccuccgagaacggcggcaaguccgaguccgucgccaaccuccaggcccagcccucccucaacuccauccacuccucccccggccccaagcgcuccaccaacacccucaagaaguggcucaccucccccguccgccgccucaacuccggcaaggccgacggcaacaucaagaagcagaagaagguccgcgacggccgcaaguccuucgaccucggcucccccaagcccggcgacgagaccaccccccagggcgacuccgccgacgagaaguccaagaagggcuggggcgaggacgagcccgacgaggagucccacaccccccuccccccccccaugaagaucuucgacaacgaccccacccaggacgagauguccuccucccuccucgccgcccgccaggccuccaccgagguccccaccgccgccgaccucgucaacgccaucgagaagcucgucaagaacaagcucucccucgagggcuccuccuaccgcggcucccucaaggaccccgccggcugccucaacgagggcauggccccccccaccccccccaagaaccccgaggaggagcagaaggccaaggcccuccgcggccgcauguucguccucaacgagcucguccagaccgagaaggacuacgucaaggaccucggcaucgucgucgagggcuucaugaagcgcaucgaggagaagggcguccccgaggacaugcgcggcaaggacaagaucgucuucggcaacauccaccagaucuacgacuggcacaaggacuucuuccucgccgagcucgagaagugcauccaggagcaggaccgccucgcccagcucuucaucaagcacgagcgcaagcuccacaucuacgucugguacugccagaacaagccccgcuccgaguacaucgucgccgaguacgacgccuacuucgaggaggucaagcaggagaucaaccagcgccucacccucuccgacuuccucaucaagcccauccagcgcaucaccaaguaccagcuccuccucaaggacuuccuccgcuacuccgagaaggccggccucgagugcuccgacaucgagaaggccgucgagcucaugugccucguccccaagcgcugcaacgacaugaugaaccucggccgccuccagggcuucgagggcacccucaccgcccagggcaagcuccuccagcaggacaccuucuacgucaucgagcucgacgccggcaugcagucccgcaccaaggagcgccgcgucuuccucuucgagcagaucgucaucuucuccgagcuccuccgcaagggcucccucacccccggcuacauguucaagcgcuccaucaagaugaacuaccucguccucgaggagaacgucgacaacgaccccugcaaguucgcccucaugaaccgcgagaccuccgagcgcgucguccuccaggccgccaacgccgacauccagcaggccuggguccaggacaucaaccagguccucgagacccagcgcgacuuccucaacgcccuccagucccccaucgaguaccagcgcaaggagcgcuccaccgccgucaugcgcucccagcccgcccgccucccccaggccuccccccgccccuacuccuccguccccgccggcuccgagaagccccccaagggcuccuccuacaaccccccccuccccccccucaagaucuccaccuccaacggcucccccggcuucgaguaccaccagcccggcgacaaguucgaggccuccaagcagaacgaccucggcggcugcaacggcaccuccuccauggccgucaucaaggacuacuacgcccucaaggagaacgagaucugcgucucccagggcgaggucguccagguccucgccgucaaccagcagaacaugugccucgucuaccagcccgccuccgaccacucccccgccgccgagggcuggguccccggcuccauccucgccccccucaccaaggccaccgccgccgaguccuccgacggcuccaucaagaaguccugcuccuggcacacccuccgcaugcgcaagcgcgccgaggucgagaacaccggcaagaacgaggccaccggcccccgcaagcccaaggacauccucggcaacaaggucuccgucaaggagaccaacuccuccgaggaguccgagugcgacgaccucgaccccaacaccuccauggagauccucaaccccaacuucauccaggaggucgcccccgaguuccucgucccccucgucgacgucaccugccuccucggcgacaccgucauccuccagugcaaggucugcggccgccccaagcccaccaucaccuggaagggccccgaccagaacauccucgacaccgacaacuccuccgccaccuacaccgucuccuccugcgacuccggcgagaucacccucaagaucugcaaccucaugccccaggacuccggcaucuacaccugcaucgccaccaacgaccacggcaccaccuccaccuccgccaccgucaagguccagggcguccccgccgcccccaaccgccccaucgcccaggagcgcuccugcaccuccgucauccuccgcuggcucccccccuccuccaccggcaacugcaccaucuccggcuacaccgucgaguaccgcgaggagggcucccagaucuggcagcaguccgucgccuccacccucgacaccuaccucgucaucgaggaccucucccccggcugccccuaccaguuccgcgucuccgccuccaaccccuggggcaucucccuccccuccgagcccuccgaguucguccgccuccccgaguacgacgccgccgccgacggcgccaccaucuccuggaaggagaacuucgacuccgccuacaccgagcucaacgagaucggccgcggccgcuucuccaucgucaagaagugcauccacaaggccacccgcaaggacgucgccgucaaguucgucuccaagaagaugaagaagaaggagcaggccgcccacgaggccgcccuccuccagcaccuccagcacccccaguacaucacccuccacgacaccuacgagucccccaccuccuacauccucauccucgagcucauggacgacggccgccuccucgacuaccucaugaaccacgacgagcucauggaggagaaggucgccuucuacauccgcgacaucauggaggcccuccaguaccuccacaacugccgcgucgcccaccucgacaucaagcccgagaaccuccucaucgaccuccgcauccccgucccccgcgucaagcucaucgaccucgaggacgccguccagaucuccggccacuuccacauccaccaccuccucggcaaccccgaguucgccgcccccgaggucauccagggcauccccgucucccucggcaccgacaucugguccaucggcguccucaccuacgucaugcucuccggcgucucccccuuccucgacgaguccaaggaggagaccugcaucaacgucugccgcgucgacuucuccuucccccacgaguacuucugcggcgucuccaacgccgcccgcgacuucaucaacgucauccuccaggaggacuuccgccgccgccccaccgccgccaccugccuccagcaccccuggcuccagccccacaacggcuccuacuccaagaucccccucgacaccucccgccucgccugcuucaucgagcgccgcaagcaccagaacgacguccgccccauccccaacgucaaguccuacaucgucaaccgcgucaaccagggcaccuga

SEQ ID NO: 44858 - RNA, 4059 nt, Artificial Sequence
  derived and/or modified sequence opt2 from KANK1__Homo_sapiens__NP_001243806
auggcccacaccaccaaggucaacggcuccgccuccggcaaggccggcgacauccucuccggcgaccaggacaaggagcagaaggaccccuacuucgucgagacccccuacggcuaccagcucgaccucgacuuccucaaguacgucgacgacauccagaagggcaacaccaucaagcgccucaacauccagaagcgccgcaagcccuccguccccugccccgagccccgcaccaccuccggccagcagggcaucuggaccuccaccgagucccucuccuccuccaacuccgacgacaacaagcagugccccaacuuccucaucgcccgcucccaggucaccuccacccccaucuccaagcccccccccccccucgagaccucccuccccuuccucaccauccccgagaaccgccagcuccccccccccuccccccagcuccccaagcacaaccuccacgucaccaagacccucauggagacccgccgccgccucgagcaggagcgcgccaccaugcagaugacccccggcgaguuccgccgcccccgccucgccuccuucggcggcaugggcaccaccuccucccuccccuccuucgucggcuccggcaaccacaaccccgccaagcaccagcuccagaacggcuaccagggcaacggcgacuacggcuccuacgcccccgccgcccccaccaccuccuccaugggcuccuccauccgccacuccccccucuccuccggcaucuccacccccgucaccaacgucucccccaugcaccuccagcacauccgcgagcagauggccaucgcccucaagcgccucaaggagcucgaggagcagguccgcaccauccccguccuccaggucaagaucuccguccuccaggaggagaagcgccagcucgucucccagcucaagaaccagcgcgccgccucccagaucaacgucugcggcguccgcaagcgcuccuacuccgccggcaacgccucccagcucgagcagcucucccgcgcccgccgcuccggcggcgagcucuacaucgacuacgaggaggaggagauggagaccgucgagcaguccacccagcgcaucaaggaguuccgccagcucaccgccgacaugcaggcccucgagcagaagauccaggacuccuccugcgaggccuccuccgagcuccgcgagaacggcgagugccgcuccgucgccgucggcgccgaggagaacaugaacgacaucgucgucuaccaccgcggcucccgcuccugcaaggacgccgccgucggcacccucgucgagaugcgcaacugcggcgucuccgucaccgaggccaugcucggcgucaugaccgaggccgacaaggagaucgagcuccagcagcagaccaucgagucccucaaggagaagaucuaccgccucgagguccagcuccgcgagaccacccacgaccgcgagaugaccaagcucaagcaggagcuccaggccgccggcucccgcaagaaggucgacaaggccaccauggcccagccccucgucuucuccaaggucgucgaggccgucguccagacccgcgaccagauggucggcucccacauggaccucgucgacaccugcgucggcaccuccgucgagaccaacuccgucggcaucuccugccagcccgagugcaagaacaaggucgucggccccgagcuccccaugaacugguggaucgucaaggagcgcgucgagaugcacgaccgcugcgccggccgcuccgucgagaugugcgacaaguccgucuccgucgaggucuccgucugcgagaccggcuccaacaccgaggaguccgucaacgaccucacccuccucaagaccaaccucaaccucaaggagguccgcuccaucggcugcggcgacugcuccgucgacgucaccgucugcucccccaaggagugcgccucccgcggcgucaacaccgaggccgucucccaggucgaggccgccgucauggccgucccccgcaccgccgaccaggacaccuccaccgaccucgagcagguccaccaguucaccaacaccgagaccgccacccucaucgaguccugcaccaacaccugccucuccacccucgacaagcagaccuccacccagaccgucgagacccgcaccgucgccgucggcgagggccgcgucaaggacaucaacuccuccaccaagacccgcuccaucggcgucggcacccuccucuccggccacuccggcuucgaccgccccuccgccgucaagaccaaggaguccggcgucggccagaucaacaucaacgacaacuaccucgucggccucaagaugcgcaccaucgccugcggccccccccagcucaccgucggccucaccgccucccgccgcuccgucggcgucggcgacgaccccgucggcgagucccucgagaacccccagccccaggccccccucggcaugaugaccggccucgaccacuacaucgagcgcauccagaagcuccucgccgagcagcagacccuccucgccgagaacuacuccgagcucgccgaggccuucggcgagccccacucccagaugggcucccucaacucccagcucaucuccacccucuccuccaucaacuccgucaugaaguccgccuccaccgaggagcuccgcaaccccgacuuccagaagaccucccucggcaagaucaccggcaacuaccucggcuacaccugcaagugcggcggccuccaguccggcuccccccucuccucccagaccucccagcccgagcaggaggucggcaccuccgagggcaagcccaucuccucccucgacgccuuccccacccaggagggcacccucucccccgucaaccucaccgacgaccagaucgccgccggccucuacgccugcaccaacaacgaguccacccucaaguccaucaugaagaagaaggacggcaacaaggacuccaacggcgccaagaagaaccuccaguucgucggcaucaacggcggcuacgagaccaccuccuccgacgacuccuccuccgacgaguccuccuccuccgaguccgacgacgagugcgacgucaucgaguacccccucgaggaggaggaggaggaggaggacgaggacacccgcggcauggccgagggccaccacgccgucaacaucgagggccucaaguccgcccgcgucgaggacgagaugcagguccaggagugcgagcccgagaaggucgagauccgcgagcgcuacgagcucuccgagaagaugcucuccgccugcaaccuccucaagaacaccaucaacgaccccaaggcccucaccuccaaggacaugcgcuucugccucaacacccuccagcacgagugguuccgcgucuccucccagaaguccgccauccccgccauggucggcgacuacaucgccgccuucgaggccaucucccccgacguccuccgcuacgucaucaaccucgccgacggcaacggcaacaccgcccuccacuacuccgucucccacuccaacuucgagaucgucaagcuccuccucgacgccgacgucugcaacgucgaccaccagaacaaggccggcuacacccccaucaugcucgccgcccucgccgccgucgaggccgagaaggacaugcgcaucgucgaggagcucuucggcugcggcgacgucaacgccaaggccucccaggccggccagaccgcccucaugcucgccgucucccacggccgcaucgacauggucaagggccuccucgccugcggcgccgacgucaacauccaggacgacgagggcuccaccgcccucaugugcgccuccgagcacggccacgucgagaucgucaagcuccuccucgcccagcccggcugcaacggccaccucgaggacaacgacggcuccaccgcccucuccaucgcccucgaggccggccacaaggacaucgccguccuccucuacgcccacgucaacuucgccaaggcccagucccccggcaccccccgccucggccgcaagaccucccccggccccacccaccgcggcuccuucgacuga

SEQ ID NO: 44859 - RNA, 2556 nt, Artificial Sequence
  derived and/or modified sequence opt2 from KANK2__Homo_sapiens__NP_001129663
auggcccagguccuccacguccccgcccccuuccccggcacccccggccccgccuccccccccgccuuccccgccaaggaccccgacccccccuacuccgucgagacccccuacggcuaccgccucgaccucgacuuccucaaguacgucgacgacaucgagaagggccacacccuccgccgcgucgccguccagcgccgcccccgccucuccucccucccccgcggccccggcuccugguggaccuccaccgagucccucugcuccaacgccuccggcgacucccgccacuccgccuacuccuacugcggccgcggcuucuacccccaguacggcgcccucgagacccgcggcggcuucaacccccgcgucgagcgcacccuccucgacgcccgccgccgccucgaggaccaggccgccacccccaccggccucggcucccucacccccuccgccgccggcuccaccgccucccucgucggcgucggccuccccccccccaccccccgcuccuccggccucuccacccccgucccccccuccgccggccaccucgcccacguccgcgagcagauggccggcgcccuccgcaagcuccgccagcucgaggagcaggucaagcucauccccguccuccaggucaagcucuccguccuccaggaggagaagcgccagcucaccguccagcucaagucccagaaguuccucggccaccccaccgccggccgcggccgcuccgagcucugccucgaccuccccgacccccccgaggaccccgucgcccucgagacccgcuccgucggcaccuggguccgcgagcgcgaccucggcaugcccgacggcgaggccgcccucgccgccaaggucgccguccucgagacccagcucaagaaggcccuccaggagcuccaggccgcccaggcccgccaggccgacccccagccccaggccuggcccccccccgacucccccguccgcgucgacaccguccgcgucgucgagggcccccgcgaggucgaggucgucgccuccaccgccgccggcgcccccgcccagcgcgcccagucccucgagcccuacggcaccggccuccgcgcccucgccaugcccggccgccccgaguccccccccgucuuccgcucccaggaggucgucgagaccaugugccccguccccgccgccgccaccuccaacguccacauggucaagaagaucuccaucaccgagcgcuccugcgacggcgccgccggccuccccgagguccccgccgaguccuccuccuccccccccggcuccgaggucgccucccucacccagcccgagaaguccaccggccgcguccccacccaggagcccacccaccgcgagcccacccgccaggccgccucccaggaguccgaggaggccggcggcaccggcggcccccccgccggcguccgcuccaucaugaagcgcaaggaggaggucgccgaccccaccgcccaccgccgcucccuccaguucgucggcgucaacggcggcuacgaguccuccuccgaggacuccuccaccgccgagaacaucuccgacaacgacuccaccgagaacgaggcccccgagccccgcgagcgcguccccuccgucgccgaggccccccagcuccgccccgccggcaccgccgccgccaagaccucccgccaggagugccagcucucccgcgagucccagcacauccccaccgccgagggcgccuccggcuccaacaccgaggaggagauccgcauggagcucucccccgaccucaucuccgccugccucgcccucgagaaguaccucgacaaccccaacgcccucaccgagcgcgagcucaaggucgccuacaccaccguccuccaggaguggcuccgccucgccugccgcuccgacgcccaccccgagcucguccgccgccaccucgucaccuuccgcgccauguccgcccgccuccucgacuacgucgucaacaucgccgacuccaacggcaacaccgcccuccacuacuccgucucccacgccaacuuccccgucguccagcagcuccucgacuccggcgucugcaaggucgacaagcagaaccgcgccggcuacucccccaucaugcucaccgcccucgccacccucaagacccaggacgacaucgagaccguccuccagcucuuccgccucggcaacaucaacgccaaggccucccaggccggccagaccgcccucaugcucgccgucucccacggccgcgucgacgucgucaaggcccuccucgccugcgaggccgacgucaacguccaggacgacgacggcuccaccgcccucaugugcgccugcgagcacggccacaaggagaucgccggccuccuccucgccguccccuccugcgacaucucccucaccgaccgcgacggcuccaccgcccucauggucgcccucgacgccggccaguccgagaucgccuccaugcucuacucccgcaugaacaucaagugcuccuucgcccccauguccgacgacgagucccccaccuccuccuccgccgaggaguga

SEQ ID NO: 44860 - RNA, 1104 nt, Artificial Sequence
  derived and/or modified sequence opt2 from KANK4__Homo_sapiens__NP_001307198
auggagaagaccgacgagaucucccccuccaccucccucaaguccaucaugaagaagaaggacuacggcuuccgcgccggcggcaacggcaccaagaagaaccuccaguucgucggcgucaacggcggcuacgagaccaccuccuccgaggagaccuccggcgaggacuccacccccgaggaccucuccgacuccgaggccgagaagaagugcgacggccccgaccacaagcacgucaaggacgcccaccucaccugcgaggccggccagggcauccccgagggcaccugccacgccgcccaggaguccggccccggcgaggaggucccccacuccaaggccgagcgcuacaagcccuccgaggaguuccucaacgccugccgcgcccucucccagcaccuccccgagaccggcaccaccaccgaccagcuccuccgccagucccucaacaccaucucccaggagugguuccgcgucuccucccgcaaguccuccucccccgccgucgucgccuccuaccuccacgagguccagccccacuccccccacuuccucaagcuccucgucaaccucgccgaccacaacggcaacaccgcccuccacuacuccgucucccacuccaacuucuccaucgucaagcuccuccucgagaccggcgucugcaacgucgaccaccagaacaaggccggcuacaccgccgucaugaucaccccccucgccuccgccgagaccaacgaggacauggccgucgucuggaagcuccuccgcgagggcaacgucaacauccaggccacccagggcggccagaccgcccucaugcucggcgucucccacgaccgcgaggacaugguccaggcccuccucuccugccaggccgacgucaaccuccaggaccacgacggcuccuccgcccucauggucgccugccaccacggcaacgucgaccucguccgccuccuccucgcccaccccgccugcgacuccucccucaccgacaaggccggccgcaccgcccucuccaucgcccucaagucccccacccacauggagaucgccggccuccuccgcgcccacgccgagcagggccgcucccucggccucuga

SEQ ID NO: 44861 - RNA, 3318 nt, Artificial Sequence
  derived and/or modified sequence opt2 from KANSL1__Homo_sapiens__XP_005275701
auggccgccauggcccccgcccucaccgacgccgccgccgaggcccaccacauccgcuucaagcucgccccccccuccuccacccucucccccggcuccgccgagaacaacggcaacgccaacauccucaucgccgccaacggcaccaagcgcaaggccaucgccgccgaggaccccucccucgacuuccgcaacaaccccaccaaggaggaccucggcaagcuccagccccucgucgccuccuaccucugcuccgacgucaccuccguccccuccaaggagucccucaagcuccagggcgucuucuccaagcagaccguccucaagucccacccccuccucucccaguccuacgagcuccgcgccgagcuccucggccgccagcccguccucgaguucucccucgagaaccuccgcaccaugaacaccuccggccagaccgcccucccccaggcccccgucaacggccucgccaagaagcucaccaaguccuccacccacuccgaccacgacaacuccaccucccucaacggcggcaagcgcgcccucaccuccuccgcccuccacggcggcgagaugggcggcuccgaguccggcgaccucaagggcggcaugaccaacugcacccucccccaccgcucccucgacgucgagcacaccacccucuacuccaacaacuccaccgccaacaaguccuccgucaacuccauggagcagcccgcccuccagggcuccucccgccucucccccggcaccgacuccuccuccaaccucggcggcgucaagcucgagggcaagaaguccccccucuccuccauccucuucuccgcccucgacuccgacacccgcaucaccgcccuccuccgccgccaggccgacaucgagucccgcgcccgccgccuccagaagcgccuccaggucguccaggccaagcaggucgagcgccacauccagcaccagcucggcggcuuccucgagaagacccucuccaagcuccccaaccucgagucccuccgcccccgcucccagcucaugcucacccgcaaggccgaggccgcccuccgcaaggccgccuccgagaccaccaccuccgagggccucuccaacuuccucaaguccaacuccaucuccgaggagcucgagcgcuucaccgccuccggcaucgccaaccuccgcugcuccgagcaggccuucgacuccgacgucaccgacuccuccuccggcggcgaguccgacaucgaggaggaggagcucacccgcgccgaccccgagcagcgccacgucccccuccgccgccgcuccgaguggaagugggccgccgaccgcgccgccaucgucucccgcuggaacuggcuccaggcccacgucuccgaccucgaguaccgcauccgccagcagaccgacaucuacaagcagauccgcgccaacaagggccucaucguccucggcgagguccccccccccgagcacaccaccgaccucuuccucccccucuccuccgaggucaagaccgaccacggcaccgacaagcucaucgaguccgucucccagccccucgagaaccacggcgcccccaucaucggccacaucuccgagucccucuccaccaaguccugcggcgcccuccgccccgucaacggcgucaucaacacccuccagcccguccucgccgaccacauccccggcgacuccuccgacgccgaggagcagcuccacaagaagcagcgccucaaccucgucuccuccuccuccgacggcaccugcgucgccgcccgcacccgccccguccucuccugcaagaagcgccgccucguccgccccaacuccaucgucccccucuccaagaagguccaccgcaacuccaccauccgccccggcugcgacgucaaccccuccugcgcccucugcggcuccggcuccaucaacaccaugccccccgagauccacuacgaggccccccuccucgagcgccucucccagcucgacuccugcguccaccccguccucgccuuccccgacgacguccccaccucccuccacuuccaguccaugcucaagucccaguggcagaacaagcccuucgacaagaucaagccccccaagaagcucucccucaagcaccgcgcccccaugcccggcucccuccccgaccccgcccgcaaggaccgccacaagcucgucuccuccuuccucaccaccgccaagcucucccaccaccagacccgccccgaccgcacccaccgccagcaccucgacgacgucggcgccguccccauggucgagcgcgucaccgcccccaaggccgagcgccuccucaacccccccccccccguccacgaccccaaccacuccaagaugcgccuccgcgaccacuccuccgagcgcuccgagguccucaagcaccacaccgacauguccuccuccuccuaccucgccgccacccaccaccccccccacuccccccucguccgccagcucuccaccuccuccgacucccccgcccccgccuccuccuccucccaggucaccgccuccaccucccagcagcccguccgccgccgccgcggcgaguccuccuucgacaucaacaacaucgucauccccauguccgucgccgccaccacccgcgucgagaagcuccaguacaaggagauccucacccccuccuggcgcgaggucgaccuccagucccucaagggcucccccgacgaggagaacgaggagaucgaggaccucuccgacgccgccuucgccgcccuccacgccaagugcgaggagauggagcgcgcccgcuggcucuggaccaccuccguccccccccagcgccgcggcucccgcuccuaccgcuccuccgacggccgcaccaccccccagcucggcuccgccaaccccuccaccccccagcccgccucccccgacgucuccuccucccacucccucuccgaguacucccacggccaguccccccgcucccccaucucccccgagcuccacuccgccccccucacccccgucgcccgcgacaccccccgccaccucgccuccgaggacacccgcugcuccacccccgagcucggccucgacgagcaguccguccagcccugggagcgccgcaccuucccccucgcccacuccccccaggccgagugcgaggaccagcucgacgcccaggagcgcgccgcccgcugcacccgccgcaccuccggcuccaagaccggccgcgagaccgaggccgcccccaccuccccccccaccgucccccucaagucccgccaccucgucgccgccgccaccgcccagcgccccacccaccgcuga

SEQ ID NO: 44862 - RNA, 2637 nt, Artificial Sequence
  derived and/or modified sequence opt2 from KANSL3__Homo_sapiens__NP_001108488
auggcccaccgcggcggcgagcgcgacuuccagaccuccgcccgccgcaugggcaccucccuccucuuccagcucuccguccacgagcgcgagcucgaccucgucuuccucgaccacuccuacgccaagcccugguccgcccaccccgacgccuccuccgcccgccccacccgcaugcucuucgucaccccccgccgccagcacgaguccaccaucgaguccgacguccccaucgacgucgagaccgucaccuccacccccaugccccucuacgacaaccagaaggcccgcuccgucaugaacgagugcgagcgccacgucaucuucgcccgcaccgacgccgacgccccccccccccccgaggacugggaggagcacgucaaccgcaccggcuggaccauggcccagaacaagcucuucaacaagauccucaaggcccuccaguccgaccgccucgcccgccucgccaacgagggcgccugcaacgagcccguccuccgccgcgucgccgucgacaagugcgcccgccgcguccgccaggcccucgccuccgucuccugggacaccaagcucauccaguggcuccacaccacccucgucgagacccucucccuccccaugcucgccgccuaccucgacgcccuccagacccucaagggcaagauccccacccucaucgaccgcaugcucgucuccuccaacaccaagaccggcgccgccggcgccgaggcccucucccuccuccucaagcgccccugggaccccgccgucggcguccucucccacaacaagcccuccaagcuccccggcuccccccucauccucaucgccuccuccggccccuccuccuccgucuuccccaccucccgccgccaccgcuucuggcagucccagcucuccugccucggcaaggucauccccgucgccacccaccuccucaacaacggcuccggcgucggcguccuccagugccucgagcacaugaucggcgccguccgcuccaagguccucgagauccacucccacuucccccacaagcccaucauccucaucggcuggaacaccggcgcccucgucgccugccacgucuccgucauggaguacgucaccgccgucgucugccucggcuucccccuccucaccgucgacggcccccgcggcgacgucgacgacccccuccucgacaugaagacccccguccucuucgucaucggccagaacucccuccagugccaccccgaggccauggaggacuuccgcgagaagauccgcgccgagaacucccucgucgucgucggcggcgccgacgacaaccuccgcaucuccaaggccaagaagaaguccgagggccucacccaguccauggucgaccgcugcauccaggacgagaucgucgacuuccucaccggcguccucacccgcgccgagggccacaugggcuccgagccccgcgaccaggacgccgagaagaagaagaagccccgcgacgucgcccgccgcgaccucgccuucgagguccccgagcgcggcucccgccccgccucccccgccgccaagcuccccgccucccccuccggcuccgaggaccucuccuccgucuccuccucccccaccuccucccccaagaccaaggucaccaccgucaccuccgcccagaaguccucccagaucggcuccucccagcuccucaagcgccacguccagcgcaccgaggccguccucacccacaagcaggcccagguccccaucuccuccgagccccccgaggagggcgagaaggaggaccuccgcguccagcucaagcgccaccaccccuccuccccccuccccggcuccaagaccuccaagcgccccaagaucaaggucucccucaucucccagggcgacaccgccggcggccccugcgcccccucccagggcuccgcccccgaggccgccggcggcaagcccaucaccaugacccucggccaggccuccgccggcgccaaggagcucaccggccuccucaccaccgccaaguccuccuccuccgagggcggcgucuccgccucccccguccccuccgucgucuccuccuccaccgcccccuccgcccuccacacccuccagucccgccucgucgccaccucccccggcuccucccuccccggcgccaccuccgccuccucccuccuccagggccucuccuucucccuccaggacaucuccuccaagaccuccggccuccccgccaaccccucccccggccccgccccccaggccaccuccgucaagcuccccacccccaugcagucccucggcgccaucaccaccggcaccuccaccaucguccgcaccauccccgucgccaccacccucuccucccucggcgccacccccggcggcaagcccaccgccauccaccagcuccucaccaacggcggccucgccaagcucgccuccucccuccccggccucgcccagaucuccaaccaggccuccggccucaagguccccaccaccaucacccucacccuccgcggccagcccucccgcaucaccacccucucccccaugggcuccggcgccgcccccuccgaggaguccuccucccagguccuccccuccuccucccagcgccucccccccgcccccuga

SEQ ID NO: 44863 - RNA, 1878 nt, Artificial Sequence
  derived and/or modified sequence opt2 from KARS__Homo_sapiens__NP_001123561
augcucacccaggccgccguccgccucguccgcggcucccuccgcaagaccuccugggccgaguggggccaccgcgagcuccgccucggccagcucgcccccuucaccgccccccacaaggacaaguccuucuccgaccagcgcuccgagcucaagcgccgccucaaggccgagaagaaggucgccgagaaggaggccaagcagaaggagcucuccgagaagcagcucucccaggccaccgccgccgccaccaaccacaccaccgacaacggcgucggccccgaggaggaguccgucgaccccaaccaguacuacaagauccgcucccaggccauccaccagcucaaggucaacggcgaggaccccuacccccacaaguuccacgucgacaucucccucaccgacuucauccagaaguacucccaccuccagcccggcgaccaccucaccgacaucacccucaaggucgccggccgcauccacgccaagcgcgccuccggcggcaagcucaucuucuacgaccuccgcggcgagggcgucaagcuccaggucauggccaacucccgcaacuacaaguccgaggaggaguucauccacaucaacaacaagcuccgccgcggcgacaucaucggcguccagggcaaccccggcaagaccaagaagggcgagcucuccaucauccccuacgagaucacccuccucucccccugccuccacaugcucccccaccuccacuucggccucaaggacaaggagacccgcuaccgccagcgcuaccucgaccucauccucaacgacuucguccgccagaaguucaucauccgcuccaagaucaucaccuacauccgcuccuuccucgacgagcucggcuuccucgagaucgagacccccaugaugaacaucauccccggcggcgccgucgccaagcccuucaucaccuaccacaacgagcucgacaugaaccucuacaugcgcaucgcccccgagcucuaccacaagaugcucgucgucggcggcaucgaccgcgucuacgagaucggccgccaguuccgcaacgagggcaucgaccucacccacaaccccgaguucaccaccugcgaguucuacauggccuacgccgacuaccacgaccucauggagaucaccgagaagauggucuccggcauggucaagcacaucaccggcuccuacaaggucaccuaccaccccgacggccccgagggccaggccuacgacgucgacuucaccccccccuuccgccgcaucaacauggucgaggagcucgagaaggcccucggcaugaagcuccccgagaccaaccucuucgagaccgaggagacccgcaagauccucgacgacaucugcgucgccaaggccgucgagugcccccccccccgcaccaccgcccgccuccucgacaagcucgucggcgaguuccucgaggucaccugcaucaaccccaccuucaucugcgaccacccccagaucauguccccccucgccaaguggcaccgcuccaaggagggccucaccgagcgcuucgagcucuucgucaugaagaaggagaucugcaacgccuacaccgagcucaacgaccccaugcgccagcgccagcucuucgaggagcaggccaaggccaaggccgccggcgacgacgaggccauguucaucgacgagaacuucugcaccgcccucgaguacggccucccccccaccgccggcuggggcaugggcaucgaccgcgucgccauguuccucaccgacuccaacaacaucaaggagguccuccucuuccccgccaugaagcccgaggacaagaaggagaacgucgccaccaccgacacccucgaguccaccaccgucggcaccuccgucuga

SEQ ID NO: 44864 - RNA, 2514 nt, Artificial Sequence
  derived and/or modified sequence opt2 from KAT2A__Homo_sapiens__NP_066564
auggccgagcccucccaggcccccacccccgcccccgccgcccagccccgcccccuccagucccccgcccccgcccccacccccacccccgcccccucccccgccuccgcccccauccccacccccacccccgcccccgcccccgcccccgccgccgcccccgccggcuccaccggcaccggcggccccggcgucggcuccggcggcgccggcuccggcggcgaccccgcccgccccggccucucccagcagcagcgcgccucccagcgcaaggcccagguccgcggccucccccgcgccaagaagcucgagaagcucggcgucuucuccgccugcaaggccaacgagaccugcaagugcaacggcuggaagaaccccaagccccccaccgccccccgcauggaccuccagcagcccgccgccaaccucuccgagcucugccgcuccugcgagcacccccucgccgaccacgucucccaccucgagaacgucuccgaggacgagaucaaccgccuccucggcauggucgucgacgucgagaaccucuucauguccguccacaaggaggaggacaccgacaccaagcaggucuacuucuaccucuucaagcuccuccgcaagugcauccuccagaugacccgccccgucgucgagggcucccucggcuccccccccuucgagaagcccaacaucgagcagggcguccucaacuucguccaguacaaguucucccaccucgccccccgcgagcgccagaccauguucgagcucuccaagauguuccuccucugccucaacuacuggaagcucgagacccccgcccaguuccgccagcgcucccaggccgaggacgucgccaccuacaaggucaacuacacccgcuggcucugcuacugccacgucccccaguccugcgacucccucccccgcuacgagaccacccacgucuucggccgcucccuccuccgcuccaucuucaccgucacccgccgccagcuccucgagaaguuccgcgucgagaaggacaagcucguccccgagaagcgcacccucauccucacccacuuccccaaguuccucuccaugcucgaggaggagaucuacggcgccaacucccccaucugggaguccggcuucaccaugccccccuccgagggcacccagcucgucccccgccccgccuccgucuccgccgccgucguccccuccacccccaucuucucccccuccaugggcggcggcuccaacuccucccucucccucgacuccgccggcgccgagcccaugcccggcgagaagcgcacccuccccgagaaccucacccucgaggacgccaagcgccuccgcgucaugggcgacauccccauggagcucgucaacgaggucaugcucaccaucaccgaccccgccgccaugcucggccccgagaccucccuccucuccgccaacgccgcccgcgacgagaccgcccgccucgaggagcgccgcggcaucaucgaguuccacgucaucggcaacucccucacccccaaggccaaccgccgcguccuccucuggcucgucggccuccagaacgucuucucccaccagcucccccgcaugcccaaggaguacaucgcccgccucgucuucgaccccaagcacaagacccucgcccucaucaaggacggccgcgucaucggcggcaucugcuuccgcauguuccccacccagggcuucaccgagaucgucuucugcgccgucaccuccaacgagcaggucaagggcuacggcacccaccucaugaaccaccucaaggaguaccacaucaagcacaacauccucuacuuccucaccuacgccgacgaguacgccaucggcuacuucaagaagcagggcuucuccaaggacaucaagguccccaagucccgcuaccucggcuacaucaaggacuacgagggcgccacccucauggagugcgagcucaacccccgcauccccuacaccgagcucucccacaucaucaagaagcagaaggagaucaucaagaagcucaucgagcgcaagcaggcccagauccgcaaggucuaccccggccucuccugcuucaaggagggcguccgccagauccccgucgaguccguccccggcauccgcgagaccggcuggaagccccucggcaaggagaagggcaaggagcucaaggaccccgaccagcucuacaccacccucaagaaccuccucgcccagaucaagucccaccccuccgccuggcccuucauggagcccgucaagaaguccgaggcccccgacuacuacgaggucauccgcuuccccaucgaccucaagaccaugaccgagcgccuccgcucccgcuacuacgucacccgcaagcucuucgucgccgaccuccagcgcgucaucgccaacugccgcgaguacaacccccccgacuccgaguacugccgcugcgccuccgcccucgagaaguucuucuacuucaagcucaaggagggcggccucaucgacaaguga

SEQ ID NO: 44865 - RNA, 2499 nt, Artificial Sequence
  derived and/or modified sequence opt2 from KAT2B__Homo_sapiens__NP_003875
auguccgaggccggcggcgccggccccggcggcugcggcgccggcgccggcgccggcgccggccccggcgcccuccccccccagcccgccgcccucccccccgcccccccccagggcucccccugcgccgccgccgccggcggcuccggcgccugcggccccgccaccgccgucgccgccgccggcaccgccgagggccccggcggcggcggcuccgcccgcaucgccgucaagaaggcccagcuccgcuccgccccccgcgccaagaagcucgagaagcucggcgucuacuccgccugcaaggccgaggaguccugcaagugcaacggcuggaagaaccccaaccccucccccacccccccccgcgccgaccuccagcagaucaucgucucccucaccgaguccugccgcuccugcucccacgcccucgccgcccacgucucccaccucgagaacgucuccgaggaggagaugaaccgccuccucggcaucguccucgacgucgaguaccucuucaccugcguccacaaggaggaggacgccgacaccaagcaggucuacuucuaccucuucaagcuccuccgcaaguccauccuccagcgcggcaagcccgucgucgagggcucccucgagaagaagccccccuucgagaagcccuccaucgagcagggcgucaacaacuucguccaguacaaguucucccaccuccccgccaaggagcgccagaccaucgucgagcucgccaagauguuccucaaccgcaucaacuacuggcaccucgaggcccccucccagcgccgccuccgcucccccaacgacgacaucuccggcuacaaggagaacuacacccgcuggcucugcuacugcaacgucccccaguucugcgacucccucccccgcuacgagaccacccaggucuucggccgcacccuccuccgcuccgucuucaccgucaugcgccgccagcuccucgagcaggcccgccaggagaaggacaagcucccccucgagaagcgcacccucauccucacccacuuccccaaguuccucuccaugcucgaggaggaggucuacucccagaacucccccaucugggaccaggacuuccucuccgccuccucccgcaccucccagcucggcauccagaccgucaucaaccccccccccgucgccggcaccaucuccuacaacuccaccuccuccucccucgagcagcccaacgccggcuccuccucccccgccugcaaggccuccuccggccucgaggccaaccccggcgagaagcgcaagaugaccgacucccacguccucgaggaggccaagaagccccgcgucaugggcgacauccccauggagcucaucaacgaggucauguccaccaucaccgaccccgccgccaugcucggccccgagaccaacuuccucuccgcccacuccgcccgcgacgaggccgcccgccucgaggagcgccgcggcgucaucgaguuccacgucgucggcaacucccucaaccagaagcccaacaagaagauccucauguggcucgucggccuccagaacgucuucucccaccagcucccccgcaugcccaaggaguacaucacccgccucgucuucgaccccaagcacaagacccucgcccucaucaaggacggccgcgucaucggcggcaucugcuuccgcauguuccccucccagggcuucaccgagaucgucuucugcgccgucaccuccaacgagcaggucaagggcuacggcacccaccucaugaaccaccucaaggaguaccacaucaagcacgacauccucaacuuccucaccuacgccgacgaguacgccaucggcuacuucaagaagcagggcuucuccaaggagaucaagauccccaagaccaaguacgucggcuacaucaaggacuacgagggcgccacccucaugggcugcgagcucaacccccgcauccccuacaccgaguucuccgucaucaucaagaagcagaaggagaucaucaagaagcucaucgagcgcaagcaggcccagauccgcaaggucuaccccggccucuccugcuucaaggacggcguccgccagauccccaucgaguccauccccggcauccgcgagaccggcuggaagcccuccggcaaggagaaguccaaggagccccgcgaccccgaccagcucuacuccacccucaaguccauccuccagcaggucaagucccaccaguccgccuggcccuucauggagcccgucaagcgcaccgaggcccccggcuacuacgaggucauccgcuuccccauggaccucaagaccauguccgagcgccucaagaaccgcuacuacgucuccaagaagcucuucauggccgaccuccagcgcgucuucaccaacugcaaggaguacaacccccccgaguccgaguacuacaagugcgccaacauccucgagaaguucuucuucuccaagaucaaggaggccggccucaucgacaaguga

SEQ ID NO: 44866 - RNA, 1485 nt, Artificial Sequence
  derived and/or modified sequence opt2 from KAT5__Homo_sapiens__NP_001193762
auggccgaggucgucucccccguccccggcgccggccgccgcgagcccggcgaggucggccgcgcccgcggcccccccgucgccgaccccggcgucgcccucuccccccagggcgagaucaucgagggcugccgccuccccguccuccgccgcaaccaggacaacgaggacgaguggccccucgccgagauccucuccgucaaggacaucuccggccgcaagcucuucuacguccacuacaucgacuucaacaagcgccucgacgagugggucacccacgagcgccucgaccucaagaagauccaguuccccaagaaggaggccaagacccccaccaagaacggccuccccggcucccgccccggcucccccgagcgcgaggucaagcgcaaggucgaggucgucucccccgccacccccguccccuccgagaccgcccccgccuccgucuucccccagaacggcgccgcccgccgcgccgucgccgcccagcccggccgcaagcgcaaguccaacugccucggcaccgacgaggacucccaggacuccuccgacggcauccccuccgccccccgcaugaccggcucccucgucuccgaccgcucccacgacgacaucgucacccgcaugaagaacaucgagugcaucgagcucggccgccaccgccucaagcccugguacuucucccccuacccccaggagcucaccacccuccccguccucuaccucugcgaguucugccucaaguacggccgcucccucaagugccuccagcgccaccucaccaagugcgaccuccgccacccccccggcaacgagaucuaccgcaagggcaccaucuccuucuucgagaucgacggccgcaagaacaaguccuacucccagaaccucugccuccucgccaagugcuuccucgaccacaagacccucuacuacgacaccgaccccuuccucuucuacgucaugaccgaguacgacugcaagggcuuccacaucgucggcuacuucuccaaggagaaggaguccaccgaggacuacaacgucgccugcauccucacccucccccccuaccagcgccgcggcuacggcaagcuccucaucgaguucuccuacgagcucuccaaggucgagggcaagaccggcacccccgagaagccccucuccgaccucggccuccucuccuaccgcuccuacuggucccagaccauccucgagauccucaugggccucaaguccgaguccggcgagcgcccccagaucaccaucaacgagaucuccgagaucaccuccaucaagaaggaggacgucaucuccacccuccaguaccucaaccucaucaacuacuacaagggccaguacauccucacccucuccgaggacaucgucgacggccacgagcgcgccaugcucaagcgccuccuccgcaucgacuccaagugccuccacuucacccccaaggacugguccaagcgcggcaagugguga

SEQ ID NO: 44867 - RNA, 6015 nt, Artificial Sequence
  derived and/or modified sequence opt2 from KAT6A__Homo_sapiens__NP_006757
auggucaagcucgccaacccccucuacaccgaguggauccucgaggccaucaagaaggucaagaagcagaagcagcgccccuccgaggagcgcaucugcaacgccgucuccuccucccacggccucgaccgcaagaccguccucgagcagcucgagcucuccgucaaggacggcaccauccucaaggucuccaacaagggccucaacuccuacaaggaccccgacaaccccggccgcaucgcccuccccaagccccgcaaccacggcaagcucgacaacaagcagaacgucgacuggaacaagcucaucaagcgcgccgucgagggccucgccgaguccggcggcuccacccucaaguccaucgagcgcuuccucaagggccagaaggacgucuccgcccucuucggcggcuccgccgccuccggcuuccaccagcagcuccgccucgccaucaagcgcgccaucggccacggccgccuccucaaggacggcccccucuaccgccucaacaccaaggccaccaacgucgacggcaaggaguccugcgagucccucuccugccucccccccgucucccuccucccccacgagaaggacaagcccgucgccgagcccauccccaucugcuccuucugccucggcaccaaggagcagaaccgcgagaagaagcccgaggagcucaucuccugcgccgacugcggcaacuccggccaccccuccugccucaaguucucccccgagcucaccguccgcgucaaggcccuccgcuggcagugcaucgagugcaagaccugcuccuccugccgcgaccagggcaagaacgccgacaacaugcucuucugcgacuccugcgaccgcggcuuccacauggagugcugcgaccccccccucacccgcaugcccaagggcauguggaucugccagaucugccgcccccgcaagaagggccgcaagcuccuccagaagaaggccgcccagaucaagcgccgcuacaccaaccccaucggccgccccaagaaccgccucaagaagcagaacaccgucuccaagggccccuucuccaagguccgcaccggccccggccgcggccgcaagcgcaagaucacccucuccucccaguccgccuccuccuccuccgaggagggcuaccucgagcgcaucgacggccucgacuucugccgcgacuccaacgucucccucaaguucaacaagaagaccaagggccucaucgacggccucaccaaguucuucacccccucccccgacggccgcaaggcccgcggcgaggucgucgacuacuccgagcaguaccgcauccgcaagcgcggcaaccgcaaguccuccaccuccgacuggcccaccgacaaccaggacggcugggacggcaagcaggagaacgaggagcgccucuucggcucccaggagaucaugaccgagaaggacauggagcucuuccgcgacauccaggagcaggcccuccagaaggucggcgucaccggcccccccgacccccagguccgcugccccuccgucaucgaguucggcaaguacgagauccacaccugguacuccucccccuacccccaggaguacucccgccuccccaagcucuaccucugcgaguucugccucaaguacaugaagucccgcaccauccuccagcagcacaugaagaagugcggcugguuccacccccccgccaacgagaucuaccgcaagaacaacaucuccgucuucgaggucgacggcaacgucuccaccaucuacugccagaaccucugccuccucgccaagcucuuccucgaccacaagacccucuacuacgacgucgagcccuuccucuucuacguccucacccagaacgacgucaagggcugccaccucgucggcuacuucuccaaggagaagcacugccagcagaaguacaacgucuccugcaucaugauccucccccaguaccagcgcaagggcuacggccgcuuccucaucgacuucuccuaccuccucuccaagcgcgagggccaggccggcucccccgagaagccccucuccgaccucggccgccucuccuacauggccuacuggaaguccgucauccucgagugccucuaccaccagaacgacaagcagaucuccaucaagaagcucuccaagcucaccggcaucugcccccaggacaucaccuccacccuccaccaccuccgcaugcucgacuuccgcuccgaccaguucgucaucauccgccgcgagaagcucauccaggaccacauggccaagcuccagcucaaccuccgccccgucgacgucgaccccgagugccuccgcuggacccccgucaucgucuccaacuccgucgucuccgaggaggaggaggaggaggccgaggagggcgagaacgaggagccccagugccaggagcgcgagcucgagaucuccgucggcaaguccgucucccacgagaacaaggagcaggacuccuacuccgucgaguccgagaagaagcccgaggucauggcccccgucuccuccacccgccucuccaagcagguccucccccacgacucccuccccgccaacucccagcccucccgccgcggccgcuggggccgcaagaaccgcaagacccaggagcgcuucggcgacaaggacuccaagcuccuccucgaggagaccuccuccgccccccaggagcaguacggcgagugcggcgagaaguccgaggccacccaggagcaguacaccgaguccgaggagcagcucgucgccuccgaggagcagcccucccaggacggcaagcccgaccuccccaagcgccgccucuccgagggcgucgagcccuggcgcggccagcucaagaagucccccgaggcccucaagugccgccucaccgagggcuccgagcgccucccccgccgcuacuccgagggcgaccgcgccguccuccgcggcuucuccgaguccuccgaggaggaggaggagcccgaguccccccgcuccuccuccccccccauccucaccaagcccacccucaagcgcaagaagcccuuccuccaccgccgccgccgcguccgcaagcgcaagcaccacaacuccuccgucgucaccgagaccaucuccgagaccaccgagguccucgacgagcccuucgaggacuccgacuccgagcgccccaugccccgccucgagcccaccuucgagaucgacgaggaggaggaggaggaggacgagaacgagcucuucccccgcgaguacuuccgccgccucuccucccaggacguccuccgcugccaguccuccuccaagcgcaaguccaaggacgaggaggaggacgaggaguccgacgacgccgacgacacccccauccucaagcccgucucccuccuccgcaagcgcgacgucaagaacuccccccucgagcccgacaccuccaccccccucaagaagaagaagggcuggcccaagggcaagucccgcaagcccauccacuggaagaagcgccccggccgcaagcccggcuucaagcucucccgcgagaucaugcccgucuccacccaggccugcgucaucgagcccaucgucuccauccccaaggccggccgcaagcccaagauccaggaguccgaggagaccgucgagcccaaggaggacaugccccuccccgaggagcgcaaggaggaggaggagaugcaggccgaggccgaggaggccgaggagggcgaggaggaggacgccgccuccuccgagguccccgccgccucccccgccgacuccuccaacucccccgagaccgagaccaaggagcccgaggucgaggaggaggaggagaagccccgcgucuccgaggagcagcgccaguccgaggaggagcagcaggagcucgaggagcccgagcccgaggaggaggaggacgccgccgccgagaccgcccagaacgacgaccacgacgccgacgacgaggacgacggccaccucgaguccaccaagaagaaggagcucgaggagcagcccacccgcgaggacgucaaggaggagcccggcguccaggaguccuuccucgacgccaacaugcagaagucccgcgagaagaucaaggacaaggaggagaccgagcucgacuccgaggaggagcagcccucccacgacaccuccgucgucuccgagcagauggccggcuccgaggacgaccacgaggaggacucccacaccaaggaggagcucaucgagcucaaggaggaggaggagaucccccacuccgagcucgaccucgagaccguccaggccguccagucccucacccaggaggaguccuccgagcacgagggcgccuaccaggacugcgaggagacccucgccgccugccagacccuccaguccuacacccaggccgacgaggacccccagauguccauggucgaggacugccacgccuccgagcacaacucccccaucuccuccguccagucccaccccucccaguccguccgcuccgucuccucccccaacguccccgcccucgaguccggcuacacccagaucucccccgagcagggcucccucuccgcccccuccaugcagaacauggagaccucccccaugauggacguccccuccgucuccgaccacucccagcaggucgucgacuccggcuucuccgaccucggcuccaucgaguccaccaccgagaacuacgagaaccccuccuccuacgacuccaccaugggcggcuccaucugcggcaacuccuccucccaguccuccugcuccuacggcggccucuccuccuccuccucccucacccaguccuccugcgucgucacccagcagauggccuccaugggcuccuccugcuccaugaugcagcaguccuccguccagcccgccgccaacugcuccaucaaguccccccaguccugcgucgucgagcgcccccccuccaaccagcagcagcagcccccccccccccccccccagcagccccagcccccccccccccagccccagcccgccccccagcccccccccccccagcagcagccccagcagcagccccagccccagccccagcagccccccccccccccccccccccagcagcagcccccccucucccagugcuccaugaacaacuccuucacccccgcccccaugaucauggagauccccgaguccggcuccaccggcaacaucuccaucuacgagcgcauccccggcgacuucggcgccggcuccuacucccagcccuccgccaccuucucccucgccaagcuccagcagcucaccaacaccaucauggacccccacgccaugcccuacucccacucccccgccgucaccuccuacgccaccuccgucucccucuccaacaccggccucgcccagcucgcccccucccacccccucgccggcaccccccaggcccaggccaccaugacccccccccccaaccucgccuccaccaccaugaaccucaccuccccccuccuccagugcaacauguccgccaccaacaucggcaucccccacacccagcgccuccagggccagaugcccgucaagggccacaucuccauccgcuccaaguccgccccccuccccuccgccgccgcccaccagcagcagcucuacggccgcucccccuccgccgucgccaugcaggccggcccccgcgcccucgccguccagcgcggcaugaacaugggcgucaaccucaugcccacccccgccuacaacgucaacuccaugaacaugaacacccucaacgccaugaacuccuaccgcaugacccagcccaugaugaacuccuccuaccacuccaaccccgccuacaugaaccagaccgcccaguaccccaugcagaugcagaugggcaugaugggcucccaggccuacacccagcagcccaugcagcccaacccccacggcaacaugauguacaccggccccucccaccacuccuacaugaacgccgccggcguccccaagcagucccucaacggccccuacaugcgccgcuga

SEQ ID NO: 44868 - RNA, 5673 nt, Artificial Sequence
  derived and/or modified sequence opt2 from KAT6B__Homo_sapiens__NP_001243397
auggucaagcucgccaacccccucuacaccgaguggauccucgaggccauccagaagaucaagaagcagaagcagcgccccuccgaggagcgcaucugccacgccgucuccaccucccacggccucgacaagaagaccgucuccgagcagcucgagcucuccguccaggacggcuccguccucaaggucaccaacaagggccucgccuccuacaaggaccccgacaaccccggccgcuucuccuccgucaagcccggcaccuuccccaaguccgccaagggcucccgcggcuccugcaacgaccuccgcaacgucgacuggaacaagcuccuccgccgcgccaucgagggccucgaggagcccaacggcuccucccucaagaacaucgagaaguaccuccgcucccaguccgaccucaccuccaccaccaacaaccccgccuuccagcagcgccuccgccucggcgccaagcgcgccgucaacaacggccgccuccucaaggacggcccccaguaccgcgucaacuacggcucccucgacggcaagggcgccccccaguaccccuccgccuuccccuccucccucccccccgucucccuccucccccacgagaaggaccagccccgcgccgaccccauccccaucugcuccuucugccucggcaccaaggaguccaaccgcgagaagaagcccgaggagcuccucuccugcgccgacugcggcuccuccggccaccccuccugccucaaguucugccccgagcucaccaccaacgucaaggcccuccgcuggcagugcaucgagugcaagaccugcuccgccugccgcguccagggccgcaacgccgacaacaugcucuucugcgacuccugcgaccgcggcuuccacauggagugcugcgaccccccccucucccgcaugcccaagggcauguggaucugccaggucugccgccccaagaagaagggccgcaagcuccuccacgagaaggccgcccagaucaagcgccgcuacgccaagcccaucggccgccccaagaacaagcucaagcagcgccuccucuccgucaccuccgacgagggcuccaugaacgccuucaccggccgcggcucccccggccgcggccagaagaccaaggucugcaccacccccuccuccggccacgccgccuccggcaaggacuccuccucccgccucgccgucaccgaccccacccgccccggcgccaccaccaagaucaccaccaccuccaccuacaucuccgccuccacccucaaggucaacaagaagaccaagggccucaucgacggccucaccaaguucuucacccccucccccgacggccgccgcucccgcggcgagaucaucgacuucuccaagcacuaccgcccccgcaagaaggucucccagaagcaguccugcaccucccacguccucgccaccgacaccgagaucaagaucaacaucaagcaggaguccgccgacgucaacgucaucggcaacaaggacgucgucaccgaggaggaccucgacgucuucaagcaggcccaggagcucuccugggagaagaucgagugcgaguccggcgucgaggacugcggccgcuaccccuccgucaucgaguucggcaaguacgagauccagaccugguacuccucccccuacccccaggaguacgcccgccuccccaagcucuaccucugcgaguucugccucaaguacaugaaguccaagaacauccuccuccgccacuccaagaagugcggcugguuccacccccccgccaacgagaucuaccgccgcaaggaccucuccgucuucgaggucgacggcaacauguccaagaucuacugccagaaccucugccuccucgccaagcucuuccucgaccacaagacccucuacuacgacgucgagcccuuccucuucuacguccucaccaagaacgacgagaagggcugccaccucgucggcuacuucuccaaggagaagcucugccagcagaaguacaacgucuccugcaucaugaucaugccccagcaccagcgccagggcuucggccgcuuccucaucgacuucuccuaccuccucucccgccgcgagggccaggccggcucccccgagaagccccucuccgaccucggccgccucuccuaccucgccuacuggaaguccgucauccucgaguaccucuaccaccaccacgagcgccacaucuccaucaaggccaucucccgcgccaccggcaugugcccccacgacaucgccaccacccuccagcaccuccacaugaucgacaagcgcgacggccgcuucgucaucauccgccgcgagaagcucauccucucccacauggagaagcucaagaccugcucccgcgccaacgagcucgaccccgacucccuccgcuggacccccauccucaucuccaacgccgccgucuccgaggaggagcgcgaggccgagaaggaggccgagcgccucauggagcaggccuccugcugggagaaggaggagcaggagauccucuccacccgcgccaacucccgccagucccccgccaagguccaguccaagaacaaguaccuccacucccccgagucccgccccgucaccggcgagcgcggccagcuccucgagcucuccaaggaguccuccgaggaggaggaggaggaggaggacgaggaggaggaggaggaggaggaggaggaggaggaggacgaggaggaggaggaggaggaggaggaggaggaggaggaggagaacauccaguccucccccccccgccucaccaagccccaguccgucgccaucaagcgcaagcgccccuucguccucaagaagaagcgcggccgcaagcgccgccgcaucaacuccuccgucaccaccgagaccaucuccgagaccaccgagguccucaacgagcccuucgacaacuccgacgaggagcgccccaugccccagcucgagcccaccugcgagaucgaggucgaggaggacggccgcaagcccguccuccgcaaggccuuccagcaccagcccggcaagaagcgccagaccgaggaggaggagggcaaggacaaccacugcuucaagaacgccgaccccugccgcaacaacaugaacgacgacuccuccaaccucaaggagggcuccaaggacaaccccgagccccucaagugcaagcaggucuggcccaagggcaccaagcgcggccucuccaaguggcgccagaacaaggagcgcaagaccggcuucaagcucaaccucuacaccccccccgagacccccauggagcccgacgagcaggucaccgucgaggagcagaaggagaccuccgagggcaagaccucccccucccccauccgcaucgaggaggaggucaaggagaccggcgaggcccuccucccccaggaggagaaccgccgcgaggagaccugcgcccccgucucccccaacaccucccccggcgagaagcccgaggacgaccucaucaagcccgaggaggaggaggaggaggaggaggaggaggaggaggaggaggaggaggaggagggcgaggaggaggagggcggcggcaacgucgagaaggaccccgacggcgccaagucccaggagaaggaggagcccgagaucuccaccgagaaggaggacuccgcccgccucgacgaccacgaggaggaggaggaggaggacgaggagcccucccacaacgaggaccacgacgccgacgacgaggacgacucccacauggaguccgccgaggucgagaaggaggagcucccccgcgaguccuucaaggagguccucgagaaccaggagaccuuccucgaccucaacguccagcccggccacuccaaccccgagguccucauggacugcggcgucgaccucaccgccuccugcaacuccgagcccaaggagcucgccggcgaccccgaggccguccccgaguccgacgaggagcccccccccggcgagcaggcccagaagcaggaccagaagaacuccaaggaggucgacaccgaguucaaggagggcaaccccgccaccauggagaucgacuccgagaccguccaggccguccagucccucacccaggaguccuccgagcaggacgacaccuuccaggacugcgccgagacccaggaggccugccgcucccuccagaacuacacccgcgccgaccaguccccccagaucgccaccacccucgacgacugccagcaguccgaccacuccucccccgucuccuccguccacucccaccccggccaguccguccgcuccgucaacucccccuccguccccgcccucgagaacuccuacgcccagaucucccccgaccaguccgccaucuccguccccucccuccagaacauggagaccucccccaugauggacguccccuccgucuccgaccacucccagcaggucgucgacuccggcuucuccgaccucggcuccaucgaguccaccaccgagaacuacgagaaccccuccuccuacgacuccaccaugggcggcuccaucugcggcaacggcuccucccagaacuccugcuccuacuccaaccucaccuccuccucccucacccaguccuccugcgccgucacccagcagauguccaacaucuccggcuccugcuccaugcuccagcagaccuccaucuccuccccccccaccugcuccgucaaguccccccagggcugcgucgucgagcgcccccccuccuccucccagcagcucgcccagugcuccauggccgccaacuucaccccccccaugcagcucgccgagauccccgagaccuccaacgccaacaucggccucuacgagcgcaugggccaguccgacuucggcgccggccacuacccccagcccuccgccaccuucucccucgccaagcuccagcagcucaccaacacccucaucgaccacucccuccccuacucccacuccgccgccgucaccuccuacgccaacuccgccucccucuccaccccccucuccaacaccggccucguccagcucucccaguccccccacuccguccccggcggcccccaggcccaggccaccaugacccccccccccaaccucacccccccccccaugaaccucccccccccccuccuccagcgcaacauggccgccuccaacaucggcaucucccacucccagcgccuccagacccagaucgccuccaagggccacaucuccaugcgcaccaaguccgccucccucucccccgccgccgccacccaccagucccagaucuacggccgcucccagaccgucgccaugcagggccccgcccgcacccucaccaugcagcgcggcaugaacauguccgucaaccucaugcccgcccccgccuacaacgucaacuccgucaacaugaacaugaacacccucaacgccaugaacggcuacuccaugucccagcccaugaugaacuccggcuaccacuccaaccacggcuacaugaaccagaccccccaguaccccaugcagaugcagaugggcaugaugggcacccagcccuacgcccagcagcccaugcagacccccccccacggcaacaugauguacaccgcccccggccaccacggcuacaugaacaccggcauguccaagcagucccucaacggcuccuacaugcgccgcuga

SEQ ID NO: 44869 - RNA, 1746 nt, Artificial Sequence
  derived and/or modified sequence opt2 from KAT7__Homo_sapiens__NP_001186084
augccccgccgcaagcgcaacgccggcuccuccuccgacggcaccgaggacuccgacuucuccaccgaccucgagcacaccgacuccuccgaguccgacggcaccucccgccgcuccgcccgcgucacccgcuccuccgcccgccucucccaguccucccaggacuccucccccguccgcaaccuccaguccuucggcaccgaggagcccgccuacuccacccgccgcgucacccgcucccagcagcagcccacccccgucacccccaagaaguacccccuccgccagacccgcuccuccggcuccgagaccgagcaggucgucgacuucuccgaccgcgagaccaagaacaccgccgaccacgacgagucccccccccgcacccccaccggcaacgcccccuccuccgaguccgacaucgacaucuccucccccaacgucucccacgacgaguccaucgccaaggacaugucccucaaggacuccggcuccgaccucucccaccgccccaagcgccgccgcuuccacgaguccuacaacuucaacaugaagugccccacccccggcugcaacucccucggccaccucaccggcaagcacgagcgccacuucuccaucuccggcugcccccucuaccacaaccucuccgccgacgagugcaaggcccccaccgagcgccagcuccgcuacaaggagaaggucgccgagcuccgcaagaagcgcaacuccggccucuccaaggagcagaaggagaaguacauggagcaccgccagaccuacggcaacacccgcgagccccuccucgagaaccucaccuccgaguacgaccucgaccucuuccgccgcgcccaggcccgcgccuccgaggaccucgagaagcuccgccuccagggccagaucaccgagggcuccaacaugaucaagaccaucgccuucggccgcuacgagcucgacaccugguaccacucccccuaccccgaggaguacgcccgccucggccgccucuacaugugcgaguucugccucaaguacaugaagucccagaccauccuccgccgccacauggccaagugcgucuggaagcacccccccggcgacgagaucuaccgcaagggcuccaucuccgucuucgaggucgacggcaagaagaacaagaucuacugccagaaccucugccuccucgccaagcucuuccucgaccacaagacccucuacuacgacgucgagcccuuccucuucuacgucaugaccgaggccgacaacaccggcugccaccucaucggcuacuucuccaaggagaagaacuccuuccucaacuacaacgucuccugcauccucaccaugccccaguacaugcgccagggcuacggcaagaugcucaucgacuucuccuaccuccucuccaaggucgaggagaaggucggcucccccgagcgcccccucuccgaccucggccucaucuccuaccgcuccuacuggaaggagguccuccuccgcuaccuccacaacuuccagggcaaggagaucuccaucaaggagaucucccaggagaccgccgucaaccccgucgacaucgucuccacccuccaggcccuccagaugcucaaguacuggaagggcaagcaccucguccucaagcgccaggaccucaucgacgaguggaucgccaaggaggccaagcgcuccaacuccaacaagaccauggaccccuccugccucaaguggaccccccccaagggcaccuga

SEQ ID NO: 44870 - RNA, 1377 nt, Artificial Sequence
  derived and/or modified sequence opt2 from KAT8__Homo_sapiens__NP_115564
auggccgcccagggcgccgccgccgccgucgccgccggcaccuccggcgucgccggcgagggcgagcccggccccggcgagaacgccgccgccgagggcaccgcccccucccccggccgcgucuccccccccacccccgcccgcggcgagcccgaggucaccgucgagaucggcgagaccuaccucugccgccgccccgacuccaccuggcacuccgccgaggucauccagucccgcgucaacgaccaggagggccgcgaggaguucuacguccacuacgucggcuucaaccgccgccucgacgagugggucgacaagaaccgccucgcccucaccaagaccgucaaggacgccguccagaagaacuccgagaaguaccucuccgagcucgccgagcagcccgagcgcaagaucacccgcaaccagaagcgcaagcacgacgagaucaaccacguccagaagaccuacgccgagauggaccccaccaccgccgcccucgagaaggagcacgaggccaucaccaaggucaaguacgucgacaagauccacaucggcaacuacgagaucgacgccugguacuucucccccuuccccgaggacuacggcaagcagcccaagcucuggcucugcgaguacugccucaaguacaugaaguacgagaaguccuaccgcuuccaccucggccagugccaguggcgccagccccccggcaaggagaucuaccgcaaguccaacaucuccgucuacgaggucgacggcaaggaccacaagaucuacugccagaaccucugccuccucgccaagcucuuccucgaccacaagacccucuacuucgacgucgagcccuucgucuucuacauccucaccgaggucgaccgccagggcgcccacaucgucggcuacuucuccaaggagaaggagucccccgacggcaacaacgucgccugcauccucacccucccccccuaccagcgccgcggcuacggcaaguuccucaucgccuucuccuacgagcucuccaagcucgaguccaccgucggcucccccgagaagccccucuccgaccucggcaagcucuccuaccgcuccuacugguccuggguccuccucgagauccuccgcgacuuccgcggcacccucuccaucaaggaccucucccagaugaccuccaucacccagaacgacaucaucuccacccuccagucccucaacauggucaaguacuggaagggccagcacgucaucugcgucacccccaagcucgucgaggagcaccucaaguccgcccaguacaagaagccccccaucaccgucgacuccgucugccucaagugggccccccccaagcacaagcaggucaagcucuccaagaaguga

SEQ ID NO: 44871 - RNA, 936 nt, Artificial Sequence
  derived and/or modified sequence opt2 from KATNA1__Homo_sapiens__NP_001191005
augucccuccucaugaucuccgagaacgucaagcucgcccgcgaguacgcccuccucggcaacuacgacuccgccauggucuacuaccagggcguccucgaccagaugaacaaguaccucuacuccgucaaggacaccuaccuccagcagaaguggcagcaggucuggcaggagaucaacgucgaggccaagcacgucaaggacaucaugaagacccucgaguccuucaagcucgacuccaccccccucaaggccgcccagcacgaccuccccgccuccgagggcgaggucugguccaugcccguccccgucgagcgccgccccucccccggcccccgcaagcgccaguccucccaguacuccgaccccaagucccacggcaaccgccccuccaccaccguccgcguccaccgcuccuccgcccagaacguccacaacgaccgcggcaaggccguccgcugccgcgagaagaaggagcagaacaagggccgcgaggagaagggcguccucauggucggcccccccggcaccggcaagacccuccucgccaaggccgucgccaccgagugcaagaccaccuucuucaacgucuccuccuccacccucaccuccaaguaccgcggcgaguccgagaagcucguccgccuccucuucgagauggcccgcuucuacucccccgccaccaucuucaucgacgagaucgacuccaucugcucccgccgcggcaccuccgaggagcacgaggccucccgccgcgucaaggccgagcuccucguccagauggacggcgucggcggcaccuccgagaacgacgaccccuccaagauggucaugguccucgccgccaccaacuuccccugggacaucgacgaggcccuccgccgccgccucgagaagcgcaucuacaucccccuccccuccggcaugcgccccuga

SEQ ID NO: 44872 - RNA, 1695 nt, Artificial Sequence
  derived and/or modified sequence opt2 from KATNAL2__Homo_sapiens__XP_005258414
augaagaagaucgagcagcgcaagacccgccccugcuucuccaccuccaacgagaaccgcguccucgcccagugccucauggagcucuccuaccagacccucaaguucacccaccaggcccgcgaggccugcgagaugcgcaccgaggcccgccgcaagaaccuccucauccucaucucccacuaccucacccaggagggcuacaucgacaccgccaacgcccucgagcaggagaccaagcucggccuccgccgcuucgaggucugcgacaacaucgaccucgagaccauccucauggaguacgaguccuacuacuucgucaaguuccagaaguaccccaagaucgucaagaaguccuccgacaccgccgagaacaaccucccccagcgcucccgcggcaagacccgccgcaugaugaacgacuccugccagaaccuccccaagaucaaccagcagcgcccccgcuccaagaccaccgccggcaagaccggcgacaccaagucccucaacaaggagcaccccaaccaggaggucgucgacaacacccgccucgaguccgccaacuucggccuccacaucucccgcauccgcaaggacuccggcgaggagaacgcccacccccgccgcggccagaucaucgacuuccagggccuccucaccgacgccaucaagggcgccaccuccgagcucgcccucaacaccuucgaccacaaccccgaccccuccgagcgccuccucaagccccucuccgccuucaucggcaugaacuccgagaugcgcgagcucgccgccgucgucucccgcgacaucuaccuccacaaccccaacaucaaguggaacgacaucaucggccucgacgccgccaagcagcucgucaaggaggccgucgucuaccccauccgcuacccccagcucuucaccggcauccucucccccuggaagggccuccuccucuacggcccccccggcaccggcaagacccuccucgccaaggccgucgccaccgagugcaagaccaccuucuucaacaucuccgccuccaccaucgucuccaaguggcgcggcgacuccgagaagcucguccgcguccucuucgagcucgcccgcuaccacgcccccuccaccaucuuccucgacgagcucgaguccgucaugucccagcgcggcaccgccuccggcggcgagcacgagggcucccuccgcaugaagaccgagcuccucguccagauggacggccucgcccgcuccgaggaccucgucuucguccucgccgccuccaaccuccccugggagcucgacugcgccaugcuccgccgccucgagaagcgcauccucgucgaccuccccucccgcgaggcccgccaggccaugaucuaccacuggcucccccccgucuccaagucccgcgcccucgagcuccacaccgagcucgaguacuccguccucucccaggagaccgagggcuacuccggcuccgacaucaagcucgucugccgcgaggccgccaugcgccccguccgcaagaucuucgacgcccucgagaaccaccaguccgaguccuccgaccucccccgcauccagcucgacaucgucaccaccgccgacuuccucgacguccucacccacaccaagcccuccgccaagaaccucgcccagcgcuacuccgacuggcagcgcgaguucgaguccgucuga

SEQ ID NO: 44873 - RNA, 1968 nt, Artificial Sequence
  derived and/or modified sequence opt2 from KATNB1__Homo_sapiens__NP_005877
auggccacccccgucgucaccaagaccgccuggaagcuccaggagaucgucgcccacgccuccaacgucuccucccucguccucggcaaggccuccggccgccuccucgccaccggcggcgacgacugccgcgucaaccucugguccaucaacaagcccaacugcaucaugucccucaccggccacaccucccccgucgaguccguccgccucaacacccccgaggagcucaucgucgccggcucccaguccggcuccauccgcgucugggaccucgaggccgccaagauccuccgcacccucaugggccacaaggccaacaucugcucccucgacuuccaccccuacggcgaguucgucgccuccggcucccaggacaccaacaucaagcucugggacauccgccgcaagggcugcgucuuccgcuaccgcggccacucccaggccguccgcugccuccgcuucucccccgacggcaaguggcucgccuccgccgccgacgaccacaccgucaagcucugggaccucaccgccggcaagaugauguccgaguuccccggccacaccggccccgucaacgucgucgaguuccaccccaacgaguaccuccucgccuccggcuccuccgaccgcaccauccgcuucugggaccucgagaaguuccaggucgucuccugcaucgagggcgagcccggccccguccgcuccguccucuucaaccccgacggcugcugccucuacuccggcugccaggacucccuccgcgucuacggcugggagcccgagcgcugcuucgacgucguccucgucaacuggggcaaggucgccgaccucgccaucugcaacgaccagcucaucggcgucgccuucucccaguccaacgucuccuccuacgucgucgaccucacccgcgucacccgcaccggcaccgucgcccgcgaccccguccaggaccaccgcccccucgcccagccccuccccaaccccuccgccccccuccgccgcaucuacgagcgccccuccaccaccugcuccaagccccagcgcgucaagcagaacuccgaguccgagcgccgcucccccuccuccgaggacgaccgcgacgagcgcgagucccgcgccgagauccagaacgccgaggacuacaacgagaucuuccagcccaagaacuccaucucccgcacccccccccgccgcuccgagcccuuccccgccccccccgaggacgacgccgccaccgccaaggaggccgccaagcccucccccgccauggacguccaguuccccguccccaaccucgagguccucccccgcccccccgucgucgccuccacccccgcccccaaggccgagcccgccaucauccccgccacccgcaacgagcccaucggccucaaggccuccgacuuccuccccgccgucaagaucccccagcaggccgagcucgucgacgaggacgccaugucccagauccgcaagggccacgacaccaugugcgucguccucaccucccgccacaagaaccucgacaccguccgcgccgucuggaccaugggcgacaucaagaccuccgucgacuccgccgucgccaucaacgaccucuccgucgucgucgaccuccucaacaucgucaaccagaaggccucccucuggaagcucgaccucugcaccaccguccucccccagaucgagaagcuccuccaguccaaguacgaguccuacguccagaccggcugcaccucccucaagcucauccuccagcgcuuccucccccucaucaccgacaugcucgccgccccccccuccgucggcgucgacaucucccgcgaggagcgccuccacaagugccgccucugcuacaagcagcucaaguccaucuccggccucgucaaguccaaguccggccucuccggccgccacggcuccaccuuccgcgagcuccaccuccucauggccucccucgacuga

SEQ ID NO: 44874 - RNA, 693 nt, Artificial Sequence
  derived and/or modified sequence opt2 from KAZALD1__Homo_sapiens__XP_005270251
augcucccccccccccgccccgccgccgcccucgcccuccccguccuccuccuccuccucgucguccucacccccccccccaccggcgcccgccccucccccggccccgacuaccuccgccgcggcuggaugcgccuccucgccgagggcgagggcugcgcccccugccgccccgaggagugcgccgccccccgcggcugccucgccggccgcguccgcgacgccugcggcugcugcugggagugcgccaaccucgagggccagcucugcgaccucgaccccuccgcccacuucuacggccacugcggcgagcagcucgagugccgccucgacaccggcggcgaccucucccgcggcgagguccccgagccccucugcgccugccgcucccaguccccccucugcggcuccgacggccacaccuacucccagaucugccgccuccaggaggccgcccgcgcccgccccgacgccaaccucaccgucgcccaccccggccccugcgaguccggcccccagaucgucucccaccccuacgacaccuggaacgucaccggccaggacgucaucuucggcugcgaggucuucgccuaccccauggccuccaucgaguggcgcaaggacggccucgacauccagcuccccggcgacgacccccacaucuccguccagggcuggacccccgaggucuga

SEQ ID NO: 44875 - RNA, 2628 nt, Artificial Sequence
  derived and/or modified sequence opt2 from KAZN__Homo_sapiens__XP_011539377
augcgcgccgccgacuccggcuccugggagcgcguccgccagcucgccgcccagggcgagcccgcccccuccugcggcgccggcgccggccccgcccgcccccccggccccgccgccugcgagcagugcgucgacgccgccggccccggcgaccgcccccgcgccggcgucccccgcguccgcgccgacggcgacugcucccagcccguccuccuccgcgaggaggucucccgccuccaggaggagguccaccuccuccgccagaugaaggagaugcucgccaaggaccucgaggagucccagggcggcaaguccuccgagguccucuccgccaccgagcuccgcguccagcucgcccagaaggagcaggagcucgcccgcgccaaggaggcccuccaggccaugaaggccgaccgcaagcgccucaagggcgagaagaccgaccucgucucccagaugcagcagcucuacgccacccucgagucccgcgaggagcagcuccgcgacuucauccgcaacuacgagcagcaccgcaaggaguccgaggacgccgucaaggcccucgccaaggagaaggaccuccucgagcgcgagaagugggagcuccgccgccaggccaaggaggccaccgaccacgccaccgcccuccgcucccagcucgaccucaaggacaaccgcaugaaggagcucgaggccgagcucgccauggccaagcagucccucgccacccucaccaaggacguccccaagcgccacucccucgccaugcccggcgagaccguccucaacggcaaccaggagugggucguccaggccgaccucccccucaccgccgccauccgccagucccagcagacccucuaccacucccaccccccccaccccgccgaccgccaggccguccgcgucucccccugccacucccgccagcccuccgucaucuccgacgccuccgccgccgagggcgaccgcuccuccacccccuccgacaucaacuccccccgccaccgcacccacucccucugcaacggcgacucccccggccccguccagaagaaccuccacaaccccaucguccagucccucgaggaccucgaggaccagaagcgcaagaagaagaaggagaagaugggcuucggcuccaucucccgcgucuucgcccgcggcaagcagcgcaagucccucgaccccggccucuucgacgacuccgacucccagugcucccccacccgccagucccucucccucuccgagggcgaggagcagauggaccgccuccagcaggucgagcucguccgcaccacccccaugucccacuggaaggccggcaccguccaggccuggcucgaggucgucauggccaugcccauguacgucaaggccugcaccgagaacgucaaguccggcaagguccuccucucccucuccgacgaggaccuccagcucggccucggcgucugcuccucccuccaccgccgcaagcuccgccucgccaucgaggacuaccgcgacgccgaggccggccgcucccucuccaaggccgccgagcucgaccaccacugggucgccaaggccuggcucaacgacaucggccucucccaguacucccaggccuuccagaaccaccucgucgacggccgcaugcucaacucccucaugaagcgcgaccucgagaagcaccucaacgucuccaagaaguuccaccaggucuccauccuccucggcaucgagcuccucuaccaggucaacuucucccgcgaggcccuccaggagcgccgcgcccgcugcgagacccagaacaucgaccccgucgucuggaccaaccagcgcguccucaaguggguccgcgacaucgaccucaaggaguacgccgacaaccucaccaacuccggcguccacggcgccguccucguccucgagcccaccuucaacgccgaggccauggccaccgcccucggcauccccuccggcaagcacauccuccgccgccaccucgccgaggagauguccgccgucuuccaccccgccaacuccaccggcauccgcgaggccgagcgcuucggcaccccccccggccgcgccuccuccgucacccgcgccggcaaggaggagaacuccuccggccucaaguacaaggccggccgcgucucccucuccauggaccuccccgucucccccgccgaccccggcaaggucuucuucuccccccccggcuccuccgucgcccccguccucgccugcgagggcggcguccccggccgcgucaccggcgccucccgcaccgacgcccucgacguccccucccgcaaccuccacgacgcccucggcaccguccacaaggcccccgccggccuccgcgucgcccccggcucccaguccgccggccucaccugccuccacgagaaccaccucggccuccuccucaaccuccagauccucggccccacccucgucuccuggaagcgcuccucccucggccgcggcggcuccugcauccagcucggcugccccgagggcuccggcgccgcccccaacuccgagccccagucccucaucuccaucugcgacuucuccgaccucaccaacuccaaggacgagcccuccggcgacuccaaccagaccgucuga

SEQ ID NO: 44876 - RNA, 1872 nt, Artificial Sequence
  derived and/or modified sequence opt2 from KBTBD11__Homo_sapiens__NP_055682
auggagcacgccgucgcccccugcguccucuaccccggcaccgagcccggcgccgccggcgaguccgaguccgagggcgccgccucccccgcccagacccccugcucccucggcgccucccucugcuucuccuccggcgaggagucccccccccagucccucgccuccgccgccgagggcgccgccaccuccccccccuccuccggcggcccccgcgucgucgagcgccagugggaggccggcuccgccggcgccgccucccccgaggagcucgccucccccgaggagcgcgccugccccgaggagcccgccgcccccucccccgagccccgcgucuggcucgaggaccccgccucccccgaggagcccggcgagcccgcccccgucccccccggcuucggcgccgucuacggcgagcccgaccucguccucgaggucuccggccgccgccuccgcgcccacaaggccguccucgccgcccgcuccgacuacuuccgcgcccgcgccucccgcgacguccuccgcguccagggcgucucccucaccgcccuccgccuccuccucgccgacgccuacuccggccgcauggccggcguccgccccgacaacgucgccgaggucgucgccggcgcccgccgccuccagcuccccggcgccgcccagcgcgccaccgacgccgucggcccccagcucucccucgccaacugcuacgagguccucuccgccgccaagcgccagcgccucaacgagcuccgcgacgccgccuacugcuucauguccgaccacuaccucgagguccuccgcgagcccgccgucuucggccgccucuccggcgccgagcgcgaccuccuccuccgccgccgccuccgcgccggccgcgcccaccuccucgccgccgcccucggccccgccggcgagcgcgccggcucccgcccccagucccccuccggcgacgccgacgcccgcggcgacgccgccgucuacugcuuccacgccgccgccggcgaguggcgcgagcucacccgccuccccgagggcgcccccgcccgcggcugcggccucugcguccucuacaacuaccucuucgucgccggcggcgucgcccccgccggccccgacggccgcgcccgccccuccgaccaggucuucugcuacaaccccgccaccgacuccugguccgccguccgcccccuccgccaggcccgcucccagcuccgccuccucgcccucgacggccaccucuacgccgucggcggcgagugccuccucuccgucgagcgcuacgacccccgcgccgaccgcugggcccccgucgccccccucccccgcggcgccuucgccgucgcccacgaggccaccaccugccacggcgagaucuacgucuccggcggcucccucuucuaccgccuccucaaguacgacccccgccgcgacgaguggcaggagugccccugcuccuccucccgcgagcgcuccgccgacauggucgcccucgacggcuucaucuaccgcuucgaccucuccggcucccgcggcgaggcccaggccgccggccccuccggcgucuccgucucccgcuaccacugccucgccaagcaguggucccccugcgucgccccccuccgccuccccggcggccccaccggccuccagcccuuccgcugcgccgcccucgacggcgccaucuacugcgucucccgcgccggcaccuggcgcuuccagcccgcccgcgagggcgaggccggcggcgacgccggccagggcggcggcuucgaggcccucggcgccccccucgacguccgcggcguccucauccccuucgcccucucccuccccgagaagcccccccgcggcgagcagggcgcccccuga

SEQ ID NO: 44877 - RNA, 1377 nt, Artificial Sequence
  derived and/or modified sequence opt2 from KBTBD13__Homo_sapiens__NP_001094832
auggcccgcggcccccagacccucguccaggucugggucggcggccagcucuuccaggccgaccgcgcccuccucgucgagcacugcggcuucuuccgcggccucuuccgcuccggcaugcgcgagacccgcgccgccgagguccgccucggcguccucuccgccggcggcuuccgcgccacccuccagguccuccgcggcgaccgccccgcccucgccgccgaggacgagcuccuccaggccgucgagugcgccgccuuccuccaggcccccgcccucgcccgcuuccucgagcacaaccucaccuccgacaacugcgcccuccucugcgacgccgccgccgccuucggccuccgcgacgucuuccacuccgccgcccucuucaucugcgacggcgagcgcgagcucgccgccgagcucgcccuccccgaggcccgcgccuacgucgccgcccuccgccccuccuccuacgccgccgucuccacccacacccccgcccccggcuuccucgaggacgccucccgcacccucugcuaccucgacgaggaggaggacgccuggcgcacccucgccgcccucccccucgaggccuccacccuccucgccggcgucgccacccucggcaacaagcucuacaucgucggcggcguccgcggcgccuccaaggaggucgucgagcucggcuucugcuacgaccccgacggcggcaccuggcacgaguuccccuccccccaccagccccgcuacgacaccgcccucgccggcuucgacggccgccucuacgccaucggcggcgaguuccagcgcacccccaucuccuccgucgagcgcuacgaccccgccgccggcugcugguccuucgucgccgaccucccccagcccgccgccggcguccccugcgcccaggccugcggccgccucuucgucugccucuggcgccccgccgacaccaccgccgucgucgaguacgccguccgcaccgacgccuggcuccccgucgccgagcuccgccgcccccaguccuacggccacugcauggucgcccaccgcgacucccucuacgucguccgcaacggccccuccgacgacuuccuccacugcgccaucgacugccucaaccucgccaccggccaguggaccgcccuccccggccaguucgucaacuccaagggcgcccucuucaccgccgucguccgcggcgacaccgucuacaccgucaaccgcauguucacccuccucuacgccaucgagggcggcaccuggcgccuccuccgcgagaaggccggcuucccccgccccggcucccuccagaccuuccuccuccgccucccccccggcgcccccggccccgucaccuccaccaccgccgagcucuga

SEQ ID NO: 44878 - RNA, 1806 nt, Artificial Sequence
  derived and/or modified sequence opt2 from KBTBD8__Homo_sapiens__NP_115894
auggccgccuccgccgaccucuccaaguccucccccacccccaacggcauccccuccuccgaccccgccuccgacgccauggaccccuuccacgccugcuccauccucaagcagcucaagaccauguacgacgagggccagcucaccgacaucgucgucgaggucgaccacggcaagaccuucuccugccaccgcaacguccucgccgccaucucccccuacuuccgcuccauguucaccuccggccucaccgaguccacccagaaggagguccgcaucgucggcgucgaggccgaguccauggaccucguccucaacuacgccuacaccucccgcgucauccucaccgaggccaacguccaggcccucuucaccgccgccuccaucuuccagauccccuccauccaggaccagugcgccaaguacaugaucucccaccucgacccccagaacuccaucggcgucuucaucuucgccgaccacuacggccaccaggagcucggcgaccgcuccaaggaguacauccgcaagaaguuccucugcgucaccaaggagcaggaguuccuccagcucaccaaggaccagcucaucuccauccucgacuccgacgaccucaacgucgaccgcgaggagcacgucuacgaguccaucauccgcugguucgagcacgagcagaacgagcgcgagguccaccuccccgagaucuucgccaagugcauccgcuucccccucauggaggacaccuucaucgagaagauccccccccaguucgcccaggccaucgccaaguccugcgucgagaagggccccuccaacaccaacggcugcacccagcgccucggcaugaccgccuccgagaugaucaucugcuucgacgccgcccacaagcacuccggcaagaagcagaccguccccugccucgacaucgucaccggccgcgucuucaagcucugcaagccccccaacgaccuccgcgaggucggcauccucgucucccccgacaacgacaucuacaucgccggcggcuaccgccccuccuccuccgaggucuccaucgaccacaaggccgagaacgacuucuggauguacgaccacuccaccaaccgcuggcucuccaagcccucccuccuccgcgcccgcaucggcugcaagcucgucuacugcugcggcaagauguacgccaucggcggccgcgucuacgagggcgacggccgcaacucccucaaguccgucgagugcuacgacucccgcgagaacugcuggaccaccgucugcgccaugcccgucgccauggaguuccacaacgccgucgaguacaaggagaagaucuacguccuccagggcgaguucuuccucuucuacgagccccagaaggacuacuggggcuuccucacccccaugaccgucccccgcauccagggccucgccgccgucuacaaggacuccaucuacuacaucgccggcaccugcggcaaccaccagcgcauguucaccgucgaggccuacgacaucgagcucaacaaguggacccgcaagaaggacuuccccugcgaccaguccaucaaccccuaccucaagcucguccucuuccagaacaagcuccaccucuucguccgcgccacccaggucaccgucgaggagcacgucuuccgcaccucccgcaagaacucccucuaccaguacgacgacaucgccgaccaguggaugaaggucuacgagacccccgaccgccucugggaccucggccgccacuucgagugcgccgucgccaagcucuacccccagugccuccagaagguccucuga

SEQ ID NO: 44879 - RNA, 1146 nt, Artificial Sequence
  derived and/or modified sequence opt2 from KCMF1__Homo_sapiens__NP_064507
augucccgccacgagggcgucuccugcgacgccugccucaagggcaacuuccgcggccgccgcuacaagugccucaucugcuacgacuacgaccucugcgccuccugcuacgaguccggcgccaccaccacccgccacaccaccgaccaccccaugcagugcauccucacccgcgucgacuucgaccucuacuacggcggcgaggccuucuccgucgagcagccccaguccuucaccugccccuacugcggcaagaugggcuacaccgagaccucccuccaggagcacgucaccuccgagcacgccgagaccuccaccgaggucaucugccccaucugcgccgcccuccccggcggcgaccccaaccacgucaccgacgacuucgccgcccaccucacccucgagcaccgcgccccccgcgaccucgacgaguccuccggcguccgccacguccgccgcauguuccaccccggccgcggccucggcggcccccgcgcccgccgcuccaacaugcacuucaccuccuccuccaccggcggccucuccuccucccaguccuccuacucccccuccaaccgcgaggccauggaccccaucgccgagcuccucucccagcucuccggcguccgccgcuccgccggcggccagcucaacuccuccggccccuccgccucccagcuccagcagcuccagaugcagcuccagcucgagcgccagcacgcccaggccgcccgccagcagcucgagaccgcccgcaacgccacccgccgcaccaacaccuccuccgucaccaccaccaucacccaguccaccgccaccaccaacaucgccaacaccgaguccucccagcagacccuccagaacucccaguuccuccucacccgccucaacgaccccaagauguccgagaccgagcgccaguccauggaguccgagcgcgccgaccgcucccucuucguccaggagcuccuccucuccacccucguccgcgaggaguccuccuccuccgacgaggacgaccgcggcgagauggccgacuucggcgccaugggcugcgucgacaucaugccccucgacgucgcccucgagaaccucaaccucaaggaguccaacaagggcaacgagccccccccccccccccucuga

SEQ ID NO: 44880 - RNA, 1488 nt, Artificial Sequence
  derived and/or modified sequence opt2 from KCNA1__Homo_sapiens__NP_000208
augaccgucauguccggcgagaacgucgacgaggccuccgccgcccccggccacccccaggacggcuccuacccccgccaggccgaccacgacgaccacgagugcugcgagcgcgucgucaucaacaucuccggccuccgcuucgagacccagcucaagacccucgcccaguuccccaacacccuccucggcaaccccaagaagcgcaugcgcuacuucgacccccuccgcaacgaguacuucuucgaccgcaaccgccccuccuucgacgccauccucuacuacuaccaguccggcggccgccuccgccgccccgucaacgucccccucgacauguucuccgaggagaucaaguucuacgagcucggcgaggaggccauggagaaguuccgcgaggacgagggcuucaucaaggaggaggagcgcccccuccccgagaaggaguaccagcgccaggucuggcuccucuucgaguaccccgaguccuccggccccgcccgcgucaucgccaucgucuccgucauggucauccucaucuccaucgucaucuucugccucgagacccuccccgagcucaaggacgacaaggacuucaccggcaccguccaccgcaucgacaacaccaccgucaucuacaacuccaacaucuucaccgaccccuucuucaucgucgagacccucugcaucaucugguucuccuucgagcucgucguccgcuucuucgccugccccuccaagaccgacuucuucaagaacaucaugaacuucaucgacaucgucgccaucauccccuacuucaucacccucggcaccgagaucgccgagcaggagggcaaccagaagggcgagcaggccaccucccucgccauccuccgcgucauccgccucguccgcgucuuccgcaucuucaagcucucccgccacuccaagggccuccagauccucggccagacccucaaggccuccaugcgcgagcucggccuccucaucuucuuccucuucaucggcgucauccucuucuccuccgccgucuacuucgccgaggccgaggaggccgagucccacuucuccuccauccccgacgccuucuggugggccgucgucuccaugaccaccgucggcuacggcgacauguaccccgucaccaucggcggcaagaucgucggcucccucugcgccaucgccggcguccucaccaucgcccuccccguccccgucaucgucuccaacuucaacuacuucuaccaccgcgagaccgagggcgaggagcaggcccagcuccuccacgucuccucccccaaccucgccuccgacuccgaccucucccgccgcuccuccuccaccauguccaaguccgaguacauggagaucgaggaggacaugaacaacuccaucgcccacuaccgccaggucaacauccgcaccgccaacugcaccaccgccaaccagaacugcgucaacaaguccaagcuccucaccgacgucuga

SEQ ID NO: 44881 - RNA, 1962 nt, Artificial Sequence
  derived and/or modified sequence opt2 from KCNA4__Homo_sapiens__NP_002224
auggaggucgccauggucuccgccgaguccuccggcugcaacucccacaugcccuacggcuacgccgcccaggcccgcgcccgcgagcgcgagcgccucgcccacucccgcgccgccgccgccgccgccgucgccgccgccaccgccgccgucgagggcuccggcggcuccggcggcggcucccaccaccaccaccagucccgcggcgccugcaccucccacgacccccaguccucccgcggcucccgccgccgccgccgccagcgcuccgagaagaagaaggcccacuaccgccaguccuccuucccccacugcuccgaccucaugcccuccggcuccgaggagaagauccuccgcgagcucuccgaggaggaggaggacgaggaggaggaggaggaggaggaggaggagggccgcuucuacuacuccgaggacgaccacggcgacgagugcuccuacaccgaccuccucccccaggacgagggcggcggcggcuacuccuccguccgcuacuccgacugcugcgagcgcgucgucaucaacgucuccggccuccgcuucgagacccagaugaagacccucgcccaguuccccgagacccuccucggcgaccccgagaagcgcacccaguacuucgacccccuccgcaacgaguacuucuucgaccgcaaccgccccuccuucgacgccauccucuacuacuaccaguccggcggccgccucaagcgccccgucaacguccccuucgacaucuucaccgaggaggucaaguucuaccagcucggcgaggaggcccuccucaaguuccgcgaggacgagggcuucguccgcgaggaggaggaccgcgcccuccccgagaacgaguucaagaagcagaucuggcuccucuucgaguaccccgaguccuccucccccgcccgcggcaucgccaucgucuccguccucgucauccucaucuccaucgucaucuucugccucgagacccuccccgaguuccgcgacgaccgcgaccucgucauggcccucuccgccggcggccacggcggccuccucaacgacaccuccgccccccaccucgagaacuccggccacaccaucuucaacgaccccuucuucaucgucgagaccgucugcaucgucugguucuccuucgaguucgucguccgcugcuucgccugccccucccaggcccucuucuucaagaacaucaugaacaucaucgacaucgucuccauccuccccuacuucaucacccucggcaccgaccucgcccagcagcagggcggcggcaacggccagcagcagcaggccauguccuucgccauccuccgcaucauccgccucguccgcgucuuccgcaucuucaagcucucccgccacuccaagggccuccagauccucggccacacccuccgcgccuccaugcgcgagcucggccuccucaucuucuuccucuucaucggcgucauccucuucuccuccgccgucuacuucgccgaggccgacgagcccaccacccacuuccaguccauccccgacgccuucuggugggccgucgucaccaugaccaccgucggcuacggcgacaugaagcccaucaccgucggcggcaagaucgucggcucccucugcgccaucgccggcguccucaccaucgcccuccccguccccgucaucgucuccaacuucaacuacuucuaccaccgcgagaccgagaacgaggagcagacccagcucacccagaacgccgucuccugccccuaccuccccuccaaccuccucaagaaguuccgcuccuccaccuccuccucccucggcgacaaguccgaguaccucgagauggaggagggcgucaaggagucccucugcgccaaggaggagaagugccagggcaagggcgacgacuccgagaccgacaagaacaacugcuccaacgccaaggccgucgagaccgacgucuga

SEQ ID NO: 44882 - RNA, 1842 nt, Artificial Sequence
  derived and/or modified sequence opt2 from KCNA5__Homo_sapiens__NP_002225
auggagaucgcccucgucccccucgagaacggcggcgccaugaccguccgcggcggcgacgaggcccgcgccggcugcggccaggccaccggcggcgagcuccagugcccccccaccgccggccucuccgacggccccaaggagcccgcccccaagggccgcggcgcccagcgcgacgccgacuccggcguccgcccccuccccccccuccccgaccccggcguccgcccccuccccccccuccccgaggagcucccccgcccccgccgccccccccccgaggacgaggaggaggagggcgaccccggccucggcaccgucgaggaccaggcccucggcaccgccucccuccaccaccagcgcguccacaucaacaucuccggccuccgcuucgagacccagcucggcacccucgcccaguuccccaacacccuccucggcgaccccgccaagcgccuccgcuacuucgacccccuccgcaacgaguacuucuucgaccgcaaccgccccuccuucgacggcauccucuacuacuaccaguccggcggccgccuccgccgccccgucaacgucucccucgacgucuucgccgacgagauccgcuucuaccagcucggcgacgaggccauggagcgcuuccgcgaggacgagggcuucaucaaggaggaggagaagccccucccccgcaacgaguuccagcgccaggucuggcucaucuucgaguaccccgaguccuccggcuccgcccgcgccaucgccaucgucuccguccucgucauccucaucuccaucaucaccuucugccucgagacccuccccgaguuccgcgacgagcgcgagcuccuccgccacccccccgccccccaccagccccccgcccccgcccccggcgccaacggcuccggcgucauggccccccccuccggccccaccgucgccccccuccucccccgcacccucgccgaccccuucuucaucgucgagaccaccugcgucaucugguucaccuucgagcuccucguccgcuucuucgccugccccuccaaggccggcuucucccgcaacaucaugaacaucaucgacgucgucgccaucuuccccuacuucaucacccucggcaccgagcucgccgagcagcagcccggcggcggcggcggcggccagaacggccagcaggccaugucccucgccauccuccgcgucauccgccucguccgcgucuuccgcaucuucaagcucucccgccacuccaagggccuccagauccucggcaagacccuccaggccuccaugcgcgagcucggccuccucaucuucuuccucuucaucggcgucauccucuucuccuccgccgucuacuucgccgaggccgacaaccagggcacccacuucuccuccauccccgacgccuucuggugggccgucgucaccaugaccaccgucggcuacggcgacaugcgccccaucaccgucggcggcaagaucgucggcucccucugcgccaucgccggcguccucaccaucgcccuccccguccccgucaucgucuccaacuucaacuacuucuaccaccgcgagaccgaccacgaggagcccgccguccucaaggaggagcagggcacccagucccagggccccggccucgaccgcggcguccagcgcaaggucuccggcucccgcggcuccuucugcaaggccggcggcacccucgagaacgccgacuccgcccgccgcggcuccugcccccucgagaagugcaacgucaaggccaaguccaacgucgaccuccgccgcucccucuacgcccucugccucgacaccucccgcgagaccgaccucuga

SEQ ID NO: 44883 - RNA, 1590 nt, Artificial Sequence
  derived and/or modified sequence opt2 from KCNA6__Homo_sapiens__XP_011519257
augcgcuccgagaagucccucacccucgccgcccccggcgagguccgcggccccgagggcgagcagcaggacgccggcgacuuccccgaggccggcggcggcggcggcugcugcuccuccgagcgccucgucaucaacaucuccggccuccgcuucgagacccagcuccgcacccucucccucuuccccgacacccuccucggcgaccccggccgccgcguccgcuucuucgacccccuccgcaacgaguacuucuucgaccgcaaccgccccuccuucgacgccauccucuacuacuaccaguccggcggccgccuccgccgccccgucaacgucccccucgacaucuuccucgaggagauccgcuucuaccagcucggcgacgaggcccucgccgccuuccgcgaggacgagggcugccuccccgagggcggcgaggacgagaagccccuccccucccagcccuuccagcgccaggucuggcuccucuucgaguaccccgaguccuccggccccgcccgcggcaucgccaucgucuccguccucgucauccucaucuccaucgucaucuucugccucgagacccucccccaguuccgcgucgacggccgcggcggcaacaacggcggcgucucccgcgucucccccgucucccgcggcucccaggaggaggaggaggacgaggacgacuccuacaccuuccaccacggcaucacccccggcgagaugggcaccggcggcuccuccucccucuccacccucggcggcuccuucuucaccgaccccuucuuccucgucgagacccucugcaucgucugguucaccuucgagcuccucguccgcuucuccgccugccccuccaagcccgccuucuuccgcaacaucaugaacaucaucgaccucgucgccaucuuccccuacuucaucacccucggcaccgagcucguccagcagcaggagcagcagcccgccuccggcggcggcggccagaacggccagcaggccaugucccucgccauccuccgcgucauccgccucguccgcgucuuccgcaucuucaagcucucccgccacuccaagggccuccagauccucggcaagacccuccaggccuccaugcgcgagcucggccuccucaucuucuuccucuucaucggcgucauccucuucuccuccgccgucuacuucgccgaggccgacgacgacgacucccucuuccccuccauccccgacgccuucuggugggccgucgucaccaugaccaccgucggcuacggcgacauguaccccaugaccgucggcggcaagaucgucggcucccucugcgccaucgccggcguccucaccaucgcccuccccguccccgucaucgucuccaacuucaacuacuucuaccaccgcgagaccgagcaggaggagcagggccaguacacccacgucaccugcggccagcccgcccccgaccuccgcgccaccgacaacggccucggcaagcccgacuuccccgaggccaaccgcgagcgccgccccuccuaccuccccaccccccaccgcgccuacgccgagaagcgcaugcucaccgaggucuga

SEQ ID NO: 44884 - RNA, 1371 nt, Artificial Sequence
  derived and/or modified sequence opt2 from KCNA7__Homo_sapiens__NP_114092
auggagccccgcugccccccccccugcggcugcugcgagcgccucguccucaacgucgccggccuccgcuucgagacccgcgcccgcacccucggccgcuuccccgacacccuccucggcgaccccgcccgccgcggccgcuucuacgacgacgcccgccgcgaguacuucuucgaccgccaccgccccuccuucgacgccguccucuacuacuaccaguccggcggccgccuccgccgccccgcccacgucccccucgacgucuuccucgaggaggucgccuucuacggccucggcgccgccgcccucgcccgccuccgcgaggacgagggcugccccgucccccccgagcgcccccucccccgccgcgccuucgcccgccagcucuggcuccucuucgaguuccccgaguccucccaggccgcccgcguccucgccgucgucuccguccucgucauccucgucuccaucgucgucuucugccucgagacccuccccgacuuccgcgacgaccgcgacggcaccggccucgccgccgccgccgccgccggccccuuccccgccccccucaacggcuccucccagaugcccggcaaccccccccgccuccccuucaacgaccccuucuucgucgucgagacccucugcaucugcugguucuccuucgagcuccucguccgccuccucgucugccccuccaaggccaucuucuucaagaacgucaugaaccucaucgacuucgucgccauccuccccuacuucgucgcccucggcaccgagcucgcccgccagcgcggcgucggccagcaggccaugucccucgccauccuccgcgucauccgccucguccgcgucuuccgcaucuucaagcucucccgccacuccaagggccuccagauccucggccagacccuccgcgccuccaugcgcgagcucggccuccucaucuucuuccucuucaucggcgucguccucuucuccuccgccgucuacuucgccgaggucgaccgcgucgacucccacuucaccuccauccccgaguccuucuggugggccgucgucaccaugaccaccgucggcuacggcgacauggcccccgucaccgucggcggcaagaucgucggcucccucugcgccaucgccggcguccucaccaucucccuccccguccccgucaucgucuccaacuucuccuacuucuaccaccgcgagaccgagggcgaggaggccggcauguucucccacgucgacaugcagcccugcggcccccucgagggcaaggccaacggcggccucgucgacggcgagguccccgagcucccccccccccucugggccccccccggcaagcaccucgucaccgaggucuga

SEQ ID NO: 44885 - RNA, 1227 nt, Artificial Sequence
  derived and/or modified sequence opt2 from KCNAB1__Homo_sapiens__NP_003462
augcaccucuacaagcccgccugcgccgacauccccucccccaagcucggccuccccaaguccuccgaguccgcccucaagugccgcuggcaccucgccgucaccaagacccagccccaggccgccugcaagcccguccgccccuccggcgccgccgagcagaaguacgucgagaaguuccuccgcguccacggcaucucccuccaggagaccacccgcgccgagaccggcauggccuaccgcaaccucggcaaguccggccuccgcgucuccugccucggccucggcaccugggucaccuucggcggccagaucuccgacgaggucgccgagcgccucaugaccaucgccuacgaguccggcgucaaccucuucgacaccgccgaggucuacgccgccggcaaggccgaggucauccucggcuccaucaucaagaagaagggcuggcgccgcuccucccucgucaucaccaccaagcucuacuggggcggcaaggccgagaccgagcgcggccucucccgcaagcacaucaucgagggccucaagggcucccuccagcgccuccagcucgaguacgucgacgucgucuucgccaaccgccccgacuccaacacccccauggaggagaucguccgcgccaugacccacgucaucaaccagggcauggccauguacuggggcaccucccgcugguccgccauggagaucauggaggccuacuccgucgcccgccaguucaacaugaucccccccgucugcgagcaggccgaguaccaccucuuccagcgcgagaaggucgagguccagcuccccgagcucuaccacaagaucggcgucggcgccaugaccugguccccccucgccugcggcaucaucuccggcaaguacggcaacggcguccccgaguccucccgcgccucccucaagugcuaccaguggcucaaggagcgcaucgucuccgaggagggccgcaagcagcagaacaagcucaaggaccucucccccaucgccgagcgccucggcugcacccucccccagcucgccgucgccuggugccuccgcaacgagggcgucuccuccguccuccucggcuccuccacccccgagcagcucaucgagaaccucggcgccauccagguccuccccaagaugaccucccacgucgucaacgagaucgacaacauccuccgcaacaagcccuacuccaagaaggacuaccgcuccuga

SEQ ID NO: 44886 - RNA, 1203 nt, Artificial Sequence
  derived and/or modified sequence opt2 from KCNAB2__Homo_sapiens__XP_011540622
augcucuccaugaccuacuccgagucccuccgcuccgucuccucccgcugccacuccgagugggcccuccaccccguccgccagaccgacacccucgagcuccagcgccuccgcgagguccgcgccgccgcccaggcccgcaacauggaguccuuccuccgcaugcacggccucucccucgacggcugcaccgcccagcgcaccggcaugaaguaccgcaaccucggcaaguccggccuccgcgucuccugccucggccucggcaccugggucaccuucggcggccagaucaccgacgagauggccgagcagcucaugacccucgccuacgacaacggcaucaaccucuucgacaccgccgaggucuacgccgccggcaaggccgaggucguccucggcaacaucaucaagaagaagggcuggcgccgcuccucccucgucaucaccaccaagaucuucuggggcggcaaggccgagaccgagcgcggccucucccgcaagcacaucaucgagggccucaaggccucccucgagcgccuccagcucgaguacgucgacgucgucuucgccaaccgccccgaccccaacacccccauggaggagaccguccgcgccaugacccacgucaucaaccagggcauggccauguacuggggcaccucccgcugguccuccauggagaucauggaggccuacuccgucgcccgccaguucaaccucaccccccccaucugcgagcaggccgaguaccacauguuccagcgcgagaaggucgagguccagcuccccgagcucuuccacaagaucggcgucggcgccaugaccugguccccccucgccugcggcaucgucuccggcaaguacgacuccggcaucccccccuacucccgcgccucccucaagggcuaccaguggcucaaggacaagauccucuccgaggagggccgccgccagcaggccaagcucaaggagcuccaggccaucgccgagcgccucggcugcacccucccccagcucgccaucgccuggugccuccgcaacgagggcgucuccuccguccuccucggcgccuccaacgccgaccagcucauggagaacaucggcgccauccagguccuccccaagcucuccuccuccaucauccacgagaucgacuccauccucggcaacaagcccuacuccaagaaggacuaccgcuccuga

SEQ ID NO: 44887 - RNA, 1215 nt, Artificial Sequence
  derived and/or modified sequence opt2 from KCNAB3__Homo_sapiens__NP_004723
augcaggucuccaucgccugcaccgagcagaaccuccgcucccgcuccuccgaggaccgccucugcggcccccgccccggccccggcggcggcaacggcggccccgccggcggcggccacggcaacccccccggcggcggcggcuccggccccaaggcccgcgccgcccucgucccccgcccccccgcccccgccggcgcccuccgcgaguccaccggccgcggcaccggcaugaaguaccgcaaccucggcaaguccggccuccgcgucuccugccucggccucggcaccugggucaccuucggcucccagaucuccgacgagaccgccgaggacguccucaccgucgccuacgagcacggcgucaaccucuucgacaccgccgaggucuacgccgccggcaaggccgagcgcacccucggcaacauccucaaguccaagggcuggcgccgcuccuccuacgucaucaccaccaagaucuucuggggcggccaggccgagaccgagcgcggccucucccgcaagcacaucaucgagggccuccgcggcucccucgagcgccuccagcucggcuacgucgacaucgucuucgccaaccgcuccgaccccaacugccccauggaggagaucguccgcgccaugaccuacgucaucaaccagggccucgcccucuacuggggcaccucccgcuggggcgccgccgagaucauggaggccuacuccauggcccgccaguucaaccucaucccccccgucugcgagcaggccgagcaccaccucuuccagcgcgagaaggucgagaugcagcuccccgagcucuaccacaagaucggcgucggcuccgucaccugguacccccucgccugcggccucaucaccuccaaguacgacggccgcguccccgacaccugccgcgccuccaucaagggcuaccaguggcucaaggacaagguccaguccgaggacggcaagaagcagcaggccaaggucauggaccuccuccccgucgcccaccagcucggcugcaccgucgcccagcucgccaucgccuggugccuccgcuccgagggcgucuccuccguccuccucggcgucuccuccgccgagcagcucaucgagcaccucggcgcccuccagguccucucccagcucaccccccagaccgucauggagaucgacggccuccucggcaacaagccccacuccaagaaguga

SEQ ID NO: 44888 - RNA, 2577 nt, Artificial Sequence
  derived and/or modified sequence opt2 from KCNB1__Homo_sapiens__XP_011527101
augcccgccggcaugaccaagcacggcucccgcuccaccuccucccucccccccgagcccauggagaucguccgcuccaaggccugcucccgccgcguccgccucaacgucggcggccucgcccacgagguccucuggcgcacccucgaccgccucccccgcacccgccucggcaagcuccgcgacugcaacacccacgacucccuccucgaggucugcgacgacuacucccucgacgacaacgaguacuucuucgaccgccaccccggcgccuucaccuccauccucaacuucuaccgcaccggccgccuccacaugauggaggagaugugcgcccucuccuucucccaggagcucgacuacuggggcaucgacgagaucuaccucgaguccugcugccaggcccgcuaccaccagaagaaggagcagaugaacgaggagcucaagcgcgaggccgagacccuccgcgagcgcgagggcgaggaguucgacaacaccugcugcgccgagaagcgcaagaagcucugggaccuccucgagaagcccaacuccuccgucgccgccaagauccucgccaucaucuccaucauguucaucguccucuccaccaucgcccucucccucaacacccuccccgagcuccagucccucgacgaguucggccaguccaccgacaacccccagcucgcccacgucgaggccgucugcaucgccugguucaccauggaguaccuccuccgcuuccucuccucccccaagaaguggaaguucuucaagggcccccucaacgccaucgaccuccucgccauccuccccuacuacgucaccaucuuccucaccgaguccaacaaguccguccuccaguuccagaacguccgccgcgucguccagaucuuccgcaucaugcgcauccuccgcauccucaagcucgcccgccacuccaccggccuccagucccucggcuucacccuccgccgcuccuacaacgagcucggccuccucauccucuuccucgccaugggcaucaugaucuucuccucccucgucuucuucgccgagaaggacgaggacgacaccaaguucaaguccauccccgccuccuucuggugggccaccaucaccaugaccaccgucggcuacggcgacaucuaccccaagacccuccucggcaagaucgucggcggccucugcugcaucgccggcguccucgucaucgcccuccccauccccaucaucgucaacaacuucuccgaguucuacaaggagcagaagcgccaggagaaggccaucaagcgccgcgaggcccucgagcgcgccaagcgcaacggcuccaucgucuccaugaacaugaaggacgccuucgcccgcuccaucgagaugauggacaucgucgucgagaagaacggcgagaacaugggcaagaaggacaagguccaggacaaccaccucucccccaacaaguggaaguggaccaagcgcacccucuccgagaccuccuccuccaaguccuucgagaccaaggagcagggcucccccgagaaggcccgcuccuccuccuccccccagcaccucaacguccagcagcucgaggacauguacaacaagauggccaagacccagucccagcccauccucaacaccaaggaguccgccgcccaguccaagcccaaggaggagcucgagauggaguccauccccucccccgucgccccccuccccacccgcaccgagggcgucaucgacaugcgcuccauguccuccaucgacuccuucaucuccugcgccaccgacuuccccgaggccacccgcuucucccacuccccccucaccucccuccccuccaagaccggcggcuccaccgcccccgaggucggcuggcgcggcgcccucggcgccuccggcggccgcuucgucgaggccaaccccucccccgacgccucccagcacuccuccuucuucaucgagucccccaaguccuccaugaagaccaacaacccccucaagcuccgcgcccucaaggucaacuucauggagggcgaccccuccccccuccuccccguccucggcauguaccacgacccccuccgcaaccgcggcuccgccgccgccgccgucgccggccucgagugcgccacccuccucgacaaggccguccucucccccgaguccuccaucuacaccaccgccuccgccaagacccccccccgcucccccgagaagcacaccgccaucgccuucaacuucgaggccggcguccaccaguacaucgacgccgacaccgacgacgagggccagcuccucuacuccgucgacuccuccccccccaagucccuccccggcuccaccucccccaaguucuccaccggcacccgcuccgagaagaaccacuucgaguccuccccccuccccaccucccccaaguuccuccgccagaacugcaucuacuccaccgaggcccucaccggcaagggccccuccggccaggagaagugcaagcucgagaaccacaucucccccgacguccgcguccuccccggcggcggcgcccacggcuccacccgcgaccaguccaucuga

SEQ ID NO: 44889 - RNA, 2736 nt, Artificial Sequence
  derived and/or modified sequence opt2 from KCNB2__Homo_sapiens__NP_004761
auggccgagaaggccccccccggccucaaccgcaagaccucccgcuccacccucucccucccccccgagcccgucgacaucauccgcuccaagaccugcucccgccgcgucaagaucaacgucggcggccucaaccacgagguccucuggcgcacccucgaccgccucccccgcacccgccucggcaagcuccgcgacugcaacacccacgagucccuccucgaggucugcgacgacuacaaccucaacgagaacgaguacuucuucgaccgccaccccggcgccuucaccuccauccucaacuucuaccgcaccggcaagcuccacaugauggaggagaugugcgcccucuccuucggccaggagcucgacuacuggggcaucgacgagaucuaccucgaguccugcugccaggcccgcuaccaccagaagaaggagcagaugaacgaggagcuccgccgcgaggccgagaccaugcgcgagcgcgagggcgaggaguucgacaacaccugcugccccgacaagcgcaagaagcucugggaccuccucgagaagcccaacuccuccgucgccgccaagauccucgccaucgucuccauccucuucaucguccucuccaccaucgcccucucccucaacacccuccccgagcuccaggagaccgacgaguucggccagcucaacgacaaccgccagcucgcccacgucgaggccgucugcaucgccugguucaccauggaguaccuccuccgcuuccucuccucccccaacaaguggaaguucuucaagggcccccucaacgucaucgaccuccucgccauccuccccuacuacgucaccaucuuccucaccgaguccaacaaguccguccuccaguuccagaacguccgccgcgucguccagaucuuccgcaucaugcgcauccuccgcauccucaagcucgcccgccacuccaccggccuccagucccucggcuucacccuccgccgcuccuacaacgagcucggccuccucauccucuuccucgccaugggcaucaugaucuucuccucccucgucuucuucgccgagaaggacgaggacgccaccaaguucaccuccauccccgccuccuucuggugggccaccaucaccaugaccaccgucggcuacggcgacaucuaccccaagacccuccucggcaagaucgucggcggccucugcugcaucgccggcguccucgucaucgcccuccccauccccaucaucgucaacaacuucuccgaguucuacaaggagcagaagcgccaggagaaggccaucaagcgccgcgaggcccucgagcgcgccaagcgcaacggcuccaucgucuccaugaaccucaaggacgccuucgcccgcuccauggagcucaucgacgucgccgucgagaaggccggcgaguccgccaacaccaaggacuccgccgacgacaaccaccucucccccucccgcuggaagugggcccgcaaggcccucuccgagaccuccuccaacaaguccuucgagaacaaguaccaggaggucucccagaaggacucccacgagcagcucaacaacaccuccuccuccuccccccagcaccucuccgcccagaagcucgagaugcucuacaacgagaucaccaagacccagccccacucccaccccaaccccgacugccaggagaagcccgagcgccccuccgccuacgaggaggagaucgagauggaggaggucgucugcccccaggagcagcucgccgucgcccagaccgaggucaucgucgacaugaaguccaccuccuccaucgacuccuucaccuccugcgccaccgacuucaccgagaccgagcgcuccccccuccccccccccuccgccucccaccuccagaugaaguuccccaccgaccuccccggcaccgaggagcaccagcgcgcccgcggcccccccuuccucacccucucccgcgagaagggccccgccgcccgcgacggcacccucgaguacgcccccgucgacaucaccgucaaccucgacgccuccggcucccagugcggccuccacuccccccuccaguccgacaacgccaccgacucccccaaguccucccucaagggcuccaacccccucaagucccgcucccucaaggucaacuucaaggagaaccgcggcuccgccccccagaccccccccuccaccgcccgcccccuccccgucaccaccgccgacuucucccucaccaccccccagcacaucuccaccauccuccucgaggagacccccucccagggcgaccgcccccuccucggcaccgaggucuccgcccccugccagggccccuccaagggccucuccccccgcuuccccaagcagaagcucuuccccuucuccucccgcgagcgccgcuccuucaccgagaucgacaccggcgacgacgaggacuuccucgagcuccccggcgcccgcgaggagaagcaggucgacuccucccccaacugcuucgccgacaagcccuccgacggccgcgacccccuccgcgaggagggcuccgucggcuccuccuccccccaggacaccggccacaacugccgccaggacaucuaccacgccgucuccgaggucaagaaggacuccucccaggagggcugcaagauggagaaccaccucuucgcccccgagauccacuccaaccccggcgacaccggcuacugccccacccgcgagaccuccauguga

SEQ ID NO: 44890 - RNA, 1758 nt, Artificial Sequence
  derived and/or modified sequence opt2 from KCNC1__Homo_sapiens__NP_001106212
augggccagggcgacgaguccgagcgcaucgucaucaacgucggcggcacccgccaccagaccuaccgcuccacccuccgcacccuccccggcacccgccucgccuggcucgccgagcccgacgcccacucccacuucgacuacgacccccgcgccgacgaguucuucuucgaccgccaccccggcgucuucgcccacauccucaacuacuaccgcaccggcaagcuccacugccccgccgacgucugcggcccccucuacgaggaggagcucgccuucuggggcaucgacgagaccgacgucgagcccugcugcuggaugaccuaccgccagcaccgcgacgccgaggaggcccucgacuccuucggcggcgccccccucgacaacuccgccgacgacgccgacgccgacggccccggcgacuccggcgacggcgaggacgagcucgagaugaccaagcgccucgcccucuccgacucccccgacggccgccccggcggcuucuggcgccgcuggcagccccgcaucugggcccucuucgaggaccccuacuccucccgcuacgcccgcuacgucgccuucgccucccucuucuucauccucgucuccaucaccaccuucugccucgagacccacgagcgcuucaaccccaucgucaacaagaccgagaucgagaacguccgcaacggcacccagguccgcuacuaccgcgaggccgagaccgaggccuuccucaccuacaucgagggcgucugcgucgucugguucaccuucgaguuccucaugcgcgucaucuucugccccaacaaggucgaguucaucaagaacucccucaacaucaucgacuucgucgccauccuccccuucuaccucgaggucggccucuccggccucuccuccaaggccgccaaggacguccucggcuuccuccgcgucguccgcuucguccgcauccuccgcaucuucaagcucacccgccacuucgucggccuccgcguccucggccacacccuccgcgccuccaccaacgaguuccuccuccucaucaucuuccucgcccucggcguccucaucuucgccaccaugaucuacuacgccgagcgcaucggcgcccagcccaacgaccccuccgccuccgagcacacccacuucaagaacauccccaucggcuucuggugggccgucgucaccaugaccacccucggcuacggcgacauguacccccagaccugguccggcaugcucgucggcgcccucugcgcccucgccggcguccucaccaucgccaugcccguccccgucaucgucaacaacuucggcauguacuacucccucgccauggccaagcagaagcuccccaagaagaagaagaagcacaucccccgccccccccagcucggcucccccaacuacugcaaguccgucgucaacuccccccaccacuccacccaguccgacaccugcccccucgcccaggaggagauccucgagaucaaccgcgccgacuccaagcucaacggcgaggucgccaaggccgcccucgccaacgaggacugcccccacaucgaccaggcccucacccccgacgagggccuccccuucacccgcuccggcacccgcgagcgcuacggccccugcuuccuccucuccaccggcgaguacgccugcccccccggcggcggcaugcgcaaggaccucugcaaggagucccccgucaucgccaaguacaugcccaccgaggccguccgcgucaccuga

SEQ ID NO: 44891 - RNA, 1890 nt, Artificial Sequence
  derived and/or modified sequence opt2 from KCNC2__Homo_sapiens__NP_001247427
augggcaagaucgagaacaacgagcgcgucauccucaacgucggcggcacccgccacgagaccuaccgcuccacccucaagacccuccccggcacccgccucgcccuccucgccuccuccgagccccccggcgacugccucaccaccgccggcgacaagcuccagcccuccccccccccccucuccccccccccccgcgcccccccccucucccccggccccggcggcugcuucgagggcggcgccggcaacugcuccucccgcggcggccgcgccuccgaccaccccggcggcggccgcgaguucuucuucgaccgccaccccggcgucuucgccuacguccucaacuacuaccgcaccggcaagcuccacugccccgccgacgucugcggcccccucuucgaggaggagcucgccuucuggggcaucgacgagaccgacgucgagcccugcugcuggaugaccuaccgccagcaccgcgacgccgaggaggcccucgacaucuucgagacccccgaccucaucggcggcgaccccggcgacgacgaggaccucgccgccaagcgccucggcaucgaggacgccgccggccucggcggccccgacggcaaguccggccgcuggcgccgccuccagccccgcaugugggcccucuucgaggaccccuacuccucccgcgccgcccgcuucaucgccuucgccucccucuucuucauccucgucuccaucaccaccuucugccucgagacccacgaggccuucaacaucgucaagaacaagaccgagcccgucaucaacggcaccuccgucguccuccaguacgagaucgagaccgaccccgcccucaccuacgucgagggcgucugcgucgucugguucaccuucgaguuccucguccgcaucgucuucucccccaacaagcucgaguucaucaagaaccuccucaacaucaucgacuucgucgccauccuccccuucuaccucgaggucggccucuccggccucuccuccaaggccgccaaggacguccucggcuuccuccgcgucguccgcuucguccgcauccuccgcaucuucaagcucacccgccacuucgucggccuccgcguccucggccacacccuccgcgccuccaccaacgaguuccuccuccucaucaucuuccucgcccucggcguccucaucuucgccaccaugaucuacuacgccgagcgcgucggcgcccagcccaacgaccccuccgccuccgagcacacccaguucaagaacauccccaucggcuucuggugggccgucgucaccaugaccacccucggcuacggcgacauguacccccagaccugguccggcaugcucgucggcgcccucugcgcccucgccggcguccucaccaucgccaugcccguccccgucaucgucaacaacuucggcauguacuacucccucgccauggccaagcagaagcucccccgcaagcgcaagaagcacaucccccccgccccccaggccuccucccccaccuucugcaagaccgagcucaacauggccugcaacuccacccaguccgacaccugccucggcaaggacaaccgccuccucgagcacaaccgcuccguccucuccggcgacgacuccaccggcuccgagcccccccucuccccccccgagcgccuccccauccgccgcuccuccacccgcgacaagaaccgccgcggcgagaccugcuuccuccucaccaccggcgacuacaccugcgccuccgacggcggcauccgcaagguccucuaccgcaucuaccacggccuccucaccgccgagaagggcaccgucgaguucucccacaccaaggacuacaccggcaaccgccuccuccuccucaacguccccuga

SEQ ID NO: 44892 - RNA, 2274 nt, Artificial Sequence
  derived and/or modified sequence opt2 from KCNC3__Homo_sapiens__XP_006723266
augcucuccuccgucugcgucuccuccuuccgcggccgccagggcgccuccaagcagcagcccgccccccccccccagccccccgaguccccccccccccccccccuccccccccagcagcagcagcccgcccagcccggccccgccgccucccccgccggcccccccgccccccgcggccccggcgaccgccgcgccgagcccugccccggccuccccgccgccgccaugggccgccacggcggcggcggcggcgacuccggcaagaucgucaucaacgucggcggcguccgccacgagaccuaccgcuccacccuccgcacccuccccggcacccgccucgccggccucaccgagcccgaggccgccgcccgcuucgacuacgaccccggcgccgacgaguucuucuucgaccgccaccccggcgucuucgccuacguccucaacuacuaccgcaccggcaagcuccacugccccgccgacgucugcggcccccucuucgaggaggagcucggcuucuggggcaucgacgagaccgacgucgaggccugcugcuggaugaccuaccgccagcaccgcgacgccgaggaggcccucgacuccuucgaggcccccgaccccgccggcgccgccaacgccgccaacgccgccggcgcccacgacggcggccucgacgacgaggccggcgccggcggcggcggccucgacggcgccggcggcgagcucaagcgccucugcuuccaggacgccggcggcggcgccggcggcccccccggcggcgccggcggcgccggcggcaccugguggcgccgcuggcagccccgcgucugggcccucuucgaggaccccuacuccucccgcgccgcccgcuacgucgccuucgccucccucuucuucauccucaucuccaucaccaccuucugccucgagacccacgagggcuucauccacaucuccaacaagaccgucacccaggccucccccauccccggcgccccccccgagaacaucaccaacgucgaggucgagaccgagcccuuccucaccuacgucgagggcgucugcgucgucugguucaccuucgaguuccucaugcgcaucaccuucugccccgacaaggucgaguuccucaaguccucccucaacaucaucgacugcgucgccauccuccccuucuaccucgaggucggccucuccggccucuccuccaaggccgccaaggacguccucggcuuccuccgcgucguccgcuucguccgcauccuccgcaucuucaagcucacccgccacuucgucggccuccgcguccucggccacacccuccgcgccuccaccaacgaguuccuccuccucaucaucuuccucgcccucggcguccucaucuucgccaccaugaucuacuacgccgagcgcaucggcgccgaccccgacgacauccucggcuccaaccacaccuacuucaagaacauccccaucggcuucuggugggccgucgucaccaugaccacccucggcuacggcgacauguaccccaagaccugguccggcaugcucgucggcgcccucugcgcccucgccggcguccucaccaucgccaugcccguccccgucaucgucaacaacuucggcauguacuacucccucgccauggccaagcagaagcuccccaagaagaagaacaagcacaucccccgccccccccagcccggcucccccaacuacugcaagcccgacccccccccccccccccccccccacccccaccacggcuccggcggcaucuccccccccccccccaucaccccccccuccaugggcgucaccgucgccggcgccuaccccgccggcccccacacccaccccggccuccuccgcggcggcgccggcggccucggcaucaugggccuccccccccuccccgcccccggcgagcccugcccccucgcccaggaggaggucaucgagaucaaccgcgccgacccccgccccaacggcgaccccgccgccgccgcccucgcccacgaggacugccccgccaucgaccagcccgccaugucccccgaggacaagucccccaucacccccggcucccgcggccgcuacucccgcgaccgcgccugcuuccuccucaccgacuacgcccccucccccgacggcuccauccgcaaggccaccggcgcccccccccuccccccccaggacuggcgcaagcccggcccccccuccuuccuccccgaccucaacgccaacgccgccgccuggaucucccccuga

SEQ ID NO: 44893 - RNA, 1893 nt, Artificial Sequence
  derived and/or modified sequence opt2 from KCND2__Homo_sapiens__NP_036413
auggccgccggcgucgccgccuggcuccccuucgcccgcgccgccgccaucggcuggaugcccgucgccuccggccccaugcccgcccccccccgccaggagcgcaagcgcacccaggacgcccucaucguccucaacgucuccggcacccgcuuccagaccuggcaggacacccucgagcgcuaccccgacacccuccucggcuccuccgagcgcgacuucuucuaccaccccgagacccagcaguacuucuucgaccgcgaccccgacaucuuccgccacauccucaacuucuaccgcaccggcaagcuccacuacccccgccacgagugcaucuccgccuacgacgaggagcucgccuucuucggccucauccccgagaucaucggcgacugcugcuacgaggaguacaaggaccgccgccgcgagaacgccgagcgccuccaggacgacgccgacaccgacaccgccggcgaguccgcccuccccaccaugaccgcccgccagcgcgucuggcgcgccuucgagaacccccacaccuccaccauggcccucgucuucuacuacgucaccggcuucuucaucgccgucuccgucaucgccaacgucgucgagaccguccccugcggcuccucccccggccacaucaaggagcuccccugcggcgagcgcuacgccgucgccuucuucugccucgacaccgccugcgucaugaucuucaccgucgaguaccuccuccgccucgccgccgcccccucccgcuaccgcuucguccgcuccgucauguccaucaucgacgucgucgccauccuccccuacuacaucggccucgucaugaccgacaacgaggacgucuccggcgccuucgucacccuccgcgucuuccgcgucuuccgcaucuucaaguucucccgccacucccagggccuccgcauccucggcuacacccucaaguccugcgccuccgagcucggcuuccuccucuucucccucaccauggccaucaucaucuucgccaccgucauguucuacgccgagaagggcuccuccgccuccaaguucaccuccauccccgccgccuucugguacaccaucgucaccaugaccacccucggcuacggcgacaugguccccaagaccaucgccggcaagaucuucggcuccaucugcucccucuccggcguccucgucaucgcccuccccguccccgucaucgucuccaacuucucccgcaucuaccaccagaaccagcgcgccgacaagcgccgcgcccagaagaaggcccgccucgcccgcauccgcgccgccaaguccggcuccgccaacgccuacaugcaguccaagcgcaacggccuccucuccaaccagcuccaguccuccgaggacgagcaggccuucgucuccaaguccggcuccuccuucgagacccagcaccaccaccuccuccacugccucgagaagaccaccaaccacgaguucgucgacgagcaggucuucgaggaguccugcauggaggucgccaccgucaaccgccccuccucccacucccccucccucuccucccagcagggcgucaccuccaccugcugcucccgccgccacaagaagaccuuccgcauccccaacgccaacgucuccggcucccaccagggcuccauccaggagcucuccaccauccagauccgcugcgucgagcgcaccccccucuccaacucccgcuccucccucaacgccaagauggaggagugcgucaagcucaacugcgagcagcccuacgucaccaccgccaucaucuccauccccaccccccccgucaccacccccgagggcgacgaccgccccgagucccccgaguacuccggcggcaacaucguccgcgucuccgcccucuga

SEQ ID NO: 44894 - RNA, 390 nt, Artificial Sequence
  derived and/or modified sequence opt2 from KCNE1__Homo_sapiens__NP_001257334
augauccucuccaacaccaccgccgucacccccuuccucaccaagcucuggcaggagaccguccagcagggcggcaacauguccggccucgcccgccgcuccccccgcuccuccgacggcaagcucgaggcccucuacguccucaugguccucggcuucuucggcuucuucacccucggcaucaugcucuccuacauccgcuccaagaagcucgagcacuccaacgaccccuucaacgucuacaucgaguccgacgccuggcaggagaaggacaaggccuacguccaggcccgcguccucgaguccuaccgcuccugcuacgucgucgagaaccaccucgccaucgagcagcccaacacccaccuccccgagaccaagcccucccccuga

SEQ ID NO: 44895 - RNA, 372 nt, Artificial Sequence
  derived and/or modified sequence opt2 from KCNE2__Homo_sapiens__NP_751951
auguccacccucuccaacuucacccagacccucgaggacgucuuccgccgcaucuucaucaccuacauggacaacuggcgccagaacaccaccgccgagcaggaggcccuccaggccaaggucgacgccgagaacuucuacuacgucauccucuaccucauggucaugaucggcauguucuccuucaucaucgucgccauccucgucuccaccgucaaguccaagcgccgcgagcacuccaacgaccccuaccaccaguacaucgucgaggacuggcaggagaaguacaagucccagauccucaaccucgaggaguccaaggccaccauccacgagaacaucggcgccgccggcuucaagaugucccccuga

SEQ ID NO: 44896 - RNA, 312 nt, Artificial Sequence
  derived and/or modified sequence opt2 from KCNE3__Homo_sapiens__NP_005463
auggagaccaccaacggcaccgagaccugguacgagucccuccacgccguccucaaggcccucaacgccacccuccacuccaaccuccucugccgccccggccccggccucggccccgacaaccagaccgaggagcgccgcgccucccuccccggccgcgacgacaacuccuacauguacauccucuucgucauguuccucuucgccgucaccgucggcucccucauccucggcuacacccgcucccgcaaggucgacaagcgcuccgaccccuaccacgucuacaucaagaaccgcgucuccaugaucuga

SEQ ID NO: 44897 - RNA, 666 nt, Artificial Sequence
  derived and/or modified sequence opt2 from KCNE4__Homo_sapiens__NP_542402
augcacuuccucaccaucuaccccaacugcuccuccggcgucguccgcgcccagucccgcaccgagcagaagaacccccucggccucgacgaccucggcauccagaaccucggccagaccgucucccucgcccccgccgucgaggccgccuccaugcucaagauggagccccucaacuccacccaccccggcaccgccgccuccuccuccccccucgagucccgcgccgccggcggcggcuccggcaacggcaacgaguacuucuacauccucgucgucauguccuucuacggcaucuuccucaucggcaucaugcucggcuacaugaaguccaagcgccgcgagaagaaguccucccuccuccuccucuacaaggacgaggagcgccucuggggcgaggccaugaagccccuccccgucgucuccggccuccgcuccguccaggucccccucaugcucaacaugcuccaggaguccgucgcccccgcccucuccugcacccucugcuccauggagggcgacuccgucuccuccgaguccuccucccccgacguccaccucaccauccaggaggagggcgccgacgacgagcucgaggagaccuccgagaccccccucaacgaguccuccgagggcuccuccgagaacauccaccagaacuccuga

SEQ ID NO: 44898 - RNA, 429 nt, Artificial Sequence
  derived and/or modified sequence opt2 from KCNE5__Homo_sapiens__NP_036414
augaacugcuccgagucccagcgccuccgcacccuccucucccgccuccuccucgagcuccaccaccgcggcaacgccuccggccucggcgccggcccccgccccuccaugggcaugggcgucguccccgaccccuucgucggccgcgaggucaccuccgccaagggcgacgacgccuaccucuacauccuccucaucaugaucuucuacgccugccucgccggcggccucauccucgccuacacccgcucccgcaagcucgucgaggccaaggacgagcccucccaggccugcgccgagcacgagugggcccccggcggcgcccucaccgccgacgccgaggccgccgccggcucccaggccgagggccgccgccagcucgccuccgagggccuccccgcccucgcccagggcgccgagcgcgucuga

SEQ ID NO: 44899 - RNA, 1311 nt, Artificial Sequence
  derived and/or modified sequence opt2 from KCNG3__Homo_sapiens__NP_579875
augaccuucggccgcuccggcgccgccuccgucguccucaacgucggcggcgcccgcuacucccucucccgcgagcuccucaaggacuucccccuccgccgcgucucccgccuccacggcugccgcuccgagcgcgacguccucgaggucugcgacgacuacgaccgcgagcgcaacgaguacuucuucgaccgccacuccgaggccuucggcuucauccuccucuacguccgcggccacggcaagcuccgcuucgccccccgcaugugcgagcucuccuucuacaacgagaugaucuacuggggccucgagggcgcccaccucgaguacugcugccagcgccgccucgacgaccgcauguccgacaccuacaccuucuacuccgccgacgagcccggcguccucggccgcgacgaggcccgccccggcggcgccgaggccgcccccucccgccgcuggcucgagcgcaugcgccgcaccuucgaggagcccaccuccucccucgccgcccagauccucgccuccgucuccgucgucuucgucaucgucuccauggucguccucugcgccuccacccuccccgacuggcgcaacgccgccgccgacaaccgcucccucgacgaccgcucccgcuacuccgccggccccggccgcgagcccuccggcaucaucgaggccaucugcaucggcugguucaccgccgagugcaucguccgcuucaucgucuccaagaacaagugcgaguucgucaagcgcccccucaacaucaucgaccuccucgccaucacccccuacuacaucuccguccucaugaccgucuucaccggcgagaacucccagcuccagcgcgccggcgucacccuccgcguccuccgcaugaugcgcaucuucugggucaucaagcucgcccgccacuucaucggccuccagacccucggccucacccucaagcgcugcuaccgcgagauggucaugcuccucgucuucaucugcgucgccauggccaucuucuccgcccucucccagcuccucgagcacggccucgaccucgagaccuccaacaaggacuucaccuccauccccgccgccugcuggugggucaucaucuccaugaccaccgucggcuacggcgacauguaccccaucaccguccccggccgcauccucggcggcgucugcgucgucuccggcaucguccuccucgcccuccccaucaccuucaucuaccacuccuucguccagugcuaccacgagcucaaguuccgcuccgcccgcuacucccgcucccucuccaccgaguuccucaacuga

SEQ ID NO: 44900 - RNA, 1560 nt, Artificial Sequence
  derived and/or modified sequence opt2 from KCNG4__Homo_sapiens__NP_758857
augcccaugcccucccgcgacggcggccuccacccccgccaccaccacuacggcucccacucccccuggucccagcuccucuccucccccauggagacccccuccaucaagggccucuacuaccgccgcguccgcaaggucggcgcccucgacgccucccccgucgaccucaagaaggagauccucaucaacgucggcggccgccgcuaccuccuccccugguccacccucgaccgcuucccccucucccgccucuccaagcuccgccucugccgcuccuacgaggagaucguccagcucugcgacgacuacgacgaggacucccaggaguucuucuucgaccgcucccccuccgccuucggcgucaucgucuccuuccucgccgccggcaagcucguccuccuccaggagaugugcgcccucuccuuccaggaggagcucgccuacuggggcaucgaggaggcccaccucgagcgcugcugccuccgcaagcuccuccgcaagcucgaggagcucgaggagcucgccaagcuccaccgcgaggacguccuccgccagcagcgcgagacccgccgccccgccucccacuccucccgcuggggccucugcaugaaccgccuccgcgagauggucgagaacccccaguccggccuccccggcaaggucuucgccugccucuccauccucuucgucgccaccaccgccgucucccucugcgucuccaccaugcccgaccuccgcgccgaggaggaccagggcgagugcucccgcaagugcuacuacaucuucaucgucgagaccaucugcgucgccugguucucccucgaguucugccuccgcuucguccaggcccaggacaagugccaguucuuccagggcccccucaacaucaucgacauccucgccaucucccccuacuacgucucccucgccgucuccgaggagccccccgaggacggcgagcgccccuccggcuccuccuaccucgagaaggucggccucguccuccgcguccuccgcgcccuccgcauccucuacgucaugcgccucgcccgccacucccucggccuccagacccucggccucaccguccgccgcugcacccgcgaguucggccuccuccuccucuuccucgccgucgccaucacccucuucuccccccucgucuacgucgccgagaaggaguccggccgcguccucgaguucaccuccauccccgccuccuacuggugggccaucaucuccaugaccaccgucggcuacggcgacauggucccccgcuccguccccggccagauggucgcccucuccuccauccucuccggcauccucaucauggccuuccccgccaccuccaucuuccacaccuucucccacuccuaccucgagcucaagaaggagcaggagcagcuccaggcccgccuccgccaccuccagaacaccggccccgccuccgagugcgagcuccucgacccccacgucgccuccgagcacgagcucaugaacgacgucaacgaccucauccucgagggccccgcccuccccaucaugcacauguga

SEQ ID NO: 44901 - RNA, 2889 nt, Artificial Sequence
  derived and/or modified sequence opt2 from KCNH1__Homo_sapiens__NP_002229
augaccauggccggcggccgccgcggccucgucgccccccagaacaccuuccucgagaacaucguccgccgcuccaacgacaccaacuucguccucggcaacgcccagaucgucgacuggcccaucgucuacuccaacgacggcuucugcaagcucuccggcuaccaccgcgccgaggucaugcagaaguccuccaccugcuccuucauguacggcgagcucaccgacaaggacaccaucgagaagguccgccagaccuucgagaacuacgagaugaacuccuucgagauccucauguacaagaagaaccgcacccccgucugguucuucgucaagaucgcccccauccgcaacgagcaggacaaggucguccucuuccucugcaccuucuccgacaucaccgccuucaagcagcccaucgaggacgacuccugcaagggcuggggcaaguucgcccgccucacccgcgcccucaccuccucccgcggcguccuccagcagcucgcccccuccguccagaagggcgagaacguccacaagcacucccgccucgccgagguccuccagcucggcuccgacauccucccccaguacaagcaggaggcccccaagacccccccccacaucauccuccacuacugcgucuucaagaccaccugggacuggaucauccucauccucaccuucuacaccgccauccucguccccuacaacgucuccuucaagacccgccagaacaacgucgccuggcucgucgucgacuccaucgucgacgucaucuuccucgucgacaucguccucaacuuccacaccaccuucgucggccccgccggcgaggucaucuccgaccccaagcucauccgcaugaacuaccucaagaccugguucgucaucgaccuccucuccugccuccccuacgacgucaucaacgccuucgagaacgucgacgagggcaucuccucccucuucuccucccucaaggucguccgccuccuccgccucggccgcgucgcccgcaagcucgaccacuacaucgaguacggcgccgccguccucguccuccucgucugcgucuucggccucgccgcccacuggauggccugcaucugguacuccaucggcgacuacgagaucuucgacgaggacaccaagaccauccgcaacaacuccuggcucuaccagcucgccauggacaucggcacccccuaccaguucaacggcuccggcuccggcaagugggagggcggccccuccaagaacuccgucuacaucuccucccucuacuucaccaugaccucccucaccuccgucggcuucggcaacaucgcccccuccaccgacaucgagaagaucuucgccgucgccaucaugaugaucggcucccuccucuacgccaccaucuucggcaacgucaccaccaucuuccagcagauguacgccaacaccaaccgcuaccacgagaugcucaacuccguccgcgacuuccucaagcucuaccagguccccaagggccucuccgagcgcgucauggacuacaucgucuccaccugguccaugucccgcggcaucgacaccgagaagguccuccagaucugccccaaggacaugcgcgccgacaucugcguccaccucaaccgcaaggucuucaaggagcaccccgccuuccgccucgccuccgacggcugccuccgcgcccucgccauggaguuccagaccguccacugcgcccccggcgaccucaucuaccacgccggcgaguccgucgacucccucugcuucgucgucuccggcucccucgaggucauccaggacgacgaggucgucgccauccucggcaagggcgacgucuucggcgacgucuucuggaaggaggccacccucgcccaguccugcgccaacguccgcgcccucaccuacugcgaccuccacgucaucaagcgcgacgcccuccagaagguccucgaguucuacaccgccuucucccacuccuucucccgcaaccucauccucaccuacaaccuccgcaagcgcaucgucuuccgcaagaucuccgacgucaagcgcgaggaggaggagcgcaugaagcgcaagaacgaggccccccucauccucccccccgaccaccccguccgccgccucuuccagcgcuuccgccagcagaaggaggcccgccucgccgccgagcgcggcggccgcgaccucgacgaccucgacgucgagaagggcaacguccucaccgagcacgccuccgccaaccacucccucgucaaggccuccgucgucaccguccgcgagucccccgccacccccgucuccuuccaggccgccuccaccuccggcguccccgaccacgccaagcuccaggcccccggcuccgagugccucggccccaagggcggcggcggcgacugcgccaagcgcaaguccugggcccgcuucaaggacgccugcggcaaguccgaggacuggaacaaggucuccaaggccgaguccauggagacccuccccgagcgcaccaaggccuccggcgaggccacccucaagaagaccgacuccugcgacuccggcaucaccaaguccgaccuccgccucgacaacgucggcgaggcccgcuccccccaggaccgcucccccauccucgccgaggucaagcacuccuucuaccccauccccgagcagacccuccaggccaccguccucgagguccgccacgagcucaaggaggacaucaaggcccucaacgccaagaugaccaacaucgagaagcagcucuccgagauccuccgcauccucaccucccgccgcuccucccaguccccccaggagcucuucgagaucucccgcccccagucccccgaguccgagcgcgacaucuucggcgccuccuga

SEQ ID NO: 44902 - RNA, 3480 nt, Artificial Sequence
  derived and/or modified sequence opt2 from KCNH2__Homo_sapiens__NP_000229
augcccguccgccgcggccacgucgccccccagaacaccuuccucgacaccaucauccgcaaguucgagggccagucccgcaaguucaucaucgccaacgcccgcgucgagaacugcgccgucaucuacugcaacgacggcuucugcgagcucugcggcuacucccgcgccgaggucaugcagcgccccugcaccugcgacuuccuccacggcccccgcacccagcgccgcgccgccgcccagaucgcccaggcccuccucggcgccgaggagcgcaaggucgagaucgccuucuaccgcaaggacggcuccugcuuccucugccucgucgacgucguccccgucaagaacgaggacggcgccgucaucauguucauccucaacuucgaggucgucauggagaaggacauggucggcucccccgcccacgacaccaaccaccgcggcccccccaccuccuggcucgcccccggccgcgccaagaccuuccgccucaagcuccccgcccuccucgcccucaccgcccgcgaguccuccguccgcuccggcggcgccggcggcgccggcgcccccggcgccgucgucgucgacgucgaccucacccccgccgcccccuccuccgagucccucgcccucgacgaggucaccgccauggacaaccacgucgccggccucggccccgccgaggagcgccgcgcccucgucggccccggcucccccccccgcuccgcccccggccagcuccccuccccccgcgcccacucccucaaccccgacgccuccggcuccuccugcucccucgcccgcacccgcucccgcgaguccugcgccuccguccgccgcgccuccuccgccgacgacaucgaggccaugcgcgccggcguccuccccccccccccccgccacgccuccaccggcgccaugcacccccuccgcuccggccuccucaacuccaccuccgacuccgaccucguccgcuaccgcaccaucuccaagaucccccagaucacccucaacuucgucgaccucaagggcgaccccuuccucgccucccccaccuccgaccgcgagaucaucgcccccaagaucaaggagcgcacccacaacgucaccgagaaggucacccagguccucucccucggcgccgacguccuccccgaguacaagcuccaggccccccgcauccaccgcuggaccauccuccacuacucccccuucaaggccgucugggacuggcucauccuccuccucgucaucuacaccgccgucuucacccccuacuccgccgccuuccuccucaaggagaccgaggagggcccccccgccaccgagugcggcuacgccugccagccccucgccgucgucgaccucaucgucgacaucauguucaucgucgacauccucaucaacuuccgcaccaccuacgucaacgccaacgaggaggucgucucccaccccggccgcaucgccguccacuacuucaagggcugguuccucaucgacauggucgccgccauccccuucgaccuccucaucuucggcuccggcuccgaggagcucaucggccuccucaagaccgcccgccuccuccgccucguccgcgucgcccgcaagcucgaccgcuacuccgaguacggcgccgccguccucuuccuccucaugugcaccuucgcccucaucgcccacuggcucgccugcaucugguacgccaucggcaacauggagcagccccacauggacucccgcaucggcuggcuccacaaccucggcgaccagaucggcaagcccuacaacuccuccggccucggcggccccuccaucaaggacaaguacgucaccgcccucuacuucaccuucuccucccucaccuccgucggcuucggcaacgucucccccaacaccaacuccgagaagaucuucuccaucugcgucaugcucaucggcucccucauguacgccuccaucuucggcaacgucuccgccaucauccagcgccucuacuccggcaccgcccgcuaccacacccagaugcuccgcguccgcgaguucauccgcuuccaccagauccccaacccccuccgccagcgccucgaggaguacuuccagcacgccugguccuacaccaacggcaucgacaugaacgccguccucaagggcuuccccgagugccuccaggccgacaucugccuccaccucaaccgcucccuccuccagcacugcaagcccuuccgcggcgccaccaagggcugccuccgcgcccucgccaugaaguucaagaccacccacgccccccccggcgacacccucguccacgccggcgaccuccucaccgcccucuacuucaucucccgcggcuccaucgagauccuccgcggcgacgucgucgucgccauccucggcaagaacgacaucuucggcgagccccucaaccucuacgcccgccccggcaaguccaacggcgacguccgcgcccucaccuacugcgaccuccacaagauccaccgcgacgaccuccucgagguccucgacauguaccccgaguucuccgaccacuucugguccucccucgagaucaccuucaaccuccgcgacaccaacaugauccccggcucccccggcuccaccgagcucgagggcggcuucucccgccagcgcaagcgcaagcucuccuuccgccgccgcaccgacaaggacaccgagcagcccggcgaggucuccgcccucggccccggccgcgccggcgccggccccuccucccgcggccgccccggcggccccuggggcgagucccccuccuccggccccuccucccccgaguccuccgaggacgagggccccggccgcuccuccuccccccuccgccucguccccuucuccuccccccgcccccccggcgagccccccggcggcgagccccucauggaggacugcgagaaguccuccgacaccugcaacccccucuccggcgccuucuccggcgucuccaacaucuucuccuucuggggcgacucccgcggccgccaguaccaggagcucccccgcugccccgcccccacccccucccuccucaacaucccccucuccucccccggccgccgcccccgcggcgacgucgagucccgccucgacgcccuccagcgccagcucaaccgccucgagacccgccucuccgccgacauggccaccguccuccagcuccuccagcgccagaugacccucgucccccccgccuacuccgccgucaccacccccggccccggccccaccuccaccuccccccuccuccccgucuccccccuccccacccucacccucgacucccucucccaggucucccaguucauggccugcgaggagcucccccccggcgcccccgagcucccccaggagggccccacccgccgccucucccuccccggccagcucggcgcccucaccucccagccccuccaccgccacggcuccgaccccggcuccuga

SEQ ID NO: 44903 - RNA, 3252 nt, Artificial Sequence
  derived and/or modified sequence opt2 from KCNH3__Homo_sapiens__NP_036416
augcccgccaugcgcggccuccucgccccccagaacaccuuccucgacaccaucgccacccgcuucgacggcacccacuccaacuucguccucggcaacgcccaggucgccggccucuuccccgucgucuacugcuccgacggcuucugcgaccucaccggcuucucccgcgccgaggucaugcagcgcggcugcgccugcuccuuccucuacggccccgacaccuccgagcucguccgccagcagauccgcaaggcccucgacgagcacaaggaguucaaggccgagcucauccucuaccgcaaguccggccuccccuucuggugccuccucgacgucauccccaucaagaacgagaagggcgaggucgcccucuuccucgucucccacaaggacaucuccgagaccaagaaccgcggcggccccgaccgcuggaaggagaccggcggcggccgccgccgcuacggccgcgcccgcuccaagggcuucaacgccaaccgccgccgcucccgcgccguccucuaccaccucuccggccaccuccagaagcagcccaagggcaagcacaagcucaacaagggcgucuucggcgagaagcccaaccuccccgaguacaaggucgccgccauccgcaagucccccuucauccuccuccacugcggcgcccuccgcgccaccugggacggcuucauccuccucgccacccucuacgucgccgucaccguccccuacuccgucugcgucuccaccgcccgcgagcccuccgccgcccgcggcccccccuccgucugcgaccucgccgucgagguccucuucauccucgacaucguccucaacuuccgcaccaccuucgucuccaaguccggccaggucgucuucgcccccaaguccaucugccuccacuacgucaccaccugguuccuccucgacgucaucgccgcccuccccuucgaccuccuccacgccuucaaggucaacgucuacuucggcgcccaccuccucaagaccguccgccuccuccgccuccuccgccuccucccccgccucgaccgcuacucccaguacuccgccgucguccucacccuccucauggccgucuucgcccuccucgcccacugggucgccugcgucugguucuacaucggccagcgcgagaucgaguccuccgaguccgagcuccccgagaucggcuggcuccaggagcucgcccgccgccucgagacccccuacuaccucgucggccgccgccccgccggcggcaacuccuccggccaguccgacaacugcuccuccuccuccgaggccaacggcaccggccucgagcuccucggcggccccucccuccgcuccgccuacaucaccucccucuacuucgcccucuccucccucaccuccgucggcuucggcaacgucuccgccaacaccgacaccgagaagaucuucuccaucugcaccaugcucaucggcgcccucaugcacgccgucgucuucggcaacgucaccgccaucauccagcgcauguacgcccgccgcuuccucuaccacucccgcacccgcgaccuccgcgacuacauccgcauccaccgcauccccaagccccucaagcagcgcaugcucgaguacuuccaggccaccugggccgucaacaacggcaucgacaccaccgagcuccuccagucccuccccgacgagcuccgcgccgacaucgccaugcaccuccacaaggagguccuccagcucccccucuucgaggccgccucccgcggcugccuccgcgcccucucccucgcccuccgccccgccuucugcacccccggcgaguaccucauccaccagggcgacgcccuccaggcccucuacuucgucugcuccggcuccauggagguccucaagggcggcaccguccucgccauccucggcaagggcgaccucaucggcugcgagcucccccgccgcgagcaggucgucaaggccaacgccgacgucaagggccucaccuacugcguccuccagugccuccagcucgccggccuccacgacucccucgcccucuaccccgaguucgccccccgcuucucccgcggccuccgcggcgagcucuccuacaaccucggcgccggcggcggcuccgccgaggucgacaccuccucccucuccggcgacaacacccucauguccacccucgaggagaaggagaccgacggcgagcagggccccaccgucucccccgcccccgccgacgagcccuccuccccccuccucucccccggcugcaccuccuccuccuccgccgccaagcuccucuccccccgccgcaccgccccccgcccccgccucggcggccgcggccgccccggccgcgccggcgcccucaaggccgaggccggccccuccgcccccccccgcgcccucgagggccuccgccucccccccaugcccuggaacgucccccccgaccucuccccccgcgucgucgacggcaucgaggacggcugcggcuccgaccagcccaaguucuccuuccgcgucggccaguccggccccgagugcuccuccucccccucccccggccccgaguccggccuccucaccgucccccacggccccuccgaggcccgcaacaccgacacccucgacaagcuccgccaggccgucaccgagcucuccgagcagguccuccagaugcgcgagggccuccagucccuccgccaggccguccagcucguccucgccccccaccgcgagggccccugcccccgcgccuccggcgagggccccugccccgccuccaccuccggccuccuccagccccucugcgucgacaccggcgccuccuccuacugccuccagccccccgccggcuccguccucuccggcaccuggccccacccccgccccggcccccccccccucauggcccccuggcccuggggcccccccgccucccaguccucccccuggccccgcgccaccgccuucuggaccuccaccuccgacuccgagccccccgccuccggcgaccucugcuccgagcccuccacccccgccucccccccccccuccgaggagggcgcccgcaccggccccgccgagcccgucucccaggccgaggccaccuccaccggcgagcccccccccggcuccggcggccucgcccuccccugggacccccacucccucgagaugguccucaucggcugccacggcuccggcaccguccaguggacccaggaggagggcaccggcgucuga

SEQ ID NO: 44904 - RNA, 3054 nt, Artificial Sequence
  derived and/or modified sequence opt2 from KCNH4__Homo_sapiens__NP_036417
augcccgucaugaagggccuccucgccccccagaacaccuuccucgacaccaucgccacccgcuucgacggcacccacuccaacuuccuccucgccaacgcccagggcacccgcggcuuccccaucgucuacugcuccgacggcuucugcgagcucaccggcuacggccgcaccgaggucaugcagaagaccugcuccugccgcuuccucuacggccccgagaccuccgagcccgcccuccagcgccuccacaaggcccucgagggccaccaggagcaccgcgccgagaucugcuucuaccgcaaggacggcuccgccuucuggugccuccucgacaugaugcccaucaagaacgagaugggcgaggucguccucuuccucuucuccuucaaggacaucacccaguccggcucccccggccucggcccccagggcggccgcggcgacuccaaccacgagaacucccucggccgccgcggcgccaccuggaaguuccgcuccgcccgccgccgcucccgcaccguccuccaccgccucaccggccacuucggccgccgcggccagggcggcaugaaggccaacaacaacgucuucgagcccaagcccuccguccccgaguacaaggucgccuccgucggcggcucccgcugccuccuccuccacuacuccgucuccaaggccaucugggacggccucauccuccucgccaccuucuacgucgccgucaccguccccuacaacgucugcuucuccggcgacgacgacacccccaucaccucccgccacacccucgucuccgacaucgccgucgagaugcucuucauccucgacaucauccucaacuuccgcaccaccuacgucucccaguccggccaggucaucuccgccccccgcuccaucggccuccacuaccucgccaccugguucuucaucgaccucaucgccgcccuccccuucgaccuccucuacaucuucaacaucaccgucaccucccucguccaccuccucaagaccguccgccuccuccgccuccuccgccuccuccagaagcucgagcgcuacucccagugcuccgccgucguccucacccuccucauguccgucuucgcccuccucgcccacuggauggccugcaucugguacgucaucggccgccgcgagauggaggccaacgacccccuccucugggacaucggcuggcuccacgagcucggcaagcgccucgagguccccuacgucaacggcuccgucggcggccccucccgccgcuccgccuacaucgccgcccucuacuucacccucuccucccucaccuccgucggcuucggcaacgucugcgccaacaccgacgccgagaagaucuucuccaucugcaccaugcucaucggcgcccucaugcacgccgucgucuucggcaacgucaccgccaucauccagcgcauguacucccgccgcucccucuaccacucccgcaugaaggaccucaaggacuucauccgcguccaccgccucccccgcccccucaagcagcgcaugcucgaguacuuccagaccaccugggccgucaacuccggcaucgacgccaacgagcuccuccgcgacuuccccgacgagcuccgcgccgacaucgccaugcaccucaaccgcgagauccuccagcucccccucuucggcgccgccucccgcggcugccuccgcgcccucucccuccacaucaagaccuccuucugcgcccccggcgaguaccuccuccgccgcggcgacgcccuccaggcccacuacuacgucugcuccggcucccucgagguccuccgcgacaacaugguccucgccauccucggcaagggcgaccucaucggcgccgacauccccgagcccggccaggagcccggccucggcgccgaccccaacuucguccucaagaccuccgccgacgucaaggcccucaccuacugcggccuccagcagcucuccucccgcggccucgccgagguccuccgccucuaccccgaguacggcgccgccuuccgcgccggccucccccgcgaccucaccuucaaccuccgccagggcuccgacaccuccggccucucccgcuucucccgcuccccccgccucucccagccccgcuccgagucccucggcuccuccuccgacaagacccuccccuccaucaccgaggccgaguccggcgccgagcccggcggcggcccccgcccccgccgcccccuccuccuccccaaccucucccccgcccgcccccgcggcucccucgucucccuccucggcgaggagcucccccccuucuccgcccucgucuccucccccucccucucccccucccucucccccgcccucgccggccagggccacuccgccuccccccacggccccccccgcugcuccgccgccuggaagcccccccagcuccucauccccccccucggcaccuucggcccccccgaccucuccccccgcaucgucgacggcaucgaggacuccggcuccaccgccgaggcccccuccuuccgcuucucccgccgccccgagcucccccgcccccgcucccaggccccccccaccggcacccgccccucccccgagcucgccuccgaggccgaggaggucaaggagaaggucugccgccucaaccaggagaucucccgccucaaccaggaggucucccagcucucccgcgagcuccgccacaucaugggccuccuccaggcccgccucggcccccccggccaccccgccggcuccgccuggacccccgacccccccugcccccagcuccgcccccccugccucucccccugcgccucccgccccccccccucccuccaggacaccacccucgccgagguccacugccccgccuccgucggcaccauggagaccggcaccgcccuccucgaccuccgccccuccauccucccccccuaccccuccgagcccgacccccucggccccucccccguccccgaggccuccccccccacccccucccuccuccgccacuccuuccagucccgcuccgacaccuuccacuga

SEQ ID NO: 44905 - RNA, 2967 nt, Artificial Sequence
  derived and/or modified sequence opt2 from KCNH5__Homo_sapiens__NP_647479
augcccggcggcaagcgcggccucgucgccccccagaacaccuuccucgagaacaucguccgccgcuccuccgaguccuccuuccuccucggcaacgcccagaucgucgacuggcccgucgucuacuccaacgacggcuucugcaagcucuccggcuaccaccgcgccgacgucaugcagaaguccuccaccugcuccuucauguacggcgagcucaccgacaagaagaccaucgagaagguccgccagaccuucgacaacuacgaguccaacugcuucgagguccuccucuacaagaagaaccgcacccccgucugguucuacaugcagaucgcccccauccgcaacgagcacgagaaggucguccucuuccucugcaccuucaaggacaucacccucuucaagcagcccaucgaggacgacuccaccaagggcuggaccaaguucgcccgccucacccgcgcccucaccaacucccgcuccguccuccagcagcucacccccaugaacaagaccgaggucguccacaagcacucccgccucgccgagguccuccagcucggcuccgacauccucccccaguacaagcaggaggcccccaagacccccccccacaucauccuccacuacugcgccuucaagaccaccugggacugggucauccucauccucaccuucuacaccgccaucaugguccccuacaacgucuccuucaagaccaagcagaacaacaucgccuggcucguccucgacuccgucgucgacgucaucuuccucgucgacaucguccucaacuuccacaccaccuucgucggccccggcggcgaggucaucuccgaccccaagcucauccgcaugaacuaccucaagaccugguucgucaucgaccuccucuccugccuccccuacgacaucaucaacgccuucgagaacgucgacgagggcaucuccucccucuucuccucccucaaggucguccgccuccuccgccucggccgcgucgcccgcaagcucgaccacuaccucgaguacggcgccgccguccucguccuccucgucugcgucuucggccucgucgcccacuggcucgccugcaucugguacuccaucggcgacuacgaggucaucgacgaggucaccaacaccauccagaucgacuccuggcucuaccagcucgcccucuccaucggcacccccuaccgcuacaacaccuccgccggcaucugggagggcggccccuccaaggacucccucuacgucuccucccucuacuucaccaugaccucccucaccaccaucggcuucggcaacaucgcccccaccaccgacgucgagaagauguucuccgucgccaugaugauggucggcucccuccucuacgccaccaucuucggcaacgucaccaccaucuuccagcagauguacgccaacaccaaccgcuaccacgagaugcucaacaacguccgcgacuuccucaagcucuaccagguccccaagggccucuccgagcgcgucauggacuacaucgucuccaccugguccauguccaagggcaucgacaccgagaagguccucuccaucugccccaaggacaugcgcgccgacaucugcguccaccucaaccgcaaggucuucaacgagcaccccgccuuccgccucgccuccgacggcugccuccgcgcccucgccgucgaguuccagaccauccacugcgcccccggcgaccucaucuaccacgccggcgaguccgucgacgcccucugcuucgucgucuccggcucccucgaggucauccaggacgacgaggucgucgccauccucggcaagggcgacgucuucggcgacaucuucuggaaggagaccacccucgcccacgccugcgccaacguccgcgcccucaccuacugcgaccuccacaucaucaagcgcgaggcccuccucaagguccucgacuucuacaccgccuucgccaacuccuucucccgcaaccucacccucaccugcaaccuccgcaagcgcaucaucuuccgcaagaucuccgacgucaagaaggaggaggaggagcgccuccgccagaagaacgaggucacccucuccauccccgucgaccaccccguccgcaagcucuuccagaaguucaagcagcagaaggagcuccgcaaccagggcuccacccagggcgaccccgagcgcaaccagcuccaggucgagucccgcucccuccagaacggcgccuccaucaccggcaccuccgucgucaccgucucccagaucacccccauccagaccucccucgccuacgucaagaccuccgagucccucaagcagaacaaccgcgacgccauggagcucaagcccaacggcggcgccgaccagaagugccucaaggucaacucccccauccgcaugaagaacggcaacggcaagggcuggcuccgccucaagaacaacaugggcgcccacgaggagaagaaggaggacuggaacaacgucaccaaggccgaguccaugggccuccucuccgaggaccccaaguccuccgacuccgagaacuccgucaccaagaacccccuccgcaagaccgacuccugcgacuccggcaucaccaaguccgaccuccgccucgacaaggccggcgaggcccgcuccccccucgagcacucccccauccaggccgacgccaagcaccccuucuaccccauccccgagcaggcccuccagaccacccuccaggaggucaagcacgagcucaaggaggacauccagcuccucuccugccgcaugaccgcccucgagaagcaggucgccgagauccucaagauccucuccgagaaguccgucccccaggccuccucccccaagucccagaugccccuccagguccccccccagauccccugccaggacaucuucuccgucucccgccccgagucccccgaguccgacaaggacgagauccacuucuga

SEQ ID NO: 44906 - RNA, 2985 nt, Artificial Sequence
  derived and/or modified sequence opt2 from KCNH6__Homo_sapiens__NP_110406
augcccguccgccgcggccacgucgccccccagaacaccuaccucgacaccaucauccgcaaguucgagggccagucccgcaaguuccucaucgccaacgcccagauggagaacugcgccaucaucuacugcaacgacggcuucugcgagcucuucggcuacucccgcgucgaggucaugcagcagcccugcaccugcgacuuccucaccggccccaacacccccuccuccgccgucucccgccucgcccaggcccuccucggcgccgaggagugcaaggucgacauccucuacuaccgcaaggacgccuccuccuuccgcugccucgucgacgucguccccgucaagaacgaggacggcgccgucaucauguucauccucaacuucgaggaccucgcccagcuccucgccaagugcuccucccgcucccucucccagcgccuccucucccaguccuuccucggcuccgagggcucccacggccgccccggcggccccggccccggcaccggccgcggcaaguaccgcaccaucucccagaucccccaguucacccucaacuucgucgaguucaaccucgagaagcaccgcuccuccuccaccaccgagaucgagaucaucgccccccacaaggucgucgagcgcacccagaacgucaccgagaaggucacccagguccucucccucggcgccgacguccuccccgaguacaagcuccaggccccccgcauccaccgcuggaccauccuccacuacucccccuucaaggccgucugggacuggcucauccuccuccucgucaucuacaccgccgucuucacccccuacuccgccgccuuccuccucuccgaccaggacgagucccgccgcggcgccugcuccuacaccugcuccccccucaccgucgucgaccucaucgucgacaucauguucgucgucgacaucgucaucaacuuccgcaccaccuacgucaacaccaacgacgaggucgucucccacccccgccgcaucgccguccacuacuucaagggcugguuccucaucgacauggucgccgccauccccuucgaccuccucaucuuccgcaccggcuccgacgagaccaccacccucaucggccuccucaagaccgcccgccuccuccgccucguccgcgucgcccgcaagcucgaccgcuacuccgaguacggcgccgccguccucuuccuccucaugugcaccuucgcccucaucgcccacuggcucgccugcaucugguacgccaucggcaacgucgagcgccccuaccucgagcacaagaucggcuggcucgacucccucggcguccagcucggcaagcgcuacaacggcuccgaccccgccuccggccccuccguccaggacaaguacgucaccgcccucuacuucaccuucuccucccucaccuccgucggcuucggcaacgucucccccaacaccaacuccgagaaggucuucuccaucugcgucaugcucaucggcucccucauguacgccuccaucuucggcaacgucuccgccaucauccagcgccucuacuccggcaccgcccgcuaccacacccagaugcuccgcgucaaggaguucauccgcuuccaccagauccccaacccccuccgccagcgccucgaggaguacuuccagcacgccugguccuacaccaacggcaucgacaugaacgccguccucaagggcuuccccgagugccuccaggccgacaucugccuccaccuccaccgcgcccuccuccagcacugccccgccuucuccggcgccggcaagggcugccuccgcgcccucgccgucaaguucaagaccacccacgccccccccggcgacacccucguccaccucggcgacguccucuccacccucuacuucaucucccgcggcuccaucgagauccuccgcgacgacgucgucgucgccauccucggcaagaacgacaucuucggcgagcccgucucccuccacgcccagcccggcaaguccuccgccgacguccgcgcccucaccuacugcgaccuccacaagauccagcgcgccgaccuccucgagguccucgacauguaccccgccuucgccgaguccuucugguccaagcucgaggucaccuucaaccuccgcgacgccgccggcggccuccacuccuccccccgccaggcccccggcucccaggaccaccagggcuucuuccucuccgacaaccaguccggcuccccccacgagcucggcccccaguuccccuccaagggcuacucccuccucggccccggcucccagaacuccaugggcgccggccccugcgcccccggccaccccgacgccgcccccccccucuccaucuccgacgccuccggccucuggcccgagcuccuccaggagaugcccccccgccacuccccccaguccccccaggaggaccccgacugcuggccccucaagcucggcucccgccucgagcagcuccaggcccagaugaaccgccucgagucccgcgucuccuccgaccucucccgcauccuccagcuccuccagaagcccaugccccagggccacgccuccuacauccucgaggcccccgccuccaacgaccucgcccucguccccaucgccuccgagaccaccucccccggcccccgccucccccagggcuuccucccccccgcccagacccccuccuacggcgaccucgacgacugcucccccaagcaccgcaacuccuccccccgcaugccccaccucgccgucgccaccgacaagacccucgcccccuccuccgagcaggagcagcccgagggccucuggcccccccucgccuccccccuccacccccucgagguccagggccucaucugcggccccugcuucuccucccuccccgagcaccucggcuccguccccaagcagcucgacuuccagcgccacggcuccgaccccggcuucgccggcuccuggggccacuga

SEQ ID NO: 44907 - RNA, 3591 nt, Artificial Sequence
  derived and/or modified sequence opt2 from KCNH7__Homo_sapiens__NP_150375
augcccguccgccgcggccacgucgccccccagaacaccuuccucggcaccaucauccgcaaguucgagggccagaacaagaaguucaucaucgccaacgcccgcguccagaacugcgccaucaucuacugcaacgacggcuucugcgagaugaccggcuucucccgccccgacgucaugcagaagcccugcaccugcgacuuccuccacggccccgagaccaagcgccacgacaucgcccagaucgcccaggcccuccucggcuccgaggagcgcaaggucgaggucaccuacuaccacaagaacggcuccaccuucaucugcaacacccacaucauccccgucaagaaccaggagggcgucgccaugauguucaucaucaacuucgaguacgucaccgacaacgagaacgccgccacccccgagcgcgucaaccccauccuccccaucaagaccgucaaccgcaaguucuucggcuucaaguuccccggccuccgcguccucaccuaccgcaagcagucccucccccaggaggaccccgacgucgucgucaucgacuccuccaagcacuccgacgacuccgucgccaugaagcacuucaagucccccaccaaggaguccugcucccccuccgaggccgacgacaccaaggcccucauccagcccuccaagugcuccccccucgucaacaucuccggcccccucgaccacuccucccccaagcgccagugggaccgccucuaccccgacaugcuccaguccuccucccagcucucccacucccgcucccgcgagucccucugcuccauccgccgcgccuccuccguccacgacaucgagggcuucggcguccaccccaagaacaucuuccgcgaccgccacgccuccgaggacaacggccgcaacgucaagggccccuucaaccacaucaaguccucccuccucggcuccaccuccgacuccaaccucaacaaguacuccaccaucaacaagaucccccagcucacccucaacuucuccgaggucaagaccgagaagaagaacuccuccccccccuccuccgacaagaccaucaucgcccccaaggucaaggaccgcacccacaacgucaccgagaaggucacccagguccucucccucggcgccgacguccuccccgaguacaagcuccagaccccccgcaucaacaaguucaccauccuccacuacucccccuucaaggccgucugggacuggcucauccuccuccucgucaucuacaccgccaucuucacccccuacuccgccgccuuccuccucaacgaccgcgaggagcagaagcgccgcgagugcggcuacuccugcuccccccucaacgucgucgaccucaucgucgacaucauguucaucaucgacauccucaucaacuuccgcaccaccuacgucaaccagaacgaggaggucgucuccgaccccgccaagaucgccauccacuacuucaagggcugguuccucaucgacauggucgccgccauccccuucgaccuccucaucuucggcuccggcuccgacgagaccaccacccucaucggccuccucaagaccgcccgccuccuccgccucguccgcgucgcccgcaagcucgaccgcuacuccgaguacggcgccgccguccucaugcuccucaugugcaucuucgcccucaucgcccacuggcucgccugcaucugguacgccaucggcaacgucgagcgccccuaccucaccgacaagaucggcuggcucgacucccucggccagcagaucggcaagcgcuacaacgacuccgacuccuccuccggccccuccaucaaggacaaguacgucaccgcccucuacuucaccuucuccucccucaccuccgucggcuucggcaacgucucccccaacaccaacuccgagaagaucuucuccaucugcgucaugcucaucggcucccucauguacgccuccaucuucggcaacgucuccgccaucauccagcgccucuacuccggcaccgcccgcuaccacaugcagaugcuccgcgucaaggaguucauccgcuuccaccagauccccaacccccuccgccagcgccucgaggaguacuuccagcacgccuggaccuacaccaacggcaucgacaugaacaugguccucaagggcuuccccgagugccuccaggccgacaucugccuccaccucaaccagacccuccuccagaacugcaaggccuuccgcggcgccuccaagggcugccuccgcgcccucgccaugaaguucaagaccacccacgccccccccggcgacacccucguccacugcggcgacguccucaccgcccucuacuuccucucccgcggcuccaucgagauccucaaggacgacaucgucgucgccauccucggcaagaacgacaucuucggcgagaugguccaccucuacgccaagcccggcaaguccaacgccgacguccgcgcccucaccuacugcgaccuccacaagauccagcgcgaggaccuccucgagguccucgacauguaccccgaguucuccgaccacuuccucaccaaccucgagcucaccuucaaccuccgccacgaguccgccaaggccgaccuccuccgcucccaguccaugaacgacuccgagggcgacaacugcaagcuccgccgccgcaagcucuccuucgaguccgagggcgagaaggagaacuccaccaacgaccccgaggacuccgccgacaccauccgccacuaccaguccuccaagcgccacuucgaggagaagaagucccgcuccuccuccuucaucuccuccaucgacgacgagcagaagccccucuucuccggcaucgucgacuccucccccggcaucggcaaggccuccggccucgacuucgaggagaccguccccaccuccggccgcaugcacaucgacaagcgcucccacuccugcaaggacaucaccgacaugcgcuccugggagcgcgagaacgcccacccccagcccgaggacuccucccccuccgcccuccagcgcgccgccuggggcaucuccgagaccgaguccgaccucaccuacggcgaggucgagcagcgccucgaccuccuccaggagcagcucaaccgccucgagucccagaugaccaccgacauccagaccauccuccagcuccuccagaagcagaccaccgucgucccccccgccuacuccauggucaccgccggcuccgaguaccagcgccccaucauccagcucaugcgcaccucccagcccgaggccuccaucaagaccgaccgcuccuucucccccuccucccagugccccgaguuccucgaccucgagaaguccaagcucaaguccaaggagucccucuccuccggcguccaccucaacaccgccuccgaggacaaccucaccucccuccucaagcaggacuccgaccucucccucgagcuccaccuccgccagcgcaagaccuacguccaccccauccgccaccccucccuccccgacuccucccucuccaccgucggcaucgucggccuccaccgccacgucuccgaccccggccuccccggcaaguga

SEQ ID NO: 44908 - RNA, 3324 nt, Artificial Sequence
  derived and/or modified sequence opt2 from KCNH8__Homo_sapiens__NP_653234
augcccgucaugaagggccuccucgccccccagaacaccuuccucgacaccaucgccacccgcuucgacggcacccacuccaacuucauccucgccaacgcccaggucgccaagggcuuccccaucgucuacugcuccgacggcuucugcgagcucgccggcuucgcccgcaccgaggucaugcagaaguccugcuccugcaaguuccucuucggcgucgagaccaacgagcagcucaugcuccagaucgagaagucccucgaggagaagaccgaguucaagggcgagaucauguucuacaagaagaacggcucccccuucuggugccuccucgacaucguccccaucaagaacgagaagggcgacgucguccucuuccucgccuccuucaaggacaucaccgacaccaaggucaagaucacccccgaggacaagaaggaggacaaggucaagggccgcucccgcgccggcacccacuucgacuccgcccgccgccgcucccgcgccguccucuaccacaucuccggccaccuccagcgccgcgagaagaacaagcucaagaucaacaacaacgucuucgucgacaagcccgccuuccccgaguacaaggucuccgacgccaagaaguccaaguucauccuccuccacuucuccaccuucaaggccggcugggacuggcucauccuccucgccaccuucuacgucgccgucaccguccccuacaacgucugcuucaucggcaacgacgaccucuccaccacccgcuccaccaccgucuccgacaucgccgucgagauccucuucaucaucgacaucauccucaacuuccgcaccaccuacgucuccaaguccggccaggucaucuucgaggcccgcuccaucugcauccacuacgucaccaccugguucaucaucgaccucaucgccgcccuccccuucgaccuccucuacgccuucaacgucaccgucgucucccucguccaccuccucaagaccguccgccuccuccgccuccuccgccuccuccagaagcucgaccgcuacucccagcacuccaccaucguccucacccuccucauguccauguucgcccuccucgcccacuggauggccugcaucugguacgucaucggcaagauggagcgcgaggacaacucccuccucaagugggaggucggcuggcuccacgagcucggcaagcgccucgagucccccuacuacggcaacaacacccucggcggccccuccauccgcuccgccuacaucgccgcccucuacuucacccucuccucccucaccuccgucggcuucggcaacgucuccgccaacaccgacgccgagaagaucuucuccaucugcaccaugcucaucggcgcccucaugcacgcccucgucuucggcaacgucaccgccaucauccagcgcauguacucccgcuggucccucuaccacacccgcaccaaggaccucaaggacuucauccgcguccaccaccucccccagcagcucaagcagcgcaugcucgaguacuuccagaccaccugguccgucaacaacggcaucgacuccaacgagcuccucaaggacuuccccgacgagcuccgcuccgacaucaccaugcaccucaacaaggagauccuccagcucucccucuucgagugcgccucccgcggcugccuccgcucccucucccuccacaucaagaccuccuucugcgcccccggcgaguaccuccuccgccagggcgacgcccuccaggccaucuacuucgucugcuccggcuccauggagguccucaaggacuccaugguccucgccauccucggcaagggcgaccucaucggcgccaaccucuccaucaaggaccaggucaucaagaccaacgccgacgucaaggcccucaccuacugcgaccuccagugcaucauccucaagggccucuucgagguccucgaccucuaccccgaguacgcccacaaguucgucgaggacauccagcacgaccucaccuacaaccuccgcgagggccacgaguccgacgucaucucccgccucuccaacaaguccauggucucccaguccgagcccaagggcaacggcaacaucaacaagcgccuccccuccaucgucgaggacgaggaggaggaggaggagggcgaggaggaggaggccgucucccucucccccaucugcacccgcggcuccuccucccgcaacaagaaggucggcuccaacaaggccuaccucggccucucccucaagcagcucgccuccggcaccguccccuuccacucccccauccgcgucucccgcuccaacucccccaagaccaagcaggagaucgacccccccaaccacaacaagcgcaaggagaagaaccucaagcuccagcucuccacccucaacaacgccggcccccccgaccucuccccccgcaucgucgacggcaucgaggacggcaacuccuccgaggagucccagaccuucgacuucggcuccgagcgcauccgcuccgagccccgcaucucccccccccucggcgaccccgagaucggcgccgccguccucuucaucaaggccgaggagaccaagcagcagaucaacaagcucaacuccgaggucaccacccucacccaggaggucucccagcucggcaaggacaugcgcaacgucauccagcuccucgagaacguccucuccccccagcagcccucccgcuucugcucccuccacuccaccuccgucugccccucccgcgagucccuccagacccgcaccuccugguccgcccaccagcccugccuccaccuccagaccggcggcgccgccuacacccaggcccagcucugcuccuccaacaucaccuccgacaucugguccgucgaccccuccuccgucggcuccuccccccagcgcaccggcgcccacgagcagaaccccgccgacuccgagcucuaccacucccccucccucgacuacucccccucccacuaccaggucguccaggagggccaccuccaguuccuccgcugcaucuccccccacuccgacuccacccucaccccccuccaguccaucuccgccacccucuccuccuccgucugcuccuccuccgagaccucccuccaccucguccuccccucccgcuccgaggagggcuccuucucccagggcaccgucuccuccuucucccucgagaaccuccccggcuccuggaaccaggagggcauggccuccgccuccaccaagccccucgagaaccucccccucgaggucgucaccuccaccgccgaggucaaggacaacaaggccaucaacgucuga

SEQ ID NO: 44909 - RNA, 684 nt, Artificial Sequence
  derived and/or modified sequence opt2 from KCNIP1__Homo_sapiens__NP_001030009
augggcgccgucaugggcaccuucuccucccuccagaccaagcagcgccgccccuccaaggacaucgccuggugguacuaccaguaccagcgcgacaagaucgaggacgagcucgagaugaccauggucugccaccgccccgagggccucgagcagcucgaggcccagaccaacuucaccaagcgcgagcuccagguccucuaccgcggcuucaagaacgagugccccuccggcgucgucaacgaggacaccuucaagcagaucuacgcccaguucuucccccacggcgacgccuccaccuacgcccacuaccucuucaacgccuucgacaccacccagaccggcuccgucaaguucgaggacuucgucaccgcccucuccauccuccuccgcggcaccguccacgagaagcuccgcuggaccuucaaccucuacgacaucaacaaggacggcuacaucaacaaggaggagaugauggacaucgucaaggccaucuacgacaugaugggcaaguacaccuaccccguccucaaggaggacaccccccgccagcacgucgacgucuucuuccagaagauggacaagaacaaggacggcaucgucacccucgacgaguuccucgaguccugccaggaggacgacaacaucaugcgcucccuccagcucuuccagaacgucauguga

SEQ ID NO: 44910 - RNA, 858 nt, Artificial Sequence
  derived and/or modified sequence opt2 from KCNIP2__Homo_sapiens__NP_055406
augcgcggccagggccgcaaggagucccucuccgacucccgcgaccucgacggcuccuacgaccagcucaccggccacccccccggccccaccaagaaggcccucaagcagcgcuuccucaagcuccuccccugcugcggcccccaggcccuccccuccgucuccgagaucggccgcgucuuccgcuuccucggcgacuccucccuccccuccgcccucgccgcccccgccucccuccgcccccaccgcccccgccuccucgaccccgacuccgucgacgacgaguucgagcucuccaccgucugccaccgccccgagggccucgagcagcuccaggagcagaccaaguucacccgcaaggagcuccagguccucuaccgcggcuucaagaacgagugccccuccggcaucgucaacgaggagaacuucaagcagaucuacucccaguucuucccccagggcgacuccuccaccuacgccaccuuccucuucaacgccuucgacaccaaccacgacggcuccgucuccuucgaggacuucgucgccggccucuccgucauccuccgcggcaccgucgacgaccgccucaacugggccuucaaccucuacgaccucaacaaggacggcugcaucaccaaggaggagaugcucgacaucaugaaguccaucuacgacaugaugggcaaguacaccuaccccgcccuccgcgaggaggccccccgcgagcacgucgaguccuucuuccagaagauggaccgcaacaaggacggcgucgucaccaucgaggaguucaucgaguccugccagaaggacgagaacaucaugcgcuccaugcagcucuucgacaacgucaucuga

SEQ ID NO: 44911 - RNA, 693 nt, Artificial Sequence
  derived and/or modified sequence opt2 from KCNIP3__Homo_sapiens__NP_001030086
augggcauccagggcauggagcucugcgccauggccgucgucguccuccucuucaucgccguccucaagcaguucggcauccucgagcccaucuccauggaggacuccuccgacuccgagcucgagcucuccaccguccgccaccagcccgagggccucgaccagcuccaggcccagaccaaguucaccaagaaggagcuccagucccucuaccgcggcuucaagaacgagugccccaccggccucgucgacgaggacaccuucaagcucaucuacgcccaguucuucccccagggcgacgccaccaccuacgcccacuuccucuucaacgccuucgacgccgacggcaacggcgccauccacuucgaggacuucgucgucggccucuccauccuccuccgcggcaccguccacgagaagcucaagugggccuucaaccucuacgacaucaacaaggacggcuacaucaccaaggaggagaugcucgccaucaugaaguccaucuacgacaugaugggccgccacaccuaccccauccuccgcgaggacgcccccgccgagcacgucgagcgcuucuucgagaagauggaccgcaaccaggacggcgucgucaccaucgaggaguuccucgaggccugccagaaggacgagaacaucauguccuccaugcagcucuucgagaacgucaucuga

SEQ ID NO: 44912 - RNA, 678 nt, Artificial Sequence
  derived and/or modified sequence opt2 from KCNIP4__Homo_sapiens__NP_001030175
auguccggcugccgcaagcgcugcaagcgcgagauccucaaguucgcccaguaccuccuccgccuccucaccggcucccuccacaccgacuccgucgaggacgagcucgagauggccaccguccgccaccgccccgaggcccucgagcuccucgaggcccaguccaaguucaccaagaaggagcuccagauccucuaccgcggcuucaagaacgagugccccuccggcgucgucaacgaggagaccuucaaggagaucuacucccaguucuucccccagggcgacuccaccaccuacgcccacuuccucuucaacgccuucgacaccgaccacaacggcgccgucuccuucgaggacuucaucaagggccucuccauccuccuccgcggcaccguccaggagaagcucaacugggccuucaaccucuacgacaucaacaaggacggcuacaucaccaaggaggagaugcucgacaucaugaaggccaucuacgacaugaugggcaagugcaccuaccccguccucaaggaggacgccccccgccagcacgucgagaccuucuuccagaagauggacaagaacaaggacggcgucgucaccaucgacgaguucaucgaguccugccagaaggacgagaacaucaugcgcuccaugcagcucuucgagaacgucaucuga

SEQ ID NO: 44913 - RNA, 1140 nt, Artificial Sequence
  derived and/or modified sequence opt2 from KCNJ10__Homo_sapiens__NP_002232
augaccuccgucgccaaggucuacuacucccagaccacccagaccgagucccgcccccucaugggccccggcauccgccgccgccgcguccucaccaaggacggccgcuccaacguccgcauggagcacaucgccgacaagcgcuuccucuaccucaaggaccucuggaccaccuucaucgacaugcaguggcgcuacaagcuccuccucuucuccgccaccuucgccggcaccugguuccucuucggcgucgucugguaccucgucgccgucgcccacggcgaccuccucgagcucgacccccccgccaaccacacccccugcgucguccagguccacacccucaccggcgccuuccucuucucccucgagucccagaccaccaucggcuacggcuuccgcuacaucuccgaggagugcccccucgccaucguccuccucaucgcccagcucguccucaccaccauccucgagaucuucaucaccggcaccuuccucgccaagaucgcccgccccaagaagcgcgccgagaccauccgcuucucccagcacgccgucgucgccucccacaacggcaagcccugccucaugauccgcgucgccaacaugcgcaagucccuccucaucggcugccaggucaccggcaagcuccuccagacccaccagaccaaggagggcgagaacauccgccucaaccaggucaacgucaccuuccaggucgacaccgccuccgacucccccuuccucauccucccccucaccuucuaccacgucgucgacgagaccuccccccucaaggaccucccccuccgcuccggcgagggcgacuucgagcucguccucauccucuccggcaccgucgaguccaccuccgccaccugccagguccgcaccuccuaccuccccgaggagauccucuggggcuacgaguucacccccgccaucucccucuccgccuccggcaaguacaucgccgacuucucccucuucgaccaggucgucaaggucgccucccccuccggccuccgcgacuccaccguccgcuacggcgaccccgagaagcucaagcucgaggagucccuccgcgagcaggccgagaaggagggcuccgcccucuccguccgcaucuccaacgucuga

SEQ ID NO: 44914 - RNA, 1173 nt, Artificial Sequence
  derived and/or modified sequence opt2 from KCNJ11__Homo_sapiens__NP_000516
augcucucccgcaagggcaucauccccgaggaguacguccucacccgccucgccgaggaccccgccaagccccgcuaccgcgcccgccagcgccgcgcccgcuucgucuccaagaagggcaacugcaacgucgcccacaagaacauccgcgagcagggccgcuuccuccaggacgucuucaccacccucgucgaccucaaguggccccacacccuccucaucuucaccauguccuuccucugcuccuggcuccucuucgccauggccugguggcucaucgccuucgcccacggcgaccucgcccccuccgagggcaccgccgagcccugcgucaccuccauccacuccuucuccuccgccuuccucuucuccaucgagguccaggucaccaucggcuucggcggccgcauggucaccgaggagugcccccucgccauccucauccucaucguccagaacaucgucggccucaugaucaacgccaucaugcucggcugcaucuucaugaagaccgcccaggcccaccgccgcgccgagacccucaucuucuccaagcacgccgucaucgcccuccgccacggccgccucugcuucaugcuccgcgucggcgaccuccgcaaguccaugaucaucuccgccaccauccacaugcaggucguccgcaagaccaccucccccgagggcgaggucgucccccuccaccaggucgacauccccauggagaacggcgucggcggcaacuccaucuuccucgucgccccccucaucaucuaccacgucaucgacgccaacuccccccucuacgaccucgcccccuccgaccuccaccaccaccaggaccucgagaucaucgucauccucgagggcgucgucgagaccaccggcaucaccacccaggcccgcaccuccuaccucgccgacgagauccucuggggccagcgcuucguccccaucgucgccgaggaggacggccgcuacuccgucgacuacuccaaguucggcaacaccgucaagguccccaccccccucugcaccgcccgccagcucgacgaggaccacucccuccucgaggcccucacccucgccuccgcccgcggcccccuccgcaagcgcuccguccccauggccaaggccaagcccaaguucuccaucucccccgacucccucuccuga

SEQ ID NO: 44915 - RNA, 1302 nt, Artificial Sequence
  derived and/or modified sequence opt2 from KCNJ12__Homo_sapiens__NP_066292
augaccgccgccucccgcgccaaccccuacuccaucgucuccuccgaggaggacggccuccaccucgucaccauguccggcgccaacggcuucggcaacggcaagguccacacccgccgccgcugccgcaaccgcuucgucaagaagaacggccagugcaacaucgaguucgccaacauggacgagaagucccagcgcuaccucgccgacauguucaccaccugcgucgacauccgcuggcgcuacaugcuccucaucuucucccucgccuuccucgccuccuggcuccucuucggcaucaucuucugggucaucgccgucgcccacggcgaccucgagcccgccgagggccgcggccgcacccccugcgucaugcagguccacggcuucauggccgccuuccucuucuccaucgagacccagaccaccaucggcuacggccuccgcugcgucaccgaggagugccccgucgccgucuucauggucgucgcccaguccaucgucggcugcaucaucgacuccuucaugaucggcgccaucauggccaagauggcccgccccaagaagcgcgcccagacccuccucuucucccacaacgccgucgucgcccuccgcgacggcaagcucugccucauguggcgcgucggcaaccuccgcaagucccacaucgucgaggcccacguccgcgcccagcucaucaagccccgcgucaccgaggagggcgaguacaucccccucgaccagaucgacaucgacgucggcuucgacaagggccucgaccgcaucuuccucgucucccccaucaccauccuccacgagaucgacgaggccuccccccucuucggcaucucccgccaggaccucgagaccgacgacuucgagaucgucgucauccucgagggcauggucgaggccaccgccaugaccacccaggcccgcuccuccuaccucgccaacgagauccucuggggccaccgcuucgagcccguccucuucgaggagaagaaccaguacaagaucgacuacucccacuuccacaagaccuacgagguccccuccaccccccgcugcuccgccaaggaccucgucgagaacaaguuccuccuccccuccgccaacuccuucugcuacgagaacgagcucgccuuccucucccgcgacgaggaggacgaggccgacggcgaccaggacggccgcucccgcgacggccucuccccccaggcccgccacgacuucgaccgccuccaggccggcggcggcguccucgagcagcgccccuaccgccgcgaguccgagaucuga

SEQ ID NO: 44916 - RNA, 285 nt, Artificial Sequence
  derived and/or modified sequence opt2 from KCNJ13__Homo_sapiens__NP_001165887
auggacuccuccaacugcaaggucaucgccccccuccucucccagcgcuaccgccgcauggucaccaaggacggccacuccacccuccagauggacggcgcccagcgcggccucgccuaccuccgcgacgccuggggcauccucauggacaugcgcuggcgcuggaugaugcucgucuucuccgccuccuucgucguccacuggcucgucuucgccguccucuggugcuucugcggcgaggacugccccgccaagaaguccuccuucuucaacucccucuacuga

SEQ ID NO: 44917 - RNA, 1311 nt, Artificial Sequence
  derived and/or modified sequence opt2 from KCNJ14__Homo_sapiens__NP_037480
augggccucgcccgcgcccuccgccgccucuccggcgcccucgacuccggcgacucccgcgccggcgacgaggaggaggccggccccggccucugccgcaacggcugggcccccgcccccguccagucccccgucggccgccgccgcggccgcuucgucaagaaggacggccacugcaacguccgcuucgucaaccucggcggccagggcgcccgcuaccucuccgaccucuucaccaccugcgucgacguccgcuggcgcuggaugugccuccucuucuccugcuccuuccucgccuccuggcuccucuucggccucgccuucuggcucaucgccucccuccacggcgaccucgccgccccccccccccccgcccccugcuucucccacgucgccuccuuccucgccgccuuccucuucgcccucgagacccagaccuccaucggcuacggcguccgcuccgucaccgaggagugccccgccgccgucgccgccgucguccuccagugcaucgccggcugcguccucgacgccuucgucgucggcgccgucauggccaagauggccaagcccaagaagcgcaacgagacccucgucuucuccgagaacgccgucgucgcccuccgcgaccaccgccucugccucauguggcgcgucggcaaccuccgccgcucccaccucgucgaggcccacguccgcgcccagcuccuccagccccgcgucacccccgagggcgaguacaucccccucgaccaccaggacgucgacgucggcuucgacggcggcaccgaccgcaucuuccucgucucccccaucaccaucguccacgagaucgacuccgccuccccccucuacgagcucggccgcgccgagcucgcccgcgccgacuucgagcucgucgucauccucgagggcauggucgaggccaccgccaugaccacccagugccgcuccuccuaccuccccggcgagcuccucuggggccaccgcuucgagcccguccucuuccagcgcggcucccaguacgaggucgacuaccgccacuuccaccgcaccuacgagguccccggcacccccgucugcuccgccaaggagcucgacgagcgcgccgagcaggccucccacucccucaaguccuccuuccccggcucccucaccgccuucugcuacgagaacgagcucgcccucuccugcugccaggaggaggacgaggacgacgagaccgaggagggcaacggcgucgagaccgaggacggcgccgccuccccccgcguccucacccccacccucgcccucacccucccccccuga

SEQ ID NO: 44918 - RNA, 1128 nt, Artificial Sequence
  derived and/or modified sequence opt2 from KCNJ15__Homo_sapiens__XP_011527863
auggacgccauccacaucggcauguccuccaccccccucgucaagcacaccgccggcgccggccucaaggccaaccgcccccgcgucauguccaaguccggccacuccaacguccgcaucgacaaggucgacggcaucuaccuccucuaccuccaggaccucuggaccaccgucaucgacaugaaguggcgcuacaagcucacccucuucgccgccaccuucgucaugaccugguuccucuucggcgucaucuacuacgccaucgccuucauccacggcgaccucgagcccggcgagcccaucuccaaccacacccccugcaucaugaaggucgacucccucaccggcgccuuccucuucucccucgagucccagaccaccaucggcuacggcguccgcuccaucaccgaggagugcccccacgccaucuuccuccucgucgcccagcucgucaucaccacccucaucgagaucuucaucaccggcaccuuccucgccaagaucgcccgccccaagaagcgcgccgagaccaucaaguucucccacugcgccgucaucaccaagcagaacggcaagcucugccucgucauccaggucgccaacaugcgcaagucccuccucauccagugccagcucuccggcaagcuccuccagacccacgucaccaaggagggcgagcgcauccuccucaaccaggccaccgucaaguuccacgucgacuccuccuccgagucccccuuccucauccuccccaugaccuucuaccacguccucgacgagaccuccccccuccgcgaccucaccccccagaaccucaaggagaaggaguucgagcucgucguccuccucaacgccaccgucgaguccaccuccgccgucugccagucccgcaccuccuacauccccgaggagaucuacuggggcuucgaguucguccccgucgucucccucuccaagaacggcaaguacgucgccgacuucucccaguucgagcagauccgcaagucccccgacugcaccuucuacugcgccgacuccgagaagcagcagcucgaggagaaguaccgccaggaggaccagcgcgagcgcgagcuccgcacccuccuccuccagcaguccaacgucuga

SEQ ID NO: 44919 - RNA, 1362 nt, Artificial Sequence
  derived and/or modified sequence opt2 from KCNJ16__Homo_sapiens__NP_001278551
augcucaagaugguccucaccgagaaccccaaccaggagaucgccaccucccucgaguuccuccuccuccagaacucccccggcucccuccgcgcccagcagcgcauguccuacuacggcuccuccuaccacaucaucaacgccgacgccaaguaccccggcuacccccccgagcacaucaucgccgagaagcgccgcgcccgccgccgccuccuccacaaggacggcuccugcaacgucuacuucaagcacaucuucggcgaguggggcuccuacgucgucgacaucuucaccacccucgucgacaccaaguggcgccacauguucgucaucuucucccucuccuacauccucuccuggcucaucuucggcuccgucuucuggcucaucgccuuccaccacggcgaccuccucaacgaccccgacaucacccccugcgucgacaacguccacuccuucaccggcgccuuccucuucucccucgagacccagaccaccaucggcuacggcuaccgcugcgucaccgaggagugcuccgucgccguccucauggucauccuccaguccauccucuccugcaucaucaacaccuucaucaucggcgccgcccucgccaagauggccaccgcccgcaagcgcgcccagaccauccgcuucuccuacuucgcccucaucggcaugcgcgacggcaagcucugccucauguggcgcaucggcgacuuccgccccaaccacgucgucgagggcaccguccgcgcccagcuccuccgcuacaccgaggacuccgagggccgcaugaccauggccuucaaggaccucaagcucgucaacgaccagaucauccucgucacccccgucaccaucguccacgagaucgaccacgaguccccccucuacgcccucgaccgcaaggccgucgccaaggacaacuucgagauccucgucaccuucaucuacaccggcgacuccaccggcaccucccaccagucccgcuccuccuacgucccccgcgagauccucuggggccaccgcuucaacgacguccucgaggucaagcgcaaguacuacaaggucaacugccuccaguucgagggcuccgucgaggucuacgcccccuucugcuccgccaagcagcucgacuggaaggaccagcagcuccacaucgagaaggccccccccguccgcgaguccugcaccuccgacaccaaggcccgccgccgcuccuucuccgccgucgccaucgucuccuccugcgagaaccccgaggagaccaccaccuccgccacccacgaguaccgcgagacccccuaccagaaggcccuccucacccucaaccgcaucuccgucgagucccagauguga

SEQ ID NO: 44920 - RNA, 1302 nt, Artificial Sequence
  derived and/or modified sequence opt2 from KCNJ18__Homo_sapiens__NP_001181887
augaccgccgccucccgcgccaaccccuacuccaucgucucccucgaggaggacggccuccaccucgucaccauguccggcgccaacggcuucggcaacggcaagguccacacccgccgccgcugccgcaaccgcuucgucaagaagaacggccagugcaacaucgccuucgccaacauggacgagaagucccagcgcuaccucgccgacauguucaccaccugcgucgacauccgcuggcgcuacaugcuccucaucuucucccucgccuuccucgccuccuggcuccucuucggcgucaucuucugggucaucgccgucgcccacggcgaccucgagcccgccgagggccacggccgcacccccugcgucaugcagguccacggcuucauggccgccuuccucuucuccaucgagacccagaccaccaucggcuacggccuccgcugcgucaccgaggagugccucgucgccgucuucauggucgucgcccaguccaucgucggcugcaucaucgacuccuucaugaucggcgccaucauggccaagauggcccgccccaagaagcgcgcccagacccuccucuucucccacaacgccgucgucgcccuccgcgacggcaagcucugccucauguggcgcgucggcaaccuccgcaagucccacaucgucgaggcccacguccgcgcccagcucaucaagccccgcgucaccgaggagggcgaguacaucccccucgaccagaucgacaucgacgucggcuucgacaagggccucgaccgcaucuuccucgucucccccaucaccauccuccacgagaucgacgaggccuccccccucuucggcaucucccgccaggaccucgagaccgacgacuucgagaucgucgucauccucgagggcauggucgaggccaccgccaugaccacccaggcccgcuccuccuaccucgccaacgagauccucuggggccaccgcuucgagcccguccucuucgaggagaagaaccaguacaagaucgacuacucccacuuccacaagaccuacgagguccccuccaccccccgcugcuccgccaaggaccucgucgagaacaaguuccuccuccccuccgccaacuccuucugcuacgagaacgagcucgccuuccucucccgcgacgaggaggacgaggccgacggcgaccaggacggccgcucccgcgacggccucuccccccaggcccgccacgacuucgaccgccuccaggccggcggcggcguccucgagcagcgccccuaccgccgcggcuccgagaucuga

SEQ ID NO: 44921 - RNA, 1176 nt, Artificial Sequence
  derived and/or modified sequence opt2 from KCNJ1__Homo_sapiens__NP_000211
augaacgccuccucccgcaacgucuucgacacccucauccgcguccucaccgaguccauguucaagcaccuccgcaagugggucgucacccgcuucuucggccacucccgccagcgcgcccgccucgucuccaaggacggccgcugcaacaucgaguucggcaacgucgaggcccagucccgcuucaucuucuucgucgacaucuggaccaccguccucgaccucaaguggcgcuacaagaugaccaucuucaucaccgccuuccucggcuccugguucuucuucggccuccucugguacgccgucgccuacauccacaaggaccuccccgaguuccaccccuccgccaaccacacccccugcgucgagaacaucaacggccucaccuccgccuuccucuucucccucgagacccaggucaccaucggcuacggcuuccgcugcgucaccgagcagugcgccaccgccaucuuccuccucaucuuccaguccauccucggcgucaucaucaacuccuucaugugcggcgccauccucgccaagaucucccgccccaagaagcgcgccaagaccaucaccuucuccaagaacgccgucaucuccaagcgcggcggcaagcucugccuccucauccgcgucgccaaccuccgcaagucccuccucaucggcucccacaucuacggcaagcuccucaagaccaccgucacccccgagggcgagaccaucauccucgaccagaucaacaucaacuucgucgucgacgccggcaacgagaaccucuucuucaucuccccccucaccaucuaccacgucaucgaccacaacucccccuucuuccacauggccgccgagacccuccuccagcaggacuucgagcucgucgucuuccucgacggcaccgucgaguccaccuccgccaccugccagguccgcaccuccuacguccccgaggagguccucuggggcuaccgcuucgcccccaucgucuccaagaccaaggagggcaaguaccgcgucgacuuccacaacuucuccaagaccgucgaggucgagaccccccacugcgccaugugccucuacaacgagaaggacguccgcgcccgcaugaagcgcggcuacgacaaccccaacuucauccucuccgaggucaacgagaccgacgacaccaagauguga

SEQ ID NO: 44922 - RNA, 1284 nt, Artificial Sequence
  derived and/or modified sequence opt2 from KCNJ2__Homo_sapiens__XP_011523081
augggcuccguccgcaccaaccgcuacuccaucgucuccuccgaggaggacggcaugaagcucgccaccauggccgucgccaacggcuucggcaacggcaaguccaagguccacacccgccagcagugccgcucccgcuucgucaagaaggacggccacugcaacguccaguucaucaacgucggcgagaagggccagcgcuaccucgccgacaucuucaccaccugcgucgacauccgcuggcgcuggaugcucgucaucuucugccucgccuucguccucuccuggcucuucuucggcugcgucuucuggcucaucgcccuccuccacggcgaccucgacgccuccaaggagggcaaggccugcgucuccgaggucaacuccuucaccgccgccuuccucuucuccaucgagacccagaccaccaucggcuacggcuuccgcugcgucaccgacgagugccccaucgccgucuucauggucgucuuccaguccaucgucggcugcaucaucgacgccuucaucaucggcgccgucauggccaagauggccaagcccaagaagcgcaacgagacccucgucuucucccacaacgccgucaucgccaugcgcgacggcaagcucugccucauguggcgcgucggcaaccuccgcaagucccaccucgucgaggcccacguccgcgcccagcuccucaagucccgcaucaccuccgagggcgaguacaucccccucgaccagaucgacaucaacgucggcuucgacuccggcaucgaccgcaucuuccucgucucccccaucaccaucguccacgagaucgacgaggacuccccccucuacgaccucuccaagcaggacaucgacaacgccgacuucgagaucgucgucauccucgagggcauggucgaggccaccgccaugaccacccagugccgcuccuccuaccucgccaacgagauccucuggggccaccgcuacgagcccguccucuucgaggagaagcacuacuacaaggucgacuacucccgcuuccacaagaccuacgagguccccaacaccccccucugcuccgcccgcgaccucgccgagaagaaguacauccucuccaacgccaacuccuucugcuacgagaacgaggucgcccucaccuccaaggaggaggacgacuccgagaacggcguccccgaguccaccuccaccgacaccccccccgacaucgaccuccacaaccaggccuccgucccccucgagccccgcccccuccgccgcgaguccgagaucuga

SEQ ID NO: 44923 - RNA, 708 nt, Artificial Sequence
  derived and/or modified sequence opt2 from KCNJ3__Homo_sapiens__NP_001247437
auguccgcccuccgccgcaaguucggcgacgacuaccaggucgucaccaccuccuccuccggcuccggccuccagccccagggccccggccaggacccccagcagcagcucguccccaagaagaagcgccagcgcuucgucgacaagaacggccgcugcaacguccagcacggcaaccucggcuccgagaccucccgcuaccucuccgaccucuucaccacccucgucgaccucaaguggcgcuggaaccucuucaucuucauccucaccuacaccgucgccuggcucuucauggccuccauguggugggucaucgccuacacccgcggcgaccucaacaaggcccacgucggcaacuacacccccugcgucgccaacgucuacaacuuccccuccgccuuccucuucuucaucgagaccgaggccaccaucggcuacggcuaccgcuacaucaccgacaagugccccgagggcaucauccucuuccucuuccaguccauccucggcuccaucgucgacgccuuccucaucggcugcauguucaucaagaugucccagcccaagaagcgcgccgagacccucauguucuccgagcacgccgucaucuccaugcgcgacggcaagcucacccucauguuccgcgucggcaaccuccgcaacucccacauggucuccgcccagauccgcugcaagcuccucaagggcuga

SEQ ID NO: 44924 - RNA, 1338 nt, Artificial Sequence
  derived and/or modified sequence opt2 from KCNJ4__Homo_sapiens__NP_690607
augcacggccacucccgcaacggccaggcccacgucccccgccgcaagcgccgcaaccgcuucgucaagaagaacggccagugcaacgucuacuucgccaaccucuccaacaagucccagcgcuacauggccgacaucuucaccaccugcgucgacacccgcuggcgcuacaugcucaugaucuucuccgccgccuuccucgucuccuggcucuucuucggccuccucuucuggugcaucgccuucuuccacggcgaccucgaggccucccccggcguccccgccgccggcggccccgccgccggcggcggcggcgccgcccccgucgcccccaagcccugcaucaugcacgucaacggcuuccucggcgccuuccucuucuccgucgagacccagaccaccaucggcuacggcuuccgcugcgucaccgaggagugcccccucgccgucaucgccgucgucguccaguccaucgucggcugcgucaucgacuccuucaugaucggcaccaucauggccaagauggcccgccccaagaagcgcgcccagacccuccucuucucccaccacgccgucaucuccguccgcgacggcaagcucugccucauguggcgcgucggcaaccuccgcaagucccacaucgucgaggcccacguccgcgcccagcucaucaagcccuacaugacccaggagggcgaguaccucccccucgaccagcgcgaccucaacgucggcuacgacaucggccucgaccgcaucuuccucgucucccccaucaucaucguccacgagaucgacgaggacuccccccucuacggcaugggcaaggaggagcucgaguccgaggacuucgagaucgucgucauccucgagggcauggucgaggccaccgccaugaccacccaggcccgcuccuccuaccucgccuccgagauccucuggggccaccgcuucgagcccgucgucuucgaggagaagucccacuacaaggucgacuacucccgcuuccacaagaccuacgaggucgccggcacccccugcugcuccgcccgcgagcuccaggaguccaagaucaccguccuccccgcccccccccccccccccuccgccuucugcuacgagaacgagcucgcccucaugucccaggaggaggaggagauggaggaggaggccgccgccgccgccgccgucgccgccggccucggccucgaggccggcuccaaggaggaggccggcaucauccgcaugcucgaguucggcucccaccucgaccucgagcgcaugcaggccucccucccccucgacaacaucuccuaccgccgcgaguccgccaucuga

SEQ ID NO: 44925 - RNA, 1260 nt, Artificial Sequence
  derived and/or modified sequence opt2 from KCNJ5__Homo_sapiens__XP_011541112
auggccggcgacucccgcaacgccaugaaccaggacauggagaucggcgucacccccugggaccccaagaagauccccaagcaggcccgcgacuacguccccaucgccaccgaccgcacccgccuccucgccgagggcaagaagccccgccagcgcuacauggagaaguccggcaagugcaacguccaccacggcaacguccaggagaccuaccgcuaccucuccgaccucuucaccacccucgucgaccucaaguggcgcuucaaccuccucgucuucaccauggucuacaccgucaccuggcucuucuucggcuucaucugguggcucaucgccuacauccgcggcgaccucgaccacgucggcgaccaggaguggauccccugcgucgagaaccucuccggcuucgucuccgccuuccucuucuccaucgagaccgagaccaccaucggcuacggcuuccgcgucaucaccgagaagugccccgagggcaucauccuccuccucguccaggccauccucggcuccaucgucaacgccuucauggucggcugcauguucgucaagaucucccagcccaagaagcgcgccgagacccucauguucuccaacaacgccgucaucuccaugcgcgacgagaagcucugccucauguuccgcgucggcgaccuccgcaacucccacaucgucgaggccuccauccgcgccaagcucaucaagucccgccagaccaaggagggcgaguucaucccccucaaccagaccgacaucaacgucggcuucgacaccggcgacgaccgccucuuccucgucuccccccucaucaucucccacgagaucaaccagaagucccccuucugggagaugucccaggcccagcuccaccaggaggaguucgaggucgucgucauccucgagggcauggucgaggccaccggcaugaccugccaggcccgcuccuccuacauggacaccgagguccucuggggccaccgcuucacccccguccucacccucgagaagggcuucuacgaggucgacuacaacaccuuccacgacaccuacgagaccaacacccccuccugcugcgccaaggagcucgccgagaugaagcgcgagggccgccuccuccaguaccuccccucccccccccuccucggcggcugcgccgaggccggccucgacgccgaggccgagcagaacgaggaggacgagcccaagggccucggcggcucccgcgaggcccgcggcuccgucuga

SEQ ID NO: 44926 - RNA, 1272 nt, Artificial Sequence
  derived and/or modified sequence opt2 from KCNJ6__Homo_sapiens__NP_002231
auggccaagcucaccgaguccaugaccaacguccucgagggcgacuccauggaccaggacgucgagucccccgucgccauccaccagcccaagcuccccaagcaggcccgcgacgaccucccccgccacaucucccgcgaccgcaccaagcgcaagauccagcgcuacguccgcaaggacggcaagugcaacguccaccacggcaacguccgcgagaccuaccgcuaccucaccgacaucuucaccacccucgucgaccucaaguggcgcuucaaccuccucaucuucgucauggucuacaccgucaccuggcucuucuucggcaugaucugguggcucaucgccuacauccgcggcgacauggaccacaucgaggaccccuccuggacccccugcgucaccaaccucaacggcuucgucuccgccuuccucuucuccaucgagaccgagaccaccaucggcuacggcuaccgcgucaucaccgacaagugccccgagggcaucauccuccuccucauccaguccguccucggcuccaucgucaacgccuucauggucggcugcauguucgucaagaucucccagcccaagaagcgcgccgagacccucgucuucuccacccacgccgucaucuccaugcgcgacggcaagcucugccucauguuccgcgucggcgaccuccgcaacucccacaucgucgaggccuccauccgcgccaagcucaucaaguccaagcagaccuccgagggcgaguucaucccccucaaccagaccgacaucaacgucggcuacuacaccggcgacgaccgccucuuccucgucuccccccucaucaucucccacgagaucaaccagcagucccccuucugggagaucuccaaggcccagcuccccaaggaggagcucgagaucgucgucauccucgagggcauggucgaggccaccggcaugaccugccaggcccgcuccuccuacaucaccuccgagauccucuggggcuaccgcuucacccccguccucacccucgaggacggcuucuacgaggucgacuacaacuccuuccacgagaccuacgagaccuccacccccucccucuccgccaaggagcucgccgagcucgccucccgcgccgagcucccccucuccugguccgucuccuccaagcucaaccagcacgccgagcucgagaccgaggaggaggagaagaaccucgaggagcagaccgagcgcaacggcgacgucgccaaccucgagaacgaguccaaggucuga

SEQ ID NO: 44927 - RNA, 1275 nt, Artificial Sequence
  derived and/or modified sequence opt2 from KCNJ8__Homo_sapiens__XP_005253415
augcucgcccgcaaguccaucauccccgaggaguacguccucgcccgcaucgccgccgagaaccuccgcaagccccgcauccgcgaccgccuccccaaggcccgcuucaucgccaaguccggcgccugcaaccucgcccacaagaacauccgcgagcagggccgcuuccuccaggacaucuucaccacccucgucgaccucaaguggcgccacacccucgucaucuucaccauguccuuccucugcuccuggcuccucuucgccaucaugugguggcucgucgccuucgcccacggcgacaucuacgccuacauggagaaguccggcauggagaaguccggccucgaguccaccgucugcgucaccaacguccgcuccuucaccuccgccuuccucuucuccaucgagguccaggucaccaucggcuucggcggccgcaugaugaccgaggagugcccccucgccaucaccguccucauccuccagaacaucgucggccucaucaucaacgccgucaugcucggcugcaucuucaugaagaccgcccaggcccaccgccgcgccgagacccucaucuucucccgccacgccgucaucgccguccgcaacggcaagcucugcuucauguuccgcgucggcgaccuccgcaaguccaugaucaucuccgccuccguccgcauccaggucgucaagaagaccaccacccccgagggcgaggucguccccauccaccagcucgacauccccgucgacaaccccaucgaguccaacaacaucuuccucgucgccccccucaucaucugccacgucaucgacaagcgcuccccccucuacgacaucuccgccaccgaccucgccaaccaggaccucgaggucaucgucauccucgagggcgucgucgagaccaccggcaucaccacccaggcccgcaccuccuacaucgccgaggagauccaguggggccaccgcuucgucuccaucgucaccgaggaggagggcgucuacuccgucgacuacuccaaguucggcaacaccgucaaggucgccgccccccgcugcuccgcccgcgagcucgacgagaagcccuccauccucauccagacccuccagaaguccgagcucucccaccagaacucccuccgcaagcgcaacuccaugcgccgcaacaacuccaugcgccgcaacaacuccauccgccgcaacaacuccucccucaugguccccaagguccaguucaugacccccgagggcaaccagaacaccuccgaguccuga

SEQ ID NO: 44928 - RNA, 1371 nt, Artificial Sequence
  derived and/or modified sequence opt2 from KCNJ9__Homo_sapiens__XP_006711368
augcgcucccgccucgaggagcucaaguuccucgagggccgcuggcgcaaccagguccucgaccucgagaucgagccccuccaggacccccgccgccgccucggcgcccagcgccgcgccgccggcggcuccuccuccggcccccgccgcacccccggcgcccgcuccgcccgccccgacgccgccgccauggcccaggagaacgccgccuucucccccggccaggaggagcccccccgccgccgcggccgccagcgcuacgucgagaaggacggccgcugcaacguccagcagggcaacguccgcgagaccuaccgcuaccucaccgaccucuucaccacccucgucgaccuccaguggcgccucucccuccucuucuucguccucgccuacgcccucaccuggcucuucuucggcgccaucugguggcucaucgccuacggccgcggcgaccucgagcaccucgaggacaccgccuggacccccugcgucaacaaccucaacggcuucgucgccgccuuccucuucuccaucgagaccgagaccaccaucggcuacggccaccgcgucaucaccgaccagugccccgagggcaucguccuccuccuccuccaggccauccucggcuccauggucaacgccuucauggucggcugcauguucgucaagaucucccagcccaacaagcgcgccgccacccucgucuucuccucccacgccgucgucucccuccgcgacggccgccucugccucauguuccgcgucggcgaccuccgcuccucccacaucgucgaggccuccauccgcgccaagcucauccgcucccgccagacccucgagggcgaguucaucccccuccaccagaccgaccucuccgucggcuucgacaccggcgacgaccgccucuuccucgucuccccccucgucaucucccacgagaucgacgccgccucccccuucugggaggccucccgccgcgcccucgagcgcgacgacuucgagaucgucgucauccucgagggcauggucgaggccaccggcaugaccugccaggcccgcuccuccuaccucgucgacgagguccucuggggccaccgcuucaccuccguccucacccucgaggacggcuucuacgaggucgacuacgccuccuuccacgagaccuucgagguccccacccccuccugcuccgcccgcgagcucgccgaggccgccgcccgccucgacgcccaccucuacugguccauccccucccgccucgacgagaaggucgaggaggagggcgccggcgagggcgccggcggcgaggccggcgccgacaaggagcagaacggcugccuccccccccccgaguccgaguccaaggucuga

SEQ ID NO: 44929 - RNA, 1617 nt, Artificial Sequence
  derived and/or modified sequence opt2 from KCNK10__Homo_sapiens__NP_066984
auguucuuccucuacaccgacuucuuccucucccucgucgccguccccgccgccgcccccgucugccagcccaaguccgccaccaacggccagccccccgcccccgcccccacccccaccccccgccucuccaucuccucccgcgccaccgucgucgcccgcauggagggcaccucccagggcggccuccagaccgucaugaaguggaagaccgucgucgccaucuucgucgucgucgucgucuaccucgucaccggcggccucgucuuccgcgcccucgagcagcccuucgaguccucccagaagaacaccaucgcccucgagaaggccgaguuccuccgcgaccacgucugcgucuccccccaggagcucgagacccucauccagcacgcccucgacgccgacaacgccggcgucucccccaucggcaacuccuccaacaacuccucccacugggaccucggcuccgccuucuucuucgccggcaccgucaucaccaccaucggcuacggcaacaucgcccccuccaccgagggcggcaagaucuucugcauccucuacgccaucuucggcaucccccucuucggcuuccuccucgccggcaucggcgaccagcucggcaccaucuucggcaaguccaucgcccgcgucgagaaggucuuccgcaagaagcaggucucccagaccaagauccgcgucaucuccaccauccucuucauccucgccggcugcaucgucuucgucaccauccccgccgucaucuucaaguacaucgagggcuggaccgcccucgaguccaucuacuucgucgucgucacccucaccaccgucggcuucggcgacuucgucgccggcggcaacgccggcaucaacuaccgcgagugguacaagccccucgucugguucuggauccucgucggccucgccuacuucgccgccguccucuccaugaucggcgacuggcuccgcguccucuccaagaagaccaaggaggaggucggcgagaucaaggcccacgccgccgaguggaaggccaacgucaccgccgaguuccgcgagacccgccgccgccucuccgucgagauccacgacaagcuccagcgcgccgccaccauccgcuccauggagcgccgccgccucggccucgaccagcgcgcccacucccucgacaugcucucccccgagaagcgcuccgucuucgccgcccucgacaccggccgcuucaaggccuccucccaggaguccaucaacaaccgccccaacaaccuccgccucaagggccccgagcagcucaacaagcacggccagggcgccuccgaggacaacaucaucaacaaguucggcuccaccucccgccucaccaagcgcaagaacaaggaccucaagaagacccuccccgaggacguccagaagaucuacaagaccuuccgcaacuacucccucgacgaggagaagaaggaggaggagaccgagaagaugugcaacuccgacaacuccuccaccgccaugcucaccgacugcauccagcagcacgccgagcucgagaacggcaugauccccaccgacaccaaggaccgcgagcccgagaacaacucccuccucgaggaccgcaacuga

SEQ ID NO: 44930 - RNA, 1293 nt, Artificial Sequence
  derived and/or modified sequence opt2 from KCNK12__Homo_sapiens__NP_071338
auguccucccgcuccccccgcccccccccccgccgcucccgccgccgccucccccgccccuccugcugcugcugcugcugccgccgcucccaccucaacgaggacaccggccgcuucguccuccucgccgcccucaucggccucuaccucgucgccggcgccaccgucuucuccgcccucgagucccccggcgaggccgaggcccgcgcccgcuggggcgccacccuccgcaacuucuccgccgcccacggcgucgccgagcccgagcuccgcgccuuccuccgccacuacgaggccgcccucgccgccggcguccgcgccgacgcccuccgcccccgcugggacuuccccggcgccuucuacuucgucggcaccgucgucuccaccaucggcuucggcaugaccacccccgccaccgucggcggcaaggccuuccucaucgccuacggccucuucggcugcgccggcaccauccucuucuucaaccucuuccucgagcgcaucaucucccuccucgccuucaucaugcgcgccugccgcgagcgccagcuccgccgcuccggccuccuccccgccaccuuccgccgcggcuccgcccucuccgaggccgacucccucgccggcuggaagcccuccgucuaccacguccuccucauccucggccucuucgccguccuccucuccugcugcgccuccgccauguacaccuccgucgagggcugggacuacgucgacucccucuacuucugcuucgucaccuucuccaccaucggcuucggcgaccucgucuccucccagcacgccgccuaccgcaaccagggccucuaccgccucggcaacuuccucuucauccuccucggcgucugcugcaucuacucccucuucaacgucaucuccauccucaucaagcagguccucaacuggaugcuccgcaagcucuccugccgcugcugcgcccgcugcugccccgcccccggcgccccccucgcccgccgcaacgccaucacccccggcucccgccuccgccgccgccucgccgcccucggcgccgaccccgccgcccgcgacuccgacgccgagggccgccgccucuccggcgagcucaucuccaugcgcgaccucaccgccuccaacaaggucucccucgcccuccuccagaagcagcucuccgagaccgccaacggcuacccccgcuccgucugcgucaacacccgccagaacggcuucuccggcggcgucggcgcccucggcaucaugaacaaccgccucgccgagaccuccgccucccgcuga

SEQ ID NO: 44931 - RNA, 969 nt, Artificial Sequence
  derived and/or modified sequence opt2 from KCNK16__Homo_sapiens__NP_001128577
augcccuccgccggccucugcuccugcuggggcggccgcguccucccccuccuccucgccuacgucugcuaccuccuccucggcgccaccaucuuccagcuccucgagcgccaggccgaggcccagucccgcgaccaguuccagcucgagaagcuccgcuuccucgagaacuacaccugccucgaccagugggccauggagcaguucguccaggucaucauggaggccugggucaagggcgucaaccccaagggcaacuccaccaaccccuccaacugggacuucggcuccuccuucuucuucgccggcaccgucgucaccaccaucggcuacggcaaccucgcccccuccaccgaggccggccaggucuucugcgucuucuacgcccuccucggcaucccccucaacgucaucuuccucaaccaccucggcaccggccuccgcgcccaccucgccgccaucgagcgcugggaggaccgcccccgccgcucccagguccuccagguccucggccucgcccucuuccucacccucggcacccucgucauccucaucuucccccccauggucuucucccacgucgagggcugguccuucuccgagggcuucuacuucgccuucaucacccucuccaccaucggcuucggcgacuacgucgucggccacccccucaacuucaucacccccuccggccuccuccccucccaggagcccuuccagaccccccacggcaagcccgagucccagcagauccccggcuccuuccagaaggucuccuccaugaacgucuggccccucuccggcaugcacucccccggccucgccuucccccuccccgacugcaacauccccgaccaggagcgcuuccgcccccuccaccccggcgccuggaaguucuggccccucccccuccccuccuccaacuccaagugggcccccauguggcucggcuccuccgcccaggucuga

SEQ ID NO: 44932 - RNA, 816 nt, Artificial Sequence
  derived and/or modified sequence opt2 from KCNK17__Homo_sapiens__NP_001128583
auguaccgcccccgcgcccgcgccgcccccgagggccgcguccgcggcugcgccguccccuccaccguccuccuccuccucgccuaccucgccuaccucgcccucggcaccggcgucuucuggacccucgagggccgcgccgcccaggacuccucccgcuccuuccagcgcgacaagugggagcuccuccagaacuucaccugccucgaccgccccgcccucgacucccucauccgcgacgucguccaggccuacaagaacggcgccucccuccucuccaacaccaccuccaugggccgcugggagcucgucggcuccuucuucuucuccgucuccaccaucaccaccaucggcuacggcaaccucucccccaacaccauggccgcccgccucuucugcaucuucuucgcccucgucggcaucccccucaaccucgucguccucaaccgccucggccaccucaugcagcagggcgucaaccacugggccucccgccucggcggcaccuggcaggaccccgacaaggcccgcuggcucgccggcuccggcgcccuccucuccggccuccuccucuuccuccuccuccccccccuccucuucucccacauggagggcugguccuacaccgagggcuucuacuucgccuucaucacccucuccaccgucggcuucggcgacuacgucaucgccuccugccucaucuccgacacccgcaagcccaaccgcgacuggcagacccucgagcgcaccuccaaguccuccggcggccuccucaaguaccgcuuccucgccggccacggcggcucccaccucuga

SEQ ID NO: 44933 - RNA, 1155 nt, Artificial Sequence
  derived and/or modified sequence opt2 from KCNK18__Homo_sapiens__NP_862823
auggaggucuccggccacccccaggcccgccgcugcugccccgaggcccucggcaagcucuuccccggccucugcuuccucugcuuccucgucaccuacgcccucgucggcgccgucgucuucuccgccaucgaggacggccagguccucgucgccgccgacgacggcgaguucgagaaguuccucgaggagcucugccgcauccucaacugcuccgagaccgucgucgaggaccgcaagcaggaccuccagggccaccuccagaaggucaagccccagugguucaaccgcaccacccacugguccuuccucuccucccucuucuucugcugcaccgucuucuccaccgucggcuacggcuacaucuaccccgucacccgccucggcaaguaccucugcaugcucuacgcccucuucggcaucccccucauguuccucguccucaccgacaccggcgacauccucgccaccauccucuccaccuccuacaaccgcuuccgcaaguuccccuucuucacccgcccccuccucuccaaguggugccccaagucccucuucaagaagaagcccgaccccaagcccgccgacgaggccgucccccagaucaucaucuccgccgaggagcuccccggccccaagcucggcaccugccccucccgccccuccugcuccauggagcucuucgagcgcucccacgcccucgagaagcagaacacccuccagcuccccccccaggccauggagcgcuccaacuccugccccgagcucguccucggccgccucuccuacuccaucaucuccaaccucgacgaggucggccagcaggucgagcgccucgacaucccccuccccaucaucgcccucaucgucuucgccuacaucuccugcgccgccgccauccuccccuucugggagacccagcucgacuucgagaacgccuucuacuucugcuucgucacccucaccaccaucggcuucggcgacaccguccucgagcaccccaacuucuuccucuucuucuccaucuacaucaucgucggcauggagaucgucuucaucgccuucaagcucguccagaaccgccucaucgacaucuacaagaacgucaugcucuucuucgccaagggcaaguucuaccaccucgucaagaaguga

SEQ ID NO: 44934 - RNA, 1011 nt, Artificial Sequence
  derived and/or modified sequence opt2 from KCNK1__Homo_sapiens__NP_002236
augcuccagucccucgccggcuccuccugcguccgccucgucgagcgccaccgcuccgccuggugcuucggcuuccucguccucggcuaccuccucuaccucgucuucggcgccgucgucuucuccuccgucgagcuccccuacgaggaccuccuccgccaggagcuccgcaagcucaagcgccgcuuccucgaggagcacgagugccucuccgagcagcagcucgagcaguuccucggccgcguccucgaggccuccaacuacggcgucuccguccucuccaacgccuccggcaacuggaacugggacuucaccuccgcccucuucuucgccuccaccguccucuccaccaccggcuacggccacaccgucccccucuccgacggcggcaaggccuucugcaucaucuacuccgucaucggcauccccuucacccuccucuuccucaccgccgucguccagcgcaucaccguccacgucacccgccgccccguccucuacuuccacauccgcuggggcuucuccaagcaggucgucgccaucguccacgccguccuccucggcuucgucaccgucuccugcuucuucuucauccccgccgccgucuucuccguccucgaggacgacuggaacuuccucgaguccuucuacuucugcuucaucucccucuccaccaucggccucggcgacuacguccccggcgagggcuacaaccagaaguuccgcgagcucuacaagaucggcaucaccugcuaccuccuccucggccucaucgccaugcucgucguccucgagaccuucugcgagcuccacgagcucaagaaguuccgcaagauguucuacgucaagaaggacaaggacgaggaccagguccacaucaucgagcacgaccagcucuccuucuccuccaucaccgaccaggccgccggcaugaaggaggaccagaagcagaacgagcccuucgucgccacccaguccuccgccugcgucgacggccccgccaaccacuga

SEQ ID NO: 44935 - RNA, 1269 nt, Artificial Sequence
  derived and/or modified sequence opt2 from KCNK2__Homo_sapiens__NP_001017424
augaugaacccccgcgccaagcgcgacuucuaccucgccgcccccgaccuccucgaccccaaguccgccgcccagaacuccaagccccgccucuccuucuccaccaagcccaccguccucgccucccgcgucgaguccgacaccaccaucaacgucaugaaguggaagaccgucuccaccaucuuccucgucgucguccucuaccucaucaucggcgccaccgucuucaaggcccucgagcagccccacgagaucucccagcgcaccaccaucgucauccagaagcagaccuucaucucccagcacuccugcgucaacuccaccgagcucgacgagcucauccagcagaucgucgccgccaucaacgccggcaucaucccccucggcaacaccuccaaccagaucucccacugggaccucggcuccuccuucuucuucgccggcaccgucaucaccaccaucggcuucggcaacaucuccccccgcaccgagggcggcaagaucuucugcaucaucuacgcccuccucggcaucccccucuucggcuuccuccucgccggcgucggcgaccagcucggcaccaucuucggcaagggcaucgccaaggucgaggacaccuucaucaaguggaacgucucccagaccaagauccgcaucaucuccaccaucaucuucauccucuucggcugcguccucuucgucgcccuccccgccaucaucuucaagcacaucgagggcugguccgcccucgacgccaucuacuucgucgucaucacccucaccaccaucggcuucggcgacuacgucgccggcggcuccgacaucgaguaccucgacuucuacaagcccgucgucugguucuggauccucgucggccucgccuacuucgccgccguccucuccaugaucggcgacuggcuccgcgucaucuccaagaagaccaaggaggaggucggcgaguuccgcgcccacgccgccgaguggaccgccaacgucaccgccgaguucaaggagacccgccgccgccucuccgucgagaucuacgacaaguuccagcgcgccaccuccaucaagcgcaagcucuccgccgagcucgccggcaaccacaaccaggagcucacccccugccgccgcacccucuccgucaaccaccucaccuccgagcgcgacguccuccccccccuccucaagaccgaguccaucuaccucaacggccucaccccccacugcgccggcgaggagaucgccgucaucgagaacaucaaguga

SEQ ID NO: 44936 - RNA, 1185 nt, Artificial Sequence
  derived and/or modified sequence opt2 from KCNK3__Homo_sapiens__NP_002237
augaagcgccagaacguccgcacccucgcccucaucgucugcaccuucaccuaccuccucgucggcgccgccgucuucgacgcccucgaguccgagcccgagcucaucgagcgccagcgccucgagcuccgccagcaggagcuccgcgcccgcuacaaccucucccagggcggcuacgaggagcucgagcgcgucguccuccgccucaagccccacaaggccggcguccaguggcgcuucgccggcuccuucuacuucgccaucaccgucaucaccaccaucggcuacggccacgccgcccccuccaccgacggcggcaaggucuucugcauguucuacgcccuccucggcaucccccucacccucgucauguuccagucccucggcgagcgcaucaacacccucguccgcuaccuccuccaccgcgccaagaagggccucggcaugcgccgcgccgacgucuccauggccaacaugguccucaucggcuucuucuccugcaucuccacccucugcaucggcgccgccgccuucucccacuacgagcacuggaccuucuuccaggccuacuacuacugcuucaucacccucaccaccaucggcuucggcgacuacgucgcccuccagaaggaccaggcccuccagacccagccccaguacgucgccuucuccuucgucuacauccucaccggccucaccgucaucggcgccuuccucaaccucgucguccuccgcuucaugaccaugaacgccgaggacgagaagcgcgacgccgagcaccgcgcccuccucacccgcaacggccaggccggcggcggcggcggcggcggcuccgcccacaccaccgacaccgccuccuccaccgccgccgccggcggcggcggcuuccgcaacgucuacgccgagguccuccacuuccaguccaugugcuccugccucugguacaagucccgcgagaagcuccaguacuccauccccaugaucaucccccgcgaccucuccaccuccgacaccugcgucgagcagucccacuccucccccggcggcggcggccgcuacuccgacacccccucccgccgcugccucugcuccggcgccccccgcuccgccaucuccuccgucuccaccggccuccacucccucuccaccuuccgcggccucaugaagcgccgcuccuccgucuga

SEQ ID NO: 44937 - RNA, 1500 nt, Artificial Sequence
  derived and/or modified sequence opt2 from KCNK5__Homo_sapiens__NP_003731
auggucgaccgcggcccccuccucaccuccgccaucaucuucuaccucgccaucggcgccgccaucuucgagguccucgaggagccccacuggaaggaggccaagaagaacuacuacacccagaagcuccaccuccucaaggaguuccccugccucggccaggagggccucgacaagauccucgaggucgucuccgacgccgccggccagggcgucgccaucaccggcaaccagaccuucaacaacuggaacuggcccaacgccaugaucuucgccgccaccgucaucaccaccaucggcuacggcaacgucgcccccaagacccccgccggccgccucuucugcgucuucuacggccucuucggcgucccccucugccucaccuggaucuccgcccucggcaaguucuucggcggccgcgccaagcgccucggccaguuccucaccaagcgcggcgucucccuccgcaaggcccagaucaccugcaccgucaucuucaucgucuggggcguccucguccaccucgucaucccccccuucgucuucauggucaccgagggcuggaacuacaucgagggccucuacuacuccuucaucaccaucuccaccaucggcuucggcgacuucgucgccggcgucaaccccuccgccaacuaccacgcccucuaccgcuacuucgucgagcucuggaucuaccucggccucgccuggcucucccucuucgucaacuggaaggucuccauguucgucgagguccacaaggccaucaagaagcgccgccgccgccgcaaggaguccuucgaguccuccccccacucccgcaaggcccuccaggucaagggcuccaccgccuccaaggacgucaacaucuucuccuuccucuccaagaaggaggagaccuacaacgaccucaucaagcagaucggcaagaaggccaugaagaccuccggcggcggcgagaccggccccggccccggccucggcccccagggcggcggccuccccgcccucccccccucccucgucccccucgucgucuacuccaagaaccgcguccccacccucgaggaggucucccagacccuccgcuccaagggccacgucucccgcucccccgacgaggaggccgucgcccgcgcccccgaggacuccucccccgcccccgaggucuucaugaaccagcucgaccgcaucuccgaggagugcgagcccugggacgcccaggacuaccacccccucaucuuccaggacgccuccaucaccuucgucaacaccgaggccggccucuccgacgaggagaccuccaaguccucccucgaggacaaccucgccggcgaggaguccccccagcagggcgccgaggccaaggccccccucaacaugggcgaguuccccuccuccuccgaguccaccuucaccuccaccgaguccgagcucuccguccccuacgagcagcucaugaacgaguacaacaaggccaacucccccaagggcaccuga

SEQ ID NO: 44938 - RNA, 942 nt, Artificial Sequence
  derived and/or modified sequence opt2 from KCNK6__Homo_sapiens__NP_004814
augcgccgcggcgcccuccucgccggcgcccucgccgccuacgccgccuaccucguccucggcgcccuccucgucgcccgccucgagggcccccacgaggcccgccuccgcgccgagcucgagacccuccgcgcccagcuccuccagcgcucccccugcgucgccgcccccgcccucgacgccuucgucgagcgcguccucgccgccggccgccucggccgcgucguccucgccaacgccuccggcuccgccaacgccuccgaccccgccugggacuucgccuccgcccucuucuucgccuccacccucaucaccaccgucggcuacggcuacaccaccccccucaccgacgccggcaaggccuucuccaucgccuucgcccuccucggcguccccaccaccaugcuccuccucaccgccuccgcccagcgccucucccuccuccucacccacgucccccucuccuggcucuccaugcgcuggggcugggacccccgccgcgccgccugcuggcaccucgucgcccuccucggcgucgucgucaccgucugcuuccucguccccgccgucaucuucgcccaccucgaggaggccugguccuuccucgacgccuucuacuucugcuucaucucccucuccaccaucggccucggcgacuacguccccggcgaggcccccggccagcccuaccgcgcccucuacaagguccucgucaccgucuaccucuuccucggccucgucgccaugguccucguccuccagaccuuccgccacgucuccgaccuccacggccucaccgagcucauccuccuccccccccccugccccgccuccuucaacgccgacgaggacgaccgcgucgacauccucggcccccagcccgagucccaccagcagcucuccgccuccucccacaccgacuacgccuccaucccccgcuga

SEQ ID NO: 44939 - RNA, 1125 nt, Artificial Sequence
  derived and/or modified sequence opt2 from KCNK9__Homo_sapiens__XP_011515404
augaagcgccagaacguccgcacccucucccucaucgucugcaccuucaccuaccuccucgucggcgccgccgucuucgacgcccucgaguccgaccacgagaugcgcgaggaggagaagcucaaggccgaggagauccgcaucaagggcaaguacaacaucuccuccgaggacuaccgccagcucgagcucgucauccuccaguccgagccccaccgcgccggcguccaguggaaguucgccggcuccuucuacuucgccaucaccgucaucaccaccaucggcuacggccacgccgcccccggcaccgacgccggcaaggccuucugcauguucuacgccguccucggcaucccccucacccucgucauguuccagucccucggcgagcgcaugaacaccuucguccgcuaccuccucaagcgcaucaagaagugcugcggcaugcgcaacaccgacgucuccauggagaacauggucaccgucggcuucuucuccugcaugggcacccucugcaucggcgccgccgccuucucccagugcgaggagugguccuucuuccacgccuacuacuacugcuucaucacccucaccaccaucggcuucggcgacuacgucgcccuccagaccaagggcgcccuccagaagaagccccucuacgucgccuucuccuucauguacauccucgucggccucaccgucaucggcgccuuccucaaccucgucguccuccgcuuccucaccaugaacuccgaggacgagcgccgcgacgccgaggagcgcgccucccucgccggcaaccgcaacuccauggucauccacauccccgaggagccccgccccucccgcccccgcuacaaggccgacguccccgaccuccaguccgucugcuccugcaccugcuaccgcucccaggacuacggcggccgcuccgucgccccccagaacuccuucuccgccaagcucgccccccacuacuuccacuccaucuccuacaagaucgaggagaucucccccuccacccucaagaacucccucuuccccucccccaucuccuccaucucccccggccuccacuccuucaccgaccaccagcgccucaugaagcgccgcaaguccgucuga

SEQ ID NO: 44940 - RNA, 3711 nt, Artificial Sequence
  derived and/or modified sequence opt2 from KCNMA1__Homo_sapiens__NP_001154824
auggccaacggcggcggcggcggcggcggcuccuccggcggcggcggcggcggcggcggcuccucccuccgcauguccuccaacauccacgccaaccaccucucccucgacgccuccuccuccuccuccuccuccuccuccuccuccuccuccuccuccuccuccuccuccuccuccuccguccacgagcccaagauggacgcccucaucauccccgucaccauggagguccccugcgacucccgcggccagcgcauguggugggccuuccucgccuccuccauggucaccuucuucggcggccucuucaucauccuccucuggcgcacccucaaguaccucuggaccgucugcugccacugcggcggcaagaccaaggaggcccagaagaucaacaacggcuccucccaggccgacggcacccucaagcccgucgacgagaaggaggaggccgucgccgccgaggucggcuggaugaccuccgucaaggacugggccggcgucaugaucuccgcccagacccucaccggccgcguccucgucguccucgucuucgcccucuccaucggcgcccucgucaucuacuucaucgacuccuccaaccccaucgaguccugccagaacuucuacaaggacuucacccuccagaucgacauggccuucaacgucuucuuccuccucuacuucggccuccgcuucaucgccgccaacgacaagcucugguucuggcucgaggucaacuccgucgucgacuucuucaccgucccccccgucuucgucuccgucuaccucaaccgcuccuggcucggccuccgcuuccuccgcgcccuccgccucauccaguucuccgagauccuccaguuccucaacauccucaagaccuccaacuccaucaagcucgucaaccuccucuccaucuucaucuccaccuggcucaccgccgccggcuucauccaccucgucgagaacuccggcgaccccugggagaacuuccagaacaaccaggcccucaccuacugggagugcgucuaccuccucauggucaccauguccaccgucggcuacggcgacgucuacgccaagaccacccucggccgccucuucauggucuucuucauccucggcggccucgccauguucgccuccuacguccccgagaucaucgagcucaucggcaaccgcaagaaguacggcggcuccuacuccgccgucuccggccgcaagcacaucgucgucugcggccacaucacccucgaguccgucuccaacuuccucaaggacuuccuccacaaggaccgcgacgacgucaacgucgagaucgucuuccuccacaacaucucccccaaccucgagcucgaggcccucuucaagcgccacuucacccaggucgaguucuaccagggcuccguccucaacccccacgaccucgcccgcgucaagaucgaguccgccgacgccugccucauccucgccaacaaguacugcgccgaccccgacgccgaggacgccuccaacaucaugcgcgucaucuccaucaagaacuaccaccccaagauccgcaucaucacccagaugcuccaguaccacaacaaggcccaccuccucaacauccccuccuggaacuggaaggagggcgacgacgccaucugccucgccgagcucaagcucggcuucaucgcccaguccugccucgcccagggccucuccaccaugcucgccaaccucuucuccaugcgcuccuucaucaagaucgaggaggacaccuggcagaaguacuaccucgagggcgucuccaacgagauguacaccgaguaccucuccuccgccuucgucggccucuccuuccccaccgucugcgagcucugcuucgucaagcucaagcuccucaugaucgccaucgaguacaaguccgccaaccgcgagucccgcauccucaucaaccccggcaaccaccucaagauccaggagggcacccucggcuucuucaucgccuccgacgccaaggaggucaagcgcgccuucuucuacugcaaggccugccacgacgacaucaccgaccccaagcgcaucaagaagugcggcugcaagcgccccaagauguccaucuacaagcgcaugcgccgcgccugcugcuucgacugcggccgcuccgagcgcgacugcuccugcauguccggccgcguccgcggcaacgucgacacccucgagcgcgccuucccccucuccuccgucuccgucaacgacugcuccaccuccuuccgcgccuucgaggacgagcagcccuccacccucucccccaagaagaagcagcgcaacggcggcaugcgcaacucccccaacaccucccccaagcucaugcgccacgacccccuccucauccccggcaacgaccagaucgacaacauggacuccaacgucaagaaguacgacuccaccggcauguuccacuggugcgcccccaaggagaucgagaaggucauccucacccgcuccgaggccgccaugaccguccucuccggccacgucgucgucugcaucuucggcgacgucuccuccgcccucaucggccuccgcaaccucgucaugccccuccgcgccuccaacuuccacuaccacgagcucaagcacaucgucuucgucggcuccaucgaguaccucaagcgcgagugggagacccuccacaacuuccccaaggucuccauccuccccggcaccccccucucccgcgccgaccuccgcgccgucaacaucaaccucugcgacaugugcgucauccucuccgccaaccagaacaacaucgacgacaccucccuccaggacaaggagugcauccucgccucccucaacaucaaguccaugcaguucgacgacuccaucggcguccuccaggccaacucccagggcuucaccccccccggcauggaccgcuccucccccgacaacucccccguccacggcaugcuccgccagcccuccaucaccaccggcgucaacauccccaucaucaccgagcucgucaacgacaccaacguccaguuccucgaccaggacgacgacgacgaccccgacaccgagcucuaccucacccagcccuucgccugcggcaccgccuucgccgucuccguccucgacucccucauguccgccaccuacuucaacgacaacauccucacccucauccgcacccucgucaccggcggcgccacccccgagcucgaggcccucaucgccgaggagaacgcccuccgcggcggcuacuccaccccccagacccucgccaaccgcgaccgcugccgcgucgcccagcucgcccuccucgacggccccuucgccgaccucggcgacggcggcugcuacggcgaccucuucugcaaggcccucaagaccuacaacaugcucugcuucggcaucuaccgccuccgcgacgcccaccucuccacccccucccagugcaccaagcgcuacgucaucaccaacccccccuacgaguucgagcucguccccaccgaccucaucuucugccucaugcaguucgaccacaacgccggccagucccgcgccucccucucccacuccucccacuccucccaguccuccuccaagaaguccuccuccguccacuccauccccuccaccgccaaccgccagaaccgccccaagucccgcgagucccgcgacaagcagaaguacguccaggaggagcgccucuga

SEQ ID NO: 44941 - RNA, 576 nt, Artificial Sequence
  derived and/or modified sequence opt2 from KCNMB1__Homo_sapiens__NP_004128
auggucaagaagcucgucauggcccagaagcgcggcgagacccgcgcccucugccucggcgucaccauggucgucugcgccgucaucaccuacuacauccucgucaccaccguccucccccucuaccagaaguccgucuggacccaggaguccaagugccaccucaucgagaccaacauccgcgaccaggaggagcucaagggcaagaaggucccccaguaccccugccucugggucaacgucuccgccgccggccgcugggccguccucuaccacaccgaggacacccgcgaccagaaccagcagugcuccuacauccccggcuccgucgacaacuaccagaccgcccgcgccgacgucgagaagguccgcgccaaguuccaggagcagcaggucuucuacugcuucuccgccccccgcggcaacgagaccuccguccucuuccagcgccucuacggcccccaggcccuccucuucucccucuucuggcccaccuuccuccucaccggcggccuccucaucaucgccauggucaaguccaaccaguaccucuccauccucgccgcccagaaguga

SEQ ID NO: 44942 - RNA, 708 nt, Artificial Sequence
  derived and/or modified sequence opt2 from KCNMB2__Homo_sapiens__NP_001265840
auguucaucuggaccuccggccgcaccuccuccuccuaccgccacgacgagaagcgcaacaucuaccagaagauccgcgaccacgaccuccucgacaagcgcaagaccgucaccgcccucaaggccggcgaggaccgcgccauccuccucggccucgccaugauggucugcuccaucaugauguacuuccuccucggcaucacccuccuccgcuccuacaugcaguccgucuggaccgaggagucccagugcacccuccucaacgccuccaucaccgagaccuucaacugcuccuucuccugcggccccgacugcuggaagcucucccaguaccccugccuccaggucuacgucaaccucaccuccuccggcgagaagcuccuccucuaccacaccgaggagaccaucaagaucaaccagaagugcuccuacauccccaagugcggcaagaacuucgaggaguccaugucccucgucaacgucgucauggagaacuuccgcaaguaccagcacuucuccugcuacuccgaccccgagggcaaccagaaguccgucauccucaccaagcucuacuccuccaacguccucuuccacucccucuucuggcccaccugcaugauggccggcggcgucgccaucgucgccauggucaagcucacccaguaccucucccuccucugcgagcgcauccagcgcaucaaccgcuga

SEQ ID NO: 44943 - RNA, 522 nt, Artificial Sequence
  derived and/or modified sequence opt2 from KCNMB3__Homo_sapiens__NP_001157149
augcagcccuucuccauccccguccagaucacccuccagggcucccgccgccgccagggccgcaccgccuuccccgccuccggcaagaagcgcgagaccgacuacuccgacggcgacccccucgacguccacaagcgccuccccuccuccgccggcgaggaccgcgccgucaugcucggcuucgccaugaugggcuucuccguccucauguucuuccuccucggcaccaccauccucaagcccuucaugcucuccauccagcgcgaggaguccaccugcaccgccauccacaccgacaucauggacgacuggcucgacugcgccuucaccugcggcguccacugccacggccagggcaaguaccccugccuccaggucuucgucaaccucucccaccccggccagaaggcccuccuccacuacaacgaggaggccguccagaucaaccccaagcgcgacgucaccgacugccgcgucaaggagaagcagacccucaccgucuccgacgagcacaagcaguga

SEQ ID NO: 44944 - RNA, 633 nt, Artificial Sequence
  derived and/or modified sequence opt2 from KCNMB4__Homo_sapiens__NP_055320
auggccaagcuccgcgucgccuacgaguacaccgaggccgaggacaaguccauccgccucggccucuuccucaucaucuccggcgucgucucccucuucaucuucggcuucugcuggcucucccccgcccuccaggaccuccaggccaccgaggccaacugcaccguccucuccguccagcagaucggcgaggucuucgagugcaccuucaccugcggcgccgacugccgcggcaccucccaguaccccugcguccaggucuacgucaacaacuccgaguccaacucccgcgcccuccuccacuccgacgagcaccagcuccucaccaaccccaagugcuccuacaucccccccugcaagcgcgagaaccagaagaaccucgaguccgucaugaacuggcagcaguacuggaaggacgagaucggcucccagcccuucaccugcuacuucaaccagcaccagcgccccgacgacguccuccuccaccgcacccacgacgagaucguccuccuccacugcuuccucuggccccucgucaccuucgucgucggcguccucaucgucguccucaccaucugcgccaagucccucgccgucaaggccgaggccaugaagaagcgcaaguucuccuga

SEQ ID NO: 44945 - RNA, 1632 nt, Artificial Sequence
  derived and/or modified sequence opt2 from KCNN1__Homo_sapiens__NP_002239
augaacucccacuccuacaacggcuccgucggccgcccccucggcuccggccccggcgcccucggccgcgacccccccgaccccgaggccggccaccccccccagcccccccacucccccggccuccaggucgucgucgccaaguccgagcccgcccgccccucccccggcuccccccgcggccagccccaggaccaggacgacgacgaggacgacgaggaggacgaggccggccgccagcgcgccuccggcaagcccuccaacgucggccaccgccucggccaccgccgcgcccucuucgagaagcgcaagcgccucuccgacuacgcccucaucuucggcauguucggcaucgucgucauggucaccgagaccgagcucuccuggggcgucuacaccaaggagucccucuacuccuucgcccucaagugccucaucucccucuccaccgccauccuccucggccucgucguccucuaccacgcccgcgagauccagcucuucauggucgacaacggcgccgacgacuggcgcaucgccaugaccugcgagcgcgucuuccucaucucccucgagcucgccgucugcgccauccaccccguccccggccacuaccgcuucaccuggaccgcccgccucgccuucaccuacgcccccuccgucgccgaggccgacgucgacguccuccucuccauccccauguuccuccgccucuaccuccucggccgcgucaugcuccuccacuccaagaucuucaccgacgccuccucccgcuccaucggcgcccucaacaagaucaccuucaacacccgcuucgucaugaagacccucaugaccaucugccccggcaccguccuccucgucuucuccaucuccuccuggaucaucgccgccuggaccguccgcgucugcgagcgcuaccacgacaagcaggaggucaccuccaacuuccucggcgccauguggcucaucuccaucaccuuccucuccaucggcuacggcgacauggucccccacaccuacugcggcaagggcgucugccuccucaccggcaucaugggcgccggcugcaccgcccucgucgucgccgucgucgcccgcaagcucgagcucaccaaggccgagaagcacguccacaacuucaugauggacacccagcucaccaagcgcgucaagaacgccgccgccaacguccuccgcgagaccuggcucaucuacaagcacacccgccucgucaagaagcccgaccaggcccgcguccgcaagcaccagcgcaaguuccuccaggccauccaccaggcccagaagcuccgcuccgucaagaucgagcagggcaagcucaacgaccaggccaacacccucaccgaccucgccaagacccagaccgucauguacgaccucgucuccgagcuccacgcccagcacgaggagcucgaggcccgccucgccacccucgagucccgccucgacgcccucggcgccucccuccaggcccuccccggccucaucgcccaggccauccgcccccccccccccccccuccccccccgccccggccccggcccccaggaccaggccgcccgcuccucccccugccgcuggacccccgucgcccccuccgacugcggcuga

SEQ ID NO: 44946 - RNA, 1740 nt, Artificial Sequence
  derived and/or modified sequence opt2 from KCNN2__Homo_sapiens__NP_067627
auguccuccugccgcuacaacggcggcgucaugcgcccccucuccaaccucuccgccucccgccgcaaccuccacgagauggacuccgaggcccagccccuccagccccccgccuccgucggcggcggcggcggcgccuccucccccuccgccgccgccgccgccgccgccgccgucuccuccuccgcccccgagaucgucgucuccaagcccgagcacaacaacuccaacaaccucgcccucuacggcaccggcggcggcggcuccaccggcggcggcggcggcggcggcggcuccggccacggcuccuccuccggcaccaaguccuccaagaagaagaaccagaacaucggcuacaagcucggccaccgccgcgcccucuucgagaagcgcaagcgccucuccgacuacgcccucaucuucggcauguucggcaucgucgucauggucaucgagaccgagcucuccuggggcgccuacgacaaggccucccucuacucccucgcccucaagugccucaucucccucuccaccaucauccuccucggccucaucaucgucuaccacgcccgcgagauccagcucuucauggucgacaacggcgccgacgacuggcgcaucgccaugaccuacgagcgcaucuucuucaucugccucgagauccucgucugcgccauccaccccauccccggcaacuacaccuucaccuggaccgcccgccucgccuucuccuacgcccccuccaccaccaccgccgacgucgacaucauccucuccauccccauguuccuccgccucuaccucaucgcccgcgucaugcuccuccacuccaagcucuucaccgacgccuccucccgcuccaucggcgcccucaacaagaucaacuucaacacccgcuucgucaugaagacccucaugaccaucugccccggcaccguccuccucgucuucuccaucucccucuggaucaucgccgccuggaccguccgcgccugcgagcgcuaccacgaccagcaggacgucaccuccaacuuccucggcgccauguggcucaucuccaucaccuuccucuccaucggcuacggcgacaugguccccaacaccuacugcggcaagggcgucugccuccucaccggcaucaugggcgccggcugcaccgcccucgucgucgccgucgucgcccgcaagcucgagcucaccaaggccgagaagcacguccacaacuucaugauggacacccagcucaccaagcgcgucaagaacgccgccgccaacguccuccgcgagaccuggcucaucuacaagaacaccaagcucgucaagaagaucgaccacgccaagguccgcaagcaccagcgcaaguuccuccaggccauccaccagcuccgcuccgucaagauggagcagcgcaagcucaacgaccaggccaacacccucgucgaccucgccaagacccagaacaucauguacgacaugaucuccgaccucaacgagcgcuccgaggacuucgagaagcgcaucgucacccucgagaccaagcucgagacccucaucggcuccauccacgcccuccccggccucaucucccagaccauccgccagcagcagcgcgacuucaucgaggcccagauggaguccuacgacaagcacgucaccuacaacgccgagcgcucccgcuccuccucccgccgccgccgcuccuccuccaccgccccccccaccuccuccgaguccuccuga

SEQ ID NO: 44947 - RNA, 2196 nt, Artificial Sequence
  derived and/or modified sequence opt2 from KCNN3__Homo_sapiens__NP_002240
auggacaccuccggccacuuccacgacuccggcgucggcgaccucgacgaggaccccaagugccccugccccuccuccggcgacgagcagcagcagcagcagcagcagcagcagcagcagcagccccccccccccgccccccccgccgccccccagcagccccucggccccucccuccagccccagcccccccagcuccagcagcagcagcagcagcagcagcagcagcagcagcagcagcccccccacccccucucccagcucgcccagcuccagucccagcccguccaccccggccuccuccacuccucccccaccgccuuccgcgccccccccuccuccaacuccaccgccauccuccaccccuccucccgccagggcucccagcucaaccucaacgaccaccuccucggccacucccccuccuccaccgccaccuccggccccggcggcggcucccgccaccgccaggccuccccccucguccaccgccgcgacuccaaccccuucaccgagaucgccauguccuccugcaaguacuccggcggcgucaugaagccccucucccgccucuccgccucccgccgcaaccucaucgaggccgagaccgagggccagccccuccagcucuucucccccuccaacccccccgagaucgucaucuccucccgcgaggacaaccacgcccaccagacccuccuccaccaccccaacgccacccacaaccaccagcacgccggcaccaccgccuccuccaccaccuuccccaaggccaacaagcgcaagaaccagaacaucggcuacaagcucggccaccgccgcgcccucuucgagaagcgcaagcgccucuccgacuacgcccucaucuucggcauguucggcaucgucgucauggucaucgagaccgagcucuccuggggccucuacuccaaggacuccauguucucccucgcccucaagugccucaucucccucuccaccaucauccuccucggccucaucaucgccuaccacacccgcgagguccagcucuucgucaucgacaacggcgccgacgacuggcgcaucgccaugaccuacgagcgcauccucuacaucucccucgagaugcucgucugcgccauccaccccauccccggcgaguacaaguucuucuggaccgcccgccucgccuucuccuacacccccucccgcgccgaggccgacgucgacaucauccucuccauccccauguuccuccgccucuaccucaucgcccgcgucaugcuccuccacuccaagcucuucaccgacgccuccucccgcuccaucggcgcccucaacaagaucaacuucaacacccgcuucgucaugaagacccucaugaccaucugccccggcaccguccuccucgucuucuccaucucccucuggaucaucgccgccuggaccguccgcgucugcgagcgcuaccacgaccagcaggacgucaccuccaacuuccucggcgccauguggcucaucuccaucaccuuccucuccaucggcuacggcgacauggucccccacaccuacugcggcaagggcgucugccuccucaccggcaucaugggcgccggcugcaccgcccucgucgucgccgucgucgcccgcaagcucgagcucaccaaggccgagaagcacguccacaacuucaugauggacacccagcucaccaagcgcaucaagaacgccgccgccaacguccuccgcgagaccuggcucaucuacaagcacaccaagcuccucaagaagaucgaccacgccaagguccgcaagcaccagcgcaaguuccuccaggccauccaccagcuccgcuccgucaagauggagcagcgcaagcucuccgaccaggccaacacccucgucgaccucuccaagaugcagaacgucauguacgaccucaucaccgagcucaacgaccgcuccgaggaccucgagaagcagaucggcucccucgaguccaagcucgagcaccucaccgccuccuucaacucccucccccuccucaucgccgacacccuccgccagcagcagcagcagcuccucuccgccaucaucgaggcccgcggcgucuccgucgccgucggcaccacccacacccccaucuccgacucccccaucggcgucuccuccaccuccuuccccacccccuacaccuccuccuccuccugcuga

SEQ ID NO: 44948 - RNA, 1284 nt, Artificial Sequence
  derived and/or modified sequence opt2 from KCNN4__Homo_sapiens__NP_002241
augggcggcgaccucguccucggccucggcgcccuccgccgccgcaagcgccuccucgagcaggagaagucccucgccggcugggcccucguccucgccggcaccggcaucggccucaugguccuccacgccgagaugcucugguucggcggcugcuccugggcccucuaccucuuccucgucaagugcaccaucuccaucuccaccuuccuccuccucugccucaucgucgccuuccacgccaaggagguccagcucuucaugaccgacaacggccuccgcgacuggcgcgucgcccucaccggccgccaggccgcccagaucguccucgagcucgucgucugcggccuccaccccgcccccguccgcggcccccccugcguccaggaccucggcgccccccucaccuccccccagcccuggcccggcuuccucggccagggcgaggcccuccucucccucgccaugcuccuccgccucuaccucgucccccgcgccguccuccuccgcuccggcguccuccucaacgccuccuaccgcuccaucggcgcccucaaccagguccgcuuccgccacugguucgucgccaagcucuacaugaacacccaccccggccgccuccuccucggccucacccucggccucuggcucaccaccgccuggguccucuccgucgccgagcgccaggccgucaacgccaccggccaccucuccgacacccucuggcucauccccaucaccuuccucaccaucggcuacggcgacgucguccccggcaccauguggggcaagaucgucugccucugcaccggcgucaugggcgucugcugcaccgcccuccucgucgccgucgucgcccgcaagcucgaguucaacaaggccgagaagcacguccacaacuucaugauggacauccaguacaccaaggagaugaaggaguccgccgcccgcguccuccaggaggccuggauguucuacaagcacacccgccgcaaggagucccacgccgcccgccgccaccagcgcaagcuccucgccgccaucaacgccuuccgccagguccgccucaagcaccgcaagcuccgcgagcaggucaacuccauggucgacaucuccaagaugcacaugauccucuacgaccuccagcagaaccucuccuccucccaccgcgcccucgagaagcagaucgacacccucgccggcaagcucgacgcccucaccgagcuccucuccaccgcccucggcccccgccagcuccccgagcccucccagcaguccaaguga

SEQ ID NO: 44949 - RNA, 2031 nt, Artificial Sequence
  derived and/or modified sequence opt2 from KCNQ1__Homo_sapiens__NP_000209
auggccgccgccuccucccccccccgcgccgagcgcaagcgcuggggcuggggccgccuccccggcgcccgccgcggcuccgccggccucgccaagaagugccccuucucccucgagcucgccgagggcggccccgccggcggcgcccucuacgcccccaucgcccccggcgcccccggccccgccccccccgccucccccgccgcccccgccgccccccccgucgccuccgaccucggcccccgcccccccgucucccucgacccccgcgucuccaucuacuccacccgccgccccguccucgcccgcacccacguccagggccgcgucuacaacuuccucgagcgccccaccggcuggaagugcuucgucuaccacuucgccgucuuccucaucguccucgucugccucaucuucuccguccucuccaccaucgagcaguacgccgcccucgccaccggcacccucuucuggauggagaucguccucgucgucuucuucggcaccgaguacgucguccgccucugguccgccggcugccgcuccaaguacgucggccucuggggccgccuccgcuucgcccgcaagcccaucuccaucaucgaccucaucgucgucgucgccuccauggucguccucugcgucggcuccaagggccaggucuucgccaccuccgccauccgcggcauccgcuuccuccagauccuccgcaugcuccacgucgaccgccagggcggcaccuggcgccuccucggcuccgucgucuucauccaccgccaggagcucaucaccacccucuacaucggcuuccucggccucaucuucuccuccuacuucgucuaccucgccgagaaggacgccgucaacgaguccggccgcgucgaguucggcuccuacgccgacgcccucugguggggcgucgucaccgucaccaccaucggcuacggcgacaaggucccccagaccugggucggcaagaccaucgccuccugcuucuccgucuucgccaucuccuucuucgcccuccccgccggcauccucggcuccggcuucgcccucaagguccagcagaagcagcgccagaagcacuucaaccgccagauccccgccgccgccucccucauccagaccgccuggcgcugcuacgccgccgagaaccccgacuccuccaccuggaagaucuacauccgcaaggccccccgcucccacacccuccucucccccucccccaagcccaagaaguccgucgucgucaagaagaagaaguucaagcucgacaaggacaacggcgucacccccggcgagaagaugcucaccgucccccacaucaccugcgacccccccgaggagcgccgccucgaccacuucuccgucgacggcuacgacuccuccguccgcaagucccccacccuccucgaggucuccaugccccacuucaugcgcaccaacuccuucgccgaggaccucgaccucgagggcgagacccuccucacccccaucacccacaucucccagcuccgcgagcaccaccgcgccaccaucaaggucauccgccgcaugcaguacuucgucgccaagaagaaguuccagcaggcccgcaagcccuacgacguccgcgacgucaucgagcaguacucccagggccaccucaaccucaugguccgcaucaaggagcuccagcgccgccucgaccaguccaucggcaagcccucccucuucaucuccgucuccgagaaguccaaggaccgcggcuccaacaccaucggcgcccgccucaaccgcgucgaggacaaggucacccagcucgaccagcgccucgcccucaucaccgacaugcuccaccagcuccucucccuccacggcggcuccacccccggcuccggcggccccccccgcgagggcggcgcccacaucacccagcccugcggcuccggcggcuccgucgaccccgagcucuuccuccccuccaacacccuccccaccuacgagcagcucaccgucccccgccgcggccccgacgagggcuccuga

SEQ ID NO: 44950 - RNA, 2535 nt, Artificial Sequence
  derived and/or modified sequence opt2 from KCNQ2__Homo_sapiens__NP_004509
augguccagaagucccgcaacggcggcgucuaccccggccccuccggcgagaagaagcucaaggucggcuucgucggccucgaccccggcgcccccgacuccacccgcgacggcgcccuccucaucgccggcuccgaggcccccaagcgcggcuccauccucuccaagccccgcgccggcggcgccggcgccggcaagccccccaagcgcaacgccuucuaccgcaagcuccagaacuuccucuacaacguccucgagcgcccccgcggcugggccuucaucuaccacgccuacgucuuccuccucgucuucuccugccucguccucuccgucuucuccaccaucaaggaguacgagaaguccuccgagggcgcccucuacauccucgagaucgucaccaucgucgucuucggcgucgaguacuucguccgcaucugggccgccggcugcugcugccgcuaccgcggcuggcgcggccgccucaaguucgcccgcaagcccuucugcgucaucgacaucaugguccucaucgccuccaucgccguccucgccgccggcucccagggcaacgucuucgccaccuccgcccuccgcucccuccgcuuccuccagauccuccgcaugauccgcauggaccgccgcggcggcaccuggaagcuccucggcuccgucgucuacgcccacuccaaggagcucgucaccgccugguacaucggcuuccucugccucauccucgccuccuuccucgucuaccucgccgagaagggcgagaacgaccacuucgacaccuacgccgacgcccucugguggggccucaucacccucaccaccaucggcuacggcgacaaguacccccagaccuggaacggccgccuccucgccgccaccuucacccucaucggcgucuccuucuucgcccuccccgccggcauccucggcuccggcuucgcccucaagguccaggagcagcaccgccagaagcacuucgagaagcgccgcaaccccgccgccggccucauccaguccgccuggcgcuucuacgccaccaaccucucccgcaccgaccuccacuccaccuggcaguacuacgagcgcaccgucaccguccccauguaccgccucauccccccccucaaccagcucgagcuccuccgcaaccucaaguccaaguccggccucgccuuccgcaaggaccccccccccgagcccucccccucccagaaggucucccucaaggaccgcgucuucuccuccccccgcggcgucgccgccaagggcaagggcuccccccaggcccagaccguccgccgcucccccuccgccgaccagucccucgaggacucccccuccaagguccccaaguccugguccuucggcgaccgcucccgcgcccgccaggccuuccgcaucaagggcgccgccucccgccagaacuccgaggaggccucccuccccggcgaggacaucgucgacgacaaguccugccccugcgaguucgucaccgaggaccucacccccggccucaaggucuccauccgcgccgucugcgucaugcgcuuccucgucuccaagcgcaaguucaaggagucccuccgccccuacgacgucauggacgucaucgagcaguacuccgccggccaccucgacaugcucucccgcaucaagucccuccagucccgcgucgaccagaucgucggccgcggccccgccaucaccgacaaggaccgcaccaagggccccgccgaggccgagcuccccgaggaccccuccaugaugggccgccucggcaaggucgagaagcagguccucuccauggagaagaagcucgacuuccucgucaacaucuacaugcagcgcaugggcaucccccccaccgagaccgaggccuacuucggcgccaaggagcccgagcccgccccccccuaccacucccccgaggacucccgcgagcacgucgaccgccacggcugcaucgucaagaucguccgcuccuccuccuccaccggccagaagaacuucuccgccccccccgccgccccccccguccagugcccccccuccaccuccuggcagccccagucccacccccgccagggccacggcaccucccccgucggcgaccacggcucccucguccgcaucccccccccccccgcccacgagcgcucccucuccgccuacggcggcggcaaccgcgccuccauggaguuccuccgccaggaggacacccccggcugccgcccccccgagggcaaccuccgcgacuccgacaccuccaucuccauccccuccgucgaccacgaggagcucgagcgcuccuucuccggcuucuccaucucccaguccaaggagaaccucgacgcccucaacuccugcuacgccgccgucgcccccugcgccaagguccgccccuacaucgccgagggcgaguccgacaccgacuccgaccucugcacccccugcggcccccccccccgcuccgccaccggcgagggccccuucggcgacgucggcugggccggcccccgcaaguga

SEQ ID NO: 44951 - RNA, 2259 nt, Artificial Sequence
  derived and/or modified sequence opt2 from KCNQ3__Homo_sapiens__NP_001191753
augaagcccgccgagcacgccaccauguuccucaucguccucggcugccucauccucgccguccucaccaccuucaaggaguacgagaccgucuccggcgacuggcuccuccuccucgagaccuucgccaucuucaucuucggcgccgaguucgcccuccgcaucugggccgccggcugcugcugccgcuacaagggcuggcgcggccgccucaaguucgcccgcaagccccucugcaugcucgacaucuucguccucaucgccuccguccccgucgucgccgucggcaaccagggcaacguccucgccaccucccuccgcucccuccgcuuccuccagauccuccgcaugcuccgcauggaccgccgcggcggcaccuggaagcuccucggcuccgccaucugcgcccacuccaaggagcucaucaccgccugguacaucggcuuccucacccucauccucuccuccuuccucgucuaccucgucgagaaggacguccccgaggucgacgcccagggcgaggagaugaaggaggaguucgagaccuacgccgacgcccucugguggggccucaucacccucgccaccaucggcuacggcgacaagacccccaagaccugggagggccgccucaucgccgccaccuucucccucaucggcgucuccuucuucgcccuccccgccggcauccucggcuccggccucgcccucaagguccaggagcagcaccgccagaagcacuucgagaagcgccgcaagcccgccgccgagcucauccaggccgccuggcgcuacuacgccaccaaccccaaccgcaucgaccucgucgccaccuggcgcuucuacgaguccgucgucuccuuccccuucuuccgcaaggagcagcucgaggccgccuccucccagaagcucggccuccucgaccgcguccgccucuccaacccccgcggcuccaacaccaagggcaagcucuucaccccccucaacgucgacgccaucgaggagucccccuccaaggagcccaagcccgucggccucaacaacaaggagcgcuuccgcaccgccuuccgcaugaaggccuacgccuucuggcaguccuccgaggacgccggcaccggcgaccccauggccgaggaccgcggcuacggcaacgacuuccccaucgaggacaugauccccacccucaaggccgccauccgcgccguccgcauccuccaguuccgccucuacaagaagaaguucaaggagacccuccgccccuacgacgucaaggacgucaucgagcaguacuccgccggccaccucgacaugcucucccgcaucaaguaccuccagacccgcaucgacaugaucuucacccccggcccccccuccacccccaagcacaagaagucccagaagggcuccgccuucaccuuccccucccagcaguccccccgcaacgagcccuacgucgcccgccccuccaccuccgagaucgaggaccaguccaugaugggcaaguucgucaaggucgagcgccagguccaggacaugggcaagaagcucgacuuccucgucgacaugcacaugcagcacauggagcgccuccagguccaggucaccgaguacuaccccaccaagggcaccuccucccccgccgaggccgagaagaaggaggacaaccgcuacuccgaccucaagaccaucaucugcaacuacuccgagaccggcccccccgagccccccuacuccuuccaccaggucaccaucgacaaggucucccccuacggcuucuucgcccacgaccccgucaaccucccccgcggcggccccuccuccggcaagguccaggccaccccccccuccuccgccaccaccuacgucgagcgccccaccguccuccccauccucacccuccucgacucccgcgucuccugccacucccaggccgaccuccagggccccuacuccgaccgcaucuccccccgccagcgccgcuccaucacccgcgacuccgacaccccccucucccucauguccgucaaccacgaggagcucgagcgcucccccuccggcuucuccaucucccaggaccgcgacgacuacgucuucggccccaacggcggcuccuccuggaugcgcgagaagcgcuaccucgccgagggcgagaccgacaccgacaccgaccccuucacccccuccggcuccaugccccucuccuccaccggcgacggcaucuccgacuccgucuggacccccuccaacaagcccaucuga

SEQ ID NO: 44952 - RNA, 2772 nt, Artificial Sequence
  derived and/or modified sequence opt2 from KCNQ5__Homo_sapiens__NP_001153602
augccccgccaccacgccggcggcgaggagggcggcgccgccggccucugggucaaguccggcgccgccgccgccgccgccggcggcggccgccucggcuccggcaugaaggacgucgaguccggccgcggccgcguccuccucaacuccgccgccgcccgcggcgacggccuccuccuccucggcacccgcgccgccacccucggcggcggcggcggcggccuccgcgagucccgccgcggcaagcagggcgcccgcaugucccuccucggcaagccccucuccuacaccuccucccaguccugccgccgcaacgucaaguaccgccgcguccagaacuaccucuacaacguccucgagcgcccccgcggcugggccuucaucuaccacgccuucgucuuccuccucgucuucggcugccucauccucuccgucuucuccaccauccccgagcacaccaagcucgccuccuccugccuccucauccucgaguucgucaugaucgucgucuucggccucgaguucaucauccgcaucugguccgccggcugcugcugccgcuaccgcggcuggcagggccgccuccgcuucgcccgcaagcccuucugcgucaucgacaccaucguccucaucgccuccaucgccgucgucuccgccaagacccagggcaacaucuucgccaccuccgcccuccgcucccuccgcuuccuccagauccuccgcaugguccgcauggaccgccgcggcggcaccuggaagcuccucggcuccgucgucuacgcccacuccaaggagcucaucaccgccugguacaucggcuuccucguccucaucuucuccuccuuccucgucuaccucgucgagaaggacgccaacaaggaguucuccaccuacgccgacgcccucugguggggcaccaucacccucaccaccaucggcuacggcgacaagaccccccucaccuggcucggccgccuccucuccgccggcuucgcccuccucggcaucuccuucuucgcccuccccgccggcauccucggcuccggcuucgcccucaagguccaggagcagcaccgccagaagcacuucgagaagcgccgcaaccccgccgccaaccucauccagugcgucuggcgcuccuacgccgccgacgagaaguccgucuccaucgccaccuggaagccccaccucaaggcccuccacaccugcucccccaccaaccagaagcucuccuucaaggagcgcguccgcauggccuccccccgcggccaguccaucaagucccgccaggccuccgucggcgaccgccgcucccccuccaccgacaucaccgccgagggcucccccaccaagguccagaaguccugguccuucaacgaccgcacccgcuuccgccccucccuccgccucaaguccucccagcccaagcccgucaucgacgccgacaccgcccucggcaccgacgacgucuacgacgagaagggcugccagugcgacgucuccgucgaggaccucacccccccccucaagaccgucauccgcgccauccgcaucaugaaguuccacgucgccaagcgcaaguucaaggagacccuccgccccuacgacgucaaggacgucaucgagcaguacuccgccggccaccucgacaugcucugccgcaucaagucccuccagacccgcgucgaccagauccucggcaagggccagaucaccuccgacaagaagucccgcgagaagaucaccgccgagcacgagaccaccgacgaccucuccaugcucggccgcgucgucaaggucgagaagcagguccaguccaucgaguccaagcucgacugccuccucgacaucuaccagcagguccuccgcaagggcuccgccuccgcccucgcccucgccuccuuccagaucccccccuucgagugcgagcagaccuccgacuaccagucccccgucgacuccaaggaccucuccggcuccgcccagaacuccggcugccucucccgcuccaccuccgccaacaucucccgcggccuccaguucauccucacccccaacgaguucuccgcccagaccuucuacgcccucucccccaccaugcacucccaggccacccagguccccaucucccaguccgacggcuccgccgucgccgccaccaacaccaucgccaaccagaucaacaccgcccccaagcccgccgcccccaccacccuccagaucccccccccccuccccgccaucaagcaccucccccgccccgagacccuccaccccaaccccgccggccuccaggaguccaucuccgacgucaccaccugccucgucgccuccaaggagaacguccaggucgcccaguccaaccucaccaaggaccgcuccaugcgcaaguccuucgacaugggcggcgagacccuccucuccgucugccccaugguccccaaggaccucggcaagucccucuccguccagaaccucauccgcuccaccgaggagcucaacauccagcucuccggcuccgaguccuccggcucccgcggcucccaggacuucuaccccaaguggcgcgaguccaagcucuucaucaccgacgaggaggucggccccgaggagaccgagaccgacaccuucgacgccgccccccagcccgcccgcgaggccgccuucgccuccgacucccuccgcaccggccgcucccgcuccucccaguccaucugcaaggccggcgaguccaccgacgcccucucccucccccacgucaagcucaaguga

SEQ ID NO: 44953 - RNA, 819 nt, Artificial Sequence
  derived and/or modified sequence opt2 from KCNRG__Homo_sapiens__NP_775876
auguccucccaggagcucgucacccucaacgucggcggcaagaucuucaccacccgcuucuccaccaucaagcaguuccccgccucccgccucgcccgcaugcucgacggccgcgaccaggaguucaagauggucggcggccagaucuucgucgaccgcgacggcgaccucuucuccuucauccucgacuuccuccgcacccaccagcuccuccuccccaccgaguucuccgacuaccuccgccuccagcgcgaggcccucuucuacgagcuccgcucccucgucgaccuccucaaccccuaccuccuccagccccgccccgcccucgucgagguccacuuccucucccgcaacacccaggccuucuuccgcgucuucggcuccugcuccaagaccaucgagaugcucaccggccgcaucaccgucuucaccgagcagcccuccgcccccaccuggaacggcaacuucuuccccccccagaugacccuccucccccuccccccccagcgccccuccuaccacgaccucgucuuccagugcggcuccgacuccaccaccgacaaccagaccggcguccgcuacgucuccaucaagcccgacaaccgcaagcucgccaacggcaccaacguccucggccuccucaucgacacccuccucaaggagggcuuccaccucgucuccacccgcaccgucuccuccgaggacaagaccgagugcuacuccuucgagcgcaucaagucccccgagguccucaucaccaacgagacccccaagcccgagaccaucaucauccccgagcagucccagaucaagaaguga

SEQ ID NO: 44954 - RNA, 1581 nt, Artificial Sequence
  derived and/or modified sequence opt2 from KCNS1__Homo_sapiens__XP_005260466
augcucaugcuccucguccgcggcacccacuacgagaaccuccgcuccaaggucguccuccccaccccccucggcggccgcuccaccgagaccuucgucuccgaguuccccggccccgacaccggcauccgcuggcgccgcuccgacgaggcccuccgcgucaacgucggcggcguccgccgccagcucuccgcccgcgcccucgcccgcuuccccggcacccgccucggccgccuccaggccgccgccuccgaggagcaggcccgccgccucugcgacgacuacgacgaggccgcccgcgaguucuacuucgaccgccaccccggcuucuuccucucccuccuccacuucuaccgcaccggccaccuccacguccucgacgagcucugcgucuucgccuucggccaggaggccgacuacuggggccucggcgagaacgcccucgccgccugcugccgcgcccgcuaccucgagcgccgccucacccagccccacgccugggacgaggacuccgacacccccuccuccgucgaccccugccccgacgagaucuccgacguccagcgcgagcucgcccgcuacggcgccgcccgcugcggccgccuccgccgccgccucuggcucaccauggagaaccccggcuacucccuccccuccaagcucuucuccugcgucuccaucuccgucguccucgccuccaucgccgccaugugcauccacucccuccccgaguaccaggcccgcgaggccgccgccgccgucgccgccgucgccgccggccgcucccccgagggcguccgcgacgaccccguccuccgccgccucgaguacuucugcaucgccugguucuccuucgaggucuccucccgccuccuccucgcccccuccacccgcaacuucuucugccacccccucaaccucaucgacaucgucuccguccuccccuucuaccucacccuccucgccggcgucgcccucggcgaccagggcggcaaggaguucggccaccucggcaaggucguccaggucuuccgccucaugcgcaucuuccgcguccucaagcucgcccgccacuccaccggccuccgcucccucggcgccacccucaagcacuccuaccgcgaggucggcauccuccuccucuaccucgccgucggcgucuccgucuucuccggcgucgccuacaccgccgagaaggaggaggacgucggcuucaacaccauccccgccugcuggugguggggcaccgucuccaugaccaccgucggcuacggcgacgucguccccgucaccgucgccggcaagcucgccgccuccggcugcauccucggcggcauccucgucgucgcccuccccaucaccaucaucuucaacaaguucucccacuucuaccgccgccagaaggcccucgaggccgccguccgcaacuccaaccaccaggaguucgaggaccuccucuccuccaucgacggcgucuccgaggccucccucgagaccucccgcgagaccucccaggagggccaguccgccgaccucgagucccaggcccccuccgagcccccccacccccagauguacuga

SEQ ID NO: 44955 - RNA, 1476 nt, Artificial Sequence
  derived and/or modified sequence opt2 from KCNS3__Homo_sapiens__XP_011531127
auggucuucggcgaguucuuccaccgccccggccaggacgaggagcucgucaaccucaacgucggcggcuucaagcaguccgucgaccaguccacccuccuccgcuucccccacacccgccucggcaagcuccucaccugccacuccgaggaggccauccucgagcucugcgacgacuacuccgucgccgacaaggaguacuacuucgaccgcaaccccucccucuuccgcuacguccucaacuucuacuacaccggcaagcuccacgucauggaggagcucugcgucuucuccuucugccaggagaucgaguacuggggcaucaacgagcucuucaucgacuccugcugcuccaaccgcuaccaggagcgcaaggaggagaaccacgagaaggacugggaccagaagucccacgacgucuccaccgacuccuccuucgaggaguccucccucuucgagaaggagcucgagaaguucgacacccuccgcuucggccagcuccgcaagaagaucuggauccgcauggagaaccccgccuacugccucuccgccaagcucaucgccaucuccucccucuccgucguccucgccuccaucgucgccaugugcguccacuccauguccgaguuccagaacgaggacggcgaggucgacgaccccguccucgagggcgucgagaucgccugcaucgccugguucaccggcgagcucgccguccgccucgccgccgcccccugccagaagaaguucuggaagaacccccucaacaucaucgacuucgucuccaucauccccuucuacgccacccucgccgucgacaccaaggaggaggaguccgaggacaucgagaacaugggcaaggucguccagauccuccgccucaugcgcaucuuccgcauccucaagcucgcccgccacuccgucggccuccgcucccucggcgccacccuccgccacuccuaccacgaggucggccuccuccuccucuuccucuccgucggcaucuccaucuucuccguccucaucuacuccgucgagaaggacgaccacaccuccucccucaccuccauccccaucugcugguggugggccaccaucuccaugaccaccgucggcuacggcgacacccaccccgucacccucgccggcaagcucaucgccuccaccugcaucaucugcggcauccucgucgucgcccuccccaucaccaucaucuucaacaaguucuccaaguacuaccagaagcagaaggacaucgacgucgaccagugcuccgaggacgcccccgagaagugccacgagcuccccuacuucaacauccgcgacaucuacgcccagcgcaugcacaccuucaucaccucccucuccuccgucggcaucgucgucuccgaccccgacuccaccgacgccuccuccaucgaggacaacgaggacaucugcaacaccaccucccucgagaacugcaccgccaaguga

SEQ ID NO: 44956 - RNA, 3708 nt, Artificial Sequence
  derived and/or modified sequence opt2 from KCNT1__Homo_sapiens__NP_065873
augccccuccccgacggcgcccgcacccccggcggcgucugccgcgaggcccgcggcggcggcuacaccaaccgcaccuucgaguucgacgacggccagugcgccccccgccgccccugcgccggcgacggcgcccuccucgacaccgccggcuucaagauguccgaccucgacuccgagguccucccccuccccccccgcuaccgcuuccgcgaccuccuccucggcgaccccuccuuccagaacgacgaccgcguccaggucgaguucuacgucaacgagaacaccuucaaggagcgccucaagcucuucuucaucaagaaccagcgcuccucccuccgcauccgccucuucaacuucucccucaagcuccucaccugccuccucuacaucguccgcguccuccucgacgaccccgcccucggcaucggcugcuggggcugccccaagcagaacuacuccuucaacgacuccuccuccgagaucaacugggcccccauccucugggucgagcgcaagaugacccucugggccauccaggucaucgucgccaucaucuccuuccucgagaccaugcuccucaucuaccucuccuacaagggcaacaucugggagcagaucuuccgcgucuccuucguccucgagaugaucaacacccuccccuucaucaucaccaucuucuggcccccccuccgcaaccucuucauccccgucuuccucaacugcuggcucgccaagcacgcccucgagaacaugaucaacgacuuccaccgcgccauccuccgcacccaguccgccauguucaaccagguccucauccucuucugcacccuccucugccucgucuucaccggcaccugcggcauccagcaccucgagcgcgccggcgagaaccucucccuccucaccuccuucuacuucugcaucgucaccuucuccaccgucggcuacggcgacgucacccccaagaucuggcccucccagcuccucgucgucaucaugaucugcgucgcccucgucguccucccccuccaguucgaggagcucgucuaccucuggauggagcgccagaaguccggcggcaacuacucccgccaccgcgcccagaccgagaagcacgucguccucugcgucuccucccucaagaucgaccuccucauggacuuccucaacgaguucuacgcccacccccgccuccaggacuacuacgucgucauccucugccccaccgagauggacguccagguccgccgcguccuccagaucccccucuggucccagcgcgucaucuaccuccagggcuccgcccucaaggaccaggaccucaugcgcgccaagauggacaacggcgaggccugcuucauccucuccucccgcaacgaggucgaccgcaccgccgccgaccaccagaccauccuccgcgccugggccgucaaggacuucgcccccaacugcccccucuacguccagauccucaagcccgagaacaaguuccacgucaaguucgccgaccacgucgucugcgaggaggagugcaaguacgccaugcucgcccucaacugcaucugccccgccaccuccacccucaucacccuccucguccacaccucccgcggccaggagggccaggagucccccgagcaguggcagcgcauguacggccgcugcuccggcaacgaggucuaccacauccgcaugggcgacuccaaguucuuccgcgaguacgagggcaaguccuucaccuacgccgccuuccacgcccacaagaaguacggcgucugccucaucggccucaagcgcgaggacaacaaguccauccuccucaaccccggcccccgccacauccucgccgccuccgacaccugcuucuacaucaacaucaccaaggaggagaacuccgccuucaucuucaagcaggaggagaagcgcaagaagcgcgccuucuccggccagggccuccacgagggccccgcccgccuccccguccacuccaucaucgccuccaugggcaccgucgccauggaccuccagggcaccgagcaccgccccacccaguccggcggcggcggcggcggcuccaagcucgcccuccccaccgagaacggcuccggcucccgccgccccuccaucgcccccguccucgagcucgccgacuccuccgcccuccuccccugcgaccuccucuccgaccaguccgaggacgaggucacccccuccgacgacgagggccucuccgucgucgaguacgucaagggcuacccccccaacucccccuacaucggcuccucccccacccucugccaccuccuccccgucaaggcccccuucugcugccuccgccucgacaagggcugcaagcacaacuccuacgaggacgccaaggccuacggcuucaagaacaagcucaucaucgucuccgccgagaccgccggcaacggccucuacaacuucaucgucccccuccgcgccuacuaccgcucccgcaaggagcucaaccccaucguccuccuccucgacaacaagcccgaccaccacuuccucgaggccaucugcugcuuccccauggucuacuacauggagggcuccgucgacaaccucgacucccuccuccagugcggcaucaucuacgccgacaaccucgucgucgucgacaaggaguccaccauguccgccgaggaggacuacauggccgacgccaagaccaucgucaacguccagaccauguuccgccucuuccccucccucuccaucaccaccgagcucacccaccccuccaacaugcgcuucaugcaguuccgcgccaaggacuccuacucccucgcccucuccaagcucgagaagcgcgagcgcgagaacggcuccaaccucgccuucauguuccgccuccccuucgccgccggccgcgucuucuccaucuccaugcucgacacccuccucuaccaguccuucgucaaggacuacaugaucaccaucacccgccuccuccucggccucgacaccacccccggcuccggcuaccucugcgccaugaagaucaccgagggcgaccucuggauccgcaccuacggccgccucuuccagaagcucugcuccuccuccgccgagauccccaucggcaucuaccgcaccgagucccacgucuucuccaccuccgagccccacgaccuccgcgcccagucccagaucuccgucaacgucgaggacugcgaggacacccgcgaggucaagggccccuggggcucccgcgccggcaccggcggcuccucccagggccgccacaccggcggcggcgaccccgccgagcacccccuccuccgccgcaagucccuccagugggcccgccgccucucccgcaaggcccccaagcaggccggccgcgccgccgccgccgaguggaucucccagcagcgccucucccucuaccgccgcuccgagcgccaggagcucuccgagcucgucaagaaccgcaugaagcaccucggccuccccaccaccggcuacgacgagaugaacgaccaccagaacacccucuccuacguccucaucaaccccccccccgacacccgccucgagcccuccgacaucgucuaccucauccgcuccgacccccucgcccacgucgccuccuccucccagucccgcaaguccuccugcucccacaagcucuccuccugcaaccccgagacccgcgacgagacccagcucuga

SEQ ID NO: 44957 - RNA, 3336 nt, Artificial Sequence
  derived and/or modified sequence opt2 from KCNT2__Homo_sapiens__NP_001274748
auggucgaccucgaguccgagguccccccccuccccccccgcuaccgcuuccgcgaccuccuccucggcgaccagggcuggcagaacgacgaccgcguccaggucgaguucuacaugaacgagaacaccuucaaggagcgccucaagcucuucuucaucaagaaccagcgcuccucccuccgcauccgccucuucaacuucucccucaagcuccucuccugccuccucuacaucauccgcguccuccucgagaaccccucccagggcaacgaguggucccacaucuucugggucaaccgcucccucccccucuggggccuccaggucuccgucgcccucaucucccucuucgagaccauccuccucggcuaccucuccuacaagggcaacaucugggagcagauccuccgcauccccuucauccucgagaucaucaacgccguccccuucaucaucuccaucuucuggcccucccuccgcaaccucuucguccccgucuuccucaacugcuggcucgccaagcacgcccucgagaacaugaucaacgaccuccaccgcgccauccagcgcacccaguccgccauguucaaccagguccucauccucaucuccacccuccucugccucaucuucaccugcaucugcggcauccagcaccucgagcgcaucggcaagaagcucaaccucuucgacucccucuacuucugcaucgucaccuucuccaccgucggcuucggcgacgucacccccgagaccugguccuccaagcucuucgucgucgccaugaucugcgucgcccucgucguccuccccauccaguucgagcagcucgccuaccucuggauggagcgccagaaguccggcggcaacuacucccgccaccgcgcccagaccgagaagcacgucguccucugcgucuccucccucaagaucgaccuccucauggacuuccucaacgaguucuacgcccacccccgccuccaggacuacuacgucgucauccucugccccaccgagauggacguccagguccgccgcguccuccagauccccauguggucccagcgcgucaucuaccuccagggcuccgcccucaaggaccaggaccuccuccgcgccaagauggacgacgccgaggccugcuucauccucuccucccgcugcgaggucgaccgcaccuccuccgaccaccagaccauccuccgcgccugggccgucaaggacuucgcccccaacugcccccucuacguccagauccucaagcccgagaacaaguuccacaucaaguucgccgaccacgucgucugcgaggaggaguucaaguacgccaugcucgcccucaacugcaucugccccgccaccuccacccucaucacccuccucguccacaccucccgcggccaggagggccagcagucccccgagcaguggcagaagauguacggccgcugcuccggcaacgaggucuaccacaucguccucgaggaguccaccuucuucgccgaguacgagggcaaguccuucaccuacgccuccuuccacgcccacaagaaguucggcgucugccucaucggcguccgccgcgaggacaacaagaacauccuccucaaccccggcccccgcuacaucaugaacuccaccgacaucugcuucuacaucaacaucaccaaggaggagaacuccgccuucaagaaccaggaccagcagcgcaaguccaacgucucccgcuccuucuaccacggccccucccgccuccccguccacuccaucaucgccuccaugggcaccgucgccaucgaccuccaggacaccuccugccgcuccgccuccggccccacccucucccuccccaccgagggcuccaaggagauccgccgccccuccaucgcccccguccucgaggucgccgacaccuccuccauccagaccugcgaccuccucuccgaccaguccgaggacgagaccacccccgacgaggagauguccuccaaccucgaguacgccaagggcuacccccccuacucccccuacaucggcuccucccccaccuucugccaccuccuccacgagaagguccccuucugcugccuccgccucgacaaguccugccagcacaacuacuacgaggacgccaaggccuacggcuucaagaacaagcucaucaucgucgccgccgagaccgccggcaacggccucuacaacuucaucgucccccuccgcgccuacuaccgccccaagaaggagcucaaccccaucguccuccuccucgacaacccccucgacgaccuccuccgcugcggcgucaccuucgccgccaacauggucgucgucgacaaggaguccaccauguccgccgaggaggacuacauggccgacgccaagaccaucgucaacguccagacccucuuccgccucuucuccucccucuccaucaucaccgagcucacccaccccgccaacaugcgcuucaugcaguuccgcgccaaggacugcuacucccucgcccucuccaagcucgagaagaaggagcgcgagcgcggcuccaaccucgccuucauguuccgccuccccuucgccgccggccgcgucuucuccaucuccaugcucgacacccuccucuaccaguccuucgucaaggacuacaugaucuccaucacccgccuccuccucggccucgacaccacccccggcuccggcuuccucugcuccaugaagaucaccgccgacgaccucuggauccgcaccuacgcccgccucuaccagaagcucugcuccuccaccggcgacguccccaucggcaucuaccgcaccgagucccagaagcucaccaccuccgagucccagaucuccaucuccgucgaggagugggaggacaccaaggacuccaaggagcagggccaccaccgcuccaaccaccgcaacuccaccuccuccgaccaguccgaccacccccuccuccgccgcaaguccaugcagugggcccgccgccucucccgcaagggccccaagcacuccggcaagaccgccgagaagaucacccagcagcgccucaaccucuaccgccgcuccgagcgccaggagcucgccgagcucgucaagaaccgcaugaagcaccucggccucuccaccgucggcuacgacgagaugaacgaccaccaguccacccucuccuacauccucaucaaccccucccccgacacccgcaucgagcucaacgacgucgucuaccucauccgccccgacccccucgccuaccuccccaacuccgagcccucccgccgcaacuccaucugcaacgucaccggccaggacucccgcgaggagacccagcucuga

SEQ ID NO: 44958 - RNA, 3450 nt, Artificial Sequence
  derived and/or modified sequence opt2 from KCNU1__Homo_sapiens__NP_001027006
auguuccagaccaagcuccgcaacgagaccugggaggaccuccccaagauguccugcaccaccgagauccaggccgccuucauccucuccuccuucgucaccuucuucuccggccucaucauccuccucaucuuccgccucaucuggcgcuccgucaagaaguggcagaucaucaagggcaccggcaucauccucgagcucuucaccuccggcaccaucgcccgcucccacguccgcucccuccacuuccagggccaguuccgcgaccacaucgagaugcuccucuccgcccagaccuucgucggccagguccucgucauccucgucuucguccucuccaucggcucccucaucaucuacuucaucaacuccgccgaccccgucggcuccugcuccuccuacgaggacaagaccauccccaucgaccucgucuucaacgccuucuucuccuucuacuucggccuccgcuucauggccgccgacgacaagaucaaguucuggcucgagaugaacuccaucgucgacaucuucaccaucccccccaccuucaucuccuacuaccucaaguccaacuggcucggccuccgcuuccuccgcgcccuccgccuccucgagcucccccagauccuccagauccuccgcgccaucaagaccuccaacuccgucaaguucuccaagcuccucuccaucauccucuccaccugguucaccgccgccggcuucauccaccucgucgagaacuccggcgaccccuggcucaagggccgcaacucccagaacaucuccuacuucgaguccaucuaccucgucauggccaccaccuccaccgucggcuucggcgacgucgucgccaagaccucccucggccgcaccuucaucauguucuucacccucggcucccucauccucuucgccaacuacauccccgagauggucgagcucuucgccaacaagcgcaaguacaccuccuccuacgaggcccucaagggcaagaaguucaucgucgucugcggcaacaucaccgucgacuccgucaccgccuuccuccgcaacuuccuccgcgacaaguccggcgagaucaacaccgagaucgucuuccucggcgagaccccccccucccucgagcucgagaccaucuucaagugcuaccucgccuacaccaccuucaucuccggcuccgccaugaagugggaggaccuccgccgcgucgccgucgaguccgccgaggccugccucaucaucgccaacccccucugcuccgacucccacgccgaggacaucuccaacaucaugcgcguccucuccaucaagaacuacgacuccaccacccgcaucaucauccagauccuccagucccacaacaaggucuaccuccccaagauccccuccuggaacugggacaccggcgacaacaucaucugcuucgccgagcucaagcucggcuucaucgcccagggcugccucguccccggccucugcaccuuccucaccucccucuucgucgagcagaacaagaaggucaugcccaagcagaccuggaagaagcacuuccucaacuccaugaagaacaagauccucacccagcgccucuccgacgacuucgccggcauguccuuccccgaggucgcccgccucugcuuccucaagaugcaccuccuccucaucgccaucgaguacaagucccucuucaccgacggcuucugcggccucauccucaacccccccccccagguccgcauccgcaagaacacccucggcuucuucaucgccgagacccccaaggacguccgccgcgcccucuucuacugcuccgucugccacgacgacgucuucauccccgagcucaucaccaacugcggcugcaagucccgcucccgccagcacaucaccguccccuccgucaagcgcaugaagaagugccucaagggcaucuccucccgcaucuccggccaggacucccccccccgcgucuccgccuccaccuccuccaucuccaacuucaccacccgcacccuccagcacgacgucgagcaggacuccgaccagcucgacuccuccggcauguuccacuggugcaagcccaccucccucgacaaggucacccucaagcgcaccggcaaguccaaguacaaguuccgcaaccacaucgucgccugcgucuucggcgacgcccacuccgcccccaugggccuccgcaacuucgucaugccccuccgcgccuccaacuacacccgcaaggagcucaaggacaucgucuucaucggcucccucgacuaccuccagcgcgaguggcgcuuccucuggaacuucccccagaucuacauccuccccggcugcgcccucuacuccggcgaccuccacgccgccaacaucgagcagugcuccaugugcgccguccucuccccccccccccagcccuccuccaaccagacccucgucgacaccgaggccaucauggccacccucaccaucggcucccuccagaucgacuccuccuccgaccccucccccuccgucuccgaggagacccccggcuacaccaacggccacaacgagaaguccaacugccgcaagguccccauccucaccgagcucaagaaccccuccaacauccacuucaucgagcagcucggcggccucgagggcucccuccaggagaccaaccuccaccucuccaccgccuucuccaccggcaccgucuucuccggcuccuuccucgacucccuccucgccaccgccuucuacaacuaccacguccucgagcuccuccagaugcucgucaccggcggcgucuccucccagcucgagcagcaccucgacaaggacaaggucuacggcgucgccgacuccugcaccucccuccucuccggccgcaaccgcugcaagcucggccuccucucccuccacgagaccauccucuccgacgucaacccccgcaacaccuucggccagcucuucugcggcucccucgaccucuucggcauccucugcgucggccucuaccgcaucaucgacgaggaggagcucaaccccgagaacaagcgcuucgucaucacccgccccgccaacgaguucaagcuccuccccuccgaccucgucuucugcgccauccccuucuccaccgccugcuacaagcgcaacgaggaguucucccuccagaaguccuacgagaucgucaacaaggccucccagaccaccgagacccacuccgacaccaacugcccccccaccaucgacuccgucaccgagacccucuacucccccgucuacuccuaccagccccgcaccaacucccucuccuuccccaagcagaucgccuggaaccagucccgcaccaacuccaucaucuccucccagaucccccucggcgacaacgccaaggagaacgagcgcaagaccuccgacgaggucuacgacgaggaccccuucgccuacuccgagccccucuga

SEQ ID NO: 44959 - RNA, 1503 nt, Artificial Sequence
  derived and/or modified sequence opt2 from KCNV1__Homo_sapiens__NP_055194
augcccuccuccggccgcgcccuccucgacuccccccucgacuccggcucccucaccucccucgacuccuccgucuucugcuccgagggcgagggcgagccccucgcccucggcgacugcuucaccgucaacgucggcggcucccgcuucguccucucccagcaggcccucuccugcuucccccacacccgccucggcaagcucgccgucgucgucgccuccuaccgccgccccggcgcccucgccgccguccccuccccccucgagcucugcgacgacgccaaccccgucgacaacgaguacuucuucgaccgcuccucccaggccuuccgcuacguccuccacuacuaccgcaccggccgccuccacgucauggagcagcucugcgcccucuccuuccuccaggagauccaguacuggggcaucgacgagcucuccaucgacuccugcugccgcgaccgcuacuuccgccgcaaggagcucuccgagacccucgacuucaagaaggacaccgaggaccaggagucccagcacgaguccgagcaggacuucucccagggccccugccccaccguccgccagaagcucuggaacauccucgagaagcccggcuccuccaccgccgcccgcaucuucggcgucaucuccaucaucuucgucgucgucuccaucaucaacauggcccucauguccgccgagcucuccuggcucgaccuccagcuccucgagauccucgaguacgucugcaucuccugguucaccggcgaguucguccuccgcuuccucugcguccgcgaccgcugccgcuuccuccgcaagguccccaacaucaucgaccuccucgccauccuccccuucuacaucacccuccucgucgagucccucuccggcucccagaccacccaggagcucgagaacgucggccgcaucguccagguccuccgccuccuccgcgcccuccgcaugcucaagcucggccgccacuccaccggccuccgcucccucggcaugaccaucacccagugcuacgaggaggucggccuccuccuccucuuccucuccgucggcaucuccaucuucuccaccgucgaguacuucgccgagcaguccauccccgacaccaccuucaccuccguccccugcgccugguggugggccaccaccuccaugaccaccgucggcuacggcgacauccgccccgacaccaccaccggcaagaucgucgccuucaugugcauccucuccggcauccucguccucgcccuccccaucgccaucaucaacgaccgcuucuccgccugcuacuucacccucaagcucaaggaggccgccguccgccagcgcgaggcccucaagaagcucaccaagaacaucgccaccgacuccuacaucuccgucaaccuccgcgacgucuacgcccgcuccaucauggagaugcuccgccucaagggccgcgagcgcgccuccacccgcuccuccggcggcgacgacuucugguucuga

SEQ ID NO: 44960 - RNA, 1638 nt, Artificial Sequence
  derived and/or modified sequence opt2 from KCNV2__Homo_sapiens__NP_598004
augcucaagcaguccgagcgccgccgcuccugguccuaccgccccuggaacaccaccgagaacgagggcucccagcaccgccgcuccaucugcucccucggcgcccgcuccggcucccaggccuccauccacggcuggaccgagggcaacuacaacuacuacaucgaggaggacgaggacggcgaggaggaggaccaguggaaggacgaccucgccgaggaggaccagcaggccggcgaggucaccaccgccaagcccgagggccccuccgacccccccgcccuccucuccacccucaacgucaacgucggcggccacuccuaccagcucgacuacugcgagcucgccggcuuccccaagacccgccucggccgccucgccaccuccaccucccgcucccgccagcucucccucugcgacgacuacgaggagcagaccgacgaguacuucuucgaccgcgaccccgccgucuuccagcucgucuacaacuucuaccucuccggcguccuccucguccucgacggccucugcccccgccgcuuccucgaggagcucggcuacuggggcguccgccucaaguacaccccccgcugcugccgcaucugcuucgaggagcgccgcgacgagcucuccgagcgccucaagauccagcacgagcuccgcgcccaggcccaggucgaggaggccgaggagcucuuccgcgacaugcgcuucuacggcccccagcgccgccgccucuggaaccucauggagaagcccuucuccuccgucgccgccaaggccaucggcgucgccuccuccaccuucguccucgucuccgucgucgcccucgcccucaacaccgucgaggagaugcagcagcacuccggccagggcgagggcggccccgaccuccgccccauccucgagcacgucgagaugcucugcaugggcuucuucacccucgaguaccuccuccgccucgccuccacccccgaccuccgccgcuucgcccgcuccgcccucaaccucgucgaccucgucgccauccucccccucuaccuccagcuccuccucgagugcuucaccggcgagggccaccagcgcggccagaccgucggcuccgucggcaaggucggccagguccuccgcgucaugcgccucaugcgcaucuuccgcauccucaagcucgcccgccacuccaccggccuccgcgccuucggcuucacccuccgccagugcuaccagcaggucggcugccuccuccucuucaucgccaugggcaucuucaccuucuccgccgccgucuacuccgucgagcacgacguccccuccaccaacuucaccaccaucccccacuccugguggugggccgccgucuccaucuccaccgucggcuacggcgacauguaccccgagacccaccucggccgcuucuucgccuuccucugcaucgccuucggcaucauccucaacggcaugcccaucuccauccucuacaacaaguucuccgacuacuacuccaagcucaaggccuacgaguacaccaccauccgccgcgagcgcggcgaggucaacuucaugcagcgcgcccgcaagaagaucgccgagugccuccucggcuccaacccccagcucaccccccgccaggagaacuga

SEQ ID NO: 44961 - RNA, 942 nt, Artificial Sequence
  derived and/or modified sequence opt2 from KCTD10__Homo_sapiens__NP_114160
auggaggagauguccggcgaguccgucgucuccuccgccguccccgccgccgccacccgcaccaccuccuucaagggcaccucccccuccuccaaguacgucaagcucaacgucggcggcgcccucuacuacaccaccaugcagacccucaccaagcaggacaccaugcucaaggccauguucuccggccgcauggagguccucaccgacuccgagggcuggauccucaucgaccgcugcggcaagcacuucggcaccauccucaacuaccuccgcgacggcgccgucccccuccccgagucccgccgcgagaucgaggagcuccucgccgaggccaaguacuaccucguccagggccucgucgaggagugccaggccgcccuccagaacaaggacaccuacgagcccuucugcaagguccccgucaucaccuccuccaaggaggagcagaagcucaucgccaccuccaacaagcccgccgucaagcuccucuacaaccgcuccaacaacaaguacuccuacaccuccaacuccgacgacaacaugcucaagaacaucgagcucuucgacaagcucucccuccgcuucaacggccgcguccucuucaucaaggacgucaucggcgacgagaucugcugcugguccuucuacggccagggccgcaagaucgccgaggucugcugcaccuccaucgucuacgccaccgagaagaagcagaccaaggucgaguuccccgaggcccgcaucuacgaggagacccucaacauccuccucuacgaggcccaggacggccgcggccccgacaacgcccuccucgaggccaccggcggcgccgccggccgcucccaccaccucgacgaggacgaggagcgcgagcgcaucgagcgcguccgccgcauccacaucaagcgccccgacgaccgcgcccaccuccaccaguga

SEQ ID NO: 44962 - RNA, 699 nt, Artificial Sequence
  derived and/or modified sequence opt2 from KCTD11__Homo_sapiens__NP_001002914
augcucggcgccauguuccgcgccggcacccccaugccccccaaccucaacucccagggcggcggccacuacuucaucgaccgcgacggcaaggccuuccgccacauccucaacuuccuccgccucggccgccucgaccucccccgcggcuacggcgagaccgcccuccuccgcgccgaggccgacuucuaccagauccgcccccuccucgacgcccuccgcgagcucgaggccucccagggcacccccgcccccaccgccgcccuccuccacgccgacgucgacgucuccccccgccucguccacuucuccgcccgccgcggcccccaccacuacgagcucuccuccguccaggucgacaccuuccgcgccaaccucuucugcaccgacuccgagugccucggcgcccuccgcgcccgcuucggcgucgccuccggcgaccgcgccgagggcuccccccacuuccaccucgagugggccccccgccccgucgagcuccccgaggucgaguacggccgccucggccuccagccccucuggaccggcggccccggcgagcgccgcgaggucgucggcacccccuccuuccucgaggagguccuccgcgucgcccucgagcacggcuuccgccucgacuccgucuuccccgaccccgaggaccuccucaacucccgcucccuccgcuucguccgccacuga

SEQ ID NO: 44963 - RNA, 978 nt, Artificial Sequence
  derived and/or modified sequence opt2 from KCTD12__Homo_sapiens__NP_612453
auggcccucgccgacuccacccgcggccuccccaacggcggcggcggcggcggcggcuccggcuccuccuccuccuccgccgagcccccccucuuccccgacaucgucgagcucaacgucggcggccaggucuacgucacccgccgcugcaccgucgucuccguccccgacucccuccucuggcgcauguucacccagcagcagccccaggagcucgcccgcgacuccaagggccgcuucuuccucgaccgcgacggcuuccucuuccgcuacauccucgacuaccuccgcgaccuccagcucguccuccccgacuacuuccccgagcgcucccgccuccagcgcgaggccgaguacuucgagcuccccgagcucguccgccgccucggcgccccccagcagcccggccccggccccccccccucccgccgcggcguccacaaggagggcucccucggcgacgagcuccucccccucggcuacuccgagcccgagcagcaggagggcgccuccgccggcgcccccucccccacccucgagcucgccucccgcucccccuccggcggcgccgccggcccccuccucacccccucccagucccucgacggcucccgccgcuccggcuacaucaccaucggcuaccgcggcuccuacaccaucggccgcgacgcccaggccgacgccaaguuccgccgcgucgcccgcaucaccgucugcggcaagaccucccucgccaaggaggucuucggcgacacccucaacgagucccgcgaccccgaccgcccccccgagcgcuacaccucccgcuacuaccucaaguucaacuuccucgagcaggccuucgacaagcucuccgaguccggcuuccacauggucgccugcuccuccaccggcaccugcgccuucgccuccuccaccgaccaguccgaggacaagaucuggaccuccuacaccgaguacgucuucugccgcgaguga

SEQ ID NO: 44964 - RNA, 990 nt, Artificial Sequence
  derived and/or modified sequence opt2 from KCTD13__Homo_sapiens__NP_849194
auguccgccgaggccuccggccccgccgccgccgccgcccccucccucgaggcccccaagcccuccggccucgagcccggccccgccgccuacggccucaagccccucacccccaacuccaaguacgucaagcucaacgucggcggcucccuccacuacaccacccuccgcacccucaccggccaggacaccaugcucaaggccauguucuccggccgcgucgagguccucaccgacgccggcggcuggguccucaucgaccgcuccggccgccacuucggcaccauccucaacuaccuccgcgacggcuccgucccccuccccgaguccacccgcgagcucggcgagcuccucggcgaggcccgcuacuaccucguccagggccucaucgaggacugccagcucgcccuccagcagaagcgcgagacccucuccccccucugccucauccccauggucaccuccccccgcgaggagcagcagcuccucgccuccaccuccaagcccgucgucaagcuccuccacaaccgcuccaacaacaaguacuccuacaccuccaccuccgacgacaaccuccucaagaacaucgagcucuucgacaagcucgcccuccgcuuccacggccgccuccucuuccucaaggacguccucggcgacgagaucugcugcugguccuucuacggccagggccgcaagaucgccgaggucugcugcaccuccaucgucuacgccaccgagaagaagcagaccaaggucgaguuccccgaggcccgcaucuucgaggagacccucaacauccucaucuacgagaccccccgcggccccgaccccgcccuccucgaggccaccggcggcgccgccggcgccggcggcgccggccgcggcgaggacgaggagaaccgcgagcaccgcguccgccgcauccacguccgccgccacaucacccacgacgagcgcccccacggccagcagaucgucuucaaggacuga

SEQ ID NO: 44965 - RNA, 705 nt, Artificial Sequence
  derived and/or modified sequence opt2 from KCTD15__Homo_sapiens__NP_076981
augccccaccgcaaggagcgccccuccggcuccucccuccacacccacggcuccaccggcaccgccgagggcggcaacaugucccgccucucccucacccgcucccccgucuccccccucgccgcccagggcaucccccuccccgcccagcucaccaaguccaacgcccccguccacaucgacgucggcggccacauguacaccuccucccucgccacccucaccaaguaccccgacucccgcaucucccgccucuucaacggcaccgagcccaucguccucgacucccucaagcagcacuacuucaucgaccgcgacggcgagaucuuccgcuacguccucuccuuccuccgcaccuccaagcuccuccuccccgacgacuucaaggacuucucccuccucuacgaggaggcccgcuacuaccagcuccagcccaugguccgcgagcucgagcgcuggcagcaggagcaggagcagcgccgccgcucccgcgccugcgacugccucgucguccgcgucacccccgaccucggcgagcgcaucgcccucuccggcgagaaggcccucaucgaggaggucuuccccgagaccggcgacgucaugugcaacuccgucaacgccggcuggaaccaggaccccacccacgucauccgcuucccccucaacggcuacugccgccucaacuccguccaggacguccucuga

SEQ ID NO: 44966 - RNA, 1287 nt, Artificial Sequence
  derived and/or modified sequence opt2 from KCTD16__Homo_sapiens__XP_005268550
auggcccucuccggcaacugcucccgcuacuacccccgcgagcagggcuccgccguccccaacuccuuccccgaggucgucgagcucaacgucggcggccaggucuacuucacccgccacuccacccucaucuccaucccccacucccuccucuggaagauguucucccccaagcgcgacaccgccaacgaccucgccaaggacuccaagggccgcuucuucaucgaccgcgacggcuuccucuuccgcuacauccucgacuaccuccgcgaccgccaggucguccuccccgaccacuuccccgagaagggccgccucaagcgcgaggccgaguacuuccagcuccccgaccucgucaagcuccucacccccgacgagaucaagcagucccccgacgaguucugccacuccgacuucgaggacgccucccagggcuccgacacccgcaucugcccccccuccucccuccuccccgccgaccgcaaguggggcuucaucaccgucggcuaccgcggcuccugcacccucggccgcgagggccaggccgacgccaaguuccgccgcgucccccgcauccucgucugcggccgcaucucccucgccaaggaggucuucggcgagacccucaacgagucccgcgaccccgaccgcgcccccgagcgcuacaccucccgcuucuaccucaaguucaagcaccucgagcgcgccuucgacaugcucuccgagugcggcuuccacauggucgccugcaacuccuccgucaccgccuccuucaucaaccaguacaccgacgacaagaucugguccuccuacaccgaguacgucuucuaccgcgagcccucccgcuggucccccucccacugcgacugcugcugcaagaacggcaagggcgacaaggagggcgaguccggcaccuccugcaacgaccucuccaccuccuccugcgacucccaguccgaggccuccuccccccaggagaccgucaucugcggccccgucacccgccagaccaacauccagacccucgaccgccccaucaagaagggccccguccagcucauccagcaguccgagaugcgccgcaaguccgaccuccuccgcacccucaccuccggcucccgcgaguccaacauguccuccaagaagaaggccgucaaggagaagcucuccaucgaggaggagcucgagaagugcauccaggacuuccucaagaucaagauccccgaccgcuuccccgagcgcaagcaccccuggcaguccgagcuccuccgcaaguaccaccucuga

SEQ ID NO: 44967 - RNA, 2598 nt, Artificial Sequence
  derived and/or modified sequence opt2 from KCTD1__Homo_sapiens__NP_001136202
auggcccgcaugcccggcuccggcgacugcaacaccuccgccggcggcuccgccuccgccgccgccgccgccgccgagaacaacggcgagcgcggcgagggcgagcgcggcgccggcggccgcggccgccgccacucccgcccccacuacugcuccgccggcgaggaggaggaggaggaggaggaggaggacgagauccaggagguccagaucaccggcgacgaggaggaggaggaggacggcggcggcggccucgaggaggacgaggaggaggaggaggaggaggagaugggccucgacugggacgagccccucgagcccgaggacuccgccggcgaggagcucgagcccgagcccguccacaugaucaacauggaccaguccgccgcccucgagcccgaggcccccccccgccuccucgccccccgcgcccgcggcggcccccccggcgacggcuccgagcucgaccccgacguccuccagcgccccgagcgcgcccgccucuccgagaacacccgccucgccacccgcuacgccguccgcaucuuccgcgaguaccucuccgagaaggcccagucccccgacuucgagaccauggacaagggcgcccucugccgcguccuccgcuccuucuacgccgaggcccgcuccaaguccggccagcucuacuccaaguccucccucaucuccauccgcuccucccucaaccgcuaccucaacgagccccccuacugccgcacccucgaccucaccaaggaccccgagcuccgcuccgccaaccucacccucgccgccgucauccgcaagcucgaggagcagggcgccggccccgucguccagaagcaggccaucacccgcgccgaccuccgcaagcucuacaccuccuccgucuucuccaccaacacccccuucggccuccucaacaaggucugguucgagaccugcauguacuucugcacccgcggccgcgagaaccagcgcgagcucgaggaggacuccuucggccucgccauggacgaggacggccgcaaguucgucuacuucaagucccucggccccuaccacaagucccgcuccuccuccugguccaagaagcgcgccgaguccuccgacgaggagaaccucccccgcauguacgagaccggcaccgaguucugccccuacgccuccuucgucaaguaccucuccaagcgcaacccccucugcaaggccuucuuccagcgcccccgcgaccacugcuccgagggcgacgucaccugguacgagaacaaggccaucggcaagaaccuccucggcacccgcaugcagaugcucuccaaggccgccaagcucuccaagaccuacaccaaccacugcaucggcgccgucuccaucgccacccucaacuccaucgccggcaucggcaccaagcucggcucccccgccccccagggcugcuacgccgaggcccucaacggcgccgcccgccaccacucccaccacccccccacccaccccucccaccaccaccgcccccagccccccucccucggcaacaccuacauccuccccaaggacucccaggucggccccgacgucaaguccgaggccgcccccaagcgcgcccucuacgaguccgucuucggcuccggcgagaucugcggccccaccucccccaagcgccucugcauccgccccuccgagcccgucgacgccgucgucgucgucuccgucaagcacgacccccucccccuccuccccgaggccaacggccaccgcuccaccaacucccccaccaucgucucccccgccaucgucucccccacccaggacucccgccccaacaugucccgcccccucaucacccgcucccccgccuccccccucaacaaccagggcauccccacccccgcccagcucaccaaguccaacgcccccguccacaucgacgucggcggccacauguacaccuccucccucgccacccucaccaaguaccccgagucccgcaucggccgccucuucgacggcaccgagcccaucguccucgacucccucaagcagcacuacuucaucgaccgcgacggccagauguuccgcuacauccucaacuuccuccgcaccuccaagcuccucauccccgacgacuucaaggacuacacccuccucuacgaggaggccaaguacuuccagcuccagcccaugcuccucgagauggagcgcuggaagcaggaccgcgagaccggccgcuucucccgccccugcgagugccucgucguccgcgucgcccccgaccucggcgagcgcaucacccucuccggcgacaagucccucaucgaggaggucuuccccgagaucggcgacgucaugugcaacuccgucaacgccggcuggaaccacgacuccacccacgucauccgcuucccccucaacggcuacugccaccucaacuccguccagguccucgagcgccuccagcagcgcggcuucgagaucgucggcuccugcggcggcggcgucgacuccucccaguucuccgaguacguccuccgccgcgagcuccgccgcaccccccgcguccccuccgucauccgcaucaagcaggagccccucgacuga

SEQ ID NO: 44968 - RNA, 990 nt, Artificial Sequence
  derived and/or modified sequence opt2 from KCTD21__Homo_sapiens__XP_005273982
auggaguucgcccucgacgcccccuccugcgaggagccccgcgagaacuaccagucccgcaaggccgcccaccgcccccgcaccgccaccccccucggcugggcccccacccuccgccccccccgcaaggccgcccucgccgcccgcggcggccgcggcugccgcgcccgcgccggcggccuccuccccgccacccagucccccgccauguccgaccccaucacccucaacgucggcggcaagcucuacaccaccucccucgccacccucaccuccuuccccgacuccaugcucggcgccauguucuccggcaagaugcccaccaagcgcgacucccagggcaacugcuucaucgaccgcgacggcaaggucuuccgcuacauccucaacuuccuccgcaccucccaccucgaccuccccgaggacuuccaggagaugggccuccuccgccgcgaggccgacuucuaccagguccagccccucaucgaggcccuccaggagaaggaggucgagcucuccaaggccgagaagaacgccaugcucaacaucacccucaaccagcgcguccagaccguccacuucaccguccgcgaggccccccagaucuacucccucuccuccuccuccauggaggucuucaacgccaacaucuucuccaccuccugccucuuccucaagcuccucggcuccaagcucuucuacugcuccaacggcaaccucuccuccaucaccucccaccuccaggaccccaaccaccucacccucgacugggucgccaacgucgagggccuccccgaggaggaguacaccaagcagaaccucaagcgccucugggucguccccgccaacaagcagaucaacuccuuccaggucuucgucgaggagguccucaagaucgcccucuccgacggcuucugcaucgacuccucccacccccacgcccucgacuucaugaacaacaagaucauccgccucauccgcuaccgcuga

SEQ ID NO: 44969 - RNA, 792 nt, Artificial Sequence
  derived and/or modified sequence opt2 from KCTD2__Homo_sapiens__NP_056168
auggccgagcuccagcucgaccccgccauggccggccucggcggcggcggcggcuccggcgucggcgacggcggcggccccguccgcggcccccccuccccccgccccgccggccccaccccccgcggccacggccgccccgccgccgccgucgcccagccccucgagcccggccccggcccccccgagcgcgccggcggcggcggcgccgcccgcuggguccgccucaacgucggcggcaccuacuucgucaccacccgccagacccucggccgcgagcccaaguccuuccucugccgccucugcugccaggaggaccccgagcucgacuccgacaaggacgagaccggcgccuaccucaucgaccgcgaccccaccuacuucggccccauccucaacuaccuccgccacggcaagcucaucaucaccaaggagcucgccgaggagggcguccucgaggaggccgaguucuacaacaucgccucccucguccgccucgucaaggagcgcauccgcgacaacgagaaccgcaccucccagggccccgucaagcacgucuaccgcguccuccagugccaggaggaggagcucacccagauggucuccaccauguccgacggcuggaaguucgagcagcucaucuccaucggcuccuccuacaacuacggcaacgaggaccaggccgaguuccucugcgucgucucccgcgagcucaacaacuccaccaacggcaucgucaucgagcccuccgagaaggccaagauccuccaggagcgcggcucccgcauguga

SEQ ID NO: 44970 - RNA, 2448 nt, Artificial Sequence
  derived and/or modified sequence opt2 from KCTD3__Homo_sapiens__NP_057205
auggccggcggccacugcggcuccuuccccgccgccgccgccggcuccggcgagaucguccagcucaacgucggcggcacccgcuucuccaccucccgccagacccucauguggauccccgacuccuucuucuccucccuccucuccggccgcaucuccacccuccgcgacgagaccggcgccaucuucaucgaccgcgaccccgccgccuucgcccccauccucaacuuccuccgcaccaaggagcucgaccuccgcggcgucuccaucaacguccuccgccacgaggccgaguucuacggcaucaccccccucguccgccgccuccuccucugcgaggagcucgagcgcuccuccugcggcuccguccucuuccacggcuaccuccccccccccggcauccccucccgcaagaucaacaacaccguccgcuccgccgacucccgcaacggccucaacuccaccgagggcgaggcccgcggcaacggcacccagcccguccucuccggcaccggcgaggagaccguccgccucggcuuccccgucgacccccgcaagguccucaucgucgccggccaccacaacuggaucgucgccgccuacgcccacuucgccgucugcuaccgcaucaaggaguccuccggcuggcagcaggucuucaccucccccuaccucgacuggaccaucgagcgcgucgcccucaacgccaaggucgucggcggcccccacggcgacaaggacaagauggucgccgucgccuccgaguccuccaucauccucugguccguccaggacggcggcuccggcuccgagaucggcgucuucucccucggcguccccgucgacgcccucuucuucaucggcaaccagcucgucgccaccucccacaccggcaaggucggcgucuggaacgccgucacccagcacuggcagguccaggacgucguccccaucaccuccuacgacaccgccggcuccuuccuccuccucggcugcaacaacggcuccaucuacuacaucgacaugcagaaguucccccuccgcaugaaggacaacgaccuccucgucaccgagcucuaccacgaccccuccaacgacgccaucaccgcccucuccgucuaccucacccccaagaccuccgucuccggcaacuggaucgagaucgccuacggcaccuccuccggcgccguccgcgucaucguccagcaccccgagaccgucggcuccggcccccagcucuuccagaccuucaccguccaccgcucccccgucaccaagaucaugcucuccgagaagcaccucgucuccgucugcgccgacaacaaccacguccgcaccuggaccgucacccgcuuccgcggcaugaucuccacccagcccggcuccaccccccucgccuccuucaagauccucucccucgaggagaccgagucccacggcuccuacuccuccggcaacgacaucggccccuucggcgagcgcgacgaccagcaggucuucauccagaaggucguccccaucaccaacaagcucuucguccgccucuccuccaccggcaagcgcaucugcgagauccaggccgucgacugcaccaccaucuccuccuucaccguccgcgagugcgagggcuccucccgcaugggcucccgcccccgccgcuaccucuucaccggccacaccaacggcuccauccagaugugggaccucaccaccgccauggacauggucaacaaguccgaggacaaggacgucggcggccccaccgaggaggagcuccucaagcuccucgaccagugcgaccucuccaccucccgcugcgccacccccaacaucucccccgccaccuccgucguccagcacucccaccuccgcgaguccaacuccucccuccagcuccagcaccacgacaccacccacgaggccgccaccuacggcuccaugcgccccuaccgcgaguccccccuccucgcccgcgcccgccgcaccgaguccuuccacuccuaccgcgacuuccagaccaucaaccucaaccgcaacgucgagcgcgccguccccgagaacggcaaccucggccccauccaggccgaggucaagggcgccaccggcgagugcaacaucuccgagcgcaagucccccggcgucgagaucaagucccuccgcgagcucgacuccggccucgagguccacaagaucgccgagggcuucuccgaguccaagaagcgcuccuccgaggacgagaacgagaacaagaucgaguuccgcaagaagggcggcuucgagggcggcggcuuccucggccgcaagaagguccccuaccucgccuccucccccuccaccuccgacggcggcaccgacucccccggcaccgccucccccucccccaccaagaccacccccuccccccgccacaagaaguccgacuccuccggccaggaguacucccucuga

SEQ ID NO: 44971 - RNA, 714 nt, Artificial Sequence
  derived and/or modified sequence opt2 from KCTD6__Homo_sapiens__NP_699162
auggacaacggcgacuggggcuacaugaugaccgaccccgucacccucaacgucggcggccaccucuacaccaccucccucaccacccucacccgcuaccccgacuccaugcucggcgccauguucggcggcgacuuccccaccgcccgcgacccccagggcaacuacuucaucgaccgcgacggcccccucuuccgcuacguccucaacuuccuccgcaccuccgagcucacccucccccucgacuucaaggaguucgaccuccuccgcaaggaggccgacuucuaccagaucgagccccucauccagugccucaacgaccccaagccccucuaccccauggacaccuucgaggaggucgucgagcucuccuccacccgcaagcucuccaaguacuccaaccccgucgccgucaucaucacccagcucaccaucaccaccaagguccacucccuccucgagggcaucuccaacuacuucaccaaguggaacaagcacaugauggacacccgcgacugccaggucuccuucaccuucggccccugcgacuaccaccaggaggucucccuccgcguccaccucauggaguacaucaccaagcagggcuucaccauccgcaacacccgcguccaccacauguccgagcgcgccaacgagaacaccgucgagcacaacuggaccuucugccgccucgcccgcaagaccgacgacuga

SEQ ID NO: 44972 - RNA, 867 nt, Artificial Sequence
  derived and/or modified sequence opt2 from KCTD7__Homo_sapiens__NP_001161433
auggucgucgucaccggccgcgagcccgacucccgccgccaggacggcgccauguccuccuccgacgccgaggacgacuuccucgagcccgccacccccaccgccacccaggccggccacgcccucccccuccucccccaggaguuccccgaggucgucccccucaacaucggcggcgcccacuucaccacccgccucuccacccuccgcugcuacgaggacaccaugcucgccgccauguucuccggccgccacuacauccccaccgacuccgagggccgcuacuucaucgaccgcgacggcacccacuucggcgacguccucaacuuccuccgcuccggcgaccuccccccccgcgagcgcguccgcgccgucuacaaggaggcccaguacuacgccaucggcccccuccucgagcagcucgagaacaugcagccccucaagggcgagaagguccgccaggccuuccucggccucaugcccuacuacaaggaccaccucgagcgcaucgucgagaucgcccgccuccgcgccguccagcgcaaggcccgcuucgccaagcucaaggucugcgucuucaaggaggagaugcccaucacccccuacgagugcccccuccucaacucccuccgcuucgagcgcuccgaguccgacggccagcucuucgagcaccacugcgaggucgacgucuccuucggccccugggaggccgucgccgacgucuacgaccuccuccacugccucgucaccgaccucuccgcccagggccucaccgucgaccaccagugcaucggcgucugcgacaagcaccucgucaaccacuacuacugcaagcgccccaucuacgaguucaagaucaccugguga

SEQ ID NO: 44973 - RNA, 1170 nt, Artificial Sequence
  derived and/or modified sequence opt2 from KCTD9__Homo_sapiens__NP_060104
augcgccgcgucacccucuuccucaacggcucccccaagaacggcaaggucgucgccgucuacggcacccucuccgaccuccucuccgucgccuccuccaagcucggcaucaaggccaccuccgucuacaacggcaagggcggccucaucgacgacaucgcccucauccgcgacgacgacguccucuucgucugcgagggcgagcccuucaucgacccccagaccgacuccaagccccccgagggccuccucggcuuccacaccgacuggcucacccucaacgucggcggccgcuacuucaccaccacccgcuccacccucgucaacaaggagcccgacuccaugcucgcccacauguucaaggacaagggcgucuggggcaacaagcaggaccaccgcggcgccuuccucaucgaccgcucccccgaguacuucgagcccauccucaacuaccuccgccacggccagcucaucgucaacgacggcaucaaccuccucggcguccucgaggaggcccgcuucuucggcaucgacucccucaucgagcaccucgaggucgccaucaagaacucccagccccccgaggaccacucccccaucucccgcaaggaguucguccgcuuccuccucgccacccccaccaaguccgagcuccgcugccagggccucaacuucuccggcgccgaccucucccgccucgaccuccgcuacaucaacuucaagauggccaaccucucccgcugcaaccucgcccacgccaaccucugcugcgccaaccucgagcgcgccgaccucuccggcuccguccucgacugcgccaaccuccagggcgucaagaugcucugcuccaacgccgagggcgccucccucaagcucugcaacuucgaggaccccuccggccucaaggccaaccucgagggcgccaaccucaagggcgucgacauggagggcucccagaugaccggcaucaaccuccgcgucgccacccucaagaacgccaagcucaagaacugcaaccuccgcggcgccacccucgccggcaccgaccucgagaacugcgaccucuccggcugcgaccuccaggaggccaaccuccgcggcuccaacgucaagggcgccaucuucgaggagaugcucaccccccuccacaugucccaguccguccgcuga

SEQ ID NO: 44974 - RNA, 1509 nt, Artificial Sequence
  derived and/or modified sequence opt2 from KDELC1__Homo_sapiens__NP_076994
auguucggcacccuccuccucuacugcuucuuccucgccaccguccccgcccucgccgagaccggcggcgagcgccagcucucccccgagaaguccgagaucuggggccccggccucaaggccgacgucguccuccccgcccgcuacuucuacauccaggccgucgacaccuccggcaacaaguucaccuccucccccggcgagaaggucuuccaggucaaggucuccgcccccgaggagcaguucacccgcgucggcguccagguccucgaccgcaaggacggcuccuucaucguccgcuaccgcauguacgccuccuacaagaaccucaaggucgagaucaaguuccagggccagcacgucgccaagucccccuacauccucaagggccccgucuaccacgagaacugcgacugcccccuccaggacuccgccgccuggcuccgcgagaugaacugccccgagaccaucgcccagauccagcgcgaccucgcccacuuccccgccgucgaccccgagaagaucgccgucgagauccccaagcgcuucggccagcgccagucccucugccacuacacccucaaggacaacaaggucuacaucaagacccacggcgagcacgucggcuuccgcaucuucauggacgccauccuccucucccucacccgcaaggucaagaugcccgacgucgagcucuucgucaaccucggcgacuggccccucgagaagaagaaguccaacuccaacauccaccccaucuucuccuggugcggcuccaccgacuccaaggacaucgucaugcccaccuacgaccucaccgacuccguccucgagaccaugggccgcgucucccucgacaugauguccguccaggccaacaccggcccccccugggaguccaagaacuccaccgccgucuggcgcggccgcgacucccgcaaggagcgccucgagcucgucaagcucucccgcaagcaccccgagcucaucgacgccgccuucaccaacuucuucuucuucaagcacgacgagaaccucuacggccccaucgucaagcacaucuccuucuucgacuucuucaagcacaaguaccagaucaacaucgacggcaccgucgccgccuaccgccuccccuaccuccucgucggcgacuccgucguccucaagcaggacuccaucuacuacgagcacuucuacaacgagcuccagcccuggaagcacuacauccccgucaaguccaaccucuccgaccuccucgagaagcucaagugggccaaggaccacgacgaggaggccaagaagaucgccaaggccggccaggaguucgcccgcaacaaccucaugggcgacgacaucuucugcuacuacuucaagcucuuccaggaguacgccaaccuccaggucuccgagccccagauccgcgagggcaugaagcgcgucgagccccagaccgaggacgaccucuuccccugcaccugccaccgcaagaagaccaaggacgagcucuga

SEQ ID NO: 44975 - RNA, 639 nt, Artificial Sequence
  derived and/or modified sequence opt2 from KDELR1__Homo_sapiens__NP_006792
augaaccucuuccgcuuccucggcgaccucucccaccuccucgccaucauccuccuccuccucaagaucuggaagucccgcuccugcgccggcaucuccggcaagucccagguccucuucgccgucgucuucaccgcccgcuaccucgaccucuucaccaacuacaucucccucuacaacaccugcaugaaggucgucuacaucgccugcuccuucaccaccgucuggcucaucuacuccaaguucaaggccaccuacgacggcaaccacgacaccuuccgcgucgaguuccucgucguccccaccgccauccucgccuuccucgucaaccacgacuucaccccccucgagauccucuggaccuucuccaucuaccucgaguccgucgccauccucccccagcucuucauggucuccaagaccggcgaggccgagaccaucaccucccacuaccucuucgcccucggcgucuaccgcacccucuaccucuucaacuggaucuggcgcuaccacuucgagggcuucuucgaccucaucgccaucgucgccggccucguccagaccguccucuacugcgacuucuucuaccucuacaucaccaagguccucaagggcaagaagcucucccuccccgccuga

SEQ ID NO: 44976 - RNA, 2172 nt, Artificial Sequence
  derived and/or modified sequence opt2 from KDM2A__Homo_sapiens__NP_001243334
augugcuccggccgcuuccagaacauccaggucaaccccgacuucccccgcggccgcaucuccaacuccuuccgccgcaccuccuccaccgagaacaagaccaagacccucggcaagcuccaccaggagccccgccagcuccaguccgacggcaagcgcaagauccuccucgaggagcucgccaacuccgaccccaagcucgcccucaccggcguccccaucguccaguggcccaagcgcgacaagcucaaguuccccacccgccccaagguccgcguccccaccauccccaucaccaagccccacaccaugaagcccgccccccgccucacccccguccgccccgccgccgccucccccaucgucuccggcgcccgccgccgccgcguccgcugccgcaagugcaaggccugcguccagggcgagugcggcgucugccacuacugccgcgacaugaagaaguucggcggccccggccgcaugaagcaguccugcguccuccgccagugccucgccccccgccucccccacuccgucaccugcucccucugcggcgaggucgaccagaacgaggagacccaggacuucgagaagaagcucauggagugcugcaucugcaacgagaucguccaccccggcugccuccagauggacggcgagggccuccucaacgaggagcuccccaacugcugggagugccccaagugcuaccaggaggacuccuccgagaaggcccagaagcgcaagauggaggaguccgacgaggaggccguccaggccaagguccuccgcccccuccgcuccugcgacgagccccucaccccccccccccacucccccaccuccaugcuccagcucauccacgaccccgucuccccccgcggcauggucacccgcuccucccccggcgccggccccuccgaccaccacuccgccucccgcgacgagcgcuucaagcgccgccagcuccuccgccuccaggccaccgagcgcaccaugguccgcgagaaggagaacaaccccuccggcaagaaggagcucuccgaggucgagaaggccaagauccgcggcuccuaccucaccgucacccuccagcgccccaccaaggagcuccacggcaccuccaucguccccaagcuccaggccaucaccgccuccuccgccaaccuccgccacuccccccgcguccucguccagcacugccccgcccgcaccccccagcgcggcgacgaggagggccucggcggcgaggaggaggaggaggaggaggaggaggaggaggacgacuccgccgaggagggcggcgccgcccgccucaacggccgcggcuccugggcccaggacggcgacgaguccuggaugcagcgcgaggucuggauguccgucuuccgcuaccucucccgccgcgagcucugcgagugcaugcgcgucugcaagaccugguacaaguggugcugcgacaagcgccucuggaccaagaucgaccucucccgcugcaaggccaucgucccccaggcccucuccggcaucaucaagcgccagcccgucucccucgaccucuccuggaccaacaucuccaagaagcagcucaccuggcucgucaaccgccuccccggccucaaggaccuccuccucgccggcugcuccugguccgccgucuccgcccucuccaccuccuccugcccccuccuccgcacccucgaccuccgcugggccgucggcaucaaggacccccagauccgcgaccuccucaccccccccgccgacaagcccggccaggacaaccgcuccaagcuccgcaacaugaccgacuuccgccucgccggccucgacaucaccgacgccacccuccgccucaucauccgccacaugccccuccucucccgccucgaccucucccacugcucccaccucaccgaccaguccuccaaccuccucaccgccgucggcuccuccacccgcuacucccucaccgagcucaacauggccggcugcaacaagcucaccgaccagacccucaucuaccuccgccgcaucgccaacgucacccucaucgaccuccgcggcugcaagcagaucacccgcaaggccugcgagcacuucaucuccgaccucuccaucaacucccucuacugccucuccgacgagaagcucauccagaagaucuccuga

SEQ ID NO: 44977 - RNA, 3798 nt, Artificial Sequence
  derived and/or modified sequence opt2 from KDM2B__Homo_sapiens__NP_001005366
auggaggccgagaaggacuccggccgccgccuccgccccaucgaccgccagcgcuacgacgagaacgaggaccucuccgacgucgaggagaucgucuccguccgcggcuucucccucgaggagaagcuccgcucccagcucuaccagggcgacuucguccacgccauggagggcaaggacuucaacuacgaguacguccagcgcgaggcccuccgcgucccccucaucuuccgcgagaaggacggccucggcaucaagaugcccgaccccgacuucaccguccgcgacgucaagcuccucgucggcucccgccgccucgucgacgucauggacgucaacacccagaagggcaccgagauguccaugucccaguucguccgcuacuacgagacccccgaggcccagcgcgacaagcucuacaacgucaucucccucgaguucucccacaccaagcucgagcaccucgucaagcgccccaccgucgucgaccucgucgacugggucgacaacauguggccccagcaccucaaggagaagcagaccgaggccaccaacgccaucgccgagaugaaguaccccaaggucaagaaguacugccucauguccgucaagggcugcuucaccgacuuccacaucgacuucggcggcaccuccgucugguaccacgucuuccgcggcggcaagaucuucuggcucaucccccccacccuccacaaccucgcccucuacgaggaguggguccucuccggcaagcaguccgacaucuuccucggcgaccgcgucgagcgcugccagcgcaucgagcucaagcagggcuacaccuucuucauccccuccggcuggauccacgccgucuacacccccgucgacucccucgucuucggcggcaacauccuccacuccuucaacguccccaugcagcuccgcaucuacgagaucgaggaccgcacccgcguccagcccaaguuccgcuaccccuucuacuacgagaugugcugguacguccucgagcgcuacgucuacugcgucacccagcgcucccaccucacccaggaguaccagcgcgaguccaugcucaucgacgccccccgcaagcccuccaucgacggcuucuccuccgacuccuggcucgagauggaggaggaggccugcgaccagcagccccaggaggaggaggagaaggacgaggagggcgagggccgcgaccgcgcccccaagccccccaccgacggcuccaccucccccaccuccacccccuccgaggaccaggaggcccucggcaagaagcccaaggcccccgcccuccgcuuccucaagcgcacccucuccaacgaguccgaggaguccgucaaguccaccacccucgccgucgacuaccccaagacccccaccggcucccccgccaccgaggucuccgccaaguggacccaccucaccgaguucgagcucaagggccucaaggcccucgucgagaagcucgagucccuccccgagaacaagaagugcguccccgagggcaucgaggacccccaggcccuccucgagggcgucaagaacguccucaaggagcacgccgacgacgaccccucccucgccaucaccggcguccccgucgucaccuggcccaagaagacccccaagaaccgcgccgucggccgccccaagggcaagcucggccccgccuccgccgucaagcucgccgccaaccgcaccaccgccggcgcccgccgccgccgcacccgcugccgcaagugcgaggccugccuccgcaccgagugcggcgagugccacuucugcaaggacaugaagaaguucggcggccccggccgcaugaagcaguccugcaucaugcgccagugcaucgcccccguccucccccacaccgccgucugccucgucugcggcgaggccggcaaggaggacaccgucgaggaggaggagggcaaguucaaccucaugcucauggagugcuccaucugcaacgagaucauccaccccggcugccucaagaucaaggaguccgagggcgucgucaacgacgagcuccccaacugcugggagugccccaagugcaaccacgccggcaagaccggcaagcagaagcgcggccccggcuucaaguacgccuccaaccuccccggcucccuccucaaggagcagaagaugaaccgcgacaacaaggagggccaggagcccgccaagcgccgcuccgagugcgaggaggccccccgccgccgcuccgacgagcacuccaagaaggucccccccgacggccuccuccgccgcaaguccgacgacguccaccuccgcaagaagcgcaaguacgagaagccccaggagcucuccggccgcaagcgccucaagcccggcaaggaggacaagcucuuccgcaagaagcgccgcuccuggaagaacgccgaggaccgcauggcccucgccaacaagccccuccgccgcuucaagcaggagcccgaggacgagcuccccgaggccccccccaagacccgcgaguccgaccacucccgcuccuccucccccaccgccggccccuccaccgagggcgccgagggccccgaggagaagaagaaggucaagaugcgccgcaagcgccgccuccccaacaaggagcucucccgcgagcucuccaaggagcucaaccacgagauccagcgcaccgagaacucccucgccaacgagaaccagcagcccaucaaguccgagcccgaguccgagggcgaggagcccaagcgcccccccggcaucugcgagcgcccccaccgcuucuccaagggccucaacggcaccccccgcgagcuccgccaccagcucggccccucccuccgcucccccccccgcgucaucucccgccccccccccuccgucuccccccccaagugcauccagauggagcgccacgucauccgccccccccccaucucccccccccccgacucccucccccucgacgacggcgccgcccacgucaugcaccgcgaggucuggauggccgucuucuccuaccucucccaccaggaccucugcgucugcaugcgcgucugccgcaccuggaaccgcuggugcugcgacaagcgccucuggacccgcaucgaccucaaccacugcaaguccaucaccccccucaugcucuccggcaucauccgccgccagcccgucucccucgaccucuccuggaccaacaucuccaagaagcagcucuccuggcucaucaaccgccuccccggccuccgcgaccucguccucuccggcugcuccuggaucgccgucuccgcccucugcuccuccuccugcccccuccuccgcacccucgacguccagugggucgagggccucaaggacgcccagaugcgcgaccuccucuccccccccaccgacaaccgccccggccagauggacaaccgcuccaagcuccgcaacaucgucgagcuccgccucgccggccucgacaucaccgacgccucccuccgccucaucauccgccacaugccccuccucuccaagcuccaccucuccuacugcaaccacgucaccgaccaguccaucaaccuccucaccgccgucggcaccaccacccgcgacucccucaccgagaucaaccucuccgacugcaacaaggucaccgaccagugccucuccuucuucaagcgcugcggcaacaucugccacaucgaccuccgcuacugcaagcaggucaccaaggagggcugcgagcaguucaucgccgagauguccuccuuccagggccgcuccugcuccaccacccgccucggcgacgaguga

SEQ ID NO: 44978 - RNA, 3966 nt, Artificial Sequence
  derived and/or modified sequence opt2 from KDM3A__Homo_sapiens__NP_060903
augguccucacccucggcgaguccuggcccguccucgucggccgccgcuuccucucccucuccgccgccgacggcuccgacggcucccacgacuccugggacgucgagcgcgucgccgaguggcccuggcucuccggcaccauccgcgccgucucccacaccgacgucaccaagaaggaccucaaggucugcgucgaguucgacggcgaguccuggcgcaagcgccgcuggaucgaggucuacucccuccuccgccgcgccuuccucgucgagcacaaccucguccucgccgagcgcaagucccccgagaucuccgagcgcaucguccaguggcccgccaucaccuacaagccccuccucgacaaggccggccucggcuccaucaccuccguccgcuuccucggcgaccagcagcgcgucuuccucuccaaggaccuccucaagcccauccaggacgucaacucccuccgccucucccucaccgacaaccagaucgucuccaaggaguuccaggcccucaucgucaagcaccucgacgagucccaccuccucaagggcgacaagaaccucgucggcuccgaggucaagaucuacucccucgaccccuccacccagugguucuccgccaccgucaucaacggcaaccccgccuccaagacccuccaggucaacugcgaggagauccccgcccucaagaucgucgaccccucccucauccacgucgaggucguccacgacaaccucgucaccugcggcaacuccgcccgcaucggcgccgucaagcgcaaguccuccgagaacaacggcacccucgucuccaagcaggccaaguccugcuccgaggccucccccuccaugugccccguccaguccguccccaccaccgucuucaaggagauccuccucggcugcaccgccgccaccccccccuccaaggacccccgccagcaguccaccccccaggccgccaacuccccccccaaccucggcgccaagaucccccagggcugccacaagcagucccuccccgaggagaucuccuccugccucaacaccaaguccgaggcccuccgcaccaagcccgacgucugcaaggccggccuccucuccaaguccucccagaucggcaccggcgaccucaagauccucaccgagcccaagggcuccugcacccagcccaagaccaacaccgaccaggagaaccgccucgaguccgucccccaggcccucaccggccuccccaaggagugccuccccaccaaggccuccuccaaggccgagcucgagaucgccaacccccccgagcuccagaagcaccucgagcacgcccccucccccuccgacgucuccaacgcccccgaggucaaggccggcgucaacuccgacucccccaacaacugcuccggcaagaaggucgagcccuccgcccucgccugccgcucccagaaccucaaggaguccuccgucaaggucgacaacgaguccugcugcucccgcuccaacaacaagauccagaacgcccccucccgcaaguccguccucaccgaccccgccaagcucaagaagcuccagcaguccggcgaggccuucguccaggacgacuccugcgucaacaucgucgcccagcuccccaagugccgcgagugccgccucgacucccuccgcaaggacaaggagcagcagaaggacucccccgucuucugccgcuucuuccacuuccgccgccuccaguucaacaagcacggcguccuccgcgucgagggcuuccucacccccaacaaguacgacaacgaggccaucggccucuggcucccccucaccaagaacgucgucggcaucgaccucgacaccgccaaguacauccucgccaacaucggcgaccacuucugccagauggucaucuccgagaaggaggccauguccaccaucgagccccaccgccaggucgccuggaagcgcgccgucaagggcguccgcgagaugugcgacgucugcgacaccaccaucuucaaccuccacugggucugcccccgcugcggcuucggcgucugcgucgacugcuaccgcaugaagcgcaagaacugccagcagggcgccgccuacaagaccuucuccuggcucaagugcgucaagucccagauccacgagcccgagaaccucaugcccacccagaucauccccggcaaggcccucuacgacgucggcgacaucguccacuccguccgcgccaaguggggcaucaaggccaacugccccugcuccaaccgccaguucaagcucuucuccaagcccgccuccaaggaggaccucaagcagaccucccucgccggcgagaagcccacccucggcgccguccuccagcagaaccccuccguccucgagcccgccgccgucggcggcgaggccgccuccaagcccgccggcuccaugaagcccgccugccccgccuccaccuccccccucaacuggcucgccgaccucaccuccggcaacgucaacaaggagaacaaggagaagcagcccaccaugcccauccucaagaacgagaucaagugccuccccccccuccccccccucuccaaguccuccaccguccuccacaccuucaacuccaccauccucacccccgucuccaacaacaacuccggcuuccuccgcaaccuccucaacuccuccaccggcaagaccgagaacggccucaagaacacccccaagauccucgacgacaucuucgccucccucguccagaacaagaccaccuccgaccucuccaagcgcccccagggccucaccaucaagcccuccauccucggcuucgacaccccccacuacuggcucugcgacaaccgccuccucugccuccaggaccccaacaacaaguccaacuggaacgucuuccgcgagugcuggaagcagggccagcccgucauggucuccggcguccaccacaagcucaacuccgagcucuggaagcccgaguccuuccgcaaggaguucggcgagcaggaggucgaccucgucaacugccgcaccaacgagaucaucaccggcgccaccgucggcgacuucugggacggcuucgaggacguccccaaccgccucaagaacgagaaggagcccaugguccucaagcucaaggacuggccccccggcgaggacuuccgcgacaugaugcccucccgcuucgacgaccucauggccaacaucccccuccccgaguacacccgccgcgacggcaagcucaaccucgccucccgccuccccaacuacuucguccgccccgaccucggccccaagauguacaacgccuacggccucaucacccccgaggaccgcaaguacggcaccaccaaccuccaccucgacgucuccgacgccgccaacgucauggucuacgucggcauccccaagggccagugcgagcaggaggaggagguccucaagaccauccaggacggcgacuccgacgagcucaccaucaagcgcuucaucgagggcaaggagaagcccggcgcccucuggcacaucuacgccgccaaggacaccgagaagauccgcgaguuccucaagaaggucuccgaggagcagggccaggagaaccccgccgaccacgaccccauccacgaccaguccugguaccucgaccgcucccuccgcaagcgccuccaccaggaguacggcguccagggcugggccaucguccaguuccucggcgacgucgucuucauccccgccggcgccccccaccagguccacaaccucuacuccugcaucaaggucgccgaggacuucgucucccccgagcacgucaagcacugcuucuggcucacccaggaguuccgcuaccucucccagacccacaccaaccacgaggacaagcuccaggucaagaacgucaucuaccacgccgucaaggacgccgucgccaugcucaaggccuccgaguccuccuucggcaagcccuga

SEQ ID NO: 44979 - RNA, 5286 nt, Artificial Sequence
  derived and/or modified sequence opt2 from KDM3B__Homo_sapiens__NP_057688
auggccgacgccgccgccucccccgucggcaagcgccuccuccuccucuucgccgacaccgccgccuccgccuccgccuccgcccccgccgccgccgccgccuccggcgaccccggccccgcccuccgcacccgcgccuggcgcgccggcaccguccgcgccauguccggcgccgucccccaggaccucgccaucuucgucgaguucgacggcugcaacuggaagcagcacuccugggucaagguccacgccgaggaggucaucguccuccuccucgagggcucccucgucugggccccccgcgaggaccccguccuccuccagggcauccgcgucuccaucgcccaguggcccgcccucaccuucaccccccucgucgacaagcucggccucggcuccgucguccccgucgaguaccuccucgaccgcgagcuccgcuuccucuccgacgccaacggccuccaccucuuccagaugggcaccgacucccagaaccagauccuccucgagcacgccgcccuccgcgagaccgucaacgcccucaucuccgaccagaagcuccaggagaucuucucccgcggccccuacuccguccagggccaccgcgucaagaucuaccagcccgagggcgaggagggcuggcucuacggcgucgucucccaccaggacuccaucacccgccucauggaggucuccgucaccgaguccggcgagaucaaguccgucgacccccgccucauccacgucaugcucauggacaacuccaccccccaguccgagggcggcacccucaaggccgucaaguccuccaagggcaagaagaagcgcgaguccaucgagggcaaggacggccgccgccgcaaguccgccuccgacuccggcugcgaccccgccuccaagaagcucaagggcgaccgcggcgaggucgacuccaacggcuccgacggcggcgaggccucccgcggccccuggaagggcggcaacgccuccggcgagcccggccucgaccagcgcgccaagcagccccccuccaccuucgucccccagaucaaccgcaacauccgcuucgccaccuacaccaaggagaacggccgcacccucgucguccaggacgagcccgucggcggcgacacccccgccuccuucacccccuacuccaccgccaccggccagaccccccucgcccccgaggucggcggcgccgagaacaaggaggccggcaagacccucgagcaggucggccagggcaucgucgccuccgccgccgucgucaccaccgccuccuccacccccaacaccguccgcaucuccgacaccggccucgccgccggcaccguccccgagaagcagaagggcucccgcucccaggccuccggcgagaacucccgcaacuccauccucgccuccuccggcuucggcgccccccuccccuccuccucccagccccucaccuucggcuccggccgcucccaguccaacggcguccucgccaccgagaacaagccccucggcuucuccuucggcugcuccuccgcccaggaggcccagaaggacaccgaccucuccaagaaccucuucuuccagugcaugucccagacccuccccaccuccaacuacuucaccaccgucuccgagucccucgccgacgacuccuccucccgcgacuccuucaagcagucccucgagucccucuccuccggccucugcaagggccgcuccguccucggcaccgacaccaagcccggcuccaaggccggcuccuccgucgaccgcaagguccccgccgaguccaugcccacccucacccccgccuucccccgcucccuccucaacgcccgcacccccgagaaccacgagaaccucuuccuccagccccccaagcucucccgcgaggagcccuccaaccccuuccucgccuucgucgagaaggucgagcacucccccuucuccuccuucgccucccaggccuccggcuccuccuccuccgccaccaccgucaccuccaaggucgcccccuccuggcccgagucccacuccuccgccgacuccgccucccucgccaagaagaagccccucuucaucaccaccgacuccuccaagcucgucuccggcguccucggcuccgcccucaccuccggcggccccucccucuccgccaugggcaacggccgcuccuccucccccaccuccucccucacccagcccaucgagaugcccacccucuccuccucccccaccgaggagcgccccaccgucggccccggccagcaggacaacccccuccucaagaccuucuccaacgucuucggccgccacuccggcggcuuccucuccucccccgccgacuucucccaggagaacaaggcccccuucgaggccgucaagcgcuucucccucgacgagcgcucccucgccugccgccaggacuccgacuccuccaccaacuccgaccucuccgaccucuccgacuccgaggagcagcuccaggccaagaccggccucaagggcauccccgagcaccucaugggcaagcucggccccaacggcgagcgcuccgccgagcuccuccucggcaaguccaagggcaagcaggcccccaagggccgcccccgcaccgccccccucaaggucggccaguccguccucaaggacgucuccaaggucaagaagcucaagcaguccggcgagcccuuccuccaggacggcuccugcaucaacgucgccccccaccuccacaagugccgcgagugccgccucgagcgcuaccgcaaguucaaggagcaggagcaggacgacuccaccgucgccugccgcuucuuccacuuccgccgccucaucuucacccgcaagggcguccuccgcgucgagggcuuccucuccccccagcaguccgaccccgacgccaugaaccucuggauccccuccuccucccucgccgagggcaucgaccucgagaccuccaaguacauccucgccaacgucggcgaccaguucugccagcucgucauguccgagaaggaggccaugaugauggucgagccccaccagaaggucgccuggaagcgcgccguccgcggcguccgcgagaugugcgacgucugcgagaccacccucuucaacauccacugggucugccgcaagugcggcuucggcgucugccucgacugcuaccgccuccgcaagucccgcccccgcuccgagaccgaggagaugggcgacgaggaggucuucuccuggcucaagugcgccaagggccagucccacgagcccgagaaccucaugcccacccagaucauccccggcaccgcccucuacaacaucggcgacaugguccacgccgcccgcggcaaguggggcaucaaggccaacugccccugcaucucccgccagaacaaguccguccuccgccccgccgucaccaacggcaugucccagcuccccuccaucaaccccuccgccuccuccggcaacgagaccaccuucuccggcggcggcggccccgcccccgucaccacccccgagcccgaccacguccccaaggccgacuccaccgacauccgcuccgaggagccccucaagaccgacuccuccgccuccaacuccaacuccgagcucaaggccauccgcccccccugccccgacaccgccccccccuccuccgcccuccacuggcucgccgaccucgccacccagaaggccaaggaggagaccaaggaggccggcucccuccgcuccguccucaacaaggagucccacucccccuucggccucgacuccuucaacuccaccgccaaggucuccccccucacccccaagcucuucaacucccuccuccucggccccaccgccuccaacaacaagaccgagggcuccucccuccgcgaccuccuccacuccggccccggcaagcucccccagaccccccucgacaccggcauccccuucccccccgucuucuccaccuccuccgccggcgucaaguccaaggccucccuccccaacuuccucgaccacaucaucgccuccgucgucgagaacaagaagaccuccgacgccuccaagcgcgccugcaaccucaccgacacccagaaggaggucaaggagauggucaugggccucaacguccucgacccccacaccucccacuccuggcucugcgacggccgccuccucugccuccacgaccccuccaacaagaacaacuggaagaucuuccgcgagugcuggaagcagggccagcccguccucgucuccggcguccacaagaagcucaaguccgagcucuggaagcccgaggccuucucccaggaguucggcgaccaggacgucgaccucgucaacugccgcaacugcgccaucaucuccgacgucaagguccgcgacuucugggacggcuucgagaucaucugcaagcgccuccgcuccgaggacggccagcccaugguccucaagcucaaggacuggccccccggcgaggacuuccgcgacaugaugcccacccgcuucgaggaccucauggagaaccucccccuccccgaguacaccaagcgcgacggccgccucaaccucgccucccgccuccccuccuacuucguccgccccgaccucggccccaagauguacaacgccuacggccucaucaccgccgaggaccgccgcgucggcaccaccaaccuccaccucgacgucuccgacgccgucaacgucauggucuacgucggcauccccaucggcgagggcgcccacgacgaggagguccucaagaccaucgacgagggcgacgccgacgaggucaccaagcagcgcauccacgacggcaaggagaagcccggcgcccucuggcacaucuacgccgccaaggacgccgagaagauccgcgagcuccuccgcaaggucggcgaggagcagggccaggagaacccccccgaccacgaccccauccacgaccaguccugguaccucgaccagacccuccgcaagcgccucuacgaggaguacggcguccagggcugggccaucguccaguuccucggcgacgccgucuucauccccgccggcgccccccaccagguccacaaccucuacuccugcaucaaggucgccgaggacuucgucucccccgagcacgucaagcacugcuuccgccucacccaggaguuccgccaccucuccaacacccacaccaaccacgaggacaagcuccaggucaagaacaucaucuaccacgccgucaaggacgccgucggcacccucaaggcccacgaguccaagcucgcccgcuccuga

SEQ ID NO: 44980 - RNA, 3291 nt, Artificial Sequence
  derived and/or modified sequence opt2 from KDM4B__Homo_sapiens__NP_055830
augggcuccgaggaccacggcgcccagaaccccuccugcaagaucaugaccuuccgccccaccauggaggaguucaaggacuucaacaaguacgucgccuacaucgagucccagggcgcccaccgcgccggccucgccaagaucaucccccccaaggaguggaagccccgccagaccuacgacgacaucgacgacgucgucauccccgcccccauccagcaggucgucaccggccaguccggccucuucacccaguacaacauccagaagaaggccaugaccgucggcgaguaccgccgccucgccaacuccgagaaguacugcaccccccgccaccaggacuucgacgaccucgagcgcaaguacuggaagaaccucaccuucgucucccccaucuacggcgccgacaucuccggcucccucuacgacgacgacgucgcccaguggaacaucggcucccuccgcaccauccucgacauggucgagcgcgagugcggcaccaucaucgagggcgucaacacccccuaccucuacuucggcauguggaagaccaccuucgccuggcacaccgaggacauggaccucuacuccaucaacuaccuccacuucggcgagcccaaguccugguacgccaucccccccgagcacggcaagcgccucgagcgccucgccaucggcuucuuccccggcuccucccagggcugcgacgccuuccuccgccacaagaugacccucaucucccccaucauccucaagaaguacggcauccccuucucccgcaucacccaggaggccggcgaguucaugaucaccuuccccuacggcuaccacgccggcuucaaccacggcuucaacugcgccgaguccaccaacuucgccacccuccgcuggaucgacuacggcaaggucgccacccagugcaccugccgcaaggacauggucaagaucuccauggacgucuucguccgcauccuccagcccgagcgcuacgagcucuggaagcagggcaaggaccucaccguccucgaccacacccgccccaccgcccucaccucccccgagcucuccuccugguccgccucccgcgccucccucaaggccaagcuccuccgccgcucccaccgcaagcgcucccagcccaagaagcccaagcccgaggaccccaaguuccccggcgagggcaccgccggcgccgcccuccucgaggaggccggcggcuccgucaaggaggaggccggccccgaggucgaccccgaggaggaggaggaggagccccagccccucccccacggccgcgaggccgagggcgccgaggaggacggccgcggcaagcuccgccccaccaaggccaaguccgagcgcaagaagaaguccuucggccuccuccccccccagcucccccccccccccgcccacuuccccuccgaggaggcccucuggcuccccuccccccucgagccccccguccucggccccggccccgccgccauggaggaguccccccuccccgccccccucaacgucgucccccccgagguccccuccgaggagcucgaggccaagccccgccccaucauccccaugcucuacgucgucccccgccccggcaaggccgccuucaaccaggagcacgucuccugccagcaggccuucgagcacuucgcccagaagggccccaccuggaaggagcccgucucccccauggagcucaccggccccgaggacggcgccgccuccuccggcgccggccgcauggagaccaaggcccgcgccggcgagggccaggcccccuccaccuucuccaagcucaagauggagaucaagaagucccgccgccacccccucggccgcccccccacccgcuccccccucuccgucgucaagcaggaggccuccuccgacgaggaggccucccccuucuccggcgaggaggacgucuccgaccccgacgcccuccgcccccuccucucccuccaguggaagaaccgcgccgccuccuuccaggccgagcgcaaguucaacgccgccgccgcccgcaccgagcccuacugcgccaucugcacccucuucuaccccuacugccaggcccuccagaccgagaaggaggcccccaucgccucccucggcgagggcugccccgccacccuccccuccaagucccgccagaagacccgcccccucauccccgagaugugcuucaccuccggcggcgagaacaccgagccccuccccgccaacuccuacaucggcgacgacggcaccuccccccucaucgccugcggcaagugcugccuccagguccacgccuccugcuacggcauccgccccgagcucgucaacgagggcuggaccugcucccgcugcgccgcccacgccuggaccgccgagugcugccucugcaaccuccgcggcggcgcccuccagaugaccaccgaccgccgcuggauccacgucaucugcgccaucgccguccccgaggcccgcuuccucaacgucaucgagcgccaccccgucgacaucuccgccauccccgagcagcgcuggaagcucaagugcgucuacugccgcaagcgcaugaagaaggucuccggcgccugcauccagugcuccuacgagcacugcuccaccuccuuccacgucaccugcgcccacgccgccggcguccucauggagcccgacgacuggcccuacgucgucuccaucaccugccucaagcacaaguccggcggccacgccguccagcuccuccgcgccgucucccucggccaggucgucaucaccaagaaccgcaacggccucuacuaccgcugccgcgucaucggcgccgccucccagaccugcuacgaggucaacuucgacgacggcuccuacuccgacaaccucuaccccgaguccaucaccucccgcgacugcguccagcucggcccccccuccgagggcgagcucgucgagcuccgcuggaccgacggcaaccucuacaaggccaaguucaucuccuccgucaccucccacaucuaccaggucgaguucgaggacggcucccagcucaccgucaagcgcggcgacaucuucacccucgaggaggagcuccccaagcgcguccgcucccgccucucccucuccaccggcgccccccaggagcccgccuucuccggcgaggaggccaaggccgccaagcgcccccgcgucggcaccccccucgccaccgaggacuccggccgcucccaggacuacgucgccuucgucgagucccuccuccagguccagggccgccccggcgcccccuucuga

SEQ ID NO: 44981 - RNA, 2442 nt, Artificial Sequence
  derived and/or modified sequence opt2 from KDM4C__Homo_sapiens__NP_001140167
auggaggucgccgaggucgaguccccccucaaccccuccugcaagaucaugaccuuccgccccuccauggaggaguuccgcgaguucaacaaguaccucgccuacauggaguccaagggcgcccaccgcgccggccucgccaaggucaucccccccaaggaguggaagccccgccagugcuacgacgacaucgacaaccuccucauccccgcccccauccagcagauggucaccggccaguccggccucuucacccaguacaacauccagaagaaggccaugaccgucaaggaguuccgccagcucgccaacuccggcaaguacugcaccccccgcuaccucgacuacgaggaccucgagcgcaaguacuggaagaaccucaccuucgucgcccccaucuacggcgccgacaucaacggcuccaucuacgacgagggcgucgacgaguggaacaucgcccgccucaacaccguccucgacgucgucgaggaggagugcggcaucuccaucgagggcgucaacacccccuaccucuacuucggcauguggaagaccaccuucgccuggcacaccgaggacauggaccucuacuccaucaacuaccuccacuucggcgagcccaaguccugguacgccaucccccccgagcacggcaagcgccucgagcgccucgcccagggcuucuuccccuccuccucccagggcugcgacgccuuccuccgccacaagaugacccucaucucccccuccguccucaagaaguacggcauccccuucgacaagaucacccaggaggccggcgaguucaugaucaccuuccccuacggcuaccacgccggcuucaaccacggcuucaacugcgccgaguccaccaacuucgccaccguccgcuggaucgacuacggcaaggucgccaagcucugcaccugccgcaaggacauggucaagaucuccauggacaucuucguccgcaaguuccagcccgaccgcuaccagcucuggaagcagggcaaggacaucuacaccaucgaccacaccaagcccacccccgccuccacccccgaggucaaggccuggcuccagcgccgccgcaagguccgcaaggccucccgcuccuuccagugcgcccgcuccaccuccaagcgccccaaggccgacgaggaggaggaggucuccgacgaggucgacggcgccgagguccccaaccccgacuccgucaccgacgaccucaaggucuccgagaaguccgaggccgccgucaagcuccgcaacaccgaggccuccuccgaggaggaguccuccgccucccgcaugcaggucgagcagaaccucuccgaccacaucaagcucuccggcaacuccugccucuccaccuccgucaccgaggacaucaagaccgaggacgacaaggccuacgccuaccgcuccguccccuccaucuccuccgaggccgacgacuccaucccccucuccuccggcuacgagaagcccgagaaguccgaccccuccgagcucuccuggcccaagucccccgaguccugcuccuccgucgccgaguccaacggcguccucaccgagggcgaggaguccgacgucgagucccacggcaacggccucgagcccggcgagauccccgccguccccuccggcgagcgcaacuccuucaagguccccuccaucgccgagggcgagaacaagaccuccaaguccuggcgccacccccucucccgcccccccgcccgcucccccaugacccucgucaagcagcaggcccccuccgacgaggagcuccccgagguccucuccaucgaggaggaggucgaggagaccgaguccugggccaagccccucauccaccucuggcagaccaagucccccaacuucgccgccgagcaggaguacaacgccaccgucgcccgcaugaagccccacugcgccaucugcacccuccucaugcccuaccacaagcccgacuccuccaacgaggagaacgacgcccgcugggagaccaagcucgacgaggucgucaccuccgagggcaagaccaagccccucauccccgagaugugcuucaucuacuccgaggagaacaucgaguacuccccccccaacgccuuccucgaggaggacggcaccucccuccucaucuccugcgccaagugcugcguccgcguccacgccuccugcuacggcauccccucccacgagaucugcgacggcuggcucugcgcccgcugcaagcgcaacgccuggaccgccgagugcugccucugcaaccuccgcggcggcgcccucaagcagaccaagaacaacaagugggcccacgucaugugcgccgucgccguccccgagguccgcuucaccaacguccccgagcgcacccagaucgacgucggccgcaucccccuccagcgccucaagcucggccgccucggcaucuga

SEQ ID NO: 44982 - RNA, 5073 nt, Artificial Sequence
  derived and/or modified sequence opt2 from KDM5A__Homo_sapiens__NP_001036068
auggccggcgucggccccggcggcuacgccgccgaguucguccccccccccgagugccccgucuucgagcccuccugggaggaguucaccgacccccucuccuucaucggccgcauccgcccccucgccgagaagaccggcaucugcaagauccgcccccccaaggacuggcagccccccuucgccugcgaggucaaguccuuccgcuucaccccccgcguccagcgccucaacgagcucgaggccaugacccgcguccgccucgacuuccucgaccagcucgccaaguucugggagcuccagggcuccacccucaagauccccgucgucgagcgcaagauccucgaccucuacgcccucuccaagaucgucgccuccaagggcggcuucgagauggucaccaaggagaagaagugguccaaggucggcucccgccucggcuaccuccccggcaagggcaccggcucccuccucaagucccacuacgagcgcauccucuaccccuacgagcucuuccaguccggcgucucccucaugggcguccagaugcccaaccucgaccucaaggagaaggucgagcccgagguccucuccaccgacacccagaccucccccgagcccggcacccgcaugaacauccuccccaagcgcacccgccgcgucaagacccaguccgaguccggcgacgucucccgcaacaccgagcucaagaagcuccagaucuucggcgccggccccaaggucgucggccucgccaugggcaccaaggacaaggaggacgaggucacccgccgccgcaaggucaccaaccgcuccgacgccuucaacaugcagaugcgccagcgcaagggcacccucuccgucaacuucgucgaccucuacgucugcauguucugcggccgcggcaacaacgaggacaagcuccuccucugcgacggcugcgacgacuccuaccacaccuucugccucauccccccccuccccgacguccccaagggcgacuggcgcugccccaagugcgucgccgaggagugcuccaagccccgcgaggccuucggcuucgagcaggccguccgcgaguacacccuccaguccuucggcgagauggccgacaacuucaaguccgacuacuucaacaugcccguccacaugguccccaccgagcucgucgagaaggaguucuggcgccucgucuccuccaucgaggaggacgucaucgucgaguacggcgccgacaucuccuccaaggacuucggcuccggcuuccccgucaaggacggccgccgcaagauccuccccgaggaggaggaguacgcccucuccggcuggaaccucaacaacaugcccguccucgagcaguccguccucgcccacaucaacgucgacaucuccggcaugaagguccccuggcucuacgucggcaugugcuucuccuccuucugcuggcacaucgaggaccacugguccuacuccaucaacuaccuccacuggggcgagcccaagaccugguacggcguccccucccacgccgccgagcagcucgaggaggucaugcgcgagcucgcccccgagcucuucgagucccagcccgaccuccuccaccagcucgucaccaucaugaaccccaacguccucauggagcacggcguccccgucuaccgcaccaaccagugcgccggcgaguucgucgucaccuucccccgcgccuaccacuccggcuucaaccagggcuacaacuucgccgaggccgucaacuucugcaccgccgacuggcuccccaucggccgccagugcgucaaccacuaccgccgccuccgccgccacugcgucuucucccacgaggagcucaucuucaagauggccgccgaccccgagugccucgacgucggccucgccgccauggucugcaaggagcucacccucaugaccgaggaggagacccgccuccgcgaguccgucguccagaugggcguccucauguccgaggaggaggucuucgagcucguccccgacgacgagcgccagugcuccgccugccgcaccaccugcuuccucuccgcccucaccugcuccugcaaccccgagcgccucgucugccucuaccaccccaccgaccucugccccugccccaugcagaagaagugccuccgcuaccgcuacccccucgaggaccuccccucccuccucuacggcgucaagguccgcgcccaguccuacgacaccugggucucccgcgucaccgaggcccucuccgccaacuucaaccacaagaaggaccucaucgagcuccgcgucaugcucgaggacgccgaggaccgcaaguaccccgagaacgaccucuuccgcaagcuccgcgacgccgucaaggaggccgagaccugcgccuccgucgcccagcuccuccucuccaagaagcagaagcaccgccagucccccgacuccggccgcacccgcaccaagcucaccgucgaggagcucaaggccuucguccagcagcucuucucccuccccugcgucaucucccaggcccgccaggucaagaaccuccucgacgacgucgaggaguuccacgagcgcgcccaggaggccaugauggacgagacccccgacuccuccaagcuccagaugcucaucgacaugggcuccucccucuacgucgagcuccccgagcucccccgccucaagcaggagcuccagcaggcccgcuggcucgacgagguccgccucacccucuccgacccccagcaggucacccucgacgucaugaagaagcucaucgacuccggcgucggccucgccccccaccacgccgucgagaaggccauggccgagcuccaggagcuccucaccgucuccgagcgcugggaggagaaggccaaggucugccuccaggcccgcccccgccacuccgucgccucccucgaguccaucgucaacgaggccaagaacauccccgccuuccuccccaacguccucucccucaaggaggcccuccagaaggcccgcgaguggaccgccaaggucgaggccauccaguccggcuccaacuacgccuaccucgagcagcucgagucccucuccgccaagggccgccccauccccguccgccucgaggcccucccccaggucgagucccaggucgccgccgcccgcgccuggcgcgagcgcaccggccgcaccuuccucaagaagaacuccucccacacccuccuccagguccucuccccccgcaccgacaucggcgucuacggcuccggcaagaaccgccgcaagaaggucaaggagcucaucgagaaggagaaggagaaggaccucgaccucgagccccucuccgaccucgaggagggccucgaggagacccgcgacaccgccauggucgucgccgucuucaaggagcgcgagcagaaggagaucgaggccaugcacucccuccgcgccgccaaccucgccaagaugaccauggucgaccgcaucgaggaggucaaguucugcaucugccgcaagaccgccuccggcuucaugcuccagugcgagcucugcaaggacugguuccacaacuccugcgucccccuccccaaguccuccucccagaagaagggcuccuccuggcaggccaaggaggucaaguuccucugcccccucugcaugcgcucccgccgcccccgccucgagaccauccucucccuccucgucucccuccagaagcuccccguccgccuccccgagggcgaggcccuccagugccucaccgagcgcgccauguccuggcaggaccgcgcccgccaggcccucgccaccgacgagcucuccuccgcccucgccaagcucuccguccucucccagcgcauggucgagcaggccgcccgcgagaagaccgagaagaucaucuccgccgagcuccagaaggccgccgccaaccccgaccuccagggccaccuccccuccuuccagcaguccgccuucaaccgcgucgucuccuccgucuccuccuccccccgccagaccauggacuacgacgacgaggagaccgacuccgacgaggacauccgcgagaccuacggcuacgacaugaaggacaccgccuccgucaaguccuccuccucccucgagcccaaccucuucugcgacgaggagauccccaucaaguccgaggaggucgucacccacauguggaccgcccccuccuucugcgccgagcacgccuacuccuccgccuccaaguccugcucccagggcuccuccaccccccgcaagcagccccgcaaguccccccucgucccccgcucccucgagccccccguccucgagcucucccccggcgccaaggcccagcucgaggagcucaugauggucggcgaccuccucgaggucucccucgacgagacccagcacaucuggcgcauccuccaggccacccacccccccuccgaggaccgcuuccuccacaucauggaggacgacuccauggaggagaagccccucaaggucaagggcaaggacuccuccgagaagaagcgcaagcgcaagcucgagaaggucgagcagcucuucggcgagggcaagcagaaguccaaggagcucaagaagauggacaagccccgcaagaagaagcucaagcucggcgccgacaaguccaaggagcucaacaagcucgccaagaagcucgccaaggaggaggagcgcaagaagaagaaggagaaggccgccgccgccaaggucgagcucgucaaggaguccaccgagaagaagcgcgagaagaagguccucgacauccccuccaaguacgacugguccggcgccgaggaguccgacgacgagaacgccgucugcgccgcccagaacugccagcgccccugcaaggacaaggucgacuggguccagugcgacggcggcugcgacgagugguuccaccaggucugcgucggcgucucccccgagauggccgagaacgaggacuacaucugcaucaacugcgccaagaagcagggccccgucucccccggccccgcccccccccccuccuucaucauguccuacaagcuccccauggaggaccucaaggagaccuccuga

SEQ ID NO: 44983 - RNA, 4635 nt, Artificial Sequence
  derived and/or modified sequence opt2 from KDM5B__Homo_sapiens__NP_006609
auggaggccgccaccacccuccaccccggcccccgccccgcccucccccucggcggccccggcccccucggcgaguuccuccccccccccgagugccccgucuucgagcccuccugggaggaguucgccgaccccuucgccuucauccacaagauccgccccaucgccgagcagaccggcaucugcaagguccgccccccccccgacuggcagccccccuucgccugcgacgucgacaagcuccacuucaccccccgcauccagcgccucaacgagcucgaggcccagacccgcgucaagcucaacuuccucgaccagaucgccaaguacugggagcuccagggcuccacccucaagaucccccacgucgagcgcaagauccucgaccucuuccagcucaacaagcucgucgccgaggagggcggcuucgccgucgucugcaaggaccgcaaguggaccaagaucgccaccaagaugggcuucgcccccggcaaggccgucggcucccacauccgcggccacuacgagcgcauccucaaccccuacaaccucuuccucuccggcgacucccuccgcugccuccagaagcccaaccucaccaccgacaccaaggacaaggaguacaagccccacgacaucccccagcgccaguccguccagcccuccgagaccugcccccccgcccgccgcgccaagcgcaugcgcgccgaggccaugaacaucaagaucgagcccgaggagaccaccgaggcccgcacccacaaccuccgccgccgcaugggcugccccacccccaagugcgagaacgagaaggagaugaaguccuccaucaagcaggagcccaucgagcgcaaggacuacaucgucgagaacgagaaggagaagcccaagucccgcuccaagaaggccaccaacgccgucgaccucuacgucugccuccucugcggcuccggcaacgacgaggaccgccuccuccucugcgacggcugcgacgacuccuaccacaccuucugccucauccccccccuccacgacguccccaagggcgacuggcgcugccccaagugccucgcccaggagugcuccaagccccaggaggccuucggcuucgagcaggccgcccgcgacuacacccuccgcaccuucggcgagauggccgacgccuucaaguccgacuacuucaacaugcccguccacaugguccccaccgagcucgucgagaaggaguucuggcgccucgucuccaccaucgaggaggacgucaccgucgaguacggcgccgacaucgccuccaaggaguucggcuccggcuuccccguccgcgacggcaagaucaagcucucccccgaggaggaggaguaccucgacuccggcuggaaccucaacaacaugcccgucauggagcaguccguccucgcccacaucaccgccgacaucugcggcaugaagcuccccuggcucuacgucggcaugugcuucuccuccuucugcuggcacaucgaggaccacugguccuacuccaucaacuaccuccacuggggcgagcccaagaccugguacggcguccccggcuacgccgccgagcagcucgagaacgucaugaagaagcucgcccccgagcucuucgucucccagcccgaccuccuccaccagcucgucaccaucaugaaccccaacacccucaugacccacgagguccccgucuaccgcaccaaccagugcgccggcgaguucgucaucaccuucccccgcgccuaccacuccggcuucaaccagggcuucaacuucgccgaggccgucaacuucugcaccgucgacuggcucccccucggccgccagugcgucgagcacuaccgccuccuccaccgcuacugcgucuucucccacgacgagaugaucugcaagauggccuccaaggccgacguccucgacgucgucgucgccuccaccguccagaaggacauggccaucaugaucgaggacgagaaggcccuccgcgagaccguccgcaagcucggcgucaucgacuccgagcgcauggacuucgagcuccuccccgacgacgagcgccagugcgucaagugcaagaccaccugcuucauguccgccaucuccugcuccugcaagcccggccuccucgucugccuccaccacgucaaggagcucugcuccugcccccccuacaaguacaagcuccgcuaccgcuacacccucgacgaccucuaccccaugaugaacgcccucaagcuccgcgccgaguccuacaacgagugggcccucaacgucaacgaggcccucgaggccaagaucaacaagaagaagucccucgucuccuucaaggcccucaucgaggaguccgagaugaagaaguuccccgacaacgaccuccuccgccaccuccgccucgucacccaggacgccgagaagugcgccuccgucgcccagcagcuccucaacggcaagcgccagacccgcuaccgcuccggcggcggcaagucccagaaccagcucaccgucaacgagcuccgccaguucgucacccagcucuacgcccuccccugcguccucucccagaccccccuccucaaggaccuccucaaccgcgucgaggacuuccagcagcacucccagaagcuccucuccgaggagacccccuccgccgccgagcuccaggaccuccucgacgucuccuucgaguucgacgucgagcucccccagcucgccgagaugcgcauccgccucgagcaggcccgcuggcucgaggagguccagcaggccugccucgaccccuccucccucacccucgacgacaugcgccgccucaucgaccucggcgucggccucgcccccuacuccgccgucgagaaggccauggcccgccuccaggagcuccucaccgucuccgagcacugggacgacaaggccaagucccuccucaaggcccgcccccgccacucccucaacucccucgccaccgccgucaaggagaucgaggagauccccgccuaccuccccaacggcgccgcccucaaggacuccguccagcgcgcccgcgacuggcuccaggacgucgagggccuccaggccggcggccgcguccccguccucgacacccucaucgagcucgucacccgcggccgcuccauccccguccaccucaacucccucccccgccucgagacccucgucgccgagguccaggccuggaaggagugcgccgucaacaccuuccucaccgagaacucccccuacucccuccucgagguccucugcccccgcugcgacaucggccuccucggccucaagcgcaagcagcgcaagcucaaggagccccuccccaacggcaagaagaaguccaccaagcucgagucccucuccgaccucgagcgcgcccucaccgaguccaaggagaccgccuccgccauggccacccucggcgaggcccgccuccgcgagauggaggcccuccagucccuccgccucgccaacgagggcaagcuccucuccccccuccaggacgucgacaucaagaucugccucugccagaaggcccccgccgcccccaugauccagugcgagcucugccgcgacgccuuccacaccuccugcgucgccguccccuccaucucccagggccuccgcaucuggcucugcccccacugccgccgcuccgagaagcccccccucgagaagauccucccccuccucgccucccuccagcgcauccgcguccgccuccccgagggcgacgcccuccgcuacaugaucgagcgcaccgucaacuggcagcaccgcgcccagcagcuccucuccuccggcaaccucaaguucguccaggaccgcgucggcuccggccuccucuacucccgcuggcaggccuccgccggccaggucuccgacaccaacaaggucucccagccccccggcaccaccuccuucucccuccccgacgacugggacaaccgcaccuccuaccuccacucccccuucuccaccggccgcuccugcaucccccuccacggcgucucccccgaggucaacgagcuccucauggaggcccagcuccuccaggucucccuccccgagauccaggagcucuaccagacccuccucgccaagcccucccccgcccagcagaccgaccgcuccucccccguccgccccuccuccgagaagaacgacugcugccgcggcaagcgcgacggcaucaacucccucgagcgcaagcucaagcgccgccucgagcgcgagggccucuccuccgagcgcugggagcgcgucaagaagaugcgcacccccaagaagaagaagaucaagcucucccaccccaaggacaugaacaacuucaagcucgagcgcgagcgcuccuacgagcucguccgcuccgccgagacccacucccuccccuccgacaccuccuacuccgagcaggaggacuccgaggacgaggacgccaucugccccgccgucuccugccuccagcccgagggcgacgaggucgacuggguccagugcgacggcuccugcaaccagugguuccaccaggucugcgucggcgucucccccgagauggccgagaaggaggacuacaucugcguccgcugcaccgucaaggacgcccccucccgcaaguga

SEQ ID NO: 44984 - RNA, 4140 nt, Artificial Sequence
  derived and/or modified sequence opt2 from KDM5C__Homo_sapiens__NP_001140174
auggagcccggcuccgacgacuuccuccccccccccgagugccccgucuucgagcccuccugggccgaguuccgcgacccccucggcuacaucgccaagauccgccccaucgccgagaaguccggcaucugcaagauccgcccccccgccaucgucgucgaggagggcggcuacgaggccaucugcaaggaccgccgcugggcccgcgucgcccagcgccucaacuacccccccggcaagaacaucggcucccuccuccgcucccacuacgagcgcaucgucuaccccuacgagauguaccaguccggcgccaaccucguccagugcaacacccgccccuucgacaacgaggagaaggacaaggaguacaagccccacuccaucccccuccgccaguccguccagcccuccaaguucaacuccuacggccgccgcgccaagcgccuccagcccgaccccgagcccaccgaggaggacaucgagaagaaccccgagcucaagaagcuccagaucuacggcgccggccccaagaugaugggccucggccucauggccaaggacaagacccuccgcaagaaggacaaggagggccccgagugcccccccaccgucgucgucaaggaggagcucggcggcgacgucaaggucgaguccaccucccccaagaccuuccucgaguccaaggaggagcucucccacucccccgagcccugcaccaagaugaccaugcgccuccgccgcaaccacuccaacgcccaguucaucgaguccuacgucugccgcaugugcucccgcggcgacgaggacgacaagcuccuccucugcgacggcugcgacgacaacuaccacaucuucugccuccuccccccccuccccgagauccccaagggcgucuggcgcugccccaagugcgucauggccgagugcaagcgcccccccgaggccuucggcuucgagcaggccacccgcgaguacacccuccaguccuucggcgagauggccgacuccuucaaggccgacuacuucaacaugcccguccacaugguccccaccgagcucgucgagaaggaguucuggcgccucgucaacuccaucgaggaggacgucaccgucgaguacggcgccgacauccacuccaaggaguucggcuccggcuuccccgucuccgacuccaagcgccaccucacccccgaggaggaggaguacgccaccuccggcuggaaccucaacgucaugcccguccucgagcaguccguccucugccacaucaacgccgacaucuccggcaugaagguccccuggcucuacgucggcauggucuucuccgccuucugcuggcacaucgaggaccacugguccuacuccaucaacuaccuccacuggggcgagcccaagaccugguacggcguccccucccucgccgccgagcaccucgaggaggucaugaagaagcucacccccgagcucuucgacucccagcccgaccuccuccaccagcucgucacccucaugaaccccaacacccucaugucccacggcguccccgucguccgcaccaaccagugcgccggcgaguucgucaucaccuucccccgcgccuaccacuccggcuucaaccagggcuacaacuucgccgaggccgucaacuucugcaccgccgacuggcuccccgccggccgccagugcaucgagcacuaccgccgccuccgccgcuacugcgucuucucccacgaggagcucaucugcaagauggccgccugccccgagaagcucgaccucaaccucgccgccgccguccacaaggagauguucaucaugguccaggaggagcgccgccuccgcaaggcccuccucgagaagggcaucaccgaggccgagcgcgaggccuucgagcuccuccccgacgacgagcgccagugcaucaagugcaagaccaccugcuuccucuccgcccucgccugcuacgacugccccgacggccucgucugccucucccacaucaacgaccucugcaagugcuccuccucccgccaguaccuccgcuaccgcuacacccucgacgagcuccccgccaugcuccacaagcucaagguccgcgccgaguccuucgacaccugggccaacaagguccgcgucgcccucgaggucgaggacggccgcaagcgcucccucgaggagcuccgcgcccucgaguccgaggcccgcgagcgccgcuuccccaacuccgagcuccuccagcagcucaagaacugccucuccgaggccgaggccugcgucucccgcgcccucggccucgucuccggccaggaggccggcccccaccgcgucgccggccuccagaugacccucaccgagcuccgcgccuuccucgaccagaugaacaaccuccccugcgccaugcaccagaucggcgacgucaagggcguccucgagcaggucgaggccuaccaggccgaggcccgcgaggcccucgccucccuccccuccucccccggccuccuccagucccuccucgagcgcggccgccagcucggcgucgagguccccgaggcccagcagcuccagcgccaggucgagcaggcccgcuggcucgacgaggucaagcgcacccucgcccccuccgcccgccgcggcacccucgccgucaugcgcggccuccucgucgccggcgccuccgucgcccccucccccgccgucgacaaggcccaggccgagcuccaggagcuccucaccaucgccgagcgcugggaggagaaggcccaccucugccucgaggcccgccagaagcacccccccgccacccucgaggccaucauccgcgaggccgagaacauccccguccaccuccccaacauccaggcccucaaggaggcccucgccaaggcccgcgccuggaucgccgacgucgacgagauccagaacggcgaccacuaccccugccucgacgaccucgagggccucgucgccgucggccgcgaccuccccgucggccucgaggagcuccgccagcucgagcuccagguccucaccgcccacuccuggcgcgagaaggccuccaagaccuuccucaagaagaacuccugcuacacccuccucgagguccucugccccugcgccgacgccggcuccgacuccaccaagcgcucccgcuggauggagaaggagcucggccucuacaaguccgacaccgagcuccucggccucuccgcccaggaccuccgcgaccccggcuccgucaucgucgccuucaaggagggcgagcagaaggagaaggagggcauccuccagcuccgccgcaccaacuccgccaagcccuccccccucgccuccuccuccaccgccuccuccaccaccuccaucugcgucugcggccagguccucgccggcgccggcgcccuccagugcgaccucugccaggacugguuccacggccgcugcgucuccgucccccgccuccucuccuccccccgccccaaccccaccuccuccccccuccucgccuggugggagugggacaccaaguuccucugcccccucugcaugcgcucccgccgcccccgccucgagaccauccucgcccuccucgucgcccuccagcgccuccccguccgccuccccgagggcgaggcccuccagugccucaccgagcgcgccaucuccuggcagggccgcgcccgccaggcccucgccuccgaggacgucaccgcccuccucggccgccucgccgagcuccgccagcgccuccaggccgagccccgccccgaggagccccccaacuaccccgccgcccccgccuccgacccccuccgcgagggcuccggcaaggacaugcccaagguccagggccuccucgagaacggcgacuccgucaccucccccgagaaggucgcccccgaggagggcuccgaccucgagcuccucuccucccuccucccccagcucaccggccccguccucgagcuccccgaggccacccgcgccccccucgaggagcucaugauggagggcgaccuccucgaggucacccucgacgagaaccacuccauccccgagucccucgacuucugcauccucaccccccgcuacugcuccgaccucuccuccuggggccccgcccccggcgucuucccccccugguga

SEQ ID NO: 44985 - RNA, 4713 nt, Artificial Sequence
  derived and/or modified sequence opt2 from KDM5D__Homo_sapiens__NP_001140177
auggagcccggcugcgacgaguuccuccccccccccgagugccccgucuucgagcccuccugggccgaguuccaggacccccucggcuacaucgccaagauccgccccaucgccgagaaguccggcaucugcaagauccgcccccccgccgacuggcagccccccuucgccgucgaggucgacaacuuccgcuucaccccccgcguccagcgccucaacgagcucgaggcccagacccgcgucaagcucaacuaccucgaccagaucgccaaguucugggagauccagggcuccucccucaagauccccaacgucgagcgcaagauccucgaccucuacucccucuccaagaucgucaucgaggagggcggcuacgaggccaucugcaaggaccgccgcugggcccgcgucgcccagcgccuccacuacccccccggcaagaacaucggcucccuccuccgcucccacuacgagcgcaucaucuaccccuacgagauguuccaguccggcgccaaccacguccagugcaacacccaccccuucgacaacgaggucaaggacaaggaguacaagccccacuccaucccccuccgccaguccguccagcccuccaaguucuccuccuacucccgccgcgccaagcgccuccagcccgaccccgagcccaccgaggaggacaucgagaagcaccccgagcucaagaagcuccagaucuacggccccggccccaagaugaugggccucggccucauggccaaggacaaggacaagaccguccacaagaaggucaccugcccccccaccgucaccgucaaggacgagcaguccggcggcggcaacgucuccuccacccuccucaagcagcaccucucccucgagcccugcaccaagaccaccaugcagcuccgcaagaaccacuccuccgcccaguucaucgacuccuacaucugccaggucugcucccgcggcgacgaggacgacaagcuccucuucugcgacggcugcgacgacaacuaccacaucuucugccuccuccccccccuccccgagaucccccgcggcaucuggcgcugccccaagugcauccucgccgagugcaagcagccccccgaggccuucggcuucgagcaggccacccaggaguacucccuccaguccuucggcgagauggccgacuccuucaaguccgacuacuucaacaugcccguccacaugguccccaccgagcucgucgagaaggaguucuggcgccucgucuccuccaucgaggaggacgucaccgucgaguacggcgccgacauccacuccaaggaguucggcuccggcuuccccgucuccaacuccaagcagaaccucucccccgaggagaagcgccagucccucaccguccucacccgccucaucuccuccuucugggcccaggccguccucccccccuggccccccaagguccucggccuccaggaguacgccaccuccggcuggaaccucaacgucaugcccguccucgaccaguccguccucugccacaucaacgccgacaucuccggcaugaagguccccuggcucuacgucggcauggucuucuccgccuucugcuggcacaucgaggaccacugguccuacuccaucaacuaccuccacuggggcgagcccaagaccugguacggcguccccucccucgccgccgagcaccucgaggaggucaugaagaugcucacccccgagcucuucgacucccagcccgaccuccuccaccagcucgucacccucaugaaccccaacacccucaugucccacggcguccccgucguccgcaccaaccagugcgccggcgaguucgucaucaccuucccccgcgccuaccacuccggcuucaaccagggcuacaacuucgccgaggccgucaacuucugcaccgccgacuggcuccccgccggccgccagugcaucgagcacuaccgccgccuccgccgcuacugcgucuucucccacgaggagcucaucugcaagauggccgccuuccccgagacccucgaccucaaccucgccgucgccguccacaaggagauguucaucaugguccaggaggagcgccgccuccgcaaggcccuccucgagaagggcgucaccgaggccgagcgcgaggccuucgagcuccuccccgacgacgagcgccagugcaucaagugcaagaccaccugcuuccucuccgcccucgccugcuacgacugccccgacggccucgucugccucucccacaucaacgaccucugcaagugcuccuccucccgccaguaccuccgcuaccgcuacacccucgacgagcuccccaccaugcuccacaagcucaagauccgcgccgaguccuucgacaccugggccaacaagguccgcgucgcccucgaggucgaggacggccgcaagcgcuccuucgaggagcuccgcgcccucgaguccgaggcccgcgagcgccgcuuccccaacuccgagcuccuccagcgccucaagaacugccucuccgaggucgaggccugcaucgcccagguccucggccucgucuccggccaggucgcccgcauggacaccccccagcucacccucaccgagcuccgcguccuccucgagcagaugggcucccuccccugcgccaugcaccagaucggcgacgucaaggacguccucgagcaggucgaggccuaccaggccgaggcccgcgaggcccucgccacccuccccuccucccccggccuccuccgcucccuccucgagcgcggccagcagcucggcgucgagguccccgaggcccaccagcuccagcagcaggucgagcaggcccaguggcucgacgaggucaagcaggcccucgcccccuccgcccaccgcggcucccucgucaucaugcagggccuccucgucaugggcgccaagaucgccuccucccccuccgucgacaaggcccgcgccgagcuccaggagcuccucaccaucgccgagcgcugggaggagaaggcccacuucugccucgaggcccgccagaagcacccccccgccacccucgaggccaucauccgcgagaccgagaacauccccguccaccuccccaacauccaggcccucaaggaggcccucaccaaggcccaggccuggaucgccgacgucgacgagauccagaacggcgaccacuaccccugccucgacgaccucgagggccucgucgccgucggccgcgaccuccccgucggccucgaggagcuccgccagcucgagcuccagguccucaccgcccacuccuggcgcgagaaggccuccaagaccuuccucaagaagaacuccugcuacacccuccucgagguccucugccccugcgccgacgccggcuccgacuccaccaagcgcucccgcuggauggagaaggcccucggccucuaccagugcgacaccgagcuccucggccucuccgcccaggaccuccgcgaccccggcuccgucaucgucgccuucaaggagggcgagcagaaggagaaggagggcauccuccagcuccgccgcaccaacuccgccaagcccuccccccucgcccccucccucauggccuccucccccaccuccaucugcgucugcggccagguccccgccggcgucggcguccuccagugcgaccucugccaggacugguuccacggccagugcgucuccgucccccaccuccucaccucccccaagcccucccucaccuccuccccccuccucgccuggugggagugggacaccaaguuccucugcccccucugcaugcgcucccgccgcccccgccucgagaccauccucgcccuccucgucgcccuccagcgccuccccguccgccuccccgagggcgaggcccuccagugccucaccgagcgcgccaucggcuggcaggaccgcgcccgcaaggcccucgccuccgaggacgucaccgcccuccuccgccagcucgccgagcuccgccagcagcuccaggccaagccccgccccgaggaggccuccgucuacaccuccgccaccgccugcgaccccauccgcgagggcuccggcaacaacaucuccaagguccagggccuccucgagaacggcgacuccgucaccucccccgagaacauggcccccggcaagggcuccgaccucgagcuccucuccucccuccucccccagcucaccggccccguccucgagcuccccgaggccauccgcgccccccucgaggagcucaugauggagggcgaccuccucgaggucacccucgacgagaaccacuccaucuggcagcuccuccaggccggccagccccccgaccucgaccgcauccgcacccuccucgagcucgagaaguucgagcaccagggcucccgcacccgcucccgcgcccucgagcgccgccgccgccgccagaaggucgaccagggccgcaacgucgagaaccucguccagcaggagcuccaguccaagcgcgcccgcuccuccggcaucaugucccaggucggccgcgaggaggagcacuaccaggagaaggccgaccgcgagaacauguuccucacccccuccaccgaccacucccccuuccucaagggcaaccagaacucccuccagcacaaggacuccggcuccuccgccgccugccccucccucaugccccuccuccagcucuccuacuccgacgagcagcagcucuga

SEQ ID NO: 44986 - RNA, 4362 nt, Artificial Sequence
  derived and/or modified sequence opt2 from KDM6A__Homo_sapiens__NP_001278344
augaaguccugcggcgucucccucgccaccgccgccgccgccgccgccgccuucggcgacgaggagaagaagauggccgccggcaaggccuccggcgaguccgaggaggccucccccucccucaccgccgaggagcgcgaggcccucggcggccucgacucccgccucuucggcuucguccgcuuccacgaggacggcgcccgcaccaaggcccuccucggcaaggccguccgcugcuacgagucccucauccucaaggccgagggcaaggucgaguccgacuucuucugccagcucggccacuucaaccuccuccucgaggacuaccccaaggcccucuccgccuaccagcgcuacuacucccuccaguccgacuacuggaagaacgccgccuuccucuacggccucggccucgucuacuuccacuacaacgccuuccagugggccaucaaggccuuccaggagguccucuacgucgaccccuccuucugccgcgccaaggagauccaccuccgccucggccucauguucaaggucaacaccgacuacgaguccucccucaagcacuuccagcucgcccucgucgacugcaaccccugcacccucuccaacgccgagauccaguuccacaucgcccaccucuacgagacccagcgcaaguaccacuccgccaaggaggccuacgagcagcuccuccagaccgagaaccucuccgcccaggucaaggccaccguccuccagcagcucggcuggaugcaccacaccgucgaccuccucggcgacaaggccaccaaggaguccuacgccauccaguaccuccagaagucccucgaggccgaccccaacuccggccaguccugguacuuccucggccgcugcuacuccuccaucggcaagguccaggacgccuucaucuccuaccgccaguccaucgacaaguccgaggccuccgccgacaccuggugcuccaucggcguccucuaccagcagcagaaccagcccauggacgcccuccaggccuacaucugcgccguccagcucgaccacggccacgccgccgccuggauggaccucggcacccucuacgaguccugcaaccagccccaggacgccaucaagugcuaccucaacgccacccgcuccaaguccugcuccaacaccuccgcccucgccgcccgcaucaaguaccuccaggcccagcucugcaaccucccccagggcucccuccagaacaagaccaagcuccuccccuccaucgaggaggccuggucccuccccauccccgccgagcucaccucccgccagggcgccaugaacaccgcccagcaggccugcaagccccaccaccccaacaccgagcccguccucggccucucccagacccccaucucccagcagucccucccccuccacaugauccccuccucccaggucgacgaccucuccucccccgccaagcgcaagcgcaccuccucccccaccaagaacaccuccgacaacugguccggcggccacgccgucucccacccccccguccagcagcaggcccacuccuggugccucaccccccagaagcuccagcaccucgagcagcuccgcgccaaccgcaacaaccucaaccccgcccagaagcucaugcucgagcagcucgagucccaguucguccucaugcagcagcaccagaugcgccccaccggcgucgcccagguccgcuccaccggcauccccaacggccccaccgccgacuccucccuccccaccaacuccgucuccggccagcagccccagcucgcccucacccgcguccccuccgucucccagcccggcguccgccccgccugccccggccagccccucgccaacggccccuucuccgccggccacguccccugcuccaccucccgcacccucggcuccaccgacaccauccucaucggcaacaaccacaucaccggcuccggcuccaacggcaacguccccuaccuccagcgcaacgcccucacccucccccacaaccgcaccaaccucaccuccuccgccgaggagcccuggaagaaccagcucuccaacuccacccagggccuccacaagggccaguccucccacuccgccggccccaacggcgagcgcccccucuccuccaccggccccucccagcaccuccaggccgccggcuccggcauccagaaccagaacggccaccccacccuccccuccaacuccgucacccagggcgccgcccucaaccaccucuccucccacaccgccaccuccggcggccagcagggcaucacccucaccaaggaguccaagcccuccggcaacauccucaccguccccgagaccucccgccacaccggcgagacccccaacuccaccgccuccgucgagggccuccccaaccacguccaccagaugaccgccgacgccgucugcucccccucccacggcgacuccaagucccccggccuccucuccuccgacaacccccagcucuccgcccuccucaugggcaaggccaacaacaacgucggcaccggcaccugcgacaaggucaacaacauccaccccgccguccacaccaagaccgacaacuccgucgccuccucccccuccuccgccaucuccaccgccacccccucccccaaguccaccgagcagaccaccaccaacuccgucaccucccucaacuccccccacuccggccuccacaccaucaacggcgagggcauggaggagucccagucccccaugaagaccgaccuccuccucgucaaccacaagcccuccccccagaucauccccuccauguccgucuccaucuaccccuccuccgccgagguccucaaggccugccgcaaccucggcaagaacggccucuccaacuccuccauccuccucgacaagugcccccccccccgcccccccuccucccccuaccccccccuccccaaggacaagcucaacccccccacccccuccaucuaccucgagaacaagcgcgacgccuucuuccccccccuccaccaguucugcaccaaccccaacaaccccgucaccgucauccgcggccucgccggcgcccucaagcucgaccucggccucuucuccaccaagacccucgucgaggccaacaacgagcacauggucgagguccgcacccagcuccuccagcccgccgacgagaacugggaccccaccggcaccaagaagaucuggcacugcgaguccaaccgcucccacaccaccaucgccaaguacgcccaguaccaggccuccuccuuccaggagucccuccgcgaggagaacgagaagcgcucccaccacaaggaccacuccgacuccgaguccaccuccuccgacaacuccggccgccgccgcaagggccccuucaagaccaucaaguucggcaccaacaucgaccucuccgacgacaagaaguggaagcuccagcuccacgagcucaccaagcuccccgccuucguccgcgucgucuccgccggcaaccuccucucccacgucggccacaccauccucggcaugaacaccguccagcucuacaugaagguccccggcucccgcacccccggccaccaggagaacaacaacuucugcuccgucaacaucaacaucggccccggcgacugcgagugguucgucguccccgagggcuacuggggcguccucaacgacuucugcgagaagaacaaccucaacuuccucaugggcuccugguggcccaaccucgaggaccucuacgaggccaacguccccgucuaccgcuucauccagcgccccggcgaccucgucuggaucaacgccggcaccguccacuggguccaggccaucggcuggugcaacaacaucgccuggaacgucggcccccucaccgccugccaguacaagcucgccgucgagcgcuacgaguggaacaagcuccaguccgucaaguccaucguccccaugguccaccucuccuggaacauggcccgcaacaucaaggucuccgaccccaagcucuucgagaugaucaaguacugccuccuccgcacccucaagcagugccagacccuccgcgaggcccucaucgccgccggcaaggagaucaucuggcacggccgcaccaaggaggagcccgcccacuacugcuccaucugcgaggucgaggucuucgaccuccucuucgucaccaacgaguccaacucccgcaagaccuacaucguccacugccaggacugcgcccgcaagaccuccggcaaccucgagaacuucgucguccucgagcaguacaagauggaggaccucaugcaggucuacgaccaguucacccucgcccccccccuccccuccgccuccuccuga

SEQ ID NO: 44987 - RNA, 5049 nt, Artificial Sequence
  derived and/or modified sequence opt2 from KDM6B__Homo_sapiens__NP_001073893
augcaccgcgccgucgacccccccggcgcccgcgccgcccgcgaggccuucgcccucggcggccucuccugcgccggcgccugguccuccugccccccccacccccccccccgcuccgccuggcuccccggcggccgcugcuccgccuccaucggccagcccccccuccccgccccccucccccccucccacggcuccuccuccggccaccccuccaagcccuacuacgcccccggcgcccccaccccccgcccccuccacggcaagcucgagucccuccacggcugcguccaggcccuccuccgcgagcccgcccagcccggccucugggagcagcucggccagcucuacgaguccgagcacgacuccgaggaggccacccgcugcuaccacuccgcccuccgcuacggcggcuccuucgccgagcucggcccccgcaucggccgccuccagcaggcccagcucuggaacuuccacaccggcuccugccagcaccgcgccaagguccuccccccccucgagcaggucuggaaccuccuccaccucgagcacaagcgcaacuacggcgccaagcgcggcggcccccccgucaagcgcgccgccgagccccccgucguccagcccgucccccccgccgcccucuccggccccuccggcgaggagggccucucccccggcggcaagcgccgccgcggcugcaacuccgagcagaccggccucccccccggccucccccuccccccccccccccucccccccccccccccccccccccccccccccccccccccccuccccggccucgccaccuccccccccuuccagcucaccaagcccggccucugguccacccuccacggcgacgccuggggccccgagcgcaagggcuccgccccccccgagcgccaggagcagcgccacucccucccccaccccuaccccuaccccgcccccgccuacaccgcccacccccccggccaccgccucguccccgccgccccccccggccccggcccccgcccccccggcgccgagucccacggcugccuccccgccacccgcccccccggcuccgaccuccgcgagucccgcguccagcgcucccgcauggacuccuccgucucccccgccgccaccaccgccugcguccccuacgcccccucccgcccccccggccuccccggcaccaccaccuccuccuccuccuccuccuccuccaacaccggccuccgcggcgucgagcccaaccccggcauccccggcgccgaccacuaccagacccccgcccucgaggucucccaccacggccgccucggccccuccgcccacuccucccgcaagcccuuccucggcgcccccgccgccaccccccaccucucccucccccccggccccuccucccccccccccccccccugcccccgccuccuccgccccccccccccccccgccuggcucaagggccccgccugccgcgccgcccgcgaggacggcgagauccucgaggagcucuucuucggcaccgagggccccccccgccccgccccccccccccucccccaccgcgagggcuuccucggcccccccgccucccgcuucuccgucggcacccaggacucccacaccccccccaccccccccacccccaccaccuccuccuccaacuccaacuccggcucccacuccuccucccccgccggccccgucuccuucccccccccccccuaccucgcccgcuccaucgacccccucccccgcccccccucccccgcccagaacccccaggaccccccccucgucccccucacccucgcccucccccccgccccccccuccuccugccaccagaacaccuccggcuccuuccgccgccccgaguccccccgcccccgcgucuccuuccccaagacccccgaggucggccccggccccccccccggcccccucuccaaggccccccagcccgucccccccggcgucggcgagcuccccgcccgcggcccccgccucuucgacuucccccccaccccccucgaggaccaguucgaggagcccgccgaguucaagauccuccccgacggccucgccaacaucaugaagaugcucgacgaguccauccgcaaggaggaggagcagcagcagcacgaggccggcgucgccccccagcccccccucaaggagcccuucgccucccuccagucccccuuccccaccgacaccgcccccaccaccaccgcccccgccgucgccgucaccaccaccaccaccaccaccaccaccaccaccgccacccaggaggaggagaagaagcccccccccgcccucccccccccccccccccucgccaaguuccccccccccucccagccccagcccccccccccccccccccccucccccgccucccuccucaagucccucgccuccguccucgagggccagaaguacugcuaccgcggcaccggcgccgccgucuccacccgccccggcccccuccccaccacccaguacucccccggcccccccuccggcgccaccgcccucccccccaccuccgccgcccccuccgcccagggcuccccccagcccuccgccuccuccuccucccaguucuccaccuccggcggccccugggcccgcgagcgccgcgccggcgaggagcccguccccggccccaugacccccacccagcccccccccccccucucccucccccccgcccgcuccgaguccgagguccucgaggagaucucccgcgccugcgagacccucgucgagcgcgucggccgcuccgccaccgaccccgccgaccccgucgacaccgccgagcccgccgacuccggcaccgagcgccuccucccccccgcccaggccaaggaggaggccggcggcgucgccgccgucuccggcuccugcaagcgccgccagaaggagcaccagaaggagcaccgccgccaccgccgcgccugcaaggacuccgucggccgccgcccccgcgagggccgcgccaaggccaaggccaagguccccaaggagaagucccgccgcguccucggcaaccucgaccuccaguccgaggagauccagggccgcgagaagucccgccccgaccucggcggcgccuccaaggccaagccccccaccgcccccgccccccccuccgcccccgcccccuccgcccagcccaccccccccuccgccuccguccccggcaagaaggcccgcgaggaggcccccggcccccccggcgucucccgcgccgacaugcucaagcuccgcucccucuccgagggcccccccaaggagcucaagauccgccucaucaaggucgaguccggcgacaaggagaccuucaucgccuccgaggucgaggagcgccgccuccgcauggccgaccucaccaucucccacugcgccgccgacgucguccgcgccucccgcaacgccaaggucaagggcaaguuccgcgaguccuaccucucccccgcccaguccgucaagcccaagaucaacaccgaggagaagcucccccgcgagaagcucaacccccccacccccuccaucuaccucgaguccaagcgcgacgccuucucccccguccuccuccaguucugcaccgacccccgcaaccccaucaccgucauccgcggccucgccggcucccuccgccucaaccucggccucuucuccaccaagacccucgucgaggccuccggcgagcacaccgucgagguccgcacccagguccagcagcccuccgacgagaacugggaccucaccggcacccgccagaucuggcccugcgaguccucccgcucccacaccaccaucgccaaguacgcccaguaccaggccuccuccuuccaggagucccuccaggaggagaaggaguccgaggacgaggaguccgaggagcccgacuccaccaccggcaccccccccuccuccgcccccgaccccaagaaccaccacaucaucaaguucggcaccaacaucgaccucuccgacgccaagcgcuggaagccccagcuccaggagcuccucaagcuccccgccuucaugcgcgucaccuccaccggcaacaugcucucccacgucggccacaccauccucggcaugaacaccguccagcucuacaugaagguccccggcucccgcacccccggccaccaggagaacaacaacuucugcuccgucaacaucaacaucggccccggcgacugcgagugguucgccguccacgagcacuacugggagaccaucuccgccuucugcgaccgccacggcgucgacuaccucaccggcuccugguggcccauccucgacgaccucuacgccuccaacauccccgucuaccgcuucguccagcgccccggcgaccucgucuggaucaacgccggcaccguccacuggguccaggccaccggcuggugcaacaacaucgccuggaacgucggcccccucaccgccuaccaguaccagcucgcccucgagcgcuacgaguggaacgaggucaagaacgucaaguccaucguccccaugauccacgucuccuggaacgucgcccgcaccgucaagaucuccgaccccgaccucuucaagaugaucaaguucugccuccuccaguccaugaagcacugccagguccagcgcgagucccucguccgcgccggcaagaagaucgccuaccagggccgcgucaaggacgagcccgccuacuacugcaacgagugcgacgucgaggucuucaacauccucuucgucaccuccgagaacggcucccgcaacaccuaccucguccacugcgagggcugcgcccgccgccgcuccgccggccuccagggcgucgucguccucgagcaguaccgcaccgaggagcucgcccaggccuacgacgccuucacccucguccgcgcccgccgcgcccgcggccagcgccgccgcgcccucggccaggccgccggcaccggcuucggcucccccgccgcccccuuccccgagcccccccccgccuucuccccccaggcccccgccuccaccucccgcuga

SEQ ID NO: 44988 - RNA, 4071 nt, Artificial Sequence
  derived and/or modified sequence opt2 from KDR__Homo_sapiens__NP_002244
augcaguccaagguccuccucgccgucgcccucuggcucugcgucgagacccgcgccgccuccgucggccuccccuccgucucccucgaccucccccgccucuccauccagaaggacauccucaccaucaaggccaacaccacccuccagaucaccugccgcggccagcgcgaccucgacuggcucuggcccaacaaccaguccggcuccgagcagcgcgucgaggucaccgagugcuccgacggccucuucugcaagacccucaccauccccaaggucaucggcaacgacaccggcgccuacaagugcuucuaccgcgagaccgaccucgccuccgucaucuacgucuacguccaggacuaccgcucccccuucaucgccuccgucuccgaccagcacggcgucgucuacaucaccgagaacaagaacaagaccgucgucauccccugccucggcuccaucuccaaccucaacgucucccucugcgcccgcuaccccgagaagcgcuucguccccgacggcaaccgcaucuccugggacuccaagaagggcuucaccauccccuccuacaugaucuccuacgccggcauggucuucugcgaggccaagaucaacgacgaguccuaccaguccaucauguacaucgucgucgucgucggcuaccgcaucuacgacgucguccucucccccucccacggcaucgagcucuccgucggcgagaagcucguccucaacugcaccgcccgcaccgagcucaacgucggcaucgacuucaacugggaguaccccuccuccaagcaccagcacaagaagcucgucaaccgcgaccucaagacccaguccggcuccgagaugaagaaguuccucuccacccucaccaucgacggcgucacccgcuccgaccagggccucuacaccugcgccgccuccuccggccucaugaccaagaagaacuccaccuucguccgcguccacgagaagcccuucgucgccuucggcuccggcauggagucccucgucgaggccaccgucggcgagcgcguccgcauccccgccaaguaccucggcuaccccccccccgagaucaagugguacaagaacggcaucccccucgaguccaaccacaccaucaaggccggccacguccucaccaucauggaggucuccgagcgcgacaccggcaacuacaccgucauccucaccaaccccaucuccaaggagaagcagucccacgucgucucccucgucgucuacguccccccccagaucggcgagaagucccucaucucccccgucgacuccuaccaguacggcaccacccagacccucaccugcaccgucuacgccaucccccccccccaccacauccacugguacuggcagcucgaggaggagugcgccaacgagcccucccaggccgucuccgucaccaaccccuaccccugcgaggaguggcgcuccgucgaggacuuccagggcggcaacaagaucgaggucaacaagaaccaguucgcccucaucgagggcaagaacaagaccgucuccacccucgucauccaggccgccaacgucuccgcccucuacaagugcgaggccgucaacaaggucggccgcggcgagcgcgucaucuccuuccacgucacccgcggccccgagaucacccuccagcccgacaugcagcccaccgagcaggaguccgucucccucuggugcaccgccgaccgcuccaccuucgagaaccucaccugguacaagcucggcccccagccccuccccauccacgucggcgagcuccccacccccgucugcaagaaccucgacacccucuggaagcucaacgccaccauguucuccaacuccaccaacgacauccucaucauggagcucaagaacgccucccuccaggaccagggcgacuacgucugccucgcccaggaccgcaagaccaagaagcgccacugcgucguccgccagcucaccguccucgagcgcgucgcccccaccaucaccggcaaccucgagaaccagaccaccuccaucggcgaguccaucgaggucuccugcaccgccuccggcaacccccccccccagaucaugugguucaaggacaacgagacccucgucgaggacuccggcaucguccucaaggacggcaaccgcaaccucaccauccgccgcguccgcaaggaggacgagggccucuacaccugccaggccugcuccguccucggcugcgccaaggucgaggccuucuucaucaucgagggcgcccaggagaagaccaaccucgagaucaucauccucgucggcaccgccgucaucgccauguucuucuggcuccuccucgucaucauccuccgcaccgucaagcgcgccaacggcggcgagcucaagaccggcuaccucuccaucgucauggaccccgacgagcucccccucgacgagcacugcgagcgccuccccuacgacgccuccaagugggaguucccccgcgaccgccucaagcucggcaagccccucggccgcggcgccuucggccaggucaucgaggccgacgccuucggcaucgacaagaccgccaccugccgcaccgucgccgucaagaugcucaaggagggcgccacccacuccgagcaccgcgcccucauguccgagcucaagauccucauccacaucggccaccaccucaacgucgucaaccuccucggcgccugcaccaagcccggcggcccccucauggucaucgucgaguucugcaaguucggcaaccucuccaccuaccuccgcuccaagcgcaacgaguucguccccuacaagaccaagggcgcccgcuuccgccagggcaaggacuacgucggcgccauccccgucgaccucaagcgccgccucgacuccaucaccuccucccaguccuccgccuccuccggcuucgucgaggagaagucccucuccgacgucgaggaggaggaggcccccgaggaccucuacaaggacuuccucacccucgagcaccucaucugcuacuccuuccaggucgccaagggcauggaguuccucgccucccgcaagugcauccaccgcgaccucgccgcccgcaacauccuccucuccgagaagaacgucgucaagaucugcgacuucggccucgcccgcgacaucuacaaggaccccgacuacguccgcaagggcgacgcccgccucccccucaaguggauggcccccgagaccaucuucgaccgcgucuacaccauccaguccgacgucugguccuucggcguccuccucugggagaucuucucccucggcgccucccccuaccccggcgucaagaucgacgaggaguucugccgccgccucaaggagggcacccgcaugcgcgcccccgacuacaccacccccgagauguaccagaccaugcucgacugcuggcacggcgagcccucccagcgccccaccuucuccgagcucgucgagcaccucggcaaccuccuccaggccaacgcccagcaggacggcaaggacuacaucguccuccccaucuccgagacccucuccauggaggaggacuccggccucucccuccccaccucccccgucuccugcauggaggaggaggaggucugcgaccccaaguuccacuacgacaacaccgccggcaucucccaguaccuccagaacuccaagcgcaagucccgccccgucuccgucaagaccuucgaggacaucccccucgaggagcccgaggucaaggucauccccgacgacaaccagaccgacuccggcaugguccucgccuccgaggagcucaagacccucgaggaccgcaccaagcucucccccuccuucggcggcaugguccccuccaagucccgcgaguccgucgccuccgagggcuccaaccagaccuccggcuaccaguccggcuaccacuccgacgacaccgacaccaccgucuacuccuccgaggaggccgagcuccucaagcucaucgagaucggcguccagaccggcuccaccgcccagauccuccagcccgacuccggcaccacccucuccuccccccccgucuga

SEQ ID NO: 44989 - RNA, 999 nt, Artificial Sequence
  derived and/or modified sequence opt2 from KDSR__Homo_sapiens__NP_002026
augcuccuccucgccgccgccuuccucgucgccuucguccuccuccucuacauggucuccccccucaucucccccaagccccucgcccuccccggcgcccacgucgucgucaccggcggcuccuccggcaucggcaagugcaucgccaucgagugcuacaagcagggcgccuucaucacccucgucgcccgcaacgaggacaagcuccuccaggccaagaaggagaucgagaugcacuccaucaacgacaagcaggucguccucugcaucuccgucgacgucucccaggacuacaaccaggucgagaacgucaucaagcaggcccaggagaagcucggccccgucgacaugcucgucaacugcgccggcauggccgucuccggcaaguucgaggaccucgaggucuccaccuucgagcgccucauguccaucaacuaccucggcuccgucuaccccucccgcgccgucaucaccaccaugaaggagcgccgcgucggccgcaucgucuucgucuccucccaggccggccagcucggccucuucggcuucaccgccuacuccgccuccaaguucgccauccgcggccucgccgaggcccuccagauggaggucaagcccuacaacgucuacaucaccgucgccuacccccccgacaccgacacccccggcuucgccgaggagaaccgcaccaagccccucgagacccgccucaucuccgagaccaccuccgucugcaagcccgagcaggucgccaagcagaucgucaaggacgccauccagggcaacuucaacuccucccucggcuccgacggcuacaugcucuccgcccucaccugcggcauggcccccgucaccuccaucaccgagggccuccagcaggucgucaccaugggccucuuccgcaccaucgcccucuucuaccucggcuccuucgacuccaucguccgccgcugcaugaugcagcgcgagaaguccgagaacgccgacaagaccgccuga

SEQ ID NO: 44990 - RNA, 1875 nt, Artificial Sequence
  derived and/or modified sequence opt2 from KEAP1__Homo_sapiens__NP_036421
augcagcccgacccccgccccuccggcgccggcgccugcugccgcuuccucccccuccagucccagugccccgagggcgccggcgacgccgucauguacgccuccaccgagugcaaggccgaggucacccccucccagcacggcaaccgcaccuucuccuacacccucgaggaccacaccaagcaggccuucggcaucaugaacgagcuccgccucucccagcagcucugcgacgucacccuccaggucaaguaccaggacgcccccgccgcccaguucauggcccacaaggucguccucgccuccuccucccccgucuucaaggccauguucaccaacggccuccgcgagcagggcauggaggucgucuccaucgagggcauccaccccaaggucauggagcgccucaucgaguucgccuacaccgccuccaucuccaugggcgagaagugcguccuccacgucaugaacggcgccgucauguaccagaucgacuccgucguccgcgccugcuccgacuuccucguccagcagcucgaccccuccaacgccaucggcaucgccaacuucgccgagcagaucggcugcgucgagcuccaccagcgcgcccgcgaguacaucuacaugcacuucggcgaggucgccaagcaggaggaguucuucaaccucucccacugccagcucgucacccucaucucccgcgacgaccucaacguccgcugcgaguccgaggucuuccacgccugcaucaacugggucaaguacgacugcgagcagcgccgcuucuacguccaggcccuccuccgcgccguccgcugccacucccucacccccaacuuccuccagaugcagcuccagaagugcgagauccuccaguccgacucccgcugcaaggacuaccucgucaagaucuucgaggagcucacccuccacaagcccacccaggucaugcccugccgcgcccccaaggucggccgccucaucuacaccgccggcggcuacuuccgccagucccucuccuaccucgaggccuacaaccccuccgacggcaccuggcuccgccucgccgaccuccaggucccccgcuccggccucgccggcugcgucgucggcggccuccucuacgccgucggcggccgcaacaacucccccgacggcaacaccgacuccuccgcccucgacugcuacaaccccaugaccaaccaguggucccccugcgcccccauguccgucccccgcaaccgcaucggcgucggcgucaucgacggccacaucuacgccgucggcggcucccacggcugcauccaccacaacuccgucgagcgcuacgagcccgagcgcgacgaguggcaccucgucgcccccaugcucacccgccgcaucggcgucggcgucgccguccucaaccgccuccucuacgccgucggcggcuucgacggcaccaaccgccucaacuccgccgagugcuacuaccccgagcgcaacgaguggcgcaugaucaccgccaugaacaccauccgcuccggcgccggcgucugcguccuccacaacugcaucuacgccgccggcggcuacgacggccaggaccagcucaacuccgucgagcgcuacgacgucgagaccgagaccuggaccuucgucgcccccaugaagcaccgccgcuccgcccucggcaucaccguccaccagggccgcaucuacguccucggcggcuacgacggccacaccuuccucgacuccgucgagugcuacgaccccgacaccgacaccugguccgaggucacccgcaugaccuccggccgcuccggcgucggcgucgccgucaccauggagcccugccgcaagcagaucgaccagcagaacugcaccugcuga

SEQ ID NO: 44991 - RNA, 2199 nt, Artificial Sequence
  derived and/or modified sequence opt2 from KEL__Homo_sapiens__NP_000411
auggagggcggcgaccaguccgaggaggagccccgcgagcgcucccaggccggcggcaugggcacccucuggucccaggaguccacccccgaggagcgccuccccgucgagggcucccgccccugggccgucgcccgccgcguccucaccgccauccucauccucggccuccuccucugcuucuccguccuccucuucuacaacuuccagaacugcggcccccgccccugcgagaccuccgucugccucgaccuccgcgaccacuaccucgccuccggcaacaccuccgucgcccccugcaccgacuucuucuccuucgccugcggccgcgccaaggagaccaacaacuccuuccaggagcucgccaccaagaacaagaaccgccuccgccgcauccucgagguccagaacuccuggcaccccggcuccggcgaggagaaggccuuccaguucuacaacuccugcauggacacccucgccaucgaggccgccggcaccggcccccuccgccaggucaucgaggagcucggcggcuggcgcaucuccggcaaguggaccucccucaacuucaaccgcacccuccgccuccucaugucccaguacggccacuuccccuucuuccgcgccuaccucggcccccaccccgccuccccccacacccccgucauccagaucgaccagcccgaguucgacgucccccucaagcaggaccaggagcagaagaucuacgcccagaucuuccgcgaguaccucaccuaccucaaccagcucggcacccuccucggcggcgaccccuccaagguccaggagcacuccucccucuccaucuccaucaccucccgccucuuccaguuccuccgcccccucgagcagcgccgcgcccagggcaagcucuuccagauggucaccaucgaccagcucaaggagauggcccccgccaucgacuggcucuccugccuccaggccaccuucacccccaugucccucucccccucccagucccucgucguccacgacgucgaguaccucaagaacaugucccagcucgucgaggagaugcuccucaagcagcgcgacuuccuccagucccacaugauccucggccucgucgucacccucucccccgcccucgacucccaguuccaggaggcccgccgcaagcucucccagaagcuccgcgagcucaccgagcagccccccaugcccgcccgcccccgcuggaugaagugcgucgaggagaccggcaccuucuucgagcccacccucgccgcccucuucguccgcgaggccuucggccccuccacccgcuccgccgccaugaagcucuucaccgccauccgcgacgcccucaucacccgccuccgcaaccuccccuggaugaacgaggagacccagaacauggcccaggacaaggucgcccagcuccaggucgagaugggcgccuccgagugggcccucaagcccgagcucgcccgccaggaguacaacgacauccagcucggcuccuccuuccuccaguccguccucuccugcguccgcucccuccgcgcccgcaucguccaguccuuccuccagccccacccccagcaccgcuggaaggucucccccugggacgucaacgccuacuacuccgucuccgaccacgucgucgucuuccccgccggccuccuccagccccccuucuuccaccccggcuacccccgcgccgucaacuucggcgccgccggcuccaucauggcccacgagcuccuccacaucuucuaccagcuccuccuccccggcggcugccucgccugcgacaaccacgcccuccaggaggcccaccucugccucaagcgccacuacgccgccuucccccuccccucccgcaccuccuucaacgacucccucaccuuccucgagaacgccgccgacgucggcggccucgccaucgcccuccaggccuacuccaagcgccuccuccgccaccacggcgagaccguccuccccucccucgaccucuccccccagcagaucuucuuccgcuccuacgcccaggucaugugccgcaagcccuccccccaggacucccacgacacccacucccccccccaccuccgcguccacggcccccucuccuccacccccgccuucgcccgcuacuuccgcugcgcccgcggcgcccuccucaaccccuccucccgcugccagcucugguga

SEQ ID NO: 44992 - RNA, 1059 nt, Artificial Sequence
  derived and/or modified sequence opt2 from KERA__Homo_sapiens__XP_011536083
auggccggcaccaucugcuucaucauguggguccucuucaucaccgacaccgucuggucccgcuccguccgccaggucuacgagguccacgacuccgacgacuggaccauccacgacuucgagugccccauggagugcuucugcccccccuccuuccccaccgcccucuacugcgagaaccgcggccucaaggagauccccgccauccccucccgcaucugguaccucuaccuccagaacaaccucaucgagaccauccccgagaagcccuucgagaacgccacccagcuccgcuggaucaaccucaacaagaacaagaucaccaacuacggcaucgagaagggcgcccucucccagcucaagaagcuccucuuccucuuccucgaggacaacgagcucgaggagguccccuccccccucccccgcucccucgagcagcuccagcucgcccgcaacaaggucucccgcaucccccagggcaccuucuccaaccucgagaaccucacccuccucgaccuccagaacaacaagcucgucgacaacgccuuccagcgcgacaccuucaagggccucaagaaccucaugcagcucaacauggccaagaacgcccuccgcaacaugcccccccgccuccccgccaacaccaugcagcucuuccucgacaacaacuccaucgagggcauccccgagaacuacuucaacgucauccccaaggucgccuuccuccgccucaaccacaacaagcucuccgacgagggccuccccucccgcggcuucgacgucuccuccauccucgaccuccagcucucccacaaccagcucaccaaggucccccgcaucuccgcccaccuccagcaccuccaccucgaccacaacaagaucaaguccgucaacgucuccgucaucugccccucccccuccaugcuccccgccgagcgcgacuccuucuccuacggcccccaccuccgcuaccuccgccucgacggcaacgagaucaagccccccauccccauggcccucaugaccugcuuccgccuccuccaggccgucaucaucuga

SEQ ID NO: 44993 - RNA, 654 nt, Artificial Sequence
  derived and/or modified sequence opt2 from KHDC3L__Homo_sapiens__NP_001017361
auggacgccccccgccgcuuccccacccucguccagcucaugcagcccaaggccaugcccgucgagguccucggccaccuccccaagcgcuucuccugguuccacuccgaguuccucaagaaccccaaggucguccgccucgaggucuggcucgucgagaagaucuucggccgcggcggcgagcgcaucccccacguccagggcaugucccagauccucauccacgucaaccgccucgaccccaacggcgaggccgagauccucgucuucggccgccccuccuaccaggaggacaccaucaagaugaucaugaaccucgccgacuaccaccgccagcuccaggccaagggcuccggcaaggcccucgcccaggacgucgccacccagaaggccgagacccagcgcuccuccaucgagguccgcgaggccggcacccagcgcuccgucgagguccgcgaggccggcacccagcgcuccgucgagguccaggaggucggcacccagggcucccccgucgagguccaggaggccggcacccagcagucccuccaggccgccaacaaguccggcacccagcgcucccccgaggccgccuccaaggccgucacccagcgcuuccgcgaggacgcccgcgaccccgucacccgccucuga

SEQ ID NO: 44994 - RNA, 1050 nt, Artificial Sequence
  derived and/or modified sequence opt2 from KHDRBS2__Homo_sapiens__NP_689901
auggaggaggagaaguaccuccccgagcucauggccgagaaggacucccucgaccccuccuucguccacgccucccgccuccucgccgaggagaucgagaaguuccagggcuccgacggcaagaaggaggacgaggagaagaaguaccucgacgucaucuccaacaagaacaucaagcucuccgagcgcguccucauccccgucaagcaguaccccaaguucaacuucgucggcaagcuccucggcccccgcggcaacucccucaagcgccuccaggaggagaccggcgccaagauguccauccucggcaagggcuccaugcgcgacaaggccaaggaggaggagcuccgcaaguccggcgaggccaaguacgcccaccucuccgacgagcuccacguccucaucgaggucuucgccccccccggcgaggccuacucccgcaugucccacgcccucgaggagaucaagaaguuccucguccccgacuacaacgacgagauccgccaggagcagcuccgcgagcucuccuaccucaacggcuccgaggacuccggccgcggccgcggcauccgcggccgcggcauccgcaucgcccccaccgcccccucccgcggccgcggcggcgccaucccccccccccccccccccggccgcggcguccucaccccccgcggcuccaccgucacccgcggcgcccuccccgucccccccgucgcccgcggcguccccaccccccgcgcccgcggcgcccccaccguccccggcuaccgcgccccccccccccccgcccacgaggccuacgaggaguacggcuacgacgacggcuacggcggcgaguacgacgaccagaccuacgagaccuacgacaacuccuacgccacccagacccaguccguccccgaguacuacgacuacggccacggcgucuccgaggacgccuacgacuccuacgcccccgaggagugggccaccacccgcuccucccucaaggcccccccccagcgcuccgcccgcggcggcuaccgcgagcaccccuacggccgcuacuga

SEQ ID NO: 44995 - RNA, 1041 nt, Artificial Sequence
  derived and/or modified sequence opt2 from KHDRBS3__Homo_sapiens__NP_006549
auggaggagaaguaccuccccgagcucauggccgagaaggacucccucgaccccuccuucacccacgcccuccgccucgucaaccaggagaucgagaaguuccagaagggcgagggcaaggacgaggagaaguacaucgacgucgucaucaacaagaacaugaagcucggccagaagguccucauccccgucaagcaguuccccaaguucaacuucgucggcaagcuccucggcccccgcggcaacucccucaagcgccuccaggaggagacccucaccaagauguccauccucggcaagggcuccaugcgcgacaaggccaaggaggaggagcuccgcaaguccggcgaggccaaguacuuccaccucaacgacgaccuccacguccucaucgaggucuucgccccccccgccgaggccuacgcccgcaugggccacgcccucgaggagaucaagaaguuccucauccccgacuacaacgacgagauccgccaggcccagcuccaggagcucaccuaccucaacggcggcuccgagaacgccgacguccccgucguccgcggcaagcccacccuccgcacccgcggcguccccgcccccgccaucacccgcggccgcggcggcgucaccgcccgccccgucggcgucgucgucccccgcggcacccccaccccccgcggcguccucuccacccgcggccccgucucccgcggccgcggccuccucaccccccgcgcccgcggcgucccccccaccggcuaccgcccccccccccccccccccacccaggagaccuacggcgaguacgacuacgacgacggcuacggcaccgccuacgacgagcaguccuacgacuccuacgacaacuccuacuccacccccgcccaguccggcgccgacuacuacgacuacggccacggccucuccgaggagaccuacgacuccuacggccaggaggaguggaccaacucccgccacaaggcccccuccgcccgcaccgccaagggcgucuaccgcgaccagcccuacggccgcuacuga

SEQ ID NO: 44996 - RNA, 897 nt, Artificial Sequence
  derived and/or modified sequence opt2 from KHK__Homo_sapiens__NP_000212
auggaggagaagcagauccucugcgucggccucgucguccucgacgucaucucccucgucgacaaguaccccaaggaggacuccgagauccgcugccucucccagcgcuggcagcgcggcggcaacgccuccaacuccugcaccguccucucccuccucggcgcccccugcgccuucaugggcuccauggcccccggccacgucgccgacuucguccucgacgaccuccgccgcuacuccgucgaccuccgcuacaccgucuuccagaccaccggcuccguccccaucgccaccgucaucaucaacgaggccuccggcucccgcaccauccucuacuacgaccgcucccuccccgacgucuccgccaccgacuucgagaaggucgaccucacccaguucaaguggauccacaucgagggccgcaacgccuccgagcaggucaagaugcuccagcgcaucgacgcccacaacacccgccagccccccgagcagaagauccgcgucuccgucgaggucgagaagccccgcgaggagcucuuccagcucuucggcuacggcgacgucgucuucgucuccaaggacgucgccaagcaccucggcuuccaguccgccgaggaggcccuccgcggccucuacggccgcguccgcaagggcgccguccucgucugcgccugggccgaggagggcgccgacgcccucggccccgacggcaagcuccuccacuccgacgccuucccccccccccgcgucgucgacacccucggcgccggcgacaccuucaacgccuccgucaucuucucccucucccagggccgcuccguccaggaggcccuccgcuucggcugccaggucgccggcaagaagugcggccuccagggcuucgacggcaucgucuga

SEQ ID NO: 44997 - RNA, 2136 nt, Artificial Sequence
  derived and/or modified sequence opt2 from KHSRP__Homo_sapiens__NP_003676
auguccgacuacuccaccggcggccccccccccggcccccccccccccgccggcggcggcggcggcgccggcggcgccggcggcggccccccccccggcccccccggcgccggcgaccgcggcggcggcggccccggcggcggcggccccggcggcggcuccgccggcggccccucccagccccccggcggcggcggccccggcauccgcaaggacgccuucgccgacgccguccagcgcgcccgccagaucgccgccaagaucggcggcgacgccgccaccaccgucaacaacuccacccccgacuucggcuucggcggccagaagcgccagcucgaggacggcgaccagcccgaguccaagaagcucgccucccagggcgacuccaucuccucccagcucggccccauccacccccccccccgcaccuccaugaccgaggaguaccgcguccccgacggcauggucggccucaucaucggccgcggcggcgagcagaucaacaagauccagcaggacuccggcugcaagguccagaucucccccgacuccggcggccuccccgagcgcuccgucucccucaccggcgcccccgaguccguccagaaggccaagaugaugcucgacgacaucgucucccgcggccgcggcggcccccccggccaguuccacgacaacgccaacggcggccagaacggcaccguccaggagaucaugauccccgccggcaaggccggccucgucaucggcaagggcggcgagaccaucaagcagcuccaggagcgcgccggcgucaagaugauccucauccaggacggcucccagaacaccaacgucgacaagccccuccgcaucaucggcgaccccuacaagguccagcaggccugcgagauggucauggacauccuccgcgagcgcgaccagggcggcuucggcgaccgcaacgaguacggcucccgcaucggcggcggcaucgacguccccgucccccgccacuccgucggcgucgucaucggccgcuccggcgagaugaucaagaagauccagaacgacgccggcguccgcauccaguucaagcaggacgacggcaccggccccgagaagaucgcccacaucaugggcccccccgaccgcugcgagcacgccgcccgcaucaucaacgaccuccuccagucccuccgcuccggcccccccggcccccccggcggccccggcaugccccccggcggccgcggccgcggccgcggccagggcaacuggggcccccccggcggcgagaugaccuucuccauccccacccacaagugcggccucgucaucggccgcggcggcgagaacgucaaggccaucaaccagcagaccggcgccuucgucgagaucucccgccagcucccccccaacggcgaccccaacuucaagcucuucaucauccgcggcuccccccagcagaucgaccacgccaagcagcucaucgaggagaagaucgagggcccccucugccccgucggccccggccccggcggccccggccccgccggccccaugggccccuucaaccccggccccuucaaccagggcccccccggcgcccccccccacgccggcggcccccccccccaccaguaccccccccagggcuggggcaacaccuacccccaguggcagccccccgccccccacgaccccuccaaggccgccgccgccgccgccgaccccaacgccgccugggccgccuacuacucccacuacuaccagcagccccccggccccguccccggccccgcccccgcccccgccgccccccccgcccagggcgagcccccccagcccccccccaccggccaguccgacuacaccaaggccugggaggaguacuacaagaagaucggccagcagccccagcagcccggcgcccccccccagcaggacuacaccaaggccugggaggaguacuacaagaagcaggcccaggucgccaccggcggcggccccggcgccccccccggcucccagcccgacuacuccgccgccugggccgaguacuaccgccagcaggccgccuacuacggccagacccccggccccggcggcccccagcccccccccacccagcagggccagcagcaggcccaguga

SEQ ID NO: 44998 - RNA, 1947 nt, Artificial Sequence
  derived and/or modified sequence opt2 from KIAA0020__Homo_sapiens__NP_055693
auggaggucaagggcaagaagcaguucaccggcaaguccaccaagaccgcccaggagaagaaccgcuuccacaagaacuccgacuccggcuccuccaagaccuuccccacccgcaaggucgccaaggagggcggccccaaggucaccucccgcaacuucgagaaguccaucaccaagcucggcaagaagggcgucaagcaguucaagaacaagcagcagggcgacaagucccccaagaacaaguuccagcccgccaacaaguucaacaagaagcgcaaguuccagcccgacggccgcuccgacgaguccgccgccaagaagcccaagugggacgacuucaagaagaagaagaaggagcucaagcagucccgccagcucuccgacaagaccaacuacgacaucgucguccgcgccaagcagaugugggagauccuccgccgcaaggacugcgacaaggagaagcgcgucaagcucauguccgaccuccagaagcucauccagggcaagaucaagaccaucgccuucgcccacgacuccacccgcgucauccagugcuacauccaguacggcaacgaggagcagcgcaagcaggccuucgaggagcuccgcgacgaccucgucgagcucuccaaggccaaguacucccgcaacaucgucaagaaguuccucauguacggcuccaagccccagaucgccgagaucauccgcuccuucaagggccacguccgcaagaugcuccgccacgccgaggccuccgccaucgucgaguacgccuacaacgacaaggccauccucgagcagcgcaacaugcucaccgaggagcucuacggcaacaccuuccagcucuacaaguccgccgaccaccgcacccucgacaagguccucgagguccagcccgagaagcucgagcucaucauggacgagaugaagcagauccucacccccauggcccagaaggaggccgucaucaagcacucccucguccacaaggucuuccucgacuucuucaccuacgccccccccaagcuccgcuccgagaugaucgaggccauccgcgaggccgucgucuaccucgcccacacccacgacggcgcccgcgucgccaugcacugccucuggcacggcacccccaaggaccgcaaggucaucgucaagaccaugaagaccuacgucgagaaggucgccaacggccaguacucccaccucguccuccucgccgccuucgacugcaucgacgacaccaagcucgucaagcagaucaucaucuccgagaucaucuccucccuccccuccaucgucaacgacaaguacggccgcaagguccuccucuaccuccucuccccccgcgaccccgcccacaccguccgcgagaucaucgagguccuccagaagggcgacggcaacgcccacuccaagaaggacaccgagguccgccgccgcgagcuccucgaguccaucucccccgcccuccucuccuaccuccaggagcacgcccaggaggucguccucgacaaguccgccugcguccucgucuccgacauccucggcuccgccaccggcgacguccagcccaccaugaacgccaucgccucccucgccgccaccggccuccaccccggcggcaaggacggcgagcuccacaucgccgagcaccccgccggccaccucguccucaaguggcucaucgagcaggacaagaagaugaaggagaacggccgcgagggcugcuucgccaagacccucgucgagcacgucggcaugaagaaccucaaguccugggccuccgucaaccgcggcgccaucauccucuccucccuccuccaguccugcgaccucgaggucgccaacaaggucaaggccgcccucaagucccucauccccacccucgagaagaccaaguccaccuccaagggcaucgagauccuccucgagaagcucuccaccuga

SEQ ID NO: 44999 - RNA, 300 nt, Artificial Sequence
  derived and/or modified sequence opt2 from KIAA0040__Homo_sapiens__NP_055471
auggagcgcaucuccgccuucuucuccuccaucugggacaccauccucaccaagcaccaggagggcaucuacaacaccaucugccucggcguccuccucggccucccccuccucgucaucaucacccuccucuucaucugcugccacugcugcugguccccccccggcaagcgcggccagcagcccgagaagaacaagaagaagaagaagaagaagaagaagaaggacgaggaggaccucuggaucuccgcccagcccaagcuccuccagauggagaagcgccccucccuccccgucuga

SEQ ID NO: 45000 - RNA, 6708 nt, Artificial Sequence
  derived and/or modified sequence opt2 from KIAA0100__Homo_sapiens__NP_055495
augccccucuucuucuccgcccuccucguccuccuccucgucgcccucuccgcccucuuccucggccgcuggcucgucguccgccucgccaccaaguggugccagcgcaagcuccaggccgagcucaagaucggcuccuuccgcuucuucuggauccagaacgucucccucaaguuccagcagcaccagcagaccgucgagaucgacaaccucuggaucuccuccaagcuccucucccacgaccucccccacuacgucgcccucugcuucggcgagguccgcauccgcaccgaccuccagaaggucuccgaccucuccgcccccuucucccaguccgccggcgucgaccagaaggagcucuccuucucccccucccuccucaagaucuucugccagcucuucuccauccacgucgacgccaucaacaucaugguccucaaggucgacaccuccgagucccucuggcacauccagaucucccgcucccgcuuccuccucgacuccgacggcaagcgccucaucugcgaggucucccucugcaagaucaacuccaagguccucaaguccggccagcucgaggacaccugccucgucgagcucucccucgcccucgaccucugccucaaggucggcaucuccucccgccaccucaccgccaucaccgucgacgucuggacccuccacgccgagcuccacgagggccucuuccagucccagcuccucugccagggccccucccucgccuccaagcccguccccugcuccgaggucaccgagaaccucgucgagcccacccuccccggccucuuccuccuccagcagcuccccgaccaggucaaggucaagauggagaacaccuccgucguccucuccaugaacucccagaagcgccaccucaccuggacccucaagcuccuccaguuccucuaccaccgcgacgaggaccagcucccccuccgcuccuucaccgccaacuccgacauggcccagauguccaccgagcuccuccucgaggacggccuccuccucucccagucccgccagcgcaucgucugccucaacucccucaaggccuccguccaggucaccaccaucgaccucuccgccucccucguccucaacaccugcaucauccacuaccgccaccaggaguucucccacuggcuccaccuccucgcccucgagacccagggcuccuccucccccguccucaagcagcgcaagaagcgcaccuucccccagauccucgcccccaucaucuucuccaccuccaucuccaacgucaacaucuccauccagcucggcgacaccccccccuucgcccucggcuucaacuccaucucccucgacuaccagcaccuccgcccccaguccauccaccagcgcggcguccucaccgucgaccaccucugcuggcgcgucggcuccgacucccacauccagcgcgccccccacccccccaacaugcacgucuggggcgaggcccucguccucgacuccuucacccuccagggcuccuacaaccagccccucggccucuccuccacccaguccgacacccucuuccucgacugcaccauccgcggccuccaggucgaggccuccgacaccugcgcccagugccucucccgcauccucucccucaugggcccccaguccggcaaguccgccgucucccgccacuccuccuucggcgaguccgucucccuccucuggaaggucgaccucaaggucgaggacaugaaccucuucacccucuccgcccucgucggcgccuccgagguccgccucgacacccucaccauccucggcuccgccgagaccuccaccgucggcauccagggccucguccucgcccucgucaaguccgucaccgagaagaugcagcccugcugcaaggcccccgacauccccacccccguccucucccucuccaugcucuccaucaccuaccacuccuccauccgcucccucgagguccagugcggcgccggccucacccuccucugguccccccccgaccacauguaccucuaccagcacguccucgccacccuccagugccgcgaccuccuccgcgccaccgucuuccccgagaccguccccucccucgcccucgagaccuccggcaccaccuccgagcucgagggccgcgcccccgagccccucccccccaagcgccuccucaaccucacccucgaggucuccaccgccaagcucaccgccuucgucgccgaggacaaguucaucacccucgccgccgaguccgucucccucucccgccacggcggcucccuccaggccuacugccccgagcucgccgccggcuucgacggcaacuccaucuucaacuucaaggaggucgagguccagcuccuccccgagcucgaggagaugauccuccaccgcaaccccuuccccgcccuccagacccuccgcaaccgcgucuggcuccucuccuucggcuccgucuccgucgaguuccccuaccaguacgacuucucccgcacccucgacgaggccgucggcguccagaaguggcucaagggccuccaccagggcacccgcgccugggccucccccucccccgucccccucccccccgaccuccuccucaaggucgagcacuucuccugggucuuccucgacgacgucuucgaggucaagcuccacgacaacuacgagcucaugaaggacgaguccaaggaguccgccaagcgccuccagcuccucgacgccaaggucgccgcccuccgcaagcagcacggcgagcuccuccccgcccgcaagaucgaggagcucuacgccucccucgagcgcaagaacaucgagaucuacauccagcgcucccgccgccucuacggcaacacccccaugcgccgcgcccuccucaccuggucccucgccggccucgagcucgucgcccucgccgacgccuccuuccacggccccgagcacgucgucgagcagguccaggagcucgaccccggcucccccuucccccccgagggccucgaccucgucauccaguggugccgcaugcucaagugcaacgucaaguccuuccucguccgcauccgcgacuacccccgcuaccucuucgagauccgcgacuggcgccucaugggccgccucgucggcaccgagcaguccggccagcccugcucccgccgccgccagauccuccaccucggccuccccuggggcaacgucgccgucgagcgcaacaugcccccccucaaguucuaccacgacuuccacuccgagaucuuccaguacaccgucgucuggggccccugcugggaccccgccuggacccucaucggccagugcgucgaccuccucaccaagcccuccgccgaccccucccccccccuccccuggugggacaagucccgccuccucuuccacggcgacuggcacauggacaucgagcaggccaaccuccaccagcucgccaccgaggaccccuacaacaccaccgagaacaugcacugggaguggucccaccucuccuuccacuggaagcccggccaguucgucuucaagggcgaccucgacaucaacguccgcaccgccuccaaguacgacgacugcugcuuccuccaccuccccgaccucugcaugacccucgaccuccaguggcucugccacggcaacccccacgaccaccacuccgucacccuccgcgcccccgaguuccuccccgaggucccccucggccagcuccacgacuccuaccgcgccuuccgcuccgagaaccucaaccucuccaucaagauggaccucacccgccacuccggcaccaucucccagccccgcauccuccucuacuccuccacccuccgcuggaugcagaacuucugggccaccuggaccuccgucacccgccccaucugccgcggcaagcucuucaacaaccucaagcccuccaagaagaagcucggccagcacuacaagcagcucuccuacaccgcccucuucccccagcuccagguccacuacugggccuccuucgcccagcagcgcggcauccagaucgagugcucccagggccacgucuucacccgcggcacccagcgccucaucccccaggccggcaccgucaugcgccgccucaucuccgacugguccgucacccagauggucuccgaccucucccaggucaccguccaccucauggccucccccaccgaggagaacgccgaccacugccucgacccccucgucaccaagacccaccuccucucccucuccucccucaccuaccagcgccacuccaaccgcaccgccgaggaggagcucuccgcccgcgacggcgaccccaccuuccacacccaccagcuccaccucgucgaccuccgcaucuccuggaccaccaccaaccgcgacaucgccuucggccucuacgacggcuacaagaaggccgccguccucaagcgcaaccucuccaccgaggcccucaagggccucaagaucgacccccagaugcccgccaagaagcccaagcgcggcguccccaccuccgccuccgcccccccccgcgucaacacccccuccuucuccggccagcccgacaagggcuccuccggcggcgccuacaugcuccagaagcucaucgaggagaccgaccgcuucgucgucuucaccgaggaggaguccggcauguccgaccagcucugcggcaucgccgccugccagaccgacgacaucuacaaccgcaacugccucaucgagcucgucaacugccagaugguccuccgcggcgccgagaccgagggcugcgucaucgucuccgccgccaaggcccagcuccuccagugccagcaccaccccgccugguacggcgacacccucaagcagaagaccuccuggaccugccuccucgacggcaugcaguacuucgccaccaccgaguccucccccaccgagcaggacggccgccagcucuggcucgaggucaagaacaucgaggagcaccgccagcgcucccucgacuccguccaggagcucauggaguccggccaggccgucggcggcauggucaccaccaccaccgacuggaaccagcccgccgaggcccagcaggcccagcagguccagcgcaucaucucccgcugcaacugccgcauguacuacaucuccuacucccacgacaucgaccccgagcucgccacccagaucaagccccccgagguccucgagaaccaggagaaggaggaccuccucaagaagcaggagggcgccgucgacaccuucacccucauccaccacgagcucgagaucuccaccaaccccgcccaguacgccaugauccucgacaucgucaacaaccuccuccuccacgucgagcccaagcgcaaggagcacuccgagaagaagcagcgcguccgcuuccagcucgagaucuccuccaaccccgaggagcagcgcuccuccauccuccaccuccaggaggccguccgccagcacgucgcccagauccgccagcucgagaagcagauguacuccaucaugaagucccuccaggacgacuccaagaacgagaaccuccucgaccucaaccagaagcuccagcuccagcucaaccaggagaaggccaaccuccagcucgaguccgaggagcucaacauccucauccgcugcuucaaggacuuccagcuccagcgcgccaacaagauggagcuccgcaagcagcaggaggacgucuccgucguccgccgcaccgaguucuacuucgcccaggcccgcuggcgccucaccgaggaggacggccagcucggcaucgccgagcucgagcuccagcgcuuccucuacuccaaggucaacaaguccgacgacaccgccgagcaccuccucgagcucggcugguucaccaugaacaaccuccuccccaacgccgucuacaaggucguccuccgcccccaguccuccugccaguccggccgccagcucgcccuccgccucuucuccaagguccgcccccccgucggcggcaucuccgucaaggagcacuucgaggucaacgucgucccccucaccauccagcucacccaccaguucuuccaccgcaugaugggcuucuucuuccccggccgcuccgucgaggacgacgaggucggcgacgaggaggacaaguccaagcucgucaccaccggcauccccgucgucaagccccgccagcucaucgccaccgacgacgccgucccccucggccccggcaagggcgucgcccagggccucacccgcuccuccggcguccgccgcuccuuccgcaagucccccgagcaccccgucgacgacaucgacaagaugaaggagcgcgccgccaugaacaacuccuucaucuacaucaagaucccccaggucccccucugcgucuccuacaagggcgagaagaacuccgucgacuggggcgaccucaaccucguccuccccugccucgaguaccacaacaacaccuggaccuggcucgacuucgccauggccgucaagcgcgacucccgcaaggcccucgucgcccaggucaucaaggagaagcuccgccucaaguccgccaccggcuccgagguccgcggcaagcucgagaccaaguccgaccucaacaugcagcagcaggaggaggaggagaaggcccgccuccucaucggccucuccgucggcgacaagaaccccggcaagaaguccaucuucggccgccgcaaguga

SEQ ID NO: 45001 - RNA, 198 nt, Artificial Sequence
  derived and/or modified sequence opt2 from KIAA0101__Homo_sapiens__NP_001025160
augguccgcaccaaggccgacuccguccccggcaccuaccgcaaggucgucgccgcccgcgccccccgcaagguccucggcuccuccaccuccgccaccaacuccaccuccgucuccucccgcaaggagcacguccucugcaaccucaucacccagaugaugaagaagaaccgcaccuucuccuucaucuucgaguga

SEQ ID NO: 45002 - RNA, 3480 nt, Artificial Sequence
  derived and/or modified sequence opt2 from KIAA0196__Homo_sapiens__NP_055661
augcucgacuuccucgccgagaacaaccucugcggccaggccauccuccgcaucgucuccugcggcaacgccaucaucgccgagcuccuccgccucuccgaguucauccccgccgucuuccgccucaaggaccgcgccgaccagcagaaguacggcgacaucaucuucgacuucuccuacuucaagggccccgagcucugggaguccaagcucgacgccaagcccgagcuccaggaccucgacgaggaguuccgcgagaacaacaucgagaucgucacccgcuucuaccucgccuuccaguccguccacaaguacaucgucgaccucaaccgcuaccucgacgaccucaacgagggcgucuacauccagcagacccucgagaccguccuccucaacgaggacggcaagcagcuccucugcgaggcccucuaccucuacggcgucaugcuccucgucaucgaccagaagaucgagggcgagguccgcgagcgcaugcucgucuccuacuaccgcuacuccgccgcccgcuccuccgccgacuccaacauggacgacaucugcaagcuccuccgcuccaccggcuacuccucccagcccggcgccaagcgccccuccaacuaccccgaguccuacuuccagcgcguccccaucaacgaguccuucaucuccauggucaucggccgccuccgcuccgacgacaucuacaaccaggucuccgccuacccccuccccgagcaccgcuccaccgcccucgccaaccaggccgccaugcucuacgucauccucuacuucgagcccuccauccuccacacccaccaggccaagaugcgcgagaucgucgacaaguacuuccccgacaacugggucaucuccaucuacaugggcaucaccgucaaccucgucgacgccugggagcccuacaaggccgccaagaccgcccucaacaacacccucgaccucuccaacguccgcgagcaggccucccgcuacgccaccgucuccgagcgcguccacgcccagguccagcaguuccucaaggagggcuaccuccgcgaggagaugguccucgacaacauccccaagcuccucaacugccuccgcgacugcaacgucgccauccgcuggcucaugcuccacaccgccgacuccgccugcgaccccaacaacaagcgccuccgccagaucaaggaccagauccucaccgacucccgcuacaacccccgcauccucuuccagcuccuccucgacaccgcccaguucgaguucauccucaaggagauguucaagcagaugcucuccgagaagcagaccaagugggagcacuacaagaaggagggcuccgagcgcaugaccgagcucgccgacgucuucuccggcgucaagccccucacccgcgucgagaagaacgagaaccuccaggccugguuccgcgagaucuccaagcagauccucucccucaacuacgacgacuccaccgccgccggccgcaagaccguccagcucauccaggcccucgaggagguccaggaguuccaccagcucgaguccaaccuccaggucugccaguuccucgccgacacccgcaaguuccuccaccagaugauccgcaccaucaacaucaaggaggagguccucaucaccaugcagaucgucggcgaccucuccuucgccuggcagcucaucgacuccuucaccuccaucaugcaggaguccauccgcgucaaccccuccauggucaccaagcuccgcgccaccuuccucaagcucgccuccgcccucgaccucccccuccuccgcaucaaccaggccaacucccccgaccuccucuccgucucccaguacuacuccggcgagcucgucuccuacguccgcaagguccuccagaucauccccgaguccauguucaccucccuccucaagaucaucaagcuccagacccacgacaucaucgagguccccacccgccucgacaaggacaagcuccgcgacuacgcccagcucggcccccgcuacgaggucgccaagcucacccacgccaucuccaucuucaccgagggcauccucaugaugaagaccacccucgucggcaucaucaaggucgaccccaagcagcuccucgaggacggcauccgcaaggagcucgucaagcgcgucgccuucgcccuccaccgcggccucaucuucaacccccgcgccaagcccuccgagcucaugcccaagcucaaggagcucggcgccaccauggacggcuuccaccgcuccuucgaguacauccaggacuacgucaacaucuacggccucaagaucuggcaggaggaggucucccgcaucaucaacuacaacgucgagcaggagugcaacaacuuccuccgcaccaagauccaggacuggcaguccauguaccaguccacccacauccccauccccaaguucacccccgucgacgaguccgucaccuucaucggccgccucugccgcgagauccuccgcaucaccgaccccaagaugaccugccacaucgaccagcucaacaccugguacgacaugaagacccaccaggaggucaccuccucccgccucuucuccgagauccagaccacccucggcaccuucggccucaacggccucgaccgccuccucugcuucaugaucgucaaggagcuccagaacuuccucuccauguuccagaagaucauccuccgcgaccgcaccguccaggacacccucaagacccucaugaacgccgucuccccccucaaguccaucgucgccaacuccaacaagaucuacuucuccgccaucgccaagacccagaagaucuggaccgccuaccucgaggccaucaugaaggucggccagaugcagauccuccgccagcagaucgccaacgagcucaacuacuccugccgcuucgacuccaagcaccucgccgccgcccucgagaaccucaacaaggcccuccucgccgacaucgaggcccacuaccaggaccccucccuccccuaccccaaggaggacaacacccuccucuacgagaucaccgccuaccucgaggccgccggcauccacaacccccucaacaagaucuacaucaccaccaagcgccuccccuacuuccccaucgucaacuuccucuuccucaucgcccagcuccccaagcuccaguacaacaagaaccucggcauggucugccgcaagcccaccgaccccgucgacuggcccccccucguccucggccuccucacccuccucaagcaguuccacucccgcuacaccgagcaguuccucgcccucaucggccaguucaucugcuccaccgucgagcagugcaccucccagaagauccccgagauccccgccgacgucgucggcgcccuccucuuccucgaggacuacguccgcuacaccaagcucccccgccgcgucgccgaggcccacguccccaacuucaucuucgacgaguuccgcaccguccucuga

SEQ ID NO: 45003 - RNA, 2784 nt, Artificial Sequence
  derived and/or modified sequence opt2 from KIAA0226__Homo_sapiens__NP_001139114
augcaguccauccucuaccacggccucauccgcgaccaggccugccgccgccagaccgacuacuggcaguucgucaaggacauccgcuggcucuccccccacuccgcccuccacgucgagaaguucaucuccguccacgagaacgaccaguccuccgccgacggcgccuccgagcgcgccgucgccgagcucuggcuccagcacucccuccaguaccacugccucuccgcccagcuccgcccccuccucggcgaccgccaguacauccgcaaguucuacaccgacgccgccuuccuccucuccgacgcccacgucaccgccaugcuccagugccucgaggccgucgagcagaacaacccccgccuccucgcccagaucgacgccuccauguucgcccgcaagcacgaguccccccuccucgucaccaagucccagucccucaccgcccuccccuccuccaccuacaccccccccaacuccuacgcccagcacuccuacuucggcuccuucuccucccuccaccaguccguccccaacaacggcuccgagcgccgcuccaccuccuucccccucuccggccccccccgcaagccccaggagucccgcggccacgucucccccgccgaggaccagaccauccaggccccccccgucuccgucuccgcccucgcccgcgacuccccccucacccccaacgagauguccuccuccacccucaccucccccaucgaggccuccugggucuccucccagaacgacucccccggcgacgccuccgagggccccgaguaccucgccaucggcaaccucgacccccgcggccgcaccgccuccugccagucccacuccuccaacgccgaguccuccuccuccaaccucuucuccuccuccuccucccagaagcccgacuccgccgccuccucccucggcgaccaggagggcggcggcgagucccagcucuccuccguccuccgccgcuccuccuucuccgagggccagacccucaccgucaccuccggcgccaagaagucccacauccgcucccacuccgacaccuccaucgccucccgcggcgcccccggcggcccccgcaacaucaccaucaucgucgaggaccccaucgccgaguccugcaacgacaaggccaagcuccgcggcccccuccccuacuccggccaguccuccgaggucuccacccccuccucccucuacauggaguacgagggcggccgcuaccucugcuccggcgagggcauguuccgccgccccuccgagggccagucccucaucuccuaccucuccgagcaggacuucggcuccugcgccgaccucgagaaggagaacgcccacuucuccaucuccgagucccucaucgccgccaucgagcucaugaagugcaacaugaugucccagugccucgaggaggaggaggucgaggaggaggacuccgaccgcgagauccaggagcucaagcagaagauccgccuccgccgccagcagauccgcaccaagaaccuccuccccauguaccaggaggccgagcacggcuccuuccgcgucaccuccuccuccucccaguucuccucccgcgacuccgcccagcucuccgacuccggcuccgccgacgaggucgacgaguucgagauccaggacgccgacauccgccgcaacaccgccuccuccuccaaguccuucgucuccucccaguccuucucccacugcuuccuccacuccaccuccgccgaggccgucgccaugggccuccucaagcaguucgagggcaugcagcuccccgccgccuccgagcucgaguggcucguccccgagcacgacgccccccagaagcuccuccccauccccgacucccuccccaucucccccgacgacggccagcacgccgacaucuacaagcuccgcauccgcguccgcggcaaccucgagugggcccccccccgcccccagaucaucuucaacguccaccccgcccccacccgcaagaucgccgucgccaagcagaacuaccgcugcgccggcugcggcauccgcaccgaccccgacuacaucaagcgccuccgcuacugcgaguaccucggcaaguacuucugccagugcugccacgagaacgcccagauggccauccccucccgcguccuccgcaagugggacuucuccaaguacuacgucuccaacuucuccaaggaccuccucaucaagaucuggaacgacccccucuucaacguccaggacaucaacuccgcccucuaccgcaaggucaagcuccucaaccagguccgccuccuccgcguccagcucugccacaugaagaacauguucaagaccugccgccucgccaaggagcuccucgacuccuucgacaccguccccggccaccucaccgaggaccuccaccucuacucccucaacgaccucaccgccacccgcaagggcgagcucggcccccgccucgccgagcucacccgcgccggcgccacccacgucgagcgcugcaugcucugccaggccaagggcuucaucugcgaguucugccagaacgaggacgacaucaucuuccccuucgagcuccacaagugccgcaccugcgaggagugcaaggccugcuaccacaaggccugcuucaaguccggcuccugcccccgcugcgagcgccuccaggcccgccgcgaggcccucgcccgccagucccucgaguccuaccucuccgacuacgaggaggagcccgccgaggcccucgcccucgaggccgccguccucgaggccaccuga

SEQ ID NO: 45004 - RNA, 1908 nt, Artificial Sequence
  derived and/or modified sequence opt2 from KIAA0226L__Homo_sapiens__NP_001273691
auggucucccaguccaccguccgccaggacucccccgucgagcccugggagggcaucuccgaccacuccggcaucaucgacggcuccccccgccuccucaacaccgaccacccccccugccagcucgacauccgccucaugcgccacaaggccgucuggaucaacccccaggacguccagcagcagccccaggaccuccagucccagguccccgccgccggcaacuccggcacccacuucgucaccgacgccgccucccccuccggccccucccccuccugccucggcgacucccucgccgagaccacccucuccgaggacaccaccgacuccgucggcuccgccuccccccacggcuccuccgagaaguccuccuccuucucccucuccuccaccgagguccacaugguccgccccggcuacucccaccgcgucucccuccccaccucccccggcauccucgccaccucccccuaccccgagaccgacuccgccuucuucgagcccucccaccucaccuccgccgccgacgagggcgccguccaggucucccgccgcaccaucuccuccaacuccuucucccccgaggucuucguccuccccgucgacgucgagaaggagaacgcccacuucuacgucgccgacaugaucaucuccgccauggagaagaugaagugcaacauccucucccagcagcagaccgaguccugguccaaggaggucuccggccuccucggcuccgaccagcccgacuccgagaugaccuucgacaccaacaucaagcaggaguccggcuccuccaccuccuccuacuccggcuacgagggcugcgccguccuccaggucucccccgucaccgagacccgcaccuaccacgacgucaaggagaucugcaagugcgacgucgacgaguucgucauccucgagcucggcgacuucaacgacaucaccgagaccugcuccugcuccugcuccuccuccaaguccgucaccuacgagcccgacuucaacuccgccgagcuccucgccaaggagcucuaccgcgucuuccagaagugcuggauccucuccgucgucaacucccagcucgccggcucccucuccgccgccggcuccaucgucgucaacgaggagugcguccgcaaggacuucgaguccuccaugaacgucguccaggagaucaaguucaagucccgcauccgcggcaccgaggacugggcccccccccgcuuccagaucaucuucaacauccaccccccccucaagcgcgaccucgucgucgccgcccagaacuucuucugcgccggcugcggcacccccgucgagcccaaguucgucaagcgccuccgcuacugcgaguaccucggcaaguacuucugcgacugcugccacuccuacgccgaguccugcauccccgcccgcauccucaugaugugggacuucaagaaguacuacgucuccaacuucuccaagcagcuccucgacuccaucuggcaccagcccaucuucaaccuccucuccaucggccagucccucuacgccaaggccaaggagcucgaccgcgucaaggagauccaggagcagcucuuccacaucaagaagcuccucaagaccugccgcuucgccaacuccugcgucaaggagcgcgcccucuucgucaacuucgcccgcauccgccucuccuccucccacuuccgccagcagcacgucgaggacguccagcgcgccggccucgccuucaccaacuccgccuccuccccccccuccgcccccggcguccgcggcucccagcgcggcgagaacuucuggaaggucuggccccuccagcagcacgacgcccccgaguacugcgagaaggacugcuccaccugccucaugaucacccccaucugcgucuacuacugguga

SEQ ID NO: 45005 - RNA, 4188 nt, Artificial Sequence
  derived and/or modified sequence opt2 from KIAA0232__Homo_sapiens__NP_001094060
auguaccccaucugcaccgucgucgucgacggccuccccuccgaguccuccuccuccuccuaccccggccccgucuccgucuccgagaugucccuccuccacgcccucggccccguccagaccuggcucggccaggagcucgagaagugcggcaucgacgccaugaucuacacccgcuacguccucucccuccuccuccacgacuccuacgacuacgaccuccaggagcaggagaacgacaucuuccucggcugggagaagggcgccuacaagaaguggggcaaguccaagaagaagugcuccgaccucacccucgaggagaugaagaagcaggccgccguccagugccuccgcuccgccuccgacgaguccuccggcaucgagacccucgucgaggagcucugcucccgccucaaggaccuccaguccaagcaggaggagaagauccacaagaagcucgagggcucccccucccccgaggccgagcucuccccccccgccaaggaccaggucgagauguacuacgaggccuuccccccccucuccgagaagcccgucugccuccaggagaucaugaccgucuggaacaaguccaaggucugcuccuacuccuccuccuccuccuccuccaccgccccccccgccuccaccgacaccuccucccccaaggacugcaacuccgaguccgaggucaccaaggagcgcuccuccgagguccccaccaccguccacgagaagacccaguccaaguccaagaacgagaaggagaacaaguucuccaacggcaccaucgaggagaagcccgcccucuacaagaagcagauccgccacaagcccgagggcaagauccgcccccgcuccugguccuccggcuccuccgaggccggcuccuccuccuccggcaaccagggcgagcucaaggccuccaugaaguacgucaagguccgccacaaggcccgcgagauccgcaacaagaagggccgcaacggccagucccgccucucccucaagcacggcgagaaggccgagcgcaacauccacaccggcuccuccuccuccuccuccuccggcuccgucaagcagcucugcaagcgcggcaagcgcccccucaaggagaucggccgcaaggaccccggcuccaccgagggcaaggaccucuacauggagaaccgcaaggacaccgaguacaaggaggagccccucugguacaccgagcccaucgccgaguacuucgucccccucucccgcaaguccaagcucgagaccaccuaccgcaaccgccaggacaccuccgaccucaccuccgaggccgucgaggagcucuccgaguccguccacggccucugcaucuccaacaacaaccuccacaagaccuaccucgccgccggcaccuucaucgacggccacuucgucgagaugcccgccgucaucaacgaggacaucgaccucaccggcaccucccucugcucccuccccgaggacaacaaguaccucgacgacauccaccucuccgagcucacccacuucuacgaggucgacaucgaccaguccaugcucgaccccggcgccuccgagaccaugcagggcgagucccgcauccucaacaugauccgccagaaguccaaggagaacaccgacuucgaggccgagugcugcaucguccucgacggcauggagcuccagggcgagcgcgccaucuggaccgacuccaccuccuccgucggcgccgagggccucuuccuccaggaccucggcaaccucgcccaguucugggagugcugcuccuccuccuccggcgacgccgacggcgaguccuucggcggcgacucccccguccgccucucccccauccucgacuccaccguccucaacucccaccuccucgccggcaaccaggagcucuucuccgacaucaacgagggcuccggcaucaacuccugcuucuccgucuucgagguccagugcuccaacuccguccuccccuucuccuucgagacccucaaccucggcaacgagaacaccgacuccuccgccaacaugcucggcaagacccagucccgccuccucaucuggaccaagaacuccgccuucgaggagaacgagcacugcuccaaccucuccacccgcaccugcucccccuggucccacuccgaggagacccgcuccgacaacgagacccucaacauccaguucgaggaguccacccaguucaacgccgaggacaucaacuacgucgucccccgcgucuccuccaacuacgucgacgaggagcuccucgacuuccuccaggacgagaccugccagcagaacucccgcacccucggcgagauccccacccucgucuucaagaagaccuccaagcucgaguccgucugcggcauccagcucgagcagaagaccgagaacaagaacuucgagaccacccaggucugcaacgaguccccccacggcgacggcuacuccuccggcgucaucaaggacaucuggaccaagauggccgacaccaacuccgucgccaccgucgagaucgagcgcaccgacgccgagcucuucuccgccgacgucaacaacuacugcugcugccucgacgccgaggccgagcucgagacccuccaggagcccgacaaggccguccgccgcuccgaguaccaccucugggagggccagaaggagucccucgagaagcgcgccuucgccuccuccgagcucuccaacgucgacggcggcgacuacaccacccccuccaagcccugggacgucgcccaggacaaggagaacaccuucauccucggcggcgucuacggcgagcucaagaccuucaacuccgacggcgagugggccgucgucccccccucccacaccaagggcucccuccuccagugcgccgccuccgacgucgucaccaucgccggcaccgacgucuucaugacccccggcaacuccuucgcccccggccaccgccagcucuggaagcccuucgucuccuucgagcagaacgaccagcccaaguccggcgagaacggccucaacaagggcuucuccuucaucuuccacgaggaccuccucggcgccugcggcaacuuccaggucgaggaccccggccucgaguacuccuucuccuccuucgaccucuccaaccccuucucccagguccuccacgucgagugcuccuucgagcccgagggcaucgccuccuucucccccuccuucaagcccaaguccauccucugcuccgacuccgacuccgaggucuuccacccccgcaucugcggcgucgaccgcacccaguaccgcgccauccgcaucuccccccgcacccacuuccgccccaucuccgccuccgagcucucccccggcggcggcuccgaguccgaguucgaguccgagaaggacgaggccaacauccccauccccucccaggucgacaucuucgaggacccccaggccgaccucaagccccucgaggaggacgccgagaaggagggccacuacuacggcaaguccgagcucgaguccggcaaguuccucccccgccucaagaaguccggcauggagaaguccgcccagaccucccucgacucccaggaggaguccaccggcauccucuccgucggcaagcagaaccagugccucgagugcuccaugaacgagucccucgagaucgaccucgaguccuccgaggccaacugcaagaucauggcccagugcgaggaggagaucaacaacuucugcggcugcaaggccggcugccaguuccccgccuacgaggacaaccccgucuccuccggccagcucgaggaguuccccguccucaacaccgacauccagggcaugaaccgcucccaggagaagcagaccuggugggagaaggcccucuacuccccccucuuccccgccuccgagugcgaggagugcuacaccaacgccaagggcgaguccggccucgaggaguaccccgacgccaaggagacccccuccaacgaggagcgccuccucgacuucaaccgcgucuccuccgucuacgaggcccgcugcaccggcgagcgcgacuccggcgccaaguccgacggcuuccgcggcaagaugugcuccuccgccuccuccaccuccgaggagaccggcuccgagggcggcggcgagugggucggccccuccgaggaggagcucuucucccgcacccaccucuga

SEQ ID NO: 45006 - RNA, 3192 nt, Artificial Sequence
  derived and/or modified sequence opt2 from KIAA0319__Homo_sapiens__NP_001161846
augacccgccucggcuggcccucccccugcugcgcccgcaagcagugcuccgagggccgcaccuacuccaacgccgucaucucccccaaccucgagaccacccgcaucaugcgcgucucccacaccuuccccgucgucgacugcaccgccgccugcugcgaccucuccuccugcgaccucgccuggugguucgagggccgcugcuaccucgucuccugcccccacaaggagaacugcgagcccaagaagaugggccccauccgcuccuaccucaccuucguccuccgccccguccagcgccccgcccagcuccucgacuacggcgacaugaugcucaaccgcggcucccccuccggcaucuggggcgacucccccgaggacauccgcaaggaccucaccuuccucggcaaggacuggggccucgaggagauguccgaguacuccgacgacuaccgcgagcucgagaaggaccuccuccagcccuccggcaagcaggagccccgcggcuccgccgaguacaccgacuggggccuccuccccggcuccgagggcgccuucaacuccuccgucggcgacucccccgccguccccgccgagacccagcaggaccccgagcuccacuaccucaacgaguccgccuccacccccgcccccaagcuccccgagcgcuccguccuccucccccuccccaccacccccuccuccggcgagguccucgagaaggagaaggccucccagcuccaggagcaguccuccaacuccuccggcaaggagguccucaugcccucccacucccucccccccgccucccucgagcucuccuccgucaccgucgagaagucccccguccucaccgucacccccggcuccaccgagcacuccauccccaccccccccaccuccgccgcccccuccgaguccacccccuccgagcuccccaucucccccaccaccgccccccgcaccgucaaggagcucaccgucuccgccggcgacaaccucaucaucacccuccccgacaacgaggucgagcucaaggccuucgucgcccccgccccccccgucgagaccaccuacaacuacgaguggaaccucaucucccaccccaccgacuaccagggcgagaucaagcagggccacaagcagacccucaaccucucccagcucuccgucggccucuacgucuucaaggucaccgucuccuccgagaacgccuucggcgagggcuucgucaacgucaccgucaagcccgcccgccgcgucaaccucccccccgucgccgucgucuccccccagcuccaggagcucacccucccccucaccuccgcccucaucgacggcucccaguccaccgacgacaccgagaucgucuccuaccacugggaggagaucaacggccccuucaucgaggagaagaccuccgucgacucccccguccuccgccucuccaaccucgaccccggcaacuacuccuuccgccucaccgucaccgacuccgacggcgccaccaacuccaccaccgccgcccucaucgucaacaacgccgucgacuacccccccgucgccaacgccggccccaaccacaccaucacccucccccagaacuccaucacccucaacggcaaccaguccuccgacgaccaccagaucguccucuacgaguggucccucggccccggcuccgagggcaagcacgucgucaugcagggcguccagacccccuaccuccaccucuccgccaugcaggagggcgacuacaccuuccagcucaaggucaccgacuccucccgccagcaguccaccgccgucgucaccgucaucguccagcccgagaacaaccgcccccccgucgccgucgccggccccgacaaggagcucaucuuccccgucgaguccgccacccucgacggcuccuccuccuccgacgaccacggcaucgucuucuaccacugggagcacguccgcggccccuccgccgucgagauggagaacaucgacaaggccaucgccaccgucaccggccuccaggucggcaccuaccacuuccgccucaccgucaaggaccagcagggccucuccuccaccuccacccucaccgucgccgucaagaaggagaacaacucccccccccgcgcccgcgccggcggccgccacguccucguccuccccaacaacuccaucacccucgacggcucccgcuccaccgacgaccagcgcaucgucuccuaccucuggauccgcgacggccagucccccgccgccggcgacgucaucgacggcuccgaccacuccgucgcccuccagcucaccaaccucgucgagggcgucuacaccuuccaccuccgcgucaccgacucccagggcgccuccgacaccgacaccgccaccgucgagguccagcccgacccccgcaaguccggccucgucgagcucacccuccaggucggcgucggccagcucaccgagcagcgcaaggacacccucguccgccagcucgccguccuccucaacguccucgacuccgacaucaagguccagaagauccgcgcccacuccgaccucuccaccgucaucgucuucuacguccagucccgcccccccuucaagguccucaaggccgccgaggucgcccgcaaccuccacaugcgccucuccaaggagaaggccgacuuccuccucuucaagguccuccgcgucgacaccgccggcugccuccucaagugcuccggccacggccacugcgacccccucaccaagcgcugcaucugcucccaccucuggauggagaaccucauccagcgcuacaucugggacggcgaguccaacugcgagugguccaucuucuacgucaccguccucgccuucacccucaucguccucaccggcggcuucaccuggcucugcaucugcugcugcaagcgccagaagcgcaccaagauccgcaagaagaccaaguacaccauccucgacaacauggacgagcaggagcgcauggagcuccgccccaaguacggcaucaagcaccgcuccaccgagcacaacuccucccucauggucuccgaguccgaguucgacuccgaccaggacaccaucuucucccgcgagaagauggagcgcggcaaccccaaggucuccaugaacggcuccauccgcaacggcgccuccuucuccuacugcuccaaggaccgcuga

SEQ ID NO: 45007 - RNA, 2547 nt, Artificial Sequence
  derived and/or modified sequence opt2 from KIAA0319L__Homo_sapiens__XP_011540484
auggagaagcgccucggcgucaagcccaaccccgccuccuggauccucuccggcuacuacuggcagaccuccgccaaguggcuccgcucccucuaccucuucuacaccugcuucugcuucuccguccucuggcucuccaccgacgccuccgagucccgcugccagcagggcaagacccaguucggcgucggccuccgcuccggcggcgagaaccaccucuggcuccucgagggcacccccucccuccaguccugcugggccgccugcugccaggacuccgccugccacgucuucugguggcucgagggcaugugcauccaggccgacugcucccgcccccaguccugccgcgccuuccgcacccacuccuccaacuccaugcucgucuuccucaagaaguuccagaccgccgacgaccucggcuuccuccccgaggacgacgucccccaccuccucggccucggcuggaacugggccuccuggcgccagucccccccccgcgccgcccuccgccccgccgucuccuccuccgaccagcagucccucauccgcaagcuccagaagcgcggcucccccuccgacgucgucacccccaucgucacccagcacuccaaggucaacgacuccaacgagcucggcggccucaccaccuccggcuccgccgagguccacaaggccaucaccaucuccuccccccucaccaccgaccucaccgccgagcucuccggcggccccaagaacgucuccguccagcccgagaucuccgagggccucgccaccacccccuccacccagcaggucaaguccuccgagaagacccagaucgccgucccccagcccgucgcccccuccuacuccuacgccacccccaccccccaggccuccuuccaguccaccuccgcccccuaccccgucaucaaggagcucgucgucuccgccggcgaguccguccagaucacccuccccaagaacgagguccagcucaacgccuacguccuccaggagccccccaagggcgagaccuacaccuacgacuggcagcucaucacccacccccgcgacuacuccggcgagauggagggcaagcacucccagauccucaagcucuccaagcucacccccggccucuacgaguucaaggucaucgucgagggccagaacgcccacggcgagggcuacgucaacgucaccgucaagcccgagccccgcaagaaccgcccccccaucgccaucgucuccccccaguuccaggagaucucccuccccaccaccuccaccgucaucgacggcucccaguccaccgacgacgacaagaucguccaguaccacugggaggagcucaagggcccccuccgcgaggagaagaucuccgaggacaccgccauccucaagcucuccaagcucguccccggcaacuacaccuucucccucaccgucgucgacuccgacggcgccaccaacuccaccaccgccaaccucaccgucaacaaggccgucgacuacccccccgucgccaacgccggccccaaccaggucaucacccucccccagaacuccaucacccucuucggcaaccaguccaccgacgaccacggcaucaccuccuacgaguggucccucucccccuccuccaagggcaaggucgucgagaugcagggcguccgcacccccacccuccagcucuccgccaugcaggagggcgacuacaccuaccagcucaccgucaccgacaccaucggccagcaggccaccgcccaggucaccgucaucguccagcccgagaacaacaagcccccccaggccgacgccggccccgacaaggagcucacccuccccgucgacuccaccacccucgacggcuccaaguccuccgacgaccagaagaucaucuccuaccucugggagaagacccagggccccgacggcguccagcucgagaacgccaacuccuccgucgccaccgucaccggccuccaggucggcaccuacgucuucacccucaccgucaaggacgagcgcaaccuccagucccaguccuccgucaacgucaucgucaaggaggagaucaacaagccccccaucgccaagaucaccggcaacgucgucaucacccuccccaccuccaccgccgagcucgacggcuccaaguccuccgacgacaagggcaucgucuccuaccucuggacccgcgacgagggcucccccgccgccggcgagguccucaaccacuccgaccaccaccccauccucuuccucuccaaccucgucgagggcaccuacaccuuccaccucaaggucaccgacgccaagggcgaguccgacaccgaccgcaccaccgucgaggucaagcccgacccccgcaagaacaaccucgucgagaucauccucgacaucaacgucucccagcucaccgagcgccucaagggcauguucauccgccagaucggcguccuccucggcguccucgacuccgacaucaucguccagaagauccagcccuacaccgagcagcgcaagaucuccuccgucgaggccucccucaaguga

SEQ ID NO: 45008 - RNA, 3213 nt, Artificial Sequence
  derived and/or modified sequence opt2 from KIAA0355__Homo_sapiens__NP_055501
auguacugcugcuccgcccaggacuccaagauggacuacaagcgccgcuuccuccucggcggcuccaagcagaagguccagcagcaccagcaguaccccaugcccgagcucggccgcgcccucuccgccccccucgccuccaccgccaccaccgccccccucggcucccucaccgccgccggcuccugccaccacgccaugccccacaccacccccaucgccgacauccagcagggcaucuccaaguaccucgacgcccucaacgucuucugccgcgccuccaccuuccucaccgaccucuucuccaccgucuuccgcaacucccacuacuccaaggccgccacccagcucaaggacguccaggagcacgucauggaggccgccucccgccucaccuccgccaucaagcccgagaucgccaagaugcucauggagcucuccgccggcgccgccaacuucaccgaccagaaggaguucucccuccaggacaucgagguccucggccgcugcuuccucaccgucguccagguccacuuccaguuccucacccacgcccuccagaagguccagcccgucgcccacuccugcuucgccgaggucaucguccccgagaagaagaacuccggcuccggcggcggccucuccggcaugggccacacccccgaggucgaggaggccguccgcuccuggcgcggcgccgccgaggccaccucccgccuccgcgagcgcggcugcgacggcugccucgccggcaucgagguccagcagcucuucugcucccaguccgccgccauccccgagcaccagcucaaggagcucaacaucaagaucgacuccgcccuccaggccuacaagaucgcccucgagucccucggccacugcgaguacgccaugaaggccggcuuccaccucaaccccaaggccaucgaggccucccuccagggcugcugcuccgaggccgaggcccagcagaccggccgccgccagacccccccccagcccaugcagugcgagcuccccaccguccccguccagaucggcucccacuuccucaagggcgucuccuucaacgaguccgccgccgacaaccucaagcucaagacccacaccaugcuccagcucaugaaggaggccggcugcuacaacggcaucaccucccgcgacgacuuccccgucaccgagguccucaaccaggucugccccuccaccuggcgcggcgccugcaagaccgccguccagcuccucuucggccaggccggccucgucgucgucgacaccgcccagaucgagaacaaggaggccuacgccccccagaucucccucgagggcucccgcaucgucguccagguccccuccaccuggugccucaaggaggaccccgccaccaugucccuccuccagcgcucccucgaccccgagaagacccucggccucgucgacguccucuacaccgccguccucgaccucaaccgcuggcgcgccggccgcgagcaggcccuccccugcauccagauccagcuccagcgcgagaucugcgacuucggcaaccaggccgaccuccccuccggcaacggcaacaaguccuccggcggccuccagaagaccuucuccaagcucaccucccgcuucaccaagaaggccuccugcaccuccuccuccuccuccaccaacuacuccauccagaacacccccuccaagaacaucuucaucgccggcugcuccgaggagaaggccaagaugcccggcaacaucgacacccgccuccaguccauccucaacaucggcaacuucccccgcaccaccgaccccucccaguccgcccagaacuccuccaacaccgucgccaacggcuuccucauggagcgccgcgagaacuuccuccacggcgacgacggcaaggacgagaagggcaugaaccuccccaccgaccaggagaugcaggaggucaucgacuuccucuccggcuucaacaugggccagucccaccagggcuccccccucgucacccgccacaacuccgccgccaccgccauggucaccgagcagaaggccggcgccaugcagccccagcagcccucccuccccguccccccccccccccgcgccccccaggccggcgcccacaccccccucaccccccagcccggccucgccccccagcagcagucccccaagcagcagcagccccagguccaguacuaccagcaccuccuccagcccaucggcccccagcagccccccccccagccccgcgcccccggcaaguggguccacggcuccucccagcagcccgcccaggccgucggcgccggccucuccccccucggccaguggcccggcaucuccgaccucuccuccgaccucuacucccucggccucgucuccuccuacauggacaacgucauguccgagguccucggccagaagccccagggcccccgcaacaacaccuggcccaaccgcgaccaguccgacggcgucuucggcaugcucggcgagauccuccccuucgaccccgccgucggcuccgaccccgaguucgcccgcuacgucgccggcgucucccaggccaugcagcagaagcgccaggcccagcacggccgccgccccggcaacccccgcggcaacuggccccccauggacgacgcccaccgcaccuggcccuuccccgaguucuucaccgagggcgacggccuccacggcggcugguccggcgcccagggcgacuccgccuccuccuccgacgagaccuccuccgccaacggcgacucccucuucuccauguucuccggccccgaccucgucgccgccgucaagcagcgccgcaagcacuccuccggcgagcaggacaccuccacccuccccucccccccccuccucaccaccgucgaggacgucaaccaggacaacaagaccaagaccuggccccccaaggcccccuggcagcaccccuccccccuccccuccacccuccccucccccuccgccccccucuacgccgucaccucccccggcucccaguggaacgacaccaugcagaugcuccagucccccgucugggccgccaccaacgacugcuccgccgccgccuucuccuacguccagacccccccccagcccccccccccccccgcccacaaggccgcccccaagggcuucaaggccuuccccggcaagggcgagcgccgccccgccuaccucccccaguacuga

SEQ ID NO: 45009 - RNA, 1704 nt, Artificial Sequence
  derived and/or modified sequence opt2 from KIAA0391__Homo_sapiens__NP_001243607
augaccuucuaccucuucggcauccgcuccuuccccaagcucuggaagucccccuaccucggccucggccccggccacuccuacgucucccucuuccucgccgaccgcugcggcauccgcaaccagcagcgccucuucucccucaagaccauguccccccagaacaccaaggccaccaaccucaucgccaaggcccgcuaccuccgcaaggacgagggcuccaacaagcaggucuacuccgucccccacuucuuccucgccggcgccgccaaggagcgcucccagaugaacucccagaccgaggaccacgcccucgcccccguccgcaacaccauccagcuccccacccagccccucaacuccgaggagugggacaagcucaaggaggaccucaaggagaacaccggcaagaccuccuucgaguccuggaucaucucccagauggccggcugccacuccuccaucgacgucgccaagucccuccucgccugggucgccgccaagaacaacggcaucgucuccuacgaccuccucgucaaguaccucuaccucugcgucuuccacaugcagaccuccgaggucaucgacgucuucgagaucaugaaggcccgcuacaagacccucgagccccgcggcuacucccuccucauccgcggccucauccacuccgaccgcuggcgcgaggcccuccuccuccucgaggacaucaagaaggucaucacccccuccaagaagaacuacaacgacugcauccagggcgcccuccuccaccaggacgucaacaccgccuggaaccucuaccaggagcuccucggccacgacaucguccccaugcucgagacccucaaggccuucuucgacuucggcaaggacaucaaggacgacaacuacuccaacaagcuccucgacauccucuccuaccuccgcaacaaccagcucuaccccggcgaguccuucgcccacuccaucaagaccugguucgaguccggccagugcuccggcugcggcaagaccaucgaguccauccagcucucccccgaggaguacgagugccucaagggcaagaucaugcgcgacgucaucgacggcggcgaccaguaccgcaagaccaccccccaggagcucaagcgcuucgagaacuucaucaagucccgcccccccuucgacgucgucaucgacggccucaacgucgccaagauguuccccaagguccgcgagucccagcuccuccucaacgucgucucccagcucgccaagcgcaaccuccgccuccucguccucggccgcaagcacaugcuccgccgcuccucccaguggucccgcgacgagauggaggagguccagaagcaggccuccugcuucuucgccgacgacaucuccgaggacgaccccuuccuccucuacgccacccuccacuccggcaaccacugccgcuucaucacccgcgaccucaugcgcgaccacaaggccugccuccccgacgccaagacccagcgccucuucuucaaguggcagcagggccaccagcucgccaucgucaaccgcuuccccggcuccaagcucaccuuccagcgcauccucuccuacgacaccgucguccagaccaccggcgacuccuggcacauccccuacgacgaggaccucgucgagcgcugcuccugcgagguccccaccaaguggcucugccuccaccagaagaccuga

SEQ ID NO: 45010 - RNA, 4935 nt, Artificial Sequence
  derived and/or modified sequence opt2 from KIAA0586__Homo_sapiens__NP_001231118
auguucuggugcggcaccugcuucgucaccaacaacaugaagggcuccgaggucucccucgagaagaagaagaagaucaagaugcccgucaagcgccuccgcgaggucgucucccagaaccacggcgaccaccucguccuccucaaggacgagcuccccugcgucccccccgcccucuccgccaacaagcgccuccccgucggcaccggcaccucccucaacggcaccucccgcggcuccuccgaccucaccuccgcccgcaacugcuaccagccccuccucgagaaccccauggucuccgaguccgacuucuccaaggacgucgccguccagguccucccccucgacaagaucgaggagaacaacaagcagaaggccaacgacaucuucaucucccaguacaccaugggccagaaggacgcccuccgcaccguccucaagcagaacgucucccucugccucaccggcugguccgaccacuccggcgucaucaccacccacugcucccucuaccuccuccgccucaugcgcuccucccaccucucccuccccuccuccugggacuaccgcgcccaguccaugcccgucuucaaggaggucaagguccaccuccucgaggacgccggcaucgagaaggacgccgucacccaggagacccgcaucucccccuccggcaucgacuccgccaccaccgucgccgccgccaccgccgccgccaucgccaccgccgccccccucaucaagguccaguccgaccucgaggccaaggucaacuccgucaccgagcuccucuccaagcuccaggagaccgacaagcaccuccagcgcgucaccgagcagcagaccuccauccagcgcaagcaggagaagcuccacugccacgaccacgagaagcagaugaacgucuucauggagcagcacauccgccaccucgagaagcuccagcagcagcagaucgacauccagacccacuucaucuccgccgcccucaagaccuccuccuuccagcccgucuccaugcccuccucccgcgccgucgagaaguacuccgucaagcccgagcaccccaaccucggcuccugcaaccccucccucuacaacaccuucgccuccaagcaggccccccucaaggaggucgaggacaccuccuucgacaagcagaaguccccccucgagacccccgccccccgccgcuucgcccccguccccgucucccgcgacgacgagcucuccaagcgcgagaaccuccucgaggagaaggagaacauggaggucuccugccaccgcggcaacguccgccuccucgagcagauccucaacaacaacgacucccucacccgcaaguccgaguccuccaacaccaccucccucacccgcuccaagaucggcuggacccccgagaagaccaaccgcuuccccuccugcgaggagcucgagaccaccaaggucaccaugcagaaguccgacgacguccuccacgaccucggccagaaggagaaggagaccaacuccaugguccagcccaaggagucccucuccaugcucaagcuccccgaccucccccagaacuccgucaagcuccagaccaccaacaccacccgcuccguccucaaggacgccgagaagauccuccgcggcguccagaacaacaagaagguccucgaggagaaccucgaggccaucauccgcgccaaggacggcgccgccauguacucccucaucaacgcccucuccaccaaccgcgagauguccgagaagauccgcauccgcaagaccgucgacgaguggaucaagaccaucuccgccgagauccaggacgagcucucccgcaccgacuacgagcagaagcgcuucgaccagaagaaccagcgcaccaagaagggccagaacaugaccaaggacauccgcaccaacacccaggacaagaccgucaacaaguccgucaucccccgcaagcacucccagaagcagaucgaggagcacuuccgcaaccuccccaugcgcggcaugcccgccuccucccuccagaaggagcgcaaggagggccuccucaaggccaccaccgucauccaggacgaggacuacaugcuccaggucuacggcaagcccgucuaccagggccaccgcuccacccucaagaagggccccuaccuccgcuucaacucccccucccccaagucccgcccccagcgccccaaggucaucgagcgcgucaagggcaccaaggucaaguccauccgcacccagaccgacuucuacgccaccaagcccaagaagauggacuccaagaugaagcacuccguccccguccucccccacggcgaccagcaguaccucuucucccccucccgcgagaugcccaccuucuccggcacccucgagggccaccucauccccauggccauccuccucggccagacccaguccaacuccgacaccaugccccccgccggcgucaucgucuccaagccccaccccgucaccgucaccaccuccaucccccccuccucccgcaaggucgagaccggcgucaagaagcccaacaucgccaucgucgagaugaaguccgagaagaaggaccccccccagcucaccguccagguccuccccuccgucgacaucgacuccaucuccaacuccuccgccgacguccucuccccccucuccucccccaaggaggccucccucccccccguccagaccuggaucaagacccccgagaucaugaaggucgacgaggaggaggucaaguuccccggcaccaacuucgacgagaucaucgacgucauccaggaggaggagaagugcgacgagauccccgacuccgagcccauccucgaguucaaccgcuccgucaaggccgacuccaccaaguacaacggcccccccuucccccccgucgccuccaccuuccagcccaccgccgacauccucgacaaggucaucgagcgcaaggagacccucgagaacucccucauccagugggucgagcaggagaucaugucccgcaucaucuccggccucuuccccguccagcagcagaucgcccccuccaucuccgucuccgucuccgagaccuccgagccccucaccuccgacaucgucgagggcaccuccuccggcgcccuccagcucuucgucgacgccggcguccccgucaacuccaacgucaucaagcacuucgucaacgaggcccucgccgagaccaucgccgucaugcucggcgaccgcgaggccaagaagcagggccccgucgccaccggcgucuccggcgacgccuccaccaacgagaccuaccuccccgcccgcgucugcaccccccuccccaccccccagcccaccccccccugcucccccuccucccccgccaaggagugcguccucgucaagacccccgacuccucccccugcgacuccgaccacgacauggccuuccccgucaaggagaucugcgccgagaagggcgacgacaugcccgccaucaugcucgucaacacccccaccgucacccccaccaccacccccccccccgccgccgccgucuucacccccacccucuccgacaucuccaucgacaagcucaaggucuccucccccgagcuccccaagcccuggggcgacggcgaccucccccucgaggaggagaaccccaacuccccccaggaggagcuccacccccgcgccaucgucauguccgucgccaaggacgaggagcccgaguccauggacuuccccgcccagccccccccccccgagcccguccccuucaugcccuuccccgccggcaccaaggcccccucccccucccagaugcccggcuccgacuccuccacccucgaguccacccucuccgucaccgucaccgagaccgagacccucgacaagcccaucuccgagggcgagauccucuucuccugcggccagaagcucgcccccaagauccucgaggacaucggccucuaccucaccaaccucaacgacucccucuccuccacccuccacgacgccgucgagauggaggacgacccccccuccgagggccaggucauccgcaugucccacaagaaguuccacgccgacgccauccucuccuucgccaagcagaaccaggaguccgccgucucccagcaggccgucuaccacuccgaggaccucgagaacuccgucggcgagcucuccgagggccagcgcccccagcucaccgccgccgccgagaacauccucaugggccacucccucuacaugcagccccccgucaccaacacccagucccucgaccagcagugcgaccccaagccccucucccgccaguucgacaccgucuccggcuccaucuacgaggacuccugcgccucccacggccccaugucccucggcgagcucgagcucgagcccaacuccaagcucguccuccccaccacccuccucaccgcccaggagaacgacgucaaccuccccgucgccgccgaggacuucucccaguaccagcucaagcagaaccaggacgucaagcaggucgagcacaagcccucccaguccuaccuccgcguccgcaacaaguccgacaucgcccccucccagcagcaggucucccccggcgacauggaccgcacccagaucgagcucaaccccuaccucaccugcgucuucuccggccucggcguccacgucaagaaggucuccugcaucggcaagcucggccucuggcgcuucgucauccagaucaucuccuccccccgcugggaguccuccgccacccuccgcuucaccgacgcccccugccaggacgucuccgacgccgccgucuccgagccccgcggccuccucuccgucuccgagucccagcacaacgccggcggccacggcgucuucggcggccgcuaccuccucaacggcaagcgccagcccgcccagugccucugccacugguucuga

SEQ ID NO: 45011 - RNA, 3828 nt, Artificial Sequence
  derived and/or modified sequence opt2 from KIAA0825__Homo_sapiens__NP_001139150
auggacugggacgacgaguacucccacaacuccuucgaccuccacugccuccucaacuccuuccccggcgaccucgaguucgagcagaucuucuccgacaucgacgagaagaucgagcagaacgccgccuccaucaagcacugcaucaaggagauccaguccgagaucaacaagcagugccccggcguccagcuccagaccaccaccgacugcuucgaguggcucaccaacuacaacuacuccaccuccgaguccuccuucaucucccacggcgaccucaucaaguucuucaagacccuccaggaccuccucaagaacgagcagaaccaggaggagaugacccucgaccuccucugggaccucuccugccacuccuccgucuccuuccccuccacccucuccggcaccuccuuccacuuccucucccgcaccucccuccacuccgucgaggacaacuccuccauggacgucaaguccaugugggacgacauccgccuccaccuccgccgcuuccucgucuccaagcuccagucccacaacgagaucaacaacucccagcagaagauccuccucaagaagcagugccuccagcagcuccucuuccucuaccccgaguccgaggucaucaucaaguaccagaacauccagaacaagcuccucgccaaccuccucuggaacugcuuccccuccuacaaccgcgacuccaaccucgacgucaucgcccacggcuaccaguccaccaugcucaagcucuacuccgucaucaaggaggacuucaacacccucugcgagauccucgcccccuccuccauggucaaguucaucaaggagaccuaccucgacaccgucaccgaggagauggccaaguuccucgagaacuucugcgagcuccaguuccgcgagaacgccguccgcgucgucaagaccuccaaguccuccuccaagcaccgcggcgccguccacgcccucgucaccaccgagugcccccagaagggccgcaacuucucccucccccucgacaaggucgaguuccucucccagcucaucaaguccuucaugaagcucgagaagggcguccaggagcucuucgacgagauccuccucucccucaagaucacccgcgacaccuccggcauccucgagaaguccgaccgcgaggucgucauggagaagccccgcgccaacgagaccaacauccccuccgagcagucccuccccggcaaggaggccacccuccucgacuucggcuggcgcuccgccuucaaggaggucucccuccccauggcccacugcgucgucaccgccaucgagggcuucuccaccaagauccuccagcaggagcagaacgagcgcuccuccgccgucuccuacgccaugaaccucgucaacguccagcaggucuggcaggacucccacauguuccccgaggaggagcagcccaagaagaucggcaaguucugcuccgacaucauggagaagcucgacaccaugcucccccucgcccucgccugccgcgacgacuccuuccaggagauccgcgccaaccucgucgaggccugcugcaaggucgccaccgccguccuccagcgccuccaggagcgcgccaaggagguccccuccaaggccccccucaagaaccuccacaccuaccucuccaccgccgucuacgucuuccagcacuucaagcgcuacgacaaccucaugaaggagaugaccaagaagcccaucuuccucguccucguccagcgcuaccaggaguucaucaacacccuccaguuccaggucaccaacuacugcguccgcgucugcgccaccuccauccuccaggacgccgagucccaccacugggacgacuacaaggccuucuacgagggcgagcgcugcuccuucuccauccagauguggcacuacuucugcuggucccuccacuacgaccucuggaccauccucccccccaagcucgcccaggagauccucgucgagguccucgagaagucccucucccuccucgccucccgcuacgcccgcgcccaccccucccgcaagcgcaccccccagcuccgccucgacgucaccaccauccucaucugcaccgagaacaugcucugguccgucugcaccuccguccagaagcuccucaacccccaccagcacaccgacgacaagaucuucaagauccacacccacugcaacaaccucuucaccacccucgucauccucaccuccccccucaccgagcucuacaagaccuuccagcacggccucgacgaguccgccuccgacucccucaaguccuucuucaagcagccccucuacugggucuccugcaucucccacuucuaccccucccuccuccgcacccccuccgccggcggccucaaggccgagggccagcucaagcuccuccucucccagccccgcugcaacuggaaccuccuccucgagacccuccuccaccacgacggccuccuccuccgcauccuccucaaguccuccaagcaggucuccgacaccgagaacaaccucaaccagggccccucccucauggaggccaucuucaagauccucuaccacugcuccuucuccccccagaccuucgccaacgucuucgucuccuacauggaggaggagcagcucugggacuuccucuacaacauccccgucuccaccugcgucgaguacgagcucgaggucauccgcugccuccgccucgcccucaccgacgccaucaaggacaccguccagcagaucgucuccgucauguccucccgccgcaacugcgagaccaaccucaacaagcacaucguccccgacugccuccucgaguccaugcccaaggaguggaacuacucccccaaggagaccaaccgcaaggaguccugcaaguccuucacccgccucaccgcccaggccgucuccaucgucaucuccaagcuccccaccgucaucgccugccuccccccccccgucaaguacuucuucuuccucuccgagcgcaagauguccaagaaguucgucgagcucaagaaggccggccuccucgucuggaaccucaucgucaucaucugccgcaucuucgaggacggcaacaccgucgagcuccucaccggcgccucccucgaccgcugguccaaggagaagcucggccucaucugcaugugccucaaguccaucaugggcgaccagaccuccauccacaaccagaugauccagaaggucauccaguccaucgagcagcagaagcccaacuggaucgagcgccagcuccucaaggcccgcaagcucuccaccgagugcgccuucaugaccaucgagaaguccaccgcccuccaggagggcgacgucgcccucgagcucaccgagcagaagaucaacaccaugguccucgaccucugccacaagcccggcggccgcgaguaccuccgccagaucuaccacaucaugcagcucaacgaggaguaccucaaggagcagcucuucuccaugaacuccuccgaggagaagccccuccccauccgcccccucaagaccacccuccgcuccaucgaggaccagcccuccgccuucaaccccuuccacgucuacaaggccuucuccgagaacaugcucgaccaggucuccaucaccaaguggaacuggaacugggccaagcuccuccccaacuaccuccgccucgacaagaugaccuucuccguccuccucaagaaccgcugggagaugaagaaggacgagacccucgaggaggaggagaaggccauccucgagcaccucaagcagaucugcaccccccagaacuccuccgccuccgacaacaucgaggagcaguga

SEQ ID NO: 45012 - RNA, 1845 nt, Artificial Sequence
  derived and/or modified sequence opt2 from KIAA0907__Homo_sapiens__NP_055764
auguccgccggcuccgccacccaccccggcgccggcggccgccgcuccaagugggaccagcccgcccccgccccccuccucuuccucccccccgccgcccccggcggcgaggucaccuccuccggcggcucccccggcggcaccaccgccgcccccuccggcgcccucgacgccgccgccgccgucgccgccaagaucaacgccaugcucauggccaagggcaagcucaagcccacccagaacgccuccgagaagcuccaggcccccggcaagggccucaccuccaacaaguccaaggacgaccucgucgucgccgaggucgagaucaacgacgucccccucaccugccgcaaccuccucacccgcggccagacccaggacgagaucucccgccucuccggcgccgccgucuccacccgcggccgcuucaugaccaccgaggagaaggccaaggucggccccggcgaccgcccccucuaccuccacguccagggccagacccgcgagcucgucgaccgcgccgucaaccgcaucaaggagaucaucaccaacggcgucgucaaggccgccaccggcaccucccccaccuucaacggcgccaccgucaccgucuaccaccagcccgcccccaucgcccagcucucccccgccgucucccagaagccccccuuccaguccggcaugcacuacguccaggacaagcucuucgucggccucgagcacgccguccccaccuucaacgucaaggagaaggucgagggccccggcugcuccuaccuccagcacauccagaucgagaccggcgccaaggucuuccuccgcggcaagggcuccggcugcaucgagcccgccuccggccgcgaggccuucgagcccauguacaucuacaucucccaccccaagcccgagggccucgccgccgccaagaagcucugcgagaaccuccuccagaccguccacgccgaguacucccgcuucgucaaccagaucaacaccgccgucccccuccccggcuacacccagcccuccgccaucuccuccguccccccccagccccccuacuaccccuccaacggcuaccaguccggcuaccccgucgucccccccccccagcagcccguccagccccccuacggcguccccuccaucgucccccccgccgucucccucgcccccggcguccuccccgcccuccccaccggcgucccccccguccccacccaguaccccaucacccagguccagccccccgccuccaccggccagucccccaugggcggccccuucauccccgccgcccccgucaagaccgcccuccccgccggcccccagccccagccccagccccagcccccccuccccucccagccccaggcccagaagcgccgcuucaccgaggagcuccccgacgagcgcgaguccggccuccucggcuaccagcacggccccauccacaugaccaaccucggcaccggcuucuccucccagaacgagaucgagggcgccggcuccaagcccgccuccuccuccggcaaggagcgcgagcgcgaccgccagcucaugcccccccccgccuuccccgucaccggcaucaagaccgaguccgacgagcgcaacggcuccggcacccucaccggcucccacgacuaccccgccaagaagaugaagaccaccgagaagggcuucggccucgucgccuacgccgccgacuccuccgacgaggaggaggagcacggcggccacaagaacgccuccuccuucccccagggcuggucccucggcuaccaguaccccuccucccagccccgcgccaagcagcagaugcccuucuggauggcccccuga

SEQ ID NO: 45013 - RNA, 4833 nt, Artificial Sequence
  derived and/or modified sequence opt2 from KIAA0922__Homo_sapiens__NP_001124479
auggccggccuccgccgcccccagcccggcugcuacugccgcaccgccgccgccgucaaccuccuccucggcgucuuccagguccuccuccccugcugccgccccggcggcgcccagggccaggccaucgagccccuccccaacgucgucgagcucuggcaggccgaggagggcgagcuccuccuccccacccagggcgacuccgaggagggccucgaggagcccucccaggagcaguccuucuccgacaagcucuucuccggcaagggccuccacuuccagcccuccguccucgacuucggcauccaguuccucggccaccccgucgccaagauccuccacgccuacaaccccucccgcgacuccgaggucgucgucaacuccgucuucgccgccgccggccacuuccacgucccccccguccccugccgcgucauccccgccaugggcaagaccuccuuccgcaucaucuuccuccccaccgaggagggcuccaucgaguccucccucuucaucaacaccuccuccuacggcguccucuccuaccacgucuccggcaucggcacccgccgcaucuccaccgagggcuccgccaagcagcuccccaacgccuacuuccuccuccccaagguccaguccauccagcucucccagaugcaggccgagaccaccaacaccucccuccuccagguccagcucgagugcucccuccacaacaaggucugccagcagcucaagggcugcuaccucgaguccgacgacguccuccgccuccagauguccaucauggucaccauggagaacuucuccaaggaguucgaggagaacacccagcaccuccucgaccaccucuccaucgucuacgucgccaccgacgaguccgagaccuccgacgacuccgccgucaacauguacauccuccacuccggcaacucccucaucuggauccaggacauccgccacuucucccagcgcgacgcccucucccuccaguucgagcccguccuccuccccaccuccaccaccaacuucaccaagaucgccuccuucaccugcaaggccgccaccuccugcgacuccggcaucaucgaggacgucaagaagaccacccacacccccacccucaaggccugccucuucuccuccgucgcccagggcuacuuccgcauggacuccuccgccacccaguuccacaucgagacccacgagaacaccuccggccucugguccaucugguaccgcaaccacuucgaccgcuccgucguccucaacgacgucuuccucuccaaggagaccaagcacaugcucaagauccucaacuucaccggcccccucuuccucccccccggcugcuggaacaucuucucccucaagcucgccgucaaggacaucgccaucaaccucuucaccaacgucuuccucaccaccaacaucggcgccaucuucgccaucccccuccagaucuacuccgcccccaccaaggagggcucccucggcuucgaggucaucgcccacugcggcaugcacuacuucaugggcaaguccaaggccggcaaccccaacuggaacggcucccucucccucgaccaguccaccuggaacgucgacuccgagcucgccaacaagcucuacgagcgcuggaagaaguacaagaacggcgacgucugcaagcgcaacguccucggcaccacccgcuucgcccaccucaagaaguccaaggaguccgaguccuucgucuucuuccucccccgccucaucgccgagcccggccucaugcucaacuucuccgccaccgcccuccgcucccgcaugaucaaguacuucgucguccagaaccccuccuccuggcccgucucccuccagcuccucccccucucccucuaccccaagcccgaggcccucguccaccuccuccaccgcugguucggcaccgacaugcagaugaucaacuucaccaccggcgaguuccagcucaccgaggccugccccuaccucggcacccacuccgaggagucccgcuucggcauccuccaccuccaccuccagccccucgagaugaagcgcgucggcgucgucuucacccccgccgacuacggcaaggucaccucccucauccucauccgcaacaaccucaccgucaucgacaugaucggcgucgagggcuucggcgcccgcgagcuccucaaggucggcggccgccuccccggcgccggcggcucccuccgcuucaagguccccgaguccacccucauggacugccgccgccagcucaaggacuccaagcagauccucuccaucaccaagaacuucaaggucgagaacaucggcccccuccccaucaccgucuccucccucaagaucaacggcuacaacugccagggcuacggcuucgagguccucgacugccaccaguucucccucgaccccaacaccucccgcgacaucuccaucgucuucacccccgacuucaccuccuccugggucauccgcgaccucucccucgucaccgccgccgaccucgaguuccgcuucacccucaacgucacccucccccaccaccuccucccccucugcgccgacgucguccccggccccuccugggaggaguccuucuggcgccucaccgucuucuucgucucccucucccuccucggcgucauccucaucgccuuccagcaggcccaguacauccucauggaguucaugaagacccgccagcgccagaacgccuccuccuccucccagcagaacaacggccccauggacgucaucuccccccacuccuacaaguccaacugcaagaacuuccucgacaccuacggccccuccgacaagggccgcggcaagaacugccuccccgucaacaccccccagucccgcauccagaacgccgccaagcgcucccccgccaccuacggccacucccagaagaagcacaagugcuccgucuacuacuccaagcacaagaccuccaccgccgccgccuccuccaccuccaccaccaccgaggagaagcagaccuccccccucggcuccucccuccccgccgccaaggaggacaucugcaccgacgccaugcgcgagaacuggaucucccuccgcuacgccuccggcaucaacgucaaccuccagaagaaccucacccuccccaagaaccuccucaacaaggaggagaacacccucaagaacaccaucgucuucuccaaccccuccuccgagugcuccaugaaggagggcauccagaccugcauguuccccaaggagaccgacaucaagaccuccgagaacaccgccgaguucaaggagcgcgagcucugcccccucaagaccuccaagaagcuccccgagaaccaccucccccgcaacuccccccaguaccaccagcccgaccuccccgagaucucccgcaagaacaacggcaacaaccagcagguccccgucaagaacgaggucgaccacugcgagaaccucaagaaggucgacaccaagcccuccuccgagaagaagauccacaagaccucccgcgaggacauguucuccgagaagcaggacauccccuucgucgagcaggaggaccccuaccgcaagaagaagcuccaggagaagcgcgagggcaaccuccagaaccucaacugguccaagucccgcaccugccgcaagaacaagaagcgcggcgucgcccccgucucccgcccccccgagcaguccgaccucaagcucgucugcuccgacuucgagcgcuccgagcucuccuccgacaucaacguccgcuccuggugcauccaggaguccacccgcgaggucugcaaggccgacgccgagaucgccuccucccuccccgccgcccagcgcgaggccgagggcuacuaccagaagcccgagaagaagugcgucgacaaguucugcuccgacuccuccuccgacugcggcuccuccuccggcuccguccgcgccucccgcggcuccuggggcuccugguccuccaccuccuccuccgacggcgacaagaagcccauggucgacgcccagcacuuccuccccgccggcgacuccgucucccagaacgacuuccccuccgaggcccccaucucccucaaccucucccacaacaucugcaaccccaugaccgucaacucccucccccaguacgccgagcccuccugccccucccuccccgccggccccaccggcgucgaggaggacaagggccucuacucccccggcgaccucuggcccaccccccccgucugcgucaccuccucccucaacugcacccucgagaacggcguccccugcgucauccaggaguccgcccccguccacaacuccuucaucgacugguccgccaccugcgagggccaguucuccuccgccuacugcccccucgagcucaacgacuacaacgccuuccccgaggagaacaugaacuacgccaacggcuuccccugccccgccgacguccagaccgacuucaucgaccacaacucccaguccaccuggaacaccccccccaacaugcccgccgccuggggccacgccuccuucaucuccuccccccccuaccucaccuccacccgcucccucucccccauguccggccucuucggcuccaucugggccccccaguccgacgucuacgagaacugcugccccaucaaccccaccaccgagcacuccacccacauggagaaccaggccgucgucugcaaggaguacuaccccggcuucaaccccuuccgcgccuacaugaaccucgacaucuggaccaccaccgccaaccgcaacgccaacuucccccucucccgcgacuccuccuacugcggcaacgucuga

SEQ ID NO: 45014 - RNA, 2751 nt, Artificial Sequence
  derived and/or modified sequence opt2 from KIAA1024__Homo_sapiens__NP_056021
auggagaccucccaggagaccucccucuuccucgucaagauccucgaggagcucgacuccaagcagaacaccgucuccuaccaggaccucugcaagucccucugcgcccgcuucgaccucucccagcucgccaagcuccgcuccguccucuucuacaccgccugccucgaccccaacuuccccgccacccucuucaaggacaagaugaagugcaccgucaacaaccagcaguccaagaagaucauggucgccgccgacaucgucaccaucuucaaccucauccagaugaacggcggcgccgccaaggagaagcuccccaccggccgccagaagguccgcaagaaggaggccuccuucgaguccugccgcuccgacaccgagaucugcaacgccgccgagugcgagccccucaacugcgagcucuccgagcgcuccuucucccgcggcuaccccauccgccaguccuccaagugccgcaagauggacugcaaggacugcccccaguucguccccgccuccgagcccaacuuccuccucggcgucuccaaggaggucaagaaccgcgccgccucccucgaccgccuccaggcccucgcccccuacuccgucaccuccccccagcccugcgagaugcagcgcaccuacuuccccaugaacaucgagaacgaguccaucuccgaccaggacucccuccccaucaaccaguccaucaaggagaccuucaucuccaacgaggagcccuucgucguccaguccugcguccagaagcgcaacaucuucaaggaggacuuccacaaccucauggccgucucccccucccucgucggccccaucuccaaggccgagaacgagcaccgcgagccccagucccgcaaggagccccacaagccccccuucuucaaccacuccuucgagaugcccuacaacucccaguaccucaaccccgucuacucccccguccccgacaagcgccgcgccaagcacgagucccucgacgaccuccaggccuccaccuacuucggccccacccccgucaugggcacccaggaggcccgccgcugccucggcaagcccaacaagcagacccccuggcccgccaaguccuggucccucaacaccgaggagguccccgacuucgagcgcuccuucuucaaccgcaaccccuccgaggagaagcuccacuaccccaacgccuccucccagacccccaacuuccccgcccccgagcgccgccccaccuaccucguccccaaggaccagcagcccauccuccccaucgccuacgccgccaagcagaacggccucaaguccaaggagaucuccucccccgucgaccucgagaagcacgagcccgucaagaaguucaaggacaaguccaucaacugcaccuccggccagcucuccuccgacaccuccuccgucggcacccagaccgagcacguccucgagcccaagaagugccgcgaccucugcaccuccggccagggcaaguacuccgaccgccacaccaugaagcacuccgacgacgacuccgagaucgucuccgacgacaucuccgacaucuuccgcuuccucgacgacauguccaucuccggcuccaccggcgucauccaguccuccugcuacaacuccaccggcucccucucccagcuccacaaguccgacugcgacuccucccccgagcacaaccucaccaagaucgccaacggcguccccaacuccaagggcgacaagggcaaccgccccgagaacacccaccacuccgaggaggagcucaagaccuccgucugcaagcucguccuccgcaucggcgagaucgagcgcaagcucgagucccucuccggcguccgcgacgagaucucccagguccucggcaagcucaacaagcucgaccagaagaugcagcagcccgagaaggucuccguccagaucgaccucaacucccucaccuccgagggccccuccgacgacuccgccuccccccgcauguuccacgcccacuccggcucccacggccccaagcucgagaacaaccccgacuggugcugcuccgacgccuccggcuccaacuccgagucccuccgcgucaaggcccucaagaagucccucuucacccgccccuccucccgcucccucaccgaggagaacuccgccaccgaguccaagaucgccuccaucuccaacuccccccgcgacuggcgcaccaucaccuacaccaaccgcgucggccucaacgaggaggagaucaaggacaccggccccggcgacaacaaggacuggcaccgcaaguccaaggaggccgaccgccaguacgacauccccccccagcaccgccuccccaagcagcccaaggacggcuuccucgucgagcaggucuucuccccccaccccuaccccgccucccucaaggcccacaugaaguccaacccccucuacaccgacaugcgccucaccgagcucgccgaggucaagcgcggccagcccuccuggaccaucgaggaguacgcccgcaacgccggcgacaagggcaagcucaccgcccucgaccuccagacccaggagucccucaaccccaacaaccucgaguacuggauggaggacaucuacacccccggcuacgacucccuccucaagcgcaaggaggccgaguuccgccgcgccaaggucugcaagaucgccgcccucaucgccgccgccgccugcaccgucauccucgucaucgucguccccaucugcaccaugaaguccuga

SEQ ID NO: 45015 - RNA, 3522 nt, Artificial Sequence
  derived and/or modified sequence opt2 from KIAA1033__Homo_sapiens__NP_056090
auggccgucgagacccucucccccgacugggaguucgaccgcgucgacgacggcucccagaagauccacgccgagguccagcucaagaacuacggcaaguuccucgaggaguacaccucccagcuccgccgcaucgaggacgcccucgacgacuccaucggcgacgucugggacuucaaccucgaccccaucgcccucaagcuccuccccuacgagcaguccucccuccucgagcucaucaagaccgagaacaagguccucaacaaggucaucaccgucuacgccgcccucugcugcgagaucaagaagcucaaguacgaggccgagaccaaguucuacaacggccuccucuucuacggcgagggcgccaccgacgccuccauggucgagggcgacugccagauccagaugggccgcuucaucuccuuccuccaggagcucuccugcuucgucacccgcugcuacgaggucgucaugaacgucguccaccagcucgccgcccucuacaucuccaacaagaucgcccccaagaucaucgagaccaccggcguccacuuccagaccauguacgagcaccucggcgagcuccucaccguccuccucacccucgacgagaucaucgacaaccacaucacccucaaggaccacuggaccauguacaagcgccuccucaaguccguccaccacaaccccuccaaguucggcauccaggaggagaagcucaagcccuucgagaaguuccuccucaagcucgagggccagcuccucgacggcaugaucuuccaggccugcaucgagcagcaguucgacucccucaacggcggcgucuccgucuccaagaacuccaccuucgccgaggaguucgcccacuccauccgcuccaucuucgccaacgucgaggccaagcucggcgagcccuccgagaucgaccagcgcgacaaguacgucggcaucugcggccucuucguccuccacuuccagaucuuccgcaccaucgacaagaaguucuacaagucccuccucgacaucugcaagaagguccccgccaucacccucaccgccaacaucaucugguuccccgacaacuuccucauccagaagauccccgccgccgccaagcuccucgaccgcaagucccuccaggccaucaagauccaccgcgacaccuuccuccagcagaaggcccagucccucaccaaggacguccaguccuacuacgucuucgucuccuccuggaugaugaagauggaguccauccucuccaaggagcagcgcauggacaaguucgccgaggaccucaccaaccgcugcaacgucuucauccagggcuuccucuacgccuacuccaucuccaccaucaucaagaccaccaugaaccucuacauguccaugcagaagcccaugaccaagaccuccgucaaggcccucugccgccucgucgagcuccucaaggccaucgagcacauguucuaccgccgcuccauggucgucgccgacuccgucucccacaucacccagcaccuccagcaccaggcccuccacuccaucuccgucgccaagaagcgcgucaucuccgacaagaaguacuccgagcagcgccucgacguccucuccgcccucguccucgccgagaacacccucaacggccccuccaccaagcagcgccgccucaucgucucccucgcccucuccgucggcacccagaugaagaccuucaaggacgaggagcucuucccccuccaggucgucaugaagaagcucgaccucaucuccgagcuccgcgagcgcguccagacccagugcgacugcugcuuccucuacuggcaccgcgccgucuuccccaucuaccucgacgacgucuacgagaacgccgucgacgccgcccgccuccacuacauguucuccgcccuccgcgacugcguccccgccaugaugcacgcccgccaccucgaguccuacgagauccuccucgacugcuacgacaaggagaucauggagauccucaacgagcaccuccucgacaagcucugcaaggagaucgagaaggaccuccgccucuccguccacacccaccucaagcucgacgaccgcaaccccuucaaggucggcaugaaggaccucgcccucuucuucucccucaaccccauccgcuucuucaaccgcuucaucgacauccgcgccuacgucacccacuaccucgacaagaccuucuacaaccucaccaccgucgcccuccacgacugggccaccuacuccgagaugcgcaaccucgccacccagcgcuacggccucgucaugaccgaggcccaccuccccucccagacccucgagcagggccucgacguccucgagaucaugcgcaacauccacaucuucgucucccgcuaccucuacaaccucaacaaccagaucuucaucgagcgcaccuccaacaacaagcaccucaacaccaucaacauccgccacaucgccaacuccauccgcacccacggcaccggcaucaugaacaccaccgucaacuucaccuaccaguuccucaagaagaaguucuacaucuucucccaguucauguacgacgagcacaucaagucccgccucaucaaggacauccgcuucuuccgcgagaucaaggaccagaacgaccacaaguaccccuucgaccgcgccgagaaguucaaccgcggcauccgcaagcucggcgucacccccgagggccaguccuaccucgaccaguuccgccagcucaucucccagaucggcaacgccaugggcuacguccgcaugauccgcuccggcggccuccacugcuccuccaacgccauccgcuucguccccgaccucgaggacaucgucaacuucgaggagcucgucaaggaggagggccucgccgaggagacccucaaggccgcccgccaccucgacuccguccucuccgaccacacccgcaacuccgccgagggcaccgaguacuucaagaugcucgucgacgucuucgcccccgaguuccgccgccccaagaacauccaccuccgcaacuucuacaucaucguccccccccucacccucaacuucgucgagcacuccaucuccugcaaggagaagcucaacaagaagaacaagaucggcgccgccuucaccgacgacggcuucgccaugggcgucgccuacauccucaagcuccucgaccaguaccgcgaguucgacucccuccacugguuccaguccguccgcgagaaguaccucaaggagauccgcgccgucgccaagcagcagaacguccaguccgccucccaggacgagaagcuccuccagaccaugaaccucacccagaagcgccucgacgucuaccuccaggaguucgagcuccucuacuucucccucuccuccgcccgcaucuucuuccgcgccgacaagaccgccgccgaggagaaccaggagaagaaggagaaggaggaggagaccaagaccuccaacggcgaccucuccgacuccaccgucuccgccgaccccgucgucaaguga

SEQ ID NO: 45016 - RNA, 15018 nt, Artificial Sequence
  derived and/or modified sequence opt2 from KIAA1109__Homo_sapiens__XP_005263344
auggaccagcgcaagaacgaguccaucguccccuccaucacccagcucgaggacuuccucaccgagcacaacuccaacgucgucuggcuccucgucgccaccauccucuccugcggcuggaucaucuaccucaccuacuacaacucccgcaacgucggccucauccucacccucguccucaaccgccucuacaagcacggcuacauccacaucggcuccuucuccuucuccguccucuccggcaaggucaugguccgcgagaucuacuacaucaccgaggacauguccauccgcauccaggacggcuucaucaucuuccgcugguggaagauguacaaccccaagcagaagcagcacgaccccaaggccgagacccgccucuacaucaccgucaacgacuucgaguuccacgucuacaaccgcuccgaccucuacggccgccuccaggagcucuucggccucgagcccaccaucaucccccccaagaaggacgacgacaagacccgcgagaucggccgcacccgcacccaguccaagaucgagcgcgucaaggucaagaccgagucccaggaccccaccuccuccuggcgcucccucauccccgucaucaaggucaacgucuccaccggccgccucgccuucggcaaccacuaccagccccagacccucugcaucaacuucgacgacgccuuccucaccuacaccaccaagccccccuccucccaccucgaccaguucaugcacaucgucaagggcaagcucgagaacguccgcgucaugcucguccccuccccccgcuacgucggccuccagaacgacgagcccccccgccucaugggcgagggcuucgucgucaugcaguccaacgacgucgacaucuacuacuacauggacgagcccggccucguccccgaggagaccgaggagaacaucgagggcgagauguccuccgaggacugcaagcuccaggaccucccccccugcuggggccucgacaucgucugcggcaagggcaccgacuucaacuacggccccugggccgaccgccagcgcgacugccucuggaaguucuucuucccccccgacuaccagguccucaaggucuccgagaucgcccagcccggccgcccccgccagauccucgccuucgagcuccgcaugaacaucaucgccgacgccaccaucgaccuccucuucaccaagaaccgcgagaccaacgccguccacgucaacgucggcgccggcuccuaccucgagaucaacauccccaugaccgucgaggagaacggcuacacccccgccaucaagggccagcuccuccacgucgacgccaccaccuccaugcaguaccgcacccuccucgaggccgagaugcucgccuuccacaucaacgccuccuacccccgcaucuggaacaugccccagaccuggcagugcgagcucgaggucuacaaggccaccuaccacuucaucuucgcccagaagaacuucuucaccgaccucauccaggacugguccuccgacuccccccccgacaucuucuccuucguccccuacaccuggaacuucaagaucauguuccaccaguucgagaugaucugggccgccaaccagcacaacuggaucgacugcuccaccaagcagcaggagaacgucuaccucgccgccugcggcgagacccucaacaucgacuucucccuccccuucaccgacuucguccccgccaccugcaacaccaaguucucccuccgcggcgaggacgucgaccuccaccucuuccuccccgacugccaccccuccaaguacucccucuucaugcucgucaagaacugccaccccaacaagaugauccacgacaccggcauccccgccgagugccaguccggccagaagaccgucaagcccaaguggcgcaacgucacccaggagaaguccggcugggucgagugcuggaccguccccuccgucaugcucaccaucgacuacaccuggcaccccaucuacccccagaaggccgacgagcagcucaagcagucccucuccgagauggaggagaccaugcucuccguccuccgccccucccagaagaccuccgaccgcgucgucuccucccccuccaccuccucccgcccccccaucgaccccuccgagcucccccccgacaagcuccacgucgagauggagcucucccccgacucccagaucacccucuacggcccccuccucaacgccuuccucugcaucaaggagaacuacuucggcgaggacgacauguacauggacuucgaggaggucaucuccucccccguccucucccucuccaccuccuccuccuccggcuggaccgccgucggcauggagaacgacaagaaggagaacgagggcuccgccaaguccauccacccccucgcccuccgccccugggacaucaccguccucgucaaccucuacaagguccacggccgccuccccguccacggcaccaccgacggccccgagugccccaccgccuuccucgagcgccucugcuucgagaugaagaagggcuuccgcgagaccaugcuccagcucauccucuccccccucaacgucuucgucuccgacaacuaccagcagcgcccccccgucgacgagguccuccgcgagggccacaucaaccucuccggccuccagcuccgcgcccacgccauguucuccgccgagggccucccccucggcuccgacucccucgaguacgccuggcucaucgacguccaggccggcucccucaccgccaaggucaccgccccccagcucgccugccuccucgaguggggccagaccuucgucuuccacgucgucugccgcgaguacgagcucgagcgccccaaguccgucaucaucugccagcacggcaucgaccgccgcuucugcgaguccaagcucuccugcauccccggccccugccccaccuccgacgaccucaaguacaccaugauccgccucgccgucgacggcgccgacaucuacaucgucgagcacggcugcgccaccaacaucaagaugggcgccauccgcgucgccaacugcaaccuccacaaccaguccgucggcgagggcaucuccgccgccauccaggacuuccagguccgccaguacaucgagcagcucaacaacugccgcaucggccuccagcccgccguccuccgccgcgccuacuggcucgaggccggcuccgccaaccucggccucaucaccgucgacaucgcccucgccgccgaccaccacuccaagcacgaggcccagcgccacuuccucgagacccacgacgcccgcaccaagcgccucugguuccucuggcccgacgacauccucaagaacaagcgcugccgcaacaagugcggcugccucggcggcugccgcuucuucggcggcaccgucaccggccucgacuucuucaagcucgaggagcucacccccuccuccuccuccgccuucuccuccaccuccgccgaguccgacauguacuacggccagucccuccuccagcccggcgaguggaucaucaccaaggagauccccaagaucaucgacggcaacgucaacggcaugaagcgcaaggagugggagaacaaguccgucggcaucgaggucgagcgcaagacccagcaccucucccuccaggucccccuccgcucccacuccuccuccuccuccuccgaggagaacuccuccuccuccgccgcccagccccuccucgccggcgagaaggagucccccuccuccgucgccgacgaccaccucguccagaaggaguuccuccacggcaccaagcgcgacgacggccaggccuccauccccaccgagaucuccggcaacucccccgucucccccaacacccaggacaaguccgucggccaguccccccuccgcuccccccucaagcgccaggccuccgucugcuccacccgccucggcuccaccaagucccucaccgccgccuucuacggcgacaagcagcccgucaccgucggcguccaguucuccuccgacgucucccgcuccgacgagaacguccucgacucccccaagcagcgccgcuccuucggcuccuuccccuacacccccuccgccgacuccaacuccuuccaccaguaccgcuccauggacuccuccauguccauggccgacuccgaggccuacuucuccgccgccgaggaguucgagcccaucuccuccgacgagggccccggcaccuaccccggccgcaagaagaagaagaagcagacccagcagaucgacuacucccgcggcuccaucuaccacuccgucgagggcccccucaccggccacggcgaguccauccaggacucccgcacccuccccuucaagacccaccccucccaggccuccuucgucuccgcccucggcggcgaggacgacgucaucgagcaccucuacaucgucgagggcgagaagaccgucgaguccgagcagaucaccccccagcagcccgucaugaacugcuaccagaccuaccucacccaguuccaggucaucaacugguccgucaagcaccccaccaacaagcgcaccuccaaguccucccuccaccgcccccucgaccucgacacccccaccuccgaggaguccuccuccuccuucgagcagcucuccguccccaccuucaaggucaucaagcagggccucaccgccaacucccuccucgaccgcggcaugcagcucuccggcuccaccuccaacacccccuacaccccccucgagaagaagcucgccgacaacaccgacgacgagacccucaccgaggaguggacccucgaccagcccgucucccagacccgcaccaccgccaucgucgaggucaagggcaccgucgacaucguccucaccccccucgucgccgaggcccucgaccgcuacaucgaggccaugguccacugcgccuccacccgccaccccgccgccaucgucgacgaccuccacgccaagguccuccgcgaggccguccagaacuccaagaccaccuucuccgagaaccucuccuccaagcaggacauccgcggcaccaagaccgagcaguccaccaucggcaccaccaaccagggccaggcccagaccaaccucaccaugaagcaggacaacgucaccaucaagggccuccagaccaacgucuccauccccaaggucaaccucugccuccuccaggccuccgucgaggagucccccaccaccgcccccucccgcuccgucacccacgucucccucgucgcccucugcuucgaccgcaucgccacccagguccgcaugaaccgcggcgucgucgaggagaccuccaacaacgccgagcccggccgcaccuccaacuucgaccgcuacguccacgccaccaagaugcagccccaguccuccggcucccuccgcuccaacgccggcgccgagaagggcaaggagaucgccgccaagcucaacauccaccgcguccacggccagcuccgcggccucgacaccaccgacaucggcaccugcgccaucaccgccauccccuucgagaaguccaagguccucuucacccucgaggagcucgacgaguucaccuucgucgacgagaccgaccagcaggccguccccgacgucacccgcaucggccccucccaggagaaguggggcuggaucauguucgagugcggccucgagaaccucaccaucaagggcggccgccaguccggcgccguccucuacaacuccuucggcaucaugggcaaggccuccgacaccgagcgcggcggcguccucaccuccaacaacuccuccgacucccccaccggcuccggcuacaacaccgacgucuccgacgacaaccuccccugcgaccgcaccucccccuccuccgaccucaacggcaacuccgucuccgacgagcaggacgagggcgucgaguccgacgaccucaagaaggaccucccccucaugccccccccccccgacuccugcuccaugaagcucaccaucaaggagaucugguucuccuucgccgcccccaccaacguccgcucccacacccacgccuucucccgccagcucaaccuccucuccaccgccacccccgccgucggcgccuggcucguccccaucgaccagcucaaguccucccucaacaagcucgagaccgagggcacccuccgcaucugcgccgucaugggcugcaucaugaccgaggcccucgagaacaaguccguccacuucccccuccgcuccaaguacaaccgccucaccaaggucgcccgcuuccuccaggagaaccccuccugccuccucugcaacauccuccaccacuaccuccaccaggccaacuacuccaucaucgacgacgccaccauguccgacggccuccccgcccucgucacccucaagaagggccucgucgcccucgcccgccaguggaugaaguucaucgucgucacccccgccuucaagggcgucucccuccaccgccccgcccagccccucaagccccagaucgccauggaccacgagcacgaggacggccucggccucgacaacggcggcggccuccaguccgacaccuccgccgacggcgccgaguucgaguucgacgccgccaccgucuccgagcacaccaugcuccucgagggcaccgccaaccgccccccccccggcuccuccggccccgucaccggcgccgagaucaugcgcaagcucuccaagacccacacccacuccgacuccgcccucaagaucaagggcauccaccccuaccacucccucuccuacaccuccggcgacaccgccaccgacucccccguccacgucggccgcgccggcaugcccgucaaggacuccccccgcaaggagucccuccucuccuaccucaccggcuccuuccccucccuccacaaccuccucgagggcaccccccagcgcuccuccgccgccgucaaguccuccucccucacccgcaccggcaacaccgucgccaccgacaugcucuccgagcacccccuccucuccgagcccuccuccgucuccuucuacaacuggauguccaacgccgucggcaaccgcggcuccguccuccaggagucccccgucaccaaguccggccacaacucccuccccaccggcgucgcccccaaccuccccaccauccccuccgccuccgacuucaacaccguccucuccuccgaccagaacacccucgacggcacccacucccagcacuccaccucccaggacgacgucgccggcgucgaggaggccaaccagggcuuccccgccguccagcucgccgacgcccaggucgucuucaagccccuccucucccacaccggcauccagucccaggacaccaugcccuucugcuaccgcauguacuucggcgagcaccucuccuucuccggcacccucgacugccuccgcgccgacaucgucgacuccgacaccgccaaggagcgcaagggcaagcgcgcccgccgccagggccacgucaaccuccccccccucgaguucaagcccgcccucaugcucggcaccuucuccaucuccgccgucgucauggagaaguccgucugcaccccccagaacuccaccuccgcccucuccuuccacgaccucuccaagcgcuacuacaacaccuuccacugcaacuucaccaucuccugccaguccaucucccagcacgucgacauggcccucguccgccucauccaccaguucuccaccaugaucgacgacaucaaggccacccagaccgacaucaagcucucccgcuacaccgccggcuccgccucccccacccccaccuucaagacccgcaagcaccgcgacuuccgcuccuccgacuucucccgcuccucccgcggcucccucaacggcggcaaccgcgucaacaacgccaagaacaagcgcaccaacaacgagaacaacaagaaggagucccgcaacaagaacucccucggccgcuccgagcgccgcaccuccaaggucucccgcaagggcuccaaggacgucgucgaccacaugaccauccacauggacgacuccgacuccaucaccgucuccgagcaguccgagcccuccgccgagugcuggcagaacauguacaagcuccucaacuucuacucccucaucuccgaccccaccggcauccucgagaaguccuccgagaccuucggccccgccggcguccgcucccccaccgagcccaccugcaaggucgucuucgagaacgagcaggacaacuccucccucaccaagacccagcgcaagcgcucccucgucaccuccgagccccagcacgucacccucaucgucuucggcaucggcauggucaaccgcacccaccucgaggccgacaucggcggccucaccauggaguccgagcucaagcgcauccacggcuccuucacccucaaggagaagaugaaggacguccuccaccagaagaugaccgagaccugcgccaccgcccacaucggcggcgucaacaucguccuccucgagggcaucacccccaacauccagcucgaggacuuccccaccucccccaccuccaccgccaagcaggaguuccucaccgucgucaagugcuccaucgccaagucccaggcccucuacuccgcccagcgcggccucaagaccaacaacgccgccgucuucaaggucggcgccaucuccaucaacaucccccagcaccccgccacccuccacuccaugaugguccgcuccucccaccagcucuccaagcagaucuccgaccucauccgccagcccuccaccgccccccagcccgucaaggaggacaucgccaccccccuccccuccgagaagacccccaccuccgucaaccagacccccgucgagaccaacgaguucccccagcuccccgagggccucgagaagaagcccaucguccucaaguucuccgccaugcucgacggcaucgccaucggcgccgcccuccuccccucccucaaggccgaguacaagaugggccgcaugcgcucccacggcaugaccggcgcccagacccgcuucaccuucgagcuccccaaccaccgccuccgcuucaccuccaaggucuccgccaccgacauguccaccaucccccccuccgccucccucaaccucccccccgucaccauguccggcaaguacaucauggaggagcacgacuccuacuccgaccaggucugguccaucgacgagcuccccuccaagcagggcuacuaccuccagggcaacuaccuccgcugcgucgccgaggucggcuccuucgagcacaaccucaccaccgaccuccucaaccaccucgucuucguccagaaggucuucaugaaggaggucaacgaggucauccagaaggucuccggcggcgagcagcccaucccccucuggaacgagcacgacggcaccgccgacggcgacaagcccaagauccuccucuacucccucaaccuccaguucaagggcauccaggucaccgccaccacccccuccaugcgcgccguccgcuucgagaccggccucaucgagcucgagcucuccaaccgccuccagaccaaggccucccccggcuccuccuccuaccucaagcucuucggcaagugccaggucgaccucaaccucgcccucggccagaucgucaagcaccaggucuacgaggaggccggcuccgacuuccaccaggucgccuacuucaagacccgcaucggccuccgcaacgcccuccgcgaggagaucuccggcuccuccgaccgcgaggccguccucaucacccucaaccgccccaucgucuacgcccagcccgucgccuucgaccgcgccguccucuucuggcucaacuacaaggccgccuacgacaacuggaacgagcagcgcauggcccuccacaaggacauccacauggccaccaaggaggucgucgacaugcuccccggcauccagcagaccuccgcccaggccuucggcacccucuuccuccagcucaccgucaacgaccucggcaucugccuccccaucaccaacaccgcccaguccaaccacaccggcgaccucgacaccggcuccgcccucguccucaccaucgaguccacccucaucaccgccugcuccuccgagucccucgucuccaagggccacuucaagaacuucugcauccgcuucgccgacggcuucgagaccuccugggacgacuggaagcccgagauccacggcgaccucgucaugaacgccugcgucguccccgacggcaccuacgaggucugcucccgcaccaccggccaggccgccgccgaguccuccuccgccggcaccuggacccucaacguccucuggaagaugugcggcaucgacguccacauggaccccaacaucggcaagcgccucaacgcccucggcaacacccucaccacccucaccggcgaggaggacaucgacgacaucgccgaccucaacuccgucaacaucgccgaccucuccgacgaggacgaggucgacaccaugucccccaccauccacaccgaggccaccgacuaccgccgccaggccgccuccgccucccagcccggcgagcuccgcggccgcaagaucaugaagcgcaucgucgacauccgcgagcucaacgagcaggccaaggucaucgacgaccucaagaagcucggcgccuccgagggcaccaucaaccaggagauccagcgcuaccagcagcucgaguccgucgccgucaacgacauccgccgcgacguccgcaagaagcuccgccgcuccuccaugcgcgccgccucccucaaggacaaguggggccucuccuacaagcccuccuacucccgcuccaaguccaucuccgccuccggccgccccccccucaagcgcauggagcgcgccuccucccgcgucggcgagaccgaggagcuccccgagauccgcgucgacgccgccucccccggcccccgcgucaccuucaacauccaggacaccuuccccgaggagaccgagcucgaccuccucuccgucaccaucgagggccccucccacuacuccuccaacuccgagggcuccugcuccgucuucuccucccccaagacccccggcggcuucucccccggcauccccuuccagaccgaggagggccgccgcgacgacucccucuccuccaccuccgaggacuccgagaaggacgagaaggacgaggaccacgagcgcgagcgcuucuacaucuaccgcaagcccucccacaccucccgcaagaaggccaccggcuucgccgccguccaccagcucuucaccgagcgcuggcccaccacccccgucaaccgcucccucuccggcaccgccaccgagcgcaacaucgacuucgagcucgacauccgcgucgagaucgacuccggcaagugcguccuccaccccaccacccuccuccaggagcacgacgacaucucccuccgccgcuccuacgaccgcuccucccgcucccucgaccaggacucccccuccaagaagaagaaguuccagaccaacuacgccuccaccacccaccucaugaccggcaagaagguccccuccucccuccagaccaagcccuccgaccucgagaccaccgucuucuacauccccggcgucgacgucaagcuccacuacaacuccaagacccucaagaccgagucccccaacgccucccgcggcuccucccucccccgcacccucuccaaggaguccaagcucuacggcaugaaggacuccgccaccuccccccccucccccccccuccccuccaccguccaguccaagaccaacacccuccuccccccccagcccccccccauccccgccgccaagggcaagggcuccggcggcgucaagaccgccaagcucuacgccugggucgcccuccagucccuccccgaggagauggucaucucccccugccuccucgacuuccucgagaaggcccucgagaccauccccaucacccccgucgagcgcaacuacaccgccgucuccucccaggacgaggacaugggccacuucgagauccccgaccccauggaggaguccaccaccucccucgucuccuccuccaccuccgccuacuccuccuuccccgucgacgucgucgucuacguccgcguccagcccucccagaucaaguucuccugccuccccgucucccgcgucgagugcaugcucaagcuccccucccucgaccucgucuucuccuccaaccgcggcgagcucgagacccucggcaccaccuaccccgccgagacccucucccccggcggcaacgccacccaguccggcaccaagaccuccgccuccaagaccggcauccccggcuccuccggccucggcuccccccucggccgcucccgccacuccuccucccaguccgaccucaccuccuccuccuccuccuccuccggccucuccuucaccgccugcauguccgacuucucccucuacgucuuccaccccuacggcgccggcaagcagaagaccgccgucuccggccucacccccggcuccggcggccucggcaacgucgacgaggagcccaccuccgucaccggccgcaaggacucccucuccaucaaccucgaguucgucaaggucucccucucccgcauccgccgcuccggcggcgccuccuucuucgagucccaguccgucuccaaguccgccuccaagauggacaccacccucaucaacaucuccgccgucugcgacaucggcuccgccuccuucaaguacgacaugcgccgccucuccgagauccucgccuucccccgcgccugguaccgccgcuccaucgcccgccgccucuuccucggcgaccagaccaucaaccuccccaccuccggccccggcacccccgacuccaucgagggcgucucccagcaccucucccccgaguccucccgcaaggccuacugcaagaccugggagcagcccucccaguccgccuccuucacccacaugccccagucccccaacgucuucaacgagcacaugaccaacuccaccaugucccccggcaccgucggccagucccucaagucccccgccuccauccgcucccgcuccgucuccgacuccuccgucccccgccgcgacucccucuccaagaccuccacccccuucaacaaguccaacaaggccgccucccagcagggcacccccugggagacccucgucgucuucgccaucaaccucaagcagcucaacguccagaugaacauguccaacgucaugggcaacaccaccuggaccaccuccggccucaagucccagggccgccucuccgucggcuccaaccgcgaccgcgagaucuccauguccgucggccucggccgcucccagcucgacuccaagggcggcgucgucggcggcaccaucgacgucaacgcccucgagauggucgcccacaucuccgagcaccccaaccagcagcccucccacaagauccagaucaccaugggcuccaccgaggcccgcgucgacuacaugggcuccuccauccucaugggcaucuucuccaacgccgaccucaagcuccaggacgaguggaaggucaaccucuacaacacccucgacuccuccaucaccgacaaguccgagaucuucguccacggcgaccucaagugggacaucuuccaggucaugaucucccgcuccaccacccccgaccucaucaagaucggcaugaagcuccaggaguucuucacccagcaguucgacaccuccaagcgcgcccucuccaccuggggccccguccccuaccucccccccaagaccaugaccuccaaccucgagaaguccucccaggagcagcuccucgacgccgcccaccaccgccacuggcccggcguccucaaggucgucuccggcugccacaucucccucuuccagaucccccuccccgaggacggcaugcaguucggcggcuccaugucccuccacggcaaccacaugacccucgccugcuuccacggccccaacuuccgcuccaaguccugggcccucuuccaccucgaggagcccaacaucgccuucuggaccgaggcccagaagaucugggaggacggcuccuccgaccacuccaccuacaucguccagacccucgacuuccaccucggccacaacaccauggucaccaagcccugcggcgcccucgagucccccauggccaccaucaccaagaucacccgccgccgccacgagaaccccccccacggcgucgccuccgucaaggagugguucaacuacgucaccgccacccgcaacgaggagcucaaccuccuccgcaacgucgacgccaacaacaccgagaacuccaccaccgucaagaacuccucccuccucuccggcuuccgcggcggcuccuccuacaaccacgagaccgagaccaucuucgcccucccccgcaugcagcucgacuucaaguccauccacguccaggagccccaggagcccucccuccaggacgccucccucaagcccaaggucgagugcuccgucgucaccgaguucaccgaccacaucugcgucaccauggacgccgagcucaucauguuccuccacgaccucgucuccgccuaccucaaggagaaggagaaggccaucuuccccccccgcauccucuccacccgccccggccagaagucccccaucaucauccacgacgacaacuccuccgacaaggaccgcgaggacuccaucaccuacaccaccgucgacuggcgcgacuucaugugcaacaccuggcaccucgagcccacccuccgccucaucuccuggaccggccgcaagaucgaccccgucggcgucgacuacauccuccagaagcucggcuuccaccacgcccgcaccaccauccccaaguggcuccagcgcggcgucauggacccccucgacaagguccucuccguccucaucaagaagcucggcaccgcccuccaggacgagaaggagaagaagggcaaggacaaggaggagcacuga

SEQ ID NO: 45017 - RNA, 1368 nt, Artificial Sequence
  derived and/or modified sequence opt2 from KIAA1147__Homo_sapiens__NP_001073861
auggucgagcagggcgacgccgccccccuccuccgcugggccgagggccccgccgucucccucccccaggccccccagccccaggccggcggcuggggccgcggcggcggcggcggcgcccgccccgccgccgagcccccccgccgccgcgagcccgaggagcccgccgcccccgagguccuccuccagcccggccgccucgagcucggcgacgucgaggaggaccaggucgucgccgucuucgucgucaccuucgacccccgcuccggcaacauggucgaguggugccucccccaggacaucgaccucgagggcgucgaguucaaguccauggccuccggcucccacaagauccaguccgacuucaucuacuuccgcaagggccccuucuucggccucgccugcuucgccaacaugcccgucgaguccgagcucgagcgcggcgcccgcaugaaguccgucggcauccucucccccuccuacacccuccucuaccgcuacaugcacuuccucgagaaccagguccgccaccagcucgagaugcccggccacuacucccaccucgccgccuucuacgaggacaagaagggcguccuccacgccggccccggccgcggcuccucccucccccccgucuacuggcuccccuccauccaccgcuacauguaccccgagaugaagaucacccaccccgccggcugcaugucccaguucaucaaguucuucggcgagcagauccucauccucuggaaguucgcccuccuccgcaagcgcauccucaucuucucccccccccccgucggcgucgucugcuaccgcgucuacugcugcugcugccucgccaacgucucccuccccggcaucggcggcaccauccccgaguccaagcccuucuucuacgucaacgucgccgacaucgagucccucgaggucgaggucuccuacgucgccugcaccaccgagaagaucuucgaggagaagcgcgagcucuacgacgucuacgucgacaaccagaacgucaagacccaccacgaccaccuccagccccuccucaagaucaacuccgccgaccgcgagaaguaccgccgccucaacgagcagcgccagaugcuccucuacucccaggaggucgaggaggacuacaaccccugcgaggaggaccucuucguccucuucuuccucgagcagaacaaccgcaucuuccagacccuccucgaggucuccgccucccaggacaagacccucaccgccgagcacgcccgcggcaugggccucgacccccagggcgaccgcuccuuccuccucgaccuccucgaggccuacggcaucgacgucaugcucgucaucgacaaccccugcugccccuga

SEQ ID NO: 45018 - RNA, 2145 nt, Artificial Sequence
  derived and/or modified sequence opt2 from KIAA1161__Homo_sapiens__NP_065753
augcuccagaacccccaggagaagucccaggccuacccccgccgccgccgccccggcugcuacgccuaccgccagaaccccgaggccaucgccgccgccgccauguacaccuuccuccccgacaacuucucccccgccaagcccaagcccuccaaggaccucaagccccuccucggcuccgccguccucggccuccuccucguccucgccgccgucgucgccuggugcuacuacuccgucucccuccgcaaggccgagcgccuccgcgccgagcuccucgaccucaaggccggcggcuucuccauccgcaaccagaagggcgagcaggucuuccgccucgccuuccgcuccggcgcccucgaccucgacuccugcucccgcgacggcgcccuccucggcugcucccucaccgccgacggccucccccuccacuucuucauccagaccguccgccccaaggacaccgucaugugcuaccgcguccgcugggaggaggccgcccccggccgcgccgucgagcacgccauguuccucggcgacgccgccgcccacugguacggcggcgccgagaugcgcacccagcacuggcccauccgccucgacggccagcaggagccccagcccuucgucaccuccgacgucuacuccuccgacgccgccuucggcggcauccucgagcgcuacuggcucuccucccgcgccgccgccaucaaggucaacgacuccguccccuuccaccucggcuggaacuccaccgagcgcucccuccgccuccaggcccgcuaccacgacacccccuacaagccccccgccggccgcgccgccgcccccgagcucuccuaccgcgucugcgucggcuccgacgucaccuccauccacaaguacaugguccgccgcuacuucaacaagcccucccgcguccccgcccccgaggccuuccgcgaccccaucugguccaccugggcccucuacggccgcgccgucgaccaggacaagguccuccgcuucgcccagcagauccgccuccaccacuucaacuccucccaccucgagaucgacgacauguacacccccgccuacggcgacuucgacuucgacgaggucaaguuccccaacgccuccgacauguuccgccgccuccgcgacgccggcuuccgcgucacccucuggguccaccccuucgucaacuacaacuccucccgcuucggcgagggcgucgagcgcgagcucuucguccgcgagcccaccggccgccuccccgcccucguccgcugguggaacggcaucggcgccguccucgacuucacccaccccaaggcccgcgacugguuccagggccaccuccgccgccuccgcucccgcuacuccgucgccuccuucaaguucgacgccggcgaggucuccuaccucccccgcgacuucuccaccuaccgcccccuccccgaccccuccgucuggucccgccgcuacaccgagauggcccuccccuucuucucccucgccgagguccgcgucggcuaccagucccagaacaucuccugcuucuuccgccucgucgaccgcgacuccgucuggggcuacgaccucggccuccgcucccucauccccgccguccucaccgucuccaugcucggcuaccccuucauccuccccgacauggucggcggcaacgccgucccccagcgcaccgccggcggcgacguccccgagcgcgagcucuacauccgcuggcucgaggucgccgccuucaugcccgccaugcaguucuccaucccccccuggcgcuacgacgccgaggucgucgccaucgcccagaaguucgccgcccuccgcgccucccucgucgccccccuccuccucgagcucgccggcgaggucaccgacaccggcgaccccaucguccgcccccucugguggaucgcccccggcgacgagaccgcccaccgcaucgacucccaguuccucaucggcgacacccuccucgucgcccccguccucgagcccggcaagcaggagcgcgacgucuaccuccccgccggcaaguggcgcuccuacaagggcgagcucuucgacaagacccccguccuccucaccgacuaccccgucgaccucgacgagaucgccuacuucaccugggccuccuga

SEQ ID NO: 45019 - RNA, 3702 nt, Artificial Sequence
  derived and/or modified sequence opt2 from KIAA1211__Homo_sapiens__NP_065773
augggcacccgcgccuucucccacgacuccaucuucauccccgacggcggcgccgaguccgagcagaccguccaggccaugucccaggacaacauccucggcaaggucaagacccuccagcagcagcucggcaagaacaucaaguucggccagcgcucccccaacgccauccccaugaacaaggccaacuccggcgaggccucccucgaggaggaccucuuccucaccucccccauggagaucgucacccagcaggacaucguccucuccgacgccgagaacaaguccuccgacacccccuccucccucuccccccucaaccuccccggcgccggcuccgagauggaggagaaggucgcccccgucaagcccucccgccccaagcgccacuucuccuccgccggcaccaucgaguccgucaaccucgacgccaucccccucgccaucgcccgccucgacaacuccgccgccaagcacaagcucgccgucaagcccaagaagcagcgcgucuccaagaagcaccgccgccucgcccaggacccccagcacgagcagggcggccucgagucccgccccugccucgaccagaacggccaccccggcgaggacaagcccaccuggcacgaggaggagcccaacccccucgacuccgaggaggagcgccgccgccaggaggacuacuggcgcgagcucgaggccaagugcaagcgccagaaggccgaggccgccgagaagcgccgccucgaggagcagcgccuccaggcccucgagcgccgccucugggaggagaaccgccgccaggagcuccucgaggaggagggcgagggccaggagcccccccucgaggccgagcgcgccccccgcgaggagcagcagcgcucccucgaggcccccggcugggaggacgccgagcgccgcgagcgcgaggagcgcgagcgccucgaggccgaggaggagcgccgccgccuccaggcccaggcccaggccgaggagcgccgccgccucgaggaggacgcccgccucgaggagcgccgccgccaggaggaggaggagggccgcugcgccgaggagcucaagcgccaggaggaggaggaggccgagggcugggaggagcucgagcagcaggaggccgagguccagggcccccccgaggcccucgaggagaccggcgagggccgccgcggcgccgaggaggaggaccucggcgaggaggaggaggagggccaggcccaccucgaggacuggcgcggccagcucuccgagcuccucaacgacuucgaggagcgccucgaggaccaggagcgccucaagcccgagggccagcgcgagcacuccgaggagcccggcaucugcgaggagcagaaccccgaggccgagcgccgccgcgagcagcagggccgcuccggcgacuuccagggcgccgaccgccccggccccgaggagaagcgcgaggagggcgacaccgagccccuccucaagcaggagggccccgucgaggccgcccagccccccgucgagcgcaaggaggccgccgcccucgagcagggccgcaaggucgaggagcuccgcuggcaggaggucgacgagcgccagaccaugccccgccccuacaccuuccaggucuccuccggcggcaagcagauccucuuccccaaggucaaccucucccccgucacccccgccaaggacaccggccucaccgccgccccccaggagcccaaggcccccaaggccucccccguccagcacgcccuccccuccucccucuccgucccccacaccgccauccucgucaccggcgcccagcucugcggccccgccgucaaccucucccagaucaaggacaccgccugcaagucccuccucggccucgaggagaagaagcacgccgaggcccccgccggcgagaaccccccccgcggccccggcgacgcccgcgccggcuccggcaaggccaagccccgccaggagucccccuccuccgccuccgcccucgccgagugggccuccauccgcucccgcauccucaagaacgccgaguccgacccccgcuccuccgagcgcgaccagcuccgccccggcgacgaguccaccccccgcggccgcugcgacucccgcggcaaccagcgcaagaccccccccgucaacgccaaguucuccaucaugcccgccuggcagaaguucuccgacggcggcaccgagaccuccaagcaguccaccgaggccgaguccauccgcaagcgccccaugcucggccccuccgaggagaccgccccccagcccccccccgccggcguccgcgagcucggcaagggccccgagaaguccgagaugcaccgcgagcccgccgacaccaccgagggcugcaaguucgccaaggaccuccccuccuuccucguccccucccuccccuaccccccccagaaggucgucgcccacaccgaguucaccaccuccuccgacuccgagaccgccaacggcaucgccaagcccgaccccgucaugcccggcggcgaggagaaggccucccccuucggcaucaagcuccgccgcaccaacuacucccuccgcuucaacugcgaccagcaggccgagcagaagaagaagaagcgccacuccuccaccggcgacuccgccgacgccggcccccccgccgccggcuccgcccgcggcgagaaggagauggagggcgucgcccucaagcacggccccucccucccccaggagcgcaagcaggcccccuccacccgccgcgacuccgccgagcccuccuccucccgcuccguccccgucgcccaccccggccccccccccgccuccucccagacccccgcccccgagcacgacaaggccgccaacaagaugccccucgcccagaagcccgcccucgcccccaagcccaccucccagaccccccccgccuccccccucuccaagcucucccgccccuaccucgucgagcuccucucccgccgcgccggccgccccgaccccgagcccuccgagcccuccaaggaggaccaggaguccuccgaccgccgcccccccuccccccccggccccgaggagcgcaagggccagaagcgcgacgaggaggaggaggccaccgagcgcaagcccgccucccccccccuccccgccacccagcaggagaagcccucccagacccccgaggccggccgcaaggagaagcccaugcuccagucccgccacucccucgacggcuccaagcucaccgagaaggucgagaccgcccagccccucuggaucacccucgcccuccagaagcagaagggcuuccgcgagcagcaggccacccgcgaggagcgcaagcaggcccgcgaggccaagcaggccgagaagcucuccaaggagaacgucuccgucuccguccagcccggcuccuccuccgucucccgcgccggcucccuccacaaguccaccgcccuccccgaggagaagcgccccgagaccgccgucucccgccucgagcgccgcgagcagcucaagaaggccaacacccuccccaccuccgucaccgucgagaucuccgacuccgccccccccgccccccucgucaaggaggucaccaagcgcuucuccacccccgacgccgcccccgucuccaccgagcccgccuggcucgcccucgccaagcgcaaggccaaggccugguccgacugcccccagaucaucaaguga

SEQ ID NO: 45020 - RNA, 2973 nt, Artificial Sequence
  derived and/or modified sequence opt2 from KIAA1211L__Homo_sapiens__XP_005263981
augcgcgagcucgaggcccacuccacccuccgccgcauggccgccuucuaccagugcauccgccccgaccccuccgagcucgacaugaucuccacccgcgucauggacaucaagcuccgcgaggccgccgagggccucggcgaggacuccaccggcaagaagaaguccaaguucaagaccuucaagaaguucuucggcaagaagaagcgcaaggagucccccuccuccaccggcuccuccaccuggaagcagucccagacccgcaacgaggucaucgccaucgaguccggccccgucggcuacgacuccgaggacgagcucgaggagucccgcggcacccucggcucccgcgcccucucccacgacuccaucuucauccccgaguccggccaggacgccacccgccccguccgcgucuucucccaggagaacgucugcgaccgcaucaaggcccuccagcucaagauccagugcaacgucaagaugggccccccccccccccccggcggccuccccgccaagcgcggcgaggacgccggcauguccuccgaggacgacggccucccccgcuccccccccgagaugucccuccuccacgacgucggccccggcaccaccaucaaggucuccgucgucucccccgaccacgucuccgacuccaccgucuccgcccgcaucuccgacaacucccucgcccccgucgccgacuucuccuaccccgccgaguccuccuccugccucgacaacuccgccgccaagcacaagcuccaggucaagccccgcaaccagcgcuccuccaagaugcgccgccucuccucccgcgcccaguccgagucccucuccgaccucaccugcacccccgaggaggaggagaacgaggagaagccccuccucgaggucucccccgaggagcgccccuccuccggccagcaggacgucgcccccgaccgcggccccgagcccggcccccccgccccccuccccccccccggcggcgcccgcgcccgccgcgcccgccuccagcacuccuccgcccucaccgccuccgucgaggagggcggcguccccggcgaggaccccuccucccgccccgccacccccgagcucgccgagcccgaguccgcccccacccuccgcgucgagccccccuccccccccgagggcccccccaaccccggccccgacggcggcaagcaggacggcgaggccccccccgccggccccugcgcccccgccaccgacaaggccgaggaggucgucugcgcccccgaggacgucgccucccccuuccccaccgccauccccgagggcgacaccaccccccccgagaccgaccccgccgccaccuccgaggcccccuccgcccgcgacggccccgagcgcuccguccccaaggaggccgagcccaccccccccguccuccccgacgaggagaagggcccccccggccccgcccccgagcccgagcgcgaggccgagaccgagcccgagcgcggcgccggcaccgagcccgagcgcaucggcaccgagcccuccaccgcccccgcccccuccccccccgcccccaaguccugccucaagcaccgccccgccgccgccuccgagggccccgccgccucccccccccucgccgccgccgaguccccccccgucgagcccggccccggcucccucgacgccgaggccgccgcccccgagcgccccaaggccgagcgcgccgaggccccccccgccggcgccgagcgcgccgcccccgagcgcaaggccgagcgcggcggcgccgagcuccgcggcgccaagaaguucuccgucuccuccugccgcgcccgcccccgccccggcgucucccgcccccucgagcgcgccuccggccgccucccccucgcccgcuccggccccgucuggcgcuccgaggccgcccucgacgaccuccagggccuccccgagccccagcacgccaagcccggcccccgcaagcucgccgagcgcggcccccaggacuccggcgaccgcgccgccucccccgccggcccccgcaaguccccccaggaggccgccgccgcccccggcacccgcgagcccugccccgccgcccaggagcccgcccccuccgaggaccgcaaccccuuccccgucaagcuccgcuccaccucccucucccucaaguaccgcgacggcgccucccaggaggucaagggcgucaagcgcuacuccgccgagguccgccucgagcgcucccucaccguccuccccaaggaggagaagugcccccucggcaccgcccccgcccuccgcggcacccgcgcccccuccgaccagggcaagggcaaggcccgcccccccgagccccucuccuccaagcccccccucccccgcaagccccuccuccaguccuucacccucccccaccagcccgccccccccgacgccggccccggcgagcgcgagccccgcaaggagccccgcaccgccgagaagcgcccccuccgccgcggcgccgagaagucccucccccccgccgccaccggccccggcgccgacggccagcccgccccccccuggaucaccgucacccgccagaagcgccgcggcacccucgaccagccccccaaccaggaggacaagcccggcgcccgcacccucaaguccgagcccggcaagcaggccaagguccccgagcgcggccaggagcccgucaagcaggccgacuucguccgcuccaaguccuuccucaucacccccgucaagcccgccgucgaccgcaagcagggcgccaagcucaacuucaaggagggccuccagcgcggcaucucccucucccaccagaaccucgcccaguccgccgucaugauggagaaggagcuccaccagcucaagcgcgccuccuacgccuccaccgaccagcccuccuggauggagcucgcccgcaagaagucccaggccugguccgacaugccccagaucaucaaguga

SEQ ID NO: 45021 - RNA, 3795 nt, Artificial Sequence
  derived and/or modified sequence opt2 from KIAA1217__Homo_sapiens__NP_001091970
augcagaccuccgagauggaccgcaagcgcgaggccuuccucgagcaccucaagcagaaguacccccaccacgccuccgccaucaugggccaccaggagcgccuccgcgaccagacccgcucccccaagcucucccacuccccccagccccccucccucggcgaccccgucgagcaccucuccgagaccuccgccgacucccucgaggccauguccgagggcgacgcccccacccccuucucccgcggcucccgcacccgcgccucccuccccgucguccgcuccaccaaccagaccaaggagcgcucccucggcguccucuaccuccaguacggcgacgagaccaagcagcuccgcaugcccaacgagaucaccuccgccgacaccauccgcgcccucuucgucuccgccuucccccagcagcucaccaugaagaugcucgagucccccuccgucgccaucuacaucaaggacgagucccgcaacgucuacuacgagcucaacgacguccgcaacauccaggaccgcucccuccucaaggucuacaacaaggaccccgcccacgccuucaaccacacccccaagaccaugaacggcgacaugcgcaugcagcgcgagcucgucuacgcccgcggcgacggccccggcgccccccgccccggcuccaccgcccaccccccccacgccauccccaacuccccccccuccacccccgucccccacuccaugccccccucccccucccgcauccccuacggcggcacccgcuccauggucguccccggcaacgccaccaucccccgcgaccgcaucuccucccuccccgucucccgccccaucucccccucccccuccgccauccucgagcgccgcgacgucaagcccgacgaggacauguccggcaagaacaucgccauguaccgcaacgagggcuucuacgccgaccccuaccucuaccacgagggccgcauguccaucgccuccucccacggcggccacccccucgacguccccgaccacaucaucgccuaccaccgcaccgccauccgcuccgccuccgccuacugcaaccccuccaugcaggccgagaugcacauggagcagucccucuaccgccagaagucccgcaaguaccccgacucccaccuccccacccucggcuccaagaccccccccgccuccccccaccgcgucuccgaccuccgcaugaucgacaugcacgcccacuacaacgcccacggccccccccacaccaugcagcccgaccgcgccucccccucccgccaggccuucaagaaggagcccggcacccucgucuacaucgagaagccccgcuccgccgccggccucuccucccucgucgaccucggccccccccucauggagaagcaggucuucgccuacuccaccgccaccauccccaaggaccgcgagacccgcgagcgcaugcaggccauggagaagcagaucgccucccucaccggccucguccaguccgcccucuucaagggccccaucaccuccuacuccaaggacgccuccuccgagaagaugaugaagaccaccgccaaccgcaaccacaccgacuccgccggcaccccccacgucuccggcggcaagaugcucuccgcccucgaguccaccgucccccccucccagcccccccccgucggcaccuccgccauccacaugucccuccucgagaugcgccgcuccgucgccgagcuccgccuccagcuccagcagaugcgccagcuccagcuccagaaccaggagcuccuccgcgccaugaugaagaaggccgagcucgagaucuccggcaaggucauggagaccaugaagcgccucgaggaccccguccagcgccagcgcguccucgucgagcaggagcgccagaaguaccuccacgaggaggagaagaucgucaagaagcucugcgagcucgaggacuucgucgaggaccucaagaaggacuccaccgccgccucccgccucgucacccucaaggacgucgaggacggcgccuuccuccuccgccaggucggcgaggccgucgccacccucaagggcgaguuccccacccuccagaacaagaugcgcgccauccuccgcaucgaggucgaggccguccgcuuccucaaggaggagccccacaagcucgacucccuccucaagcgcguccgcuccaugaccgacguccucaccaugcuccgccgccacgucaccgacggccuccucaagggcaccgacgccgcccaggccgcccaguacauggccauggagaaggccaccgccgccgagguccucaagucccaggaggaggccgcccacaccuccggccagcccuuccacuccaccggcgcccccggcgacgccaaguccgaggucgucccccucuccggcaugaugguccgccacgcccaguccucccccgucgucauccagcccucccagcacuccgucgcccuccucaaccccgcccagaaccucccccacgucgccuccucccccgccgucccccaggaggccaccuccacccuccagaugucccaggccccccaguccccccagauccccaugaacggcuccgccaugcagucccucuucaucgaggagauccacuccgucuccgccaagaaccgcgccgucuccaucgagaaggccgagaagaagugggaggagaagcgccagaaccucgaccacuacaacggcaaggaguucgagaagcuccucgaggaggcccaggccaacaucaugaaguccauccccaaccucgagaugccccccgccaccggcccccucccccgcggcgacgcccccgucgacaaggucgagcucuccgaggacucccccaacuccgagcaggaccucgagaagcucggcggcaagucccccccccccccccccccccccccccgccgcuccuaccuccccggcuccggccucaccaccacccgcuccggcgacgucgucuacaccggccgcaaggagaacaucaccgccaaggccuccuccgaggacgccggccccuccccccagacccgcgccaccaaguaccccgccgaggagcccgccuccgccuggacccccucccccccccccgucaccaccuccuccuccaaggacgaggaggaggaggaggaggagggcgacaagaucauggccgagcuccagggcuccuccggcgccccccagaccucccgcaugcccguccccauguccgccaagaaccgccccggcacccucgacaagcccggcaagcaguccaagcuccaggacccccgccaguaccgccaggccaacggcuccgccaagaaguccggcggcgacuucaagcccaccucccccucccuccccgccuccaagauccccgcccucucccccuccuccggcaaguccuccucccuccccuccuccuccggcgacuccuccaaccuccccaacccccccgccaccaagcccuccaucgccuccaacccccucuccccccagaccggcccccccgcccacuccgccucccucauccccuccgucuccaacggcucccucaaguuccagucccucacccacaccggcaagggccaccaccucuccuucuccccccagucccagaacggccgcgccccccccccccucuccuucuccuccuccccccccucccccgccuccuccgucucccucaaccagggcgccaagggcacccgcaccauccacacccccucccucaccuccuacaaggcccagaacggcuccuccuccaaggccacccccuccaccgccaaggagaccuccuga

SEQ ID NO: 45022 - RNA, 1866 nt, Artificial Sequence
  derived and/or modified sequence opt2 from KIAA1279__Homo_sapiens__NP_056449
auggccaacguccccugggccgaggucugcgagaaguuccaggccgcccucgcccucucccgcgucgagcuccacaagaaccccgagaaggagcccuacaaguccaaguacuccgcccgcgcccuccucgaggaggucaaggcccuccucggccccgcccccgaggacgaggacgagcgccccgaggccgaggacggccccggcgccggcgaccacgcccucggccuccccgccgaggucgucgagcccgagggccccgucgcccagcgcgccguccgccucgccgucaucgaguuccaccucggcgucaaccacaucgacaccgaggagcucuccgccggcgaggagcaccucgucaagugccuccgccuccuccgccgcuaccgccucucccacgacugcaucucccucugcauccaggcccagaacaaccucggcauccucugguccgagcgcgaggagaucgagaccgcccaggccuaccucgaguccuccgaggcccucuacaaccaguacaugaaggaggucggcucccccccccucgaccccaccgagcgcuuccuccccgaggaggagaagcucaccgagcaggagcgcuccaagcgcuucgagaaggucuacacccacaaccucuacuaccucgcccaggucuaccagcaccucgagauguucgagaaggccgcccacuacugccacuccacccucaagcgccagcucgagcacaacgccuaccaccccaucgagugggccaucaacgccgccacccucucccaguucuacaucaacaagcucugcuucauggaggcccgccacugccucuccgccgccaacgucaucuucggccagaccggcaagaucuccgccaccgaggacacccccgaggccgagggcgagguccccgagcucuaccaccagcgcaagggcgagaucgcccgcugcuggaucaaguacugccucacccucaugcagaacgcccagcucuccaugcaggacaacaucggcgagcucgaccucgacaagcaguccgagcuccgcgcccuccgcaagaaggagcucgacgaggaggaguccauccgcaagaaggccguccaguucggcaccggcgagcucugcgacgccaucuccgccgucgaggagaaggucuccuaccuccgcccccucgacuucgaggaggcccgcgagcucuuccuccucggccagcacuacgucuucgaggccaaggaguucuuccagaucgacggcuacgucaccgaccacaucgaggucguccaggaccacuccgcccucuucaagguccucgccuucuucgagaccgacauggagcgccgcugcaagaugcacaagcgccgcaucgccaugcucgagccccucaccgucgaccucaacccccaguacuaccuccucgucaaccgccagauccaguucgagaucgcccacgccuacuacgacaugauggaccucaaggucgccaucgccgaccgccuccgcgaccccgacucccacaucgucaagaagaucaacaaccucaacaaguccgcccucaaguacuaccagcucuuccucgacucccuccgcgaccccaacaaggucuuccccgagcacaucggcgaggacguccuccgccccgccaugcucgccaaguuccgcgucgcccgccucuacggcaagaucaucaccgccgaccccaagaaggagcucgagaaccucgccaccucccucgagcacuacaaguucaucgucgacuacugcgagaagcaccccgaggccgcccaggagaucgaggucgagcucgagcucuccaaggagauggucucccuccuccccaccaagauggagcgcuuccgcaccaagauggcccucaccuga

SEQ ID NO: 45023 - RNA, 3015 nt, Artificial Sequence
  derived and/or modified sequence opt2 from KIAA1324__Homo_sapiens__XP_011540127
auggccgagcccggccacucccaccaccucuccgcccgcguccgcggccgcaccgagcgccgcaucccccgccucuggcgccuccuccucugggccggcaccgccuuccaggucacccagggcaccggccccgagcuccacgccugcaaggaguccgaguaccacuacgaguacaccgccugcgacuccaccggcucccgcuggcgcgucgccgucccccacacccccggccucugcaccucccuccccgaccccaucaagggcaccgagugcuccuucuccugcaacgccggcgaguuccucgacaugaaggaccaguccugcaagcccugcgccgagggccgcuacucccucggcaccggcauccgcuucgacgagugggacgagcucccccacggcuucgccucccucuccgccaacauggagcucgacgacuccgccgccgaguccaccggcaacugcaccuccuccaagugggucccccgcggcgacuacaucgccuccaacaccgacgagugcaccgccacccucauguacgccgucaaccucaagcaguccggcaccgucaacuucgaguacuacuaccccgacuccuccaucaucuucgaguucuucguccagaacgaccagugccagcccaacgccgacgacucccgcuggaugaagaccaccgagaagggcugggaguuccacuccgucgagcucaaccgcggcaacaacguccucuacuggcgcaccaccgccuucuccgucuggaccaagguccccaagcccguccucguccgcaacaucgccaucaccggcgucgccuacaccuccgagugcuuccccugcaagcccggcaccuacgccgacaagcagggcuccuccuucugcaagcucugccccgccaacuccuacuccaacaagggcgagaccuccugccaccagugcgaccccgacaaguacuccgagaagggcuccuccuccugcaacguccgccccgccugcaccgacaaggacuacuucuacacccacaccgccugcgacgccaacggcgagacccagcucauguacaagugggccaagcccaagaucugcuccgaggaccucgagggcgccgucaagcuccccgccuccggcgucaagacccacugcccccccugcaaccccggcuucuucaagaccaacaacuccaccugccagcccugccccuacggcuccuacuccaacggcuccgacugcacccgcugccccgccggcaccgagcccgccgucggcuucgaguacaagugguggaacacccuccccaccaacauggagaccaccguccucuccggcaucaacuucgaguacaagggcaugaccggcugggaggucgccggcgaccacaucuacaccgccgccggcgccuccgacaacgacuucaugauccucacccucgucguccccggcuuccgccccccccaguccgucauggccgacaccgagaacaaggaggucgcccgcaucaccuucgucuucgagacccucugcuccgucaacugcgagcucuacuucauggucggcgucaacucccgcaccaacacccccgucgagaccuggaagggcuccaagggcaagcaguccuacaccuacaucaucgaggagaacaccaccaccuccuucaccugggccuuccagcgcaccaccuuccacgaggccucccgcaaguacaccaacgacgucgccaagaucuacuccaucaacgucaccaacgucaugaacggcgucgccuccuacugccgccccugcgcccucgaggccuccgacgucggcuccuccugcaccuccugccccgccggcuacuacaucgaccgcgacuccggcaccugccacuccugccccaccaacaccauccucaaggcccaccagcccuacggcguccaggccugcguccccugcggccccggcaccaagaacaacaagauccacucccucugcuacaacgacugcaccuucucccgcaacacccccacccgcaccuucaacuacaacuucuccgcccucgccaacaccgucacccucgccggcggccccuccuucaccuccaagggccucaaguacuuccaccacuucacccucucccucugcggcaaccagggccgcaagauguccgucugcaccgacaacgucaccgaccuccgcauccccgagggcgaguccggcuucuccaaguccaucaccgccuacgucugccaggccgucaucaucccccccgaggucaccggcuacaaggccggcgucuccucccagcccgucucccucgccgaccgccucaucggcgucaccaccgacaugacccucgacggcaucaccucccccgccgagcucuuccaccucgagucccucggcauccccgacgucaucuucuucuaccgcuccaacgacgucacccaguccugcuccuccggccgcuccaccaccauccgcguccgcugcuccccccagaagaccguccccggcucccuccuccuccccggcaccugcuccgacggcaccugcgacggcugcaacuuccacuuccucugggaguccgccgccgccugcccccucugcuccgucgccgacuaccacgccaucgucuccuccugcgucgccggcauccagaagaccaccuacgucuggcgcgagcccaagcucugcuccggcggcaucucccuccccgagcagcgcgucaccaucugcaagaccaucgacuucuggcucaaggucggcaucuccgccggcaccugcaccgccauccuccucaccguccucaccugcuacuucuggaagaagaaccagaagcucgaguacaaguacuccaagcucgucaugaacgccacccucaaggacugcgaccuccccgccgccgacuccugcgccaucauggagggcgaggacgucgaggacgaccucaucuucaccuccaagaagucccucuucggcaagaucaaguccuucaccuccaagcagcccgcccccgucaccaucucccucuccgaggacuccuga

SEQ ID NO: 45024 - RNA, 3090 nt, Artificial Sequence
  derived and/or modified sequence opt2 from KIAA1324L__Homo_sapiens__NP_001136221
augcucuuccgcgcccgcggccccguccgcggccgcggcuggggccgccccgccgaggccccccgccgcggccgcuccccccccuggucccccgccuggaucugcugcugggcccucgccggcugccaggccgccugggccggcgaccuccccuccuccuccucccgcccccucccccccugccaggagaaggacuaccacuucgaguacaccgagugcgacuccuccggcucccgcuggcgcgucgccauccccaacuccgccgucgacugcuccggccuccccgaccccguccgcggcaaggagugcaccuucuccugcgccuccggcgaguaccucgagaugaagaaccaggucugcuccaagugcggcgagggcaccuacucccucggcuccggcaucaaguucgacgagugggacgagcuccccgccggcuucuccaacaucgccaccuucauggacaccgucgucggccccuccgacucccgccccgacggcugcaacaacuccuccuggaucccccgcggcaacuacaucgaguccaaccgcgacgacugcaccgucucccucaucuacgccguccaccucaagaaguccggcuacgucuucuucgaguaccaguacgucgacaacaacaucuucuucgaguucuucauccagaacgaccagugccaggagauggacaccaccaccgacaagugggucaagcucaccgacaacggcgaguggggcucccacuccgucaugcucaaguccggcaccaacauccucuacuggcgcaccaccggcauccucaugggcuccaaggccgucaagcccguccucgucaagaacaucaccaucgagggcgucgccuacaccuccgagugcuuccccugcaagcccggcaccuucuccaacaagcccggcuccuucaacugccaggucugcccccgcaacaccuacuccgagaagggcgccaaggagugcauccgcugcaaggacgacucccaguucuccgaggagggcuccuccgagugcaccgagcgcccccccugcaccaccaaggacuacuuccagauccacacccccugcgacgaggagggcaagacccagaucauguacaaguggaucgagcccaagaucugccgcgaggaccucaccgacgccauccgccucccccccuccggcgagaagaaggacugcccccccugcaaccccggcuucuacaacaacggcuccuccuccugccaccccugcccccccggcaccuucuccgacggcaccaaggagugccgccccugccccgccggcaccgagcccgcccucggcuucgaguacaagugguggaacguccuccccggcaacaugaagaccuccugcuucaacgucggcaacuccaagugcgacggcaugaacggcugggaggucgccggcgaccacauccaguccggcgccggcggcuccgacaacgacuaccucauccucaaccuccacauccccggcuucaagccccccaccuccaugaccggcgccaccggcuccgagcucggccgcaucaccuucgucuucgagacccucugcuccgccgacugcguccucuacuucauggucgacaucaaccgcaaguccaccaacgucgucgaguccuggggcggcaccaaggagaagcaggccuacacccacaucaucuucaagaacgccaccuucaccuucaccugggccuuccagcgcaccaaccagggccaggacaaccgccgcuucaucaacgacauggucaagaucuacuccaucaccgccaccaacgccgucgacggcgucgccuccuccugccgcgccugcgcccucggcuccgagcaguccggcuccuccugcguccccugcccccccggccacuacaucgagaaggagaccaaccagugcaaggagugcccccccgacaccuaccucuccauccaccaggucuacggcaaggaggccugcauccccugcggccccggcuccaagaacaaccaggaccacuccgucugcuacuccgacugcuucuucuaccacgagaaggagaaccagucccuccacuacgacuucuccaaccucuccuccgucggcucccucaugaacggccccuccuucaccuccaagggcaccaaguacuuccacuucuucaacaucucccucugcggccacgagggcaagaagauggcccucugcaccaacaacaucaccgacuucaccgucaaggagaucgucgccggcuccgacgacuacaccaaccucgucggcgccuucgucugccaguccaccaucauccccuccgaguccaagggcuuccgcgccgcccucuccucccaguccaucauccucgccgacaccuucaucggcgucaccgucgagaccacccucaagaacaucaacaucaaggaggacauguuccccguccccaccucccagauccccgacguccacuucuucuacaaguccuccaccgccaccaccuccugcaucaacggccgcuccaccgccgucaagaugcgcugcaaccccaccaaguccggcgccggcgucaucuccguccccuccaagugccccgccggcaccugcgacggcugcaccuucuacuuccucugggaguccgccgaggccugcccccucugcaccgagcacgacuuccacgagaucgagggcgccugcaagcgcggcuuccaggagacccucuacgucuggaacgagcccaaguggugcaucaagggcaucucccuccccgagaagaagcucgccaccugcgagaccgucgacuucuggcucaaggucggcgccggcgucggcgccuucaccgccguccuccucgucgcccucaccugcuacuucuggaagaagaaccagaagcucgaguacaaguacuccaagcucgucaugaccaccaacuccaaggagugcgagcuccccgccgccgacuccugcgccaucauggagggcgaggacaacgaggaggaggucgucuacuccaacaagcagucccuccucggcaagcucaagucccucgccaccaaggagaaggaggaccacuucgaguccguccagcucaagaccucccgcucccccaacaucuga

SEQ ID NO: 45025 - RNA, 3354 nt, Artificial Sequence
  derived and/or modified sequence opt2 from KIAA1377__Homo_sapiens__NP_065853
augcucgccggccgccccggcacccgcuccgccgucggcgagcucggcaccgaguccuccgacaaccucgaccgcgccccccucggcccccgcgaguccggcggccaccaccgccccggcuccuaccucgacaugaagauccaccucgagaagaaccucgaggaggagcgccagauccuccuccagcagcagaagaucugccgcaaccgcgcccgcaaguacuucgucgaguccaaccgccgcaagaaggccuucgaggagaagcgcaaggagcaggaggagaaggagcaccagauccgcgagcagauccuccagcagcgcaagcagaaguucgaggaggucaccgagaaguuccagcgcgcccacgucccccucucccagcgccgcaaggccgucucccgcaagcccguccccccccucgaggaggcccucaagcagauccaggaguccaaccucaaguccgaggucaaccuccccuucucccgccgccccaccaucaacuggcgcgccaucgacuccgcccuccccuccgcccucuccaagaacgaccacaagcaccagaagcagcuccucuccaagaucaacugcgagaaggagaugaacgagaacaugcgcgccacccucgccaccuccaagaacgucuuccagcucaagcucgaggagacccagaagcuccucgaggaccagcaccucuccaaccuccagaaguucugcgacgaggucaaccagaucaccaacuccgagacccucuccuccaucgacucccucgaggccaccgagcacgaggagaucuaccucacccucaacaaggagcacuccaccuccauccagcgcaacaccaucucccucaagcccgccaacaugcaguccaccaaccucuccugcuucgacgaggacaagcucgccuucuccaagacccagcacaucaacaacuggcucaccaaccucgacgccuccaacacccagaacgucaccgccuucuccgacauccucuccaaguccaacguccuccccuccugggaguacuucaacuccaaggagcagaaccccuccccccucaacggcaccgucgagcgcgccaccaacaccgccaacaacuccguccccuucgucuccuccccccccauguucguccucgacaagaagugcgagaagaccuccgagaccuccaccaugcgcaccaccgacuccaccuccggcgccuucaagcgcgagcgcccccucgucaccgagucccccaccuucaaguucuccaagucccaguccaccuccgacucccucacccaggaggucgccaccuuccccgaccaggagaaguacuccgagcucaaccaggagaacggcaccaccuccauccccaccuccugcguccccgucgccaccccccucguccuccccuccaacauccaguccgcccgccccuccgccaagaacuccauccacaucaaggagaucgacgccguccagugcuccgacaagcucgacgagcucaaggacggcaaggaggaggagaucaaguacuucaacugcaacaaggaggagcucccccucuucuccgacuccuuccaggacgccuacaucccccacaaccccgacuccaaggacgagaagcagaagcucgccgagaccuccucccucuccaacgucaccuccaacuacgacuucgucggccagcacaagaagaugaaguacaacauccacgagcgcaacggcguccgcuuccucaaguccauccucaagaaggaguccaaguacgagcacggcuaccucaaggcccucaucaucaaccaguccuucaaguucggcaaccagaaggccgccgccauccgcgacuccaucgagcucaccaaggagaagggcgccgagauccccaagaccaucaagaagcuccgcugguucgacgagaccuccaacaucgagaacaacgccgagaacucccacucccucaagaacaagaccggcaccacccagcagcacucccagcaguuccacauccaguccggcgccggcuccaacaucaucuccgucuccaccugcgccgucaacuccgccgacaccaagaagucccgcgaggacuccaucuccgagaacgucaccacccucggcggcuccggcgccgaccacaugccccucaacugcuucauccccuccggcuacaacuucgccaagcacgccuggcccgccuccaagaaggaggaguccaagauccccguccacgacgacuccaagaccaagcagggcaagccccagcgcggccgcgccaagaucauccgcaagcccggcuccgccaagguccaguccggcuucaucugcaccaaccgcaagggcgccgucauccagccccaguccgccuccaaggucaacaucuucacccaggcccagggcaagcucaucauccccugcccccccccccaguccaccuccaacauccgcuccggcaagaacauccaggucucccagugccagcccgucacccccgagaacccccagaacaucaucacccacaacuccuucaacuccaagcacguccuccccaccgagcacucccucaaccaguggaaccaggaguccuccuccccccucuccaacgccugcuccgaccucgucaccgucauccccucccuccccuccuacugcuccuccgagugccagaccuucgccaagaucaaccacuccaacggcacccaggccgucgcccgccaggacgccacccucuacugcacccagcgcucccccgucugcgaggaguccuaccccuccgucacccuccgcaccgccgaggaggaguccgucccccucuggaagcgcggccccaacguccuccaccagaacaagcgcgccaccggcuccaccgucaugcgccgcaagcgcaucgccgagaccaagcgccgcaacauccucgagcagaagcgccagaaccccggcuccgucggccagaaguacuccgagcagaucaacaacuucggccaguccguccuccucuccuccuccgagcccaagcagaccacccgcggcaccuccuacaucgaggaggucuccgacuccaccuccgaguuccucauggccgagaaccucgucaaggccuccguccccgaggacgagauccucaccguccucaacuccaagcagauccagaaguccaaccucccccucaacaagacccagcaguucaacaucugcacccucuccgccgaggagcagaagauccucgagucccucaacgaccucuccgagcgccuccacuacauccaggaguccaucugcaagaaccccuccaucaagaacacccuccagaucaucccccuccucgagaagcgcgaggaccgcaccuccuccugccgcgacaagcgcuga

SEQ ID NO: 45026 - RNA, 1572 nt, Artificial Sequence
  derived and/or modified sequence opt2 from KIAA1456__Homo_sapiens__XP_005273641
augaagauccaguucaagaaggagugccagaaccgcaagggccucugcuuccuccagcgccucacccaggaggucuaccacgagaaggaccgcaccaucuccuuccacuccuacaaguucuccuucacccuccacaucgagaaggucaugcgcuccaacugccacucccucgaggucgagaccgccgucauccacaaggacaagcgcauggaccacgaggccgcccagcucgagaagcagcacguccacaacgucuacgaguccaccgcccccuacuucuccgaccuccaguccaaggccuggccccgcguccgccaguuccuccaggagcagaagcccggcucccucaucgccgacaucggcugcggcaccggcaaguaccucaaggucaacucccagguccacaccgucggcugcgacuacugcggcccccucgucgagaucgcccgcaaccgcggcugcgaggccauggucugcgacaaccucaaccuccccuuccgcgacgagggcuucgacgccaucaucuccaucggcgucauccaccacuucuccaccaagcagcgccgcauccgcgccaucaaggagauggcccgcguccucguccccggcggccagcucaugaucuacgucugggccauggagcagaagaaccgccacuucgagaagcaggacguccucguccccuggaaccgcgcccucugcucccagcucuucuccgaguccucccaguccggccgcaagcgccagugcggcuaccccgagcgcggccaccccuaccacccccccugcuccgagugcuccugcuccgucugcuucaaggagcagugcggcuccaagcgcucccacuccgucggcuacgagcccgccauggcccgcaccugcuucgccaacaucuccaaggagggcgaggaggaguacggcuucuacuccacccucggcaaguccuuccgcuccugguucuucucccgcucccucgacgaguccacccuccgcaagcagaucgagcgcguccgcccccucaagaacaccgaggucugggccuccuccaccgucaccguccagcccucccgccacuccucccucgacuucgaccaccaggagcccuucuccaccaagggccagucccucgacgaggaggucuucgucgaguccuccuccggcaagcaccucgaguggcuccgcgcccccggcacccucaagcaccucaacggcgaccaccagggcgagaugcgccgcaacggcggcggcaacuuccucgacuccaccaacaccggcgucaacugcgucgacgccggcaacaucgaggacgacaaccccuccgccuccaagauccuccgccgcaucuccgccgucgacuccaccgacuucaaccccgacgacaccauguccgucgaggacccccagaccgacguccucgacuccaccgccuucaugcgcuacuaccacgucuuccgcgagggcgagcucugcucccuccucaaggagaacgucuccgagcuccgcauccucuccuccggcaacgaccacggcaacuggugcaucaucgccgagaagaagcgcggcugcgacuga

SEQ ID NO: 45027 - RNA, 4080 nt, Artificial Sequence
  derived and/or modified sequence opt2 from KIAA1462__Homo_sapiens__XP_011517910
auguacuccgucgaggaccuccucaucucccacggcuacaagcucucccgcgacccccccgccucccgcgaggacaaccccaagggccgccaggccgcccgcaccggcacccgcgccggccagggccuccagaacggccacgaggacggccccgccgcccucgcccaccgcaagaccuccgccggcaagggccacgucuccgacuccgagucccgccgcuccaccccccgcggccacggcgagccccaguccaccuccgccucccgcaccuccgaggccggcuucugcaaccagccccccuccgccugguccucccacccccccaccggcaacgaccaggccuaccgccgccgcggccgccaggaggcccgcucccagaagccccgcgagcacgagaaccucgaggcccgcggcauggcccaggcccacucccuccccguccacguccgcgagggccccugggaggucggcggccgcuccgagcacgucaugaagaagcccgucugggaggaggagcuccgcauguccggccccgccaaguggcagaacgucucccucgaguccuggaaccagccccgcaagcucggccgccagauguccgacggcgacggcgagcgccucuuccaggaccucuaccccuucauccagggcgagcacguccucaacucccagaacaagggcaagucccgcucccucccccgcguccucucccccgagucccucuccugcaccgagauccccaucccccucaacgagcgccacucccccaagaugccccccuacccccccaccugcgcccccaaccucgacuccacccgcaacuccgagaaguccggcugcuccgcccccuucccccgccccaaguucggccgcccccucaagccccccuccuacuccucccaccagcagucccgcggcggcgccgacuccuccgacucccaggacucccagcagauggacgccuacgucccccgccacgagcucugccucuccgaccccggccucgagccccccgucuacguccccccccccuccuaccgcucccccccccagaacauccccaaccccuaccucgaggacaccguccccaucaacgucugcggcggccacucccagcagcagucccccaccgagaaggccggcgccuccggccagccccccuccggcccccccggcaccggcaacgaguacggcgucuccccccgccucccccagggccuccccgcccacccccgccccgucaccgccuacgacggcuucguccaguacauccccuucgacgacccccgccuccgccacuucaagcucgcccagccccagggcuucugcgaggacaucaagcucgacgacaaguccuacaacuccucccccgucaccgcccaggagcccgcccacggcggcaugcagcccgacggcgccaucuggaacccccagucccucaucccccccuccggcgacgagcgcggccucguccucgccgacuccuccccccgcuggcucuggggccagccccccggcgacggcgagaacuccggccuccccaaccagcgcgaccgcugcgucgcccgcggccaguggcccgacguccgcggcucccagcacggccacaccggccgccaggucuccucccccuacucccagggcgaguccaccugcgagacccagaccaagcucaagaaguuccagaccggcacccgcaccaagaaguccuccaagaagaagaugaacgagaccaucuucugccucgucuccauccccgucaaguccgagucccaccuccccgaccgcgacauggacaacaacgaccucaagcccuccgccgaccagaagaacggcuccgacaagucccccgcccuccaggagcagucccuccucuccauguccuccaccgaccucgagcuccaggcccucaccggcuccaugggcggccgcaccgaguuccagaagcaggaccucggcgagcccgaggaggaccgccagaccaacgaccucuccuucauccaccucaccaagcaccgcgagcucaagcacuccggcuccuggcccggccaccgcuaccgcgaccagcagacccagaccuccuucuccgaggagccccaguccucccagcuccuccccggcgccaagcucggcggccccucccgcgccgcccucucccccaagugcuccgaccccgccgccuccgaggcccagacccacaccgccuuccccaccggcgaccacaagcagcgccccuccgcccgcaaccucaagggccaccgcucccucucccccuccuccaacuccgccuucucccgcaccucccucuccgucgaccaggcccccacccccaaggccggccgcucccagcccugcgucgacguccacggccucggcgcccaccccggccccaagcgcgaggucgucaagggcgagcccaccggccccugcaacuccaagcagcucuucggccaguuccuccucaagcccgucucccgccgccccugggaccucaucucccagcucgaguccuucaacaaggagcuccaggaggaggaggaguccuccuccuccuccuccuccuccuccuccuccuccgaggaguccgaggccgagccccagcaggagaaccgcgcccacugccgccaggaggacgucggcuuccgcggcaacucccccgagaugcgcgucgagccccagccccgcauguggguccccgagucccccgucugccgcuccggccgcggcgaguccaaguccgaguccugguccgaggagcuccagcccggccacccccgcgccuggccccccucccccggccgcuuccgcgucgaggagggcggcggcgcccccuucugcuccgccgacggcuccaccuccgccgagaagcgccaccucgaggucuccaacggcauggacgagcucgccggcucccccuuccccgucacccgcauguccucccgcuccuccgacgccaagccccuccccgccuccuaccccgccgagccccgcgagccccaggagucccccaagaucaccuccgccuucuccuccgucaagcccuccgaggccgucccccgcaaguucgacuccggcggcgagcgcggcgccggccucccccucucccucuccaacaagaaccgcggccucuccgcccccgaccuccgcuccgucggccucacccccggccaggagcagggcgccuccgagcucgagggcucccucggcgaggccuccaccaucgagaucccccccggcgagucccuccaggcccgcgccgcccgcauccucggcaucgaggucgccgucgagucccuccuccccggcauccgccgcgccggccagaaccagcccgccgagcccgacgccuccgccugcacccccgaguccccccaggaggagcuccucucccgccccgcccccgccgacgucccccgcgucuccaccgacgccuucuacggccgccgcaagugcggcuggaccaaguccccccucuucgucggcgaccgcgacuccgcccgccgcgccccccaggccuucgagcacuccgacgucgacggcgucgucaccuccaccgaccccguccccgagcccgagcccuccccccucgaguccaaguucuucgagcagaaggacgucgagaccaagccccccuuccgcuccacccucuuccacuucgucgagcgcacccccuccgucgccggcuccgagaagcgccuccgcucccccuccaaggucaucgagucccuccaggagaagcucgccucccccccccgccgcgccgaccccgaccgccucaugcgcaugaaggaggucuccuccgucucccgcaugcgcguccucuccuuccgcaacgccgacucccaggaggacgccgaggagcucaaggccaccacccgcggccaggccggccuccccggcggccucgucucccccggcuccggcgaccgcgcccagcgccucggccacucccucuccgucuccaaggacuccaucucccgcgaggagaaggagcaccccgccgcccagaaggagaaguccauggaccaggacuucuggugccccgacuccuacgaccccucccgcgucgagcgcgucuga

SEQ ID NO: 45028 - RNA, 3651 nt, Artificial Sequence
  derived and/or modified sequence opt2 from KIAA1468__Homo_sapiens__NP_065905
auggccgccauggcccccggcggcuccggcuccggcggcggcgucaaccccuuccucuccgacuccgacgaggacgacgacgaggucgccgccaccgaggagcgccgcgccguccuccgccucggcgccggcuccggccucgaccccggcuccgccggcucccucuccccccaggaccccgucgcccucggcuccuccgcccgccccggccuccccggcgaggccuccgccgccgccgucgcccucggcggcaccggcgagacccccgcccgccucuccaucgacgccaucgccgcccagcuccuccgcgaccaguaccuccucaccgcccucgagcuccacaccgagcuccucgaguccggccgcgagcucccccgccuccgcgacuacuucuccaaccccggcaacuucgagcgccaguccggcaccccccccggcaugggcgcccccggcguccccggcgccgccggcgucggcggcgccggcggccgcgagcccuccaccgccuccggcggcggccagcucaaccgcgccggcuccaucuccacccucgacucccucgacuucgcccgcuacuccgacgacggcaaccgcgagaccgacgagaaggucgccguccucgaguucgagcuccgcaaggccaaggagaccauccaggcccuccgcgccaaccucaccaaggccgccgagcacgaggucccccuccaggagcgcaagaacuacaaguccucccccgagauccaggagcccaucaagccccucgagaagcgcgcccucaacuuccucgucaacgaguuccuccucaagaacaacuacaagcucaccuccaucaccuucuccgacgagaacgacgaccaggacuucgagcucugggacgacgucggccucaacauccccaagccccccgaccuccuccagcucuaccgcgacuucggcaaccaccaggucaccggcaaggaccucgucgacgucgccuccggcgucgaggaggacgagcucgaggcccucacccccaucaucuccaaccucccccccacccucgagaccccccagcccgccgagaacuccaugcucguccagaagcucgaggacaagaucucccuccucaacuccgagaaguggucccucauggagcagauccgccgccucaaguccgagauggacuuccucaagaacgagcacuucgccauccccgccgucugcgacuccguccagcccccccucgaccagcucccccacaaggacuccgaggacuccggccagcaccccgacgucaacuccuccgacaagggcaagaacaccgacauccaccucuccaucuccgacgaggccgacuccaccauccccaaggagaacucccccaacuccuucccccgccgcgagcgcgagggcaugccccccuccucccucuccuccaagaagaccguccacuucgacaagcccaaccgcaagcucucccccgccuuccaccaggcccuccucuccuucugccgcauguccgccgacucccgccucggcuacgaggucucccgcaucgccgacuccgagaaguccgucaugcucaugcucggccgcugccucccccacaucguccccaacguccuccucgccaagcgcgaggagcucaucccccucauccucugcaccgccugccuccaccccgagcccaaggagcgcgaccagcuccuccacauccucuucaaccucaucaagcgccccgacgacgagcagcgccagaugauccucaccggcugcgucgccuucgcccgccacgucggccccacccgcgucgaggccgagcuccucccccagugcugggagcagaucaaccacaaguaccccgagcgccgccuccucgucgccgaguccugcggcgcccucgcccccuaccuccccaaggagauccgcuccucccucguccucuccaugcuccagcagaugcucauggaggacaaggccgaccucguccgcgaggccgucaucaagucccucggcaucaucaugggcuacaucgacgaccccgacaaguaccaccagggcuucgagcuccuccucuccgcccucggcgaccccuccgagcgcgucgucuccgccacccaccaggucuuccuccccgccuacgccgccuggaccaccgagcucggcaaccuccagucccaccucauccucacccuccucaacaagaucgagaagcuccuccgcgagggcgagcacggccucgacgagcacaagcuccacauguaccucuccgcccuccagucccucauccccucccucuucgcccucguccuccagaacgcccccuucuccuccaaggccaagcuccacggcgaggucccccagaucgaggucacccgcuucccccgccccauguccccccuccaggacgucuccaccaucaucggcucccgcgagcagcucgccguccuccuccagcucuacgacuaccagcucgagcaggagggcaccaccggcugggagucccuccucugggucgucaaccagcuccucccccagcucaucgagaucgucggcaagaucaacgucaccuccaccgccugcguccacgaguucucccgcuucuucuggcgccucugccgcaccuucggcaagaucuucaccaacaccaaggucaagccccaguuccaggagauccuccgccucuccgaggagaacaucgacuccuccgccggcaacggcguccucaccaaggccaccguccccaucuacgccaccggcguccucaccugcuacauccaggaggaggaccgcaagcuccucgucggcuuccucgaggacgucaugacccuccucucccucucccacgccccccucgacucccucaaggccuccuucgucgagcucggcgccaaccccgccuaccacgagcuccuccucaccguccucugguacggcgucguccacaccuccgcccucguccgcugcaccgccgcccgcauguucgagcucacccuccgcggcauguccgaggcccucgucgacaagcgcgucgcccccgcccucgucacccucuccuccgaccccgaguucuccguccgcaucgccaccauccccgccuucggcaccaucauggagaccgucauccagcgcgagcuccucgagcgcgucaagaugcagcucgccuccuuccucgaggacccccaguaccaggaccagcacucccuccacaccgagaucaucaagaccuucggccgcgucggccccaacgccgagccccgcuuccgcgacgaguucgucaucccccaccuccacaagcucgcccucgucaacaaccuccagaucgucgacuccaagcgccucgacaucgccacccaccucuucgaggccuacuccgcccucuccugcugcuucaucuccgaggaccucauggucaaccacuuccuccccggccuccgcugccuccgcaccgacauggagcaccucucccccgagcacgaggucauccucuccuccaugaucaaggagugcgagcagaaggucgagaacaagaccguccaggagccccagggcuccauguccaucgccgccucccucgucuccgaggacaccaagaccaaguuccucaacaagaugggccagcucaccaccuccggcgccaugcucgccaacgucuuccagcgcaagaaguga

SEQ ID NO: 45029 - RNA, 2718 nt, Artificial Sequence
  derived and/or modified sequence opt2 from KIAA1524__Homo_sapiens__NP_065941
auggacuccaccgccugccucaagucccuccuccucaccgucucccaguacaaggccgucaaguccgaggccaacgccacccagcuccuccgccaccucgaggucaucuccggccagaagcucacccgccucuucaccuccaaccagauccucaccuccgagugccucuccugccucgucgagcuccucgaggaccccaacaucuccgccucccucauccucuccaucaucggccuccucucccagcucgccgucgacaucgagacccgcgacugccuccagaacaccuacaaccucaacuccguccucgccggcgucgucugccgcuccucccacaccgacuccgucuuccuccagugcauccagcuccuccagaagcucaccuacaacgucaagaucuucuacuccggcgccaacaucgacgagcucaucaccuuccucaucgaccacauccaguccuccgaggacgagcucaagaugcccugccucggccuccucgccaaccucugccgccacaaccucuccguccagacccacaucaagacccucuccaacgucaaguccuucuaccgcacccucaucacccuccucgcccacuccucccucaccgucgucgucuucgcccucuccauccucuccucccucacccucaacgaggaggucggcgagaagcucuuccacgcccgcaacauccaccagaccuuccagcucaucuucaacauccucaucaacggcgacggcacccucacccgcaaguacuccgucgaccuccucauggaccuccucaagaaccccaagaucgccgacuaccucacccgcuacgagcacuucuccuccugccuccaccagguccucggccuccucaacggcaaggaccccgacuccuccuccaagguccucgagcuccuccucgccuucugcuccgucacccagcuccgccacaugcucacccagaugauguucgagcaguccccccccggcuccgccacccucggcucccacaccaagugccucgagcccaccgucgcccuccuccgcuggcucucccagccccucgacggcuccgagaacugcuccguccucgcccucgagcucuucaaggagaucuucgaggacgucaucgacgccgccaacugcuccuccgccgaccgcuucgucacccuccuccuccccaccauccucgaccagcuccaguucaccgagcagaaccucgacgaggcccucacccgcaagaagugcgagcgcaucgccaaggccaucgagguccuccucacccucugcggcgacgacacccucaagaugcacaucgccaagauccucaccaccgucaagugcaccacccucaucgagcagcaguucaccuacggcaagaucgaccucggcuucggcaccaaggucgccgacuccgagcucugcaagcucgccgccgacgucauccucaagacccucgaccucaucaacaagcucaagccccucguccccggcauggaggucuccuucuacaagauccuccaggacccccgccucaucaccccccucgccuucgcccucaccuccgacaaccgcgagcagguccaguccggccuccgcauccuccucgaggccgccccccuccccgacuuccccgcccucguccucggcgaguccaucgccgccaacaacgccuaccgccagcaggagaccgagcacaucccccgcaagaugcccuggcaguccuccaaccacuccuuccccaccuccaucaagugccucaccccccaccucaaggacggcguccccggccucaacaucgaggagcucaucgagaagcuccaguccggcauggucgucaaggaccagaucugcgacguccgcaucuccgacaucauggacgucuacgagaugaagcucuccacccucgccuccaaggagucccgccuccaggaccuccucgagaccaaggcccucgcccucgcccaggccgaccgccucaucgcccagcaccgcugccagcgcacccaggccgagaccgaggcccgcacccucgccuccaugcuccgcgaggucgagcgcaagaacgaggagcucuccguccuccucaaggcccagcaggucgaguccgagcgcgcccaguccgacaucgagcaccucuuccagcacaaccgcaagcucgaguccgucgccgaggagcacgagauccucaccaaguccuacauggagcuccuccagcgcaacgaguccaccgagaagaagaacaaggaccuccagaucaccugcgacucccucaacaagcagaucgagaccgucaagaagcucaacgagucccucaaggagcagaacgagaaguccaucgcccagcucaucgagaaggaggagcagcgcaaggagguccagaaccagcucgucgaccgcgagcacaagcucgccaaccuccaccagaagaccaagguccaggaggagaagaucaagacccuccagaaggagcgcgaggacaaggaggagaccaucgacauccuccgcaaggagcucucccgcaccgagcagauccgcaaggagcucuccaucaaggccuccucccucgagguccagaaggcccagcucgagggccgccucgaggagaaggagucccucgucaagcuccagcaggaggagcucaacaagcacucccacaugaucgccaugauccacucccucuccggcggcaagaucaaccccgagaccgucaaccucuccaucuga

SEQ ID NO: 45030 - RNA, 5853 nt, Artificial Sequence
  derived and/or modified sequence opt2 from KIAA1549__Homo_sapiens__NP_001158137
augcccggcgcccgccgccgccgccgcggcgccgccauggagggcaagccccgcgccggcgucgcccucgcccccggccccuccggccgccgccccuccgcccgcugcgcccgccgccgccgccccggccuccuccuccccggccucuggcuccuccuccucgcccgccccgccuccugcgcccccgacgagcucucccccgagcagcacaaccucucccucuacuccauggagcucguccucaagaaguccaccggccacuccgccgcccaggucgcccucaccgagaccgcccccggcucccagcacuccuccccccuccacgucaccgccccccccuccgccaccaccuucgacaccgccuucuucaaccagggcaagcagaccaaguccaccgccgaccccuccaucuucgucgccaccuacgucuccgucaccuccaaggaggucgccgucaacgacgacgagauggacaacuuccuccccgacacccacuggaccaccccccgcauggucucccccauccaguacaucaccgucuccccccccggccucccccgcgaggcccucgagcccaugcucacccccucccuccccauggucucccuccaggacgaggaggucaccuccggcuggcagaacaccacccgccagcccgccgccuacgccgaguccgccucccacuuccacaccuuccgcuccgccuuccgcaccuccgagggcaucguccccacccccggccgcaaccucguccucuaccccaccgacgccuacucccaccucuccucccgcacccuccccgagaucgucgccucccucaccgagggcgucgagaccacccucuuccucuccucccgcucccucaugccccagccccucggcgacggcaucaccaucccccuccccucccucggcgaggucucccagccccccgaggaggucugggccaccuccgccgaccgcuacaccgacgucaccaccguccucucccagucccucgaggagaccaucuccccccgcaccuaccccaccgucaccgccucccacgccgcccucgccuucucccgcacccacuccccccuccucuccaccccccucgccuucgccuccuccgccucccccaccgacgucuccuccaaccccuuccuccccuccgacuccuccaagaccuccgagcuccacuccaacuccgcccuccccggccccgucgacaacacccacauccucucccccgucuccuccuuccgccccuacaccuggugcgccgccugcaccguccccuccccccagcagguccucgccaccucccucauggagaaggacgucggcuccggcgacggcgccgagacccucugcaugaccguccucgaggaguccuccaucucccucauguccuccgucgucgccgacuucuccgaguucgaggaggacccccaggucuucaacacccucuuccccucccgccccaucgucccccucuccucccgcuccauggagaucuccgagaccuccgucggcaucuccgccgaggucgacauguccuccgucaccaccacccaggucccccccgcccacggccgccucuccguccccgccucccucgaccccaccgccggcucccucuccgucgccgagacccaggucacccccuccuccgucaccaccgccuucuucuccgucaucaccuccauccuccucgacuccuccuucuccgucaucgccaacaagaacacccccucccucgccguccgcgaccccuccgucuucacccccuacucccucguccccuccgucgaguccucccucuucuccgaccaggagcgcuccuccuucuccgagcacaagccccgcggcgcccucgacuucgccuccuccuucuucuccacccccccccucgagcucuccggcuccaucuccucccccuccgaggcccccgccucccucucccucaugcccuccgaccucucccccuucaccucccaguccuucuccccccucgucgagaccuucacccucuucgacuccuccgaccuccaguccucccagcucucccuccccuccuccaccaaccucgaguucucccagcuccagcccuccuccgagcucccccucaacaccaucaugcuccuccccucccgcuccgaggucucccccugguccuccuuccccuccgacucccucgaguucgucgaggccuccaccgucucccucaccgacuccgaggcccacuucaccuccgccuucaucgagaccaccuccuaccucgaguccucccucaucucccacgaguccgccgucaccgcccucgucccccccggcuccgaguccuucgacauccucaccgccggcauccaggccaccuccccccucaccaccguccacaccacccccauccucaccgaguccucccucuucuccacccucaccccccccgacgaccagaucuccgcccucgacggccacgucuccguccucgccuccuucuccaaggccauccccaccggcaccguccucaucaccgacgccuaccuccccuccggcuccuccuucgucuccgaggccacccccuucccccuccccaccgagcucaccgucgucggccccucccucacccccaccgaggucccccucaacaccuccaccgaggucuccaccaccuccaccggcgccgccaccggcggcccccucgacuccacccucaugggcgacgccgccucccaguccccccccgaguccuccgccgcccccccccuccccucccuccgccccgucaccgccuucacccucgaggccaccgucgacacccccacccucgccaccgccaagccccccuacgucugcgacaucaccguccccgacgccuaccucaucaccaccguccucgcccgccgcgccguccaggaguacaucaucaccgccaucaaggagguccuccgcauccacuucaaccgcgccgucgagcucaaggucuacgagcucuucaccgacuucaccuuccucgucaccuccggccccuucgucuacaccgccaucuccgucaucaacguccucaucaacuccaagcucguccgcgaccagaccccccucauccucuccgucaagcccuccuuccucguccccgagucccgcuuccagguccagaccguccuccaguucgucccccccuccgucgacaccggcuucugcaacuucacccagcgcaucgagaagggccucaugaccgcccucuucgagguccgcaagcaccaccagggcaccuacaaccucaccguccagauccucaacaucaccaucuccuccucccgcgucaccccccgccgcggccccgucaacaucaucuucgccgucaaguccacccagggcuuccucaacggcuccgaggucuccgagcuccuccgcaaccucuccgucgucgaguucuccuucuaccucggcuaccccguccuccagaucgccgagcccuuccaguacccccagcucaaccucucccagcuccucaaguccuccuggguccgcaccguccuccucggcgucauggagaagcagcuccagaacgaggucuuccaggccgagauggagcgcaagcucgcccagcuccucuccgaggucuccacccgccgccgcauguggcgccgcgccaccgucgccgccggcaacuccgucguccaggucgucaacgucucccgccucgagggcgacgacaaccccguccagcucaucuacuucgucgaggaccaggacggcgagcgccucuccgccgucaaguccuccgaccucaucaacaagauggaccuccagcgcgccgccaucauccucggcuaccgcauccagggcgucaucgcccagcccgucgaccgcgucaagcgccccucccccgagucccaguccaacaaccucugggucaucgucggcgucgucauccccguccucgucgucauggucaucgucgucauccucuacuggaagcucugccgcaccgacaagcucgacuuccagcccgacaccgucgccaacauccagcagcgccagaagcuccagauccccuccgucaagggcuucgacuucgccaagcagcaccucggccagcacaacaaggacgacauccucaucauccacgagcccgccccccuccccggcccccucaaggaccacaccacccccuccgagaacggcgacguccccucccccaaguccaagauccccuccaagaacguccgccaccgcggccgcgucucccccuccgacgccgacuccaccgucuccgaggaguccuccgagcgcgacgccggcgacaagacccccggcgccgucaacgacggccgcucccaccgcgccccccaguccggccccccccuccccuccuccggcaacgagcagcacuccuccgccuccaucuucgagcacgucgaccgcaucucccgcccccccgaggccucccgccgcguccccuccaagauccagcucaucgccaugcagcccauccccgccccccccguccagcgccccucccccgccgaccgcgucgccgaguccaacaagaucaacaaggagauccagaccgcccuccgccacaaguccgagaucgagcaccaccgcaacaagauccgccuccgcgccaagcgccgcggccacuacgaguuccccgucgucgacgaccucuccuccggcgacaccaaggagcgccaccgcgucuaccgccgcgcccagaugcagaucgacaagauccucgaccccaccgccuccguccccuccgucuucaucgagccccgcaaguccucccgcaucaagcgcucccccaagccccgccgcaagcaccaggucaacggcugccccgccgacgccgagaaggaccgccucaucaccaccgacuccgacggcaccuaccgccgcccccccggcguccacaacuccgccuacaucggcugccccuccgaccccgaccuccccgccgacguccagacccccuccuccgucgagcucggccgcuaccccgcccuccccuuccccgccucccaguacauccccccccagcccuccaucgaggaggcccgccagaccaugcacucccuccucgacgacgccuucgcccucgucgcccccuccucccagcccgccuccaccgccggcgucggccccggcgucccccccggccuccccgccaacuccacccccucccaggaggagcgccgcgccacccaguggggcuccuucuacucccccgcccagaccgccaacaaccccugcucccgcuacgaggacuacggcaugaccccccccaccggcccccucccccgccccggcuucggccccggccuccuccaguccaccgagcucgucccccccgacccccagcagccccaggccuccgccgaggcccccuucgccgcccgcggcaucuacuccgaggagaugcccuccgucgcccgcccccgccccgucggcggcaccaccggcucccagauccagcaccucacccaggucggcaucgccucccgcaucggcgcccagcccgucgagaucccccccucccgcggcucccaguacggcggccccggcuggcccuccuacggcgaggacgaggccggccgccgcgaggccacccacaugcucggccaccaggaguacuccuccuccccccucuuccaggucccccgcaccuccggccgcgagcccuccgcccccuccggcaaccucccccaccgcggccuccagggccccggccucggcuaccccaccuccuccaccgaggaccuccagcccggccacuccuccgccucccucaucaaggccauccgcgaggagcuccuccgccucucccagaagcaguccaccguccagaacuuccacuccuga

SEQ ID NO: 45031 - RNA, 5244 nt, Artificial Sequence
  derived and/or modified sequence opt2 from KIAA1551__Homo_sapiens__XP_005253462
augaacuggaacgagaagcccaaguccgccacccuccccccccucuaccccaagucccagccccccuuccuccaccagucccucaucaaccagaucaccaccaccucccaguccuccuucuccuaccccggcuccaaccaggaggccugcauguaccccggcaacuccaaccccaucucccagccccuccucaacauccagaacuacccccagcagaucuccgucuccgacaugcacaacggcaccgucgucgccucccacaccuccgucgagcgcaucaccuacgccaacgucaacggccccaagcagcucacccacaaccuccagauguccuccggcgucacccagaacgucuggcucaacucccccaugcgcaaccccguccacucccacaucggcgccaccgucucccaccagaccgacuucggcgccaacguccccaacaugcccgcccuccagucccagcucaucaccuccgacaccuacuccaugcagaugcagaugauccccuccaacuccacccgccuccccgucgccuaccagggcaaccagggccucaaccaguccuucuccgagcagcaggucgacuggacccagcagugcaucuccaagggccucaccuaccccgacuaccgccccccccccaagcucuaccgcuacuccccccaguccuuccuccccgacuccaccauccagaagcagaacuucaucccccacaccucccuccaggucaagaacucccagcuccucaacuccguccucacccuccccucccgccagaccuccgccguccccucccagcaguacgccacccagaccgacaagcgccccccccccccccccuacaacugccgcuacggcucccagccccuccaguccacccagcacaucaccaagcaccucuccauggaggucccccagucccgcgagaugcucuccuccgagauccgcaccuccuuccagcagcaguggcagaaccccaacgagaacgucuccaccaucggcaacuucaccaaccucaaggucaacaccaacuccaagcagcccuucaacucccccauccgcuccuccgucgacggcguccagacccucgcccagaccaacgaggagaagaucauggacuccugcaaccccaccuccaaccagguccucgacaccuccgucgccaaggagaagcucguccgcgacaucaagacccucgucgagaucaagcagaaguucuccgagcucgcccgcaagaucaagaucaacaaggaccuccucauggccgccggcugcaucaagaugaccaacaccuccuacuccgagcccgcccagaacuccaagcucucccucaagcagaccgccaagauccaguccggcccccagaucacccccgucaugcccgagaacgccgagcgccagacccccaccgucgucgaguccgccgagaccaacaagacccagugcaugcucaacuccgacauccaggaggucaacugccgccgcuucaaccaggucgacuccguccuccccaaccccgucuacuccgagaagcgccccaugcccgacuccucccacgacgucaagguccucaccuccaagaccuccgccgucgagaugacccaggccguccucaacacccagcucuccuccgagaacgucaccaaggucgagcagaacucccccgccgucugcgagaccaucuccguccccaaguccauguccaccgaggaguacaaguccaagauccagaacgagaacaugcuccuccucgcccuccucucccaggcccgcaagacccagaagaccguccucaaggacgccaaccagaccauccaggacuccaagcccgacuccugcgagaugaaccccaacacccagaugaccggcaaccagcucaaccucaagaacauggagacccccuccaccuccaacgucuccggccgcguccucgacaacuccuucugcuccggccaggaguccuccaccaagggcaugcccgccaaguccgacuccuccugcuccauggagguccucgccaccugccucucccucuggaagaagcagcccuccgacaccgccaaggagaaggagugcgacaagcuccgcaccaacaccaccgccgucggcaucuccaagcccgccaacauccacgucaagucccccugcuccgucgucggcaacuccaacucccagaacaagaucuccaaccccucccagcagaccgcccucuccauggucaugcacaacuacgaguccuccggcaucaacaucaccaagggcaccgagcuccagaucgccgucgucuccccccucguccucuccgaggucaagacccucuccgucaagggcaucacccccgccguccuccccgagaccgucuaccccgucaucaaggagggcuccgucugcucccuccagaaccagcucgccgagaacgccaaggccaccgccgcccucaaggucgacgucuccggccccgucgccuccaccgccaccuccaccaagaucuucccccucacccagaaggagaagcagaacgaguccaccaacggcaacuccgaggucacccccaacgucaaccagggcaagcacaacaagcucgaguccgccauccacucccccaugaacgaccagcagaucucccaggagucccgcaacuccaccgucgucuccuccgacacccuccagaucgacaacaucugcucccucgucgagggcgacaccuccuacaacucccagaucgccaagaucuucuccucccucccccucaagauggucgagccccagaagcccucccuccccaaccagcagggcaucggcucccgcgagcccgagaagcagcucgacaacaccaccgagaacaaggacuucggcuuccagaaggacaagcccguccagugcaccgacgucucccacaagaucugcgaccaguccaaguccgagcccccccucgaguccuccuucaacaaccucgagaccaaccgcgucauccucgagaaguccucccucgagcacgccaccgagaaguccaccgccaacgacaccugcuccuccgccgccauccaggaggacaucuacccccaggagaucgacgccuccuccaacuacaccccccaggaccccgcccgcaacgagauccacuccgacaaggcccccguccucuaccuccacgaccagcucuccgagcuccucaaggaguuccccuacggcaucgaggccgucaacacccgcgagggcuccgucggccagcagaccaccuaccagaccuccgaggaccagaccgccgacaagaccuccuccgacuccaaggaccccgccgaccagauccagaucaccauccucuccuccgagcagaugaaggagaucuuccccgagcaggacgaccagcccuacgucgucgacaagcucgccgagccccagaaggaggagcccaucaccgaggucgucucccagugcgaccuccaggcccccgccgccggccagucccgcgacuccgucauccucgacuccgagaaggacgacauccacugcugcgcccucggcuggcucuccauggucuacgagggcgucccccagugccagugcaacuccaucaagaacuccuccuccgaggaggagaagcagaaggagcagugcuccccccucgacaccaacuccugcaagcagggcgagcgcaccuccgaccgcgacgucaccgucguccaguucaagucccucgucaacaaccccaagaccccccccgacggcaagucccacuuccccgagcuccaggacgacucccgcaaggacacccccaagaccaagcacaagucccucccccgcaccgagcaggagcucgucgccggccaguucuccuccaagugcgacaagcucaacccccuccagaaccacaagcgcaagaagcuccgcuuccacgaggucaccuuccacuccuccaacaagaugaccgccuccuacgagcaggccucccaggagacccgccagaagaagcacgucacccagaacucccgcccccucaagaccaagaccgccuuccuccccaacaaggacgucuacaagaagcacuccucccucggccagucccucucccccgagaagaucaagcucaagcucaaguccgucuccuucaagcagaagcgcaagcucgaccagggcaacguccucgacauggaggucaagaagaagaagcacgacaagcaggagcagaagggcuccgucggcgccaccuucaagcucggcgacucccucuccaaccccaacgagcgcgccaucgucaaggagaagauggucuccaacaccaaguccgucgacaccaaggccuccuccuccaaguucucccgcauccucacccccaaggaguaccuccagcgccagaagcacaaggaggcccucuccaacaaggccuccaagaagaucugcgucaagaacguccccugcgacuccgagcacaugcgccccuccaagcucgccguccaggucgaguccugcggcaaguccaacgagaagcacuccuccggcguccagaccuccaaggagucccucaacggccucaccucccacggcaagaaccucaagauccaccacucccaggaguccaagaccuacaacauccuccgcaacgucaaggagaaggucggcggcaagcagcccgacaagaucuggaucgacaagaccaagcucgacaagcucaccaacaucuccaacgaggcccaguucucccagaugcccccccaggucaaggaccagaagaagcucuaccucaaccgcgucggcuucaagugcaccgagcgcgaguccaucucccucaccaagcucgaguccuccccccgcaagcuccacaaggacaagcgccaggagaacaagcacaagaccuuccuccccgucaagggcaacaccgagaaguccaacaugcucgaguucaagcucugccccgacauccuccucaagaacaccaacuccgucgaggagcgcaaggacgucaagccccacccccgcaaggagcaggccccccuccaggucuccggcaucaaguccaccaaggaggacuggcucaaguucgucgccaccaagaagcgcacccagaaggacucccaggagcgcgacaacgucaacucccgccucuccaagcgcuccuucuccgccgacggcuucgagaugcuccagaaccccgucaaggacuccaaggagauguuccagaccuacaagcagauguaccucgagaagcgcucccgcucccucggcuccucccccgucaaguga

SEQ ID NO: 45032 - RNA, 1896 nt, Artificial Sequence
  derived and/or modified sequence opt2 from KIAA1598__Homo_sapiens__NP_001120683
augaacuccuccgacgaggagaagcagcuccagcucaucaccucccucaaggagcaggccaucggcgaguacgaggaccuccgcgccgagaaccagaagaccaaggagaagugcgacaagauccgccaggagcgcgacgaggccgucaagaagcucgaggaguuccagaagaucucccacauggucaucgaggaggucaacuucaugcagaaccaccucgagaucgagaagaccugccgcgaguccgccgaggcccucgccaccaagcucaacaaggagaacaagacccucaagcgcaucuccaugcucuacauggccaagcucggccccgacgucaucaccgaggagaucaacaucgacgacgaggacuccaccaccgacaccgacggcgccgccgagaccugcgucuccguccagugccagaagcagaucaaggagcuccgcgaccagaucgucuccguccaggaggagaagaagauccucgccaucgagcucgagaaccucaaguccaagcucgucgaggucaucgaggaggucaacaaggucaagcaggagaagaccguccucaacuccgagguccucgagcagcgcaagguccucgagaagugcaaccgcgucuccaugcucgccgucgaggaguacgaggagaugcaggucaaccucgagcucgagaaggaccuccgcaagaaggccgaguccuucgcccaggagauguucaucgagcagaacaagcucaagcgccagucccaccuccuccuccaguccuccauccccgaccagcagcuccucaaggcccucgacgagaacgccaagcucacccagcagcucgaggaggagcgcauccagcaccagcagaaggucaaggagcucgaggagcagcucgagaacgagacccuccacaaggagauccacaaccucaagcagcagcucgagcuccucgaggaggacaagaaggagcucgagcucaaguaccagaacuccgaggagaaggcccgcaaccucaagcacuccgucgacgagcuccagaagcgcgucaaccaguccgagaacuccgucccccccccccccccccccccccccccccuccccccccccccccccaaccccauccgcucccucauguccaugauccgcaagcgcucccaccccuccggcuccggcgccaagaaggagaaggccacccagcccgagaccaccgaggaggucaccgaccucaagcgccaggccgucgaggagaugauggaccgcaucaagaagggcguccaccuccgccccgucaaccagaccgcccgccccaagaccaagcccgaguccuccaagggcugcgaguccgccgucgacgagcucaagggcauccucggcacccucaacaaguccaccuccucccgcucccucaagucccucgaccccgagaacuccgagaccgagcucgagcgcauccuccgccgccgcaaggucaccgccgaggccgacuccuccucccccaccggcauccucgccaccuccgaguccaaguccaugcccguccucggcuccgucuccuccgucaccaagaccgcccucaacaagaagacccucgaggccgaguucaacucccccuccccccccacccccgagcccggcgagggcccccgcaagcucgagggcugcaccuccuccaaggucaccuuccagccccccuccuccaucggcugccgcaagaaguacaucgacggcgagaagcaggccgagcccgucgucguccucgaccccgucuccacccacgagccccagaccaaggaccaggucgccgagaaggaccccacccagcacaaggaggacgagggcgagauccagcccgagaacaaggaggacuccaucgagaacguccgcgagaccgacuccuccaacugcuga

SEQ ID NO: 45033 - RNA, 1485 nt, Artificial Sequence
  derived and/or modified sequence opt2 from KIAA1715__Homo_sapiens__NP_001291937
augggccgcuccuggcccggccucucccucugccaguggcgccuccuccccgcccucgaggccggcugggccgucgccgccgagaccggcggcggcggccgccccggccgcgccgcccccgccuccugcuccugcgaguuccucuggaccaucgacgacaucuaccacugcgcccaguuccuccagaucaaggacggcuggaucaucuucuccauggagggcaagaccaagcccuccaccgucgagguccucgaguccaucgacaaggagauccaggcccucgaggaguuccgcgagaagaaccagcgccuccagaagcucugggucggccgccucauccucuacuccuccguccucuaccucuucaccugccucaucgucuaccucugguaccuccccgacgaguucaccgcccgccucgccaugacccuccccuucuucgccuucccccucaucaucugguccauccgcaccgucaucaucuucuucuucuccaagcgcaccgagcgcaacaacgaggcccucgacgaccucaagucccagcgcaagaagauccucgaggaggucauggagaaggagaccuacaagaccgccaagcucauccucgagcgcuucgaccccgacuccaagaaggccaaggagugcgagccccccuccgccggcgccgccgucaccgcccgccccggccaggagauccgccagcgcaccgccgcccagcgcaaccucucccccacccccgccucccccaaccagggcccccccccccagguccccgucucccccggcccccccaaggacuccuccgcccccggcggcccccccgagcgcaccgucacccccgcccucuccuccaacguccucccccgccaccucggcucccccgccaccuccguccccggcaugggccuccacccccccggccccccccucgcccgccccauccucccccgcgagcgcggcgcccucgaccgcaucgucgaguaccucgucggcgacggcccccagaaccgcuacgcccucaucugccagcagugcuucucccacaacggcauggcccucaaggaggaguucgaguacaucgccuuccgcugcgccuacugcuucuuccucaaccccgcccgcaagacccgcccccaggccccccgccuccccgaguucuccuucgagaagcgccaggucgucgagggcuccuccuccgucggcccccuccccuccggcuccguccucuccuccgacaaccaguucaacgaggagucccucgagcacgacguccucgacgacaacaccgagcagaccgacgacaagauccccgccaccgagcagaccaaccaggucaucgagaaggccuccgacuccgaggagcccgaggagaagcaggagaccgagaacgaggaggccuccgucaucgagaccaacuccaccguccccggcgccgacuccauccccgaccccgagcucuccggcgagucccucaccgccgaguga

SEQ ID NO: 45034 - RNA, 3111 nt, Artificial Sequence
  derived and/or modified sequence opt2 from KIAA1804__Homo_sapiens__NP_115811
auggcccuccgcggcgccgccggcgccaccgacacccccgucuccuccgccggcggcgcccccggcggcuccgccuccuccuccuccaccuccuccggcggcuccgccuccgccggcgccggccucugggccgcccucuacgacuacgaggcccgcggcgaggacgagcucucccuccgccgcggccagcucgucgagguccucucccaggacgccgccgucuccggcgacgagggcuggugggccggccagguccagcgccgccucggcaucuuccccgccaacuacgucgcccccugccgccccgccgccucccccgcccccccccccucccgccccuccucccccguccacgucgccuucgagcgccucgagcucaaggagcucaucggcgccggcggcuucggccaggucuaccgcgccaccuggcagggccaggaggucgccgucaaggccgcccgccaggaccccgagcaggacgccgccgccgccgccgaguccguccgccgcgaggcccgccucuucgccaugcuccgccaccccaacaucaucgagcuccgcggcgucugccuccagcagccccaccucugccucguccucgaguucgcccgcggcggcgcccucaaccgcgcccucgccgccgccaacgccgcccccgacccccgcgcccccggcccccgccgcgcccgccgcauccccccccacguccucgucaacugggccguccagaucgcccgcggcaugcucuaccuccacgaggaggccuucguccccauccuccaccgcgaccucaaguccuccaacauccuccuccucgagaagaucgagcacgacgacaucugcaacaagacccucaagaucaccgacuucggccucgcccgcgaguggcaccgcaccaccaagauguccaccgccggcaccuacgccuggauggcccccgaggucaucaaguccucccucuucuccaagggcuccgacaucugguccuacggcguccuccucugggagcuccucaccggcgagguccccuaccgcggcaucgacggccucgccgucgccuacggcgucgccgucaacaagcucacccuccccauccccuccaccugccccgagcccuucgccaagcucaugaaggagugcuggcagcaggacccccacauccgccccuccuucgcccucauccucgagcagcucaccgccaucgagggcgccgucaugaccgagaugccccaggaguccuuccacuccaugcaggacgacuggaagcucgagauccagcagauguucgacgagcuccgcaccaaggagaaggagcuccgcucccgcgaggaggagcucacccgcgccgcccuccagcagaagucccaggaggagcuccucaagcgccgcgagcagcagcucgccgagcgcgagaucgacguccucgagcgcgagcucaacauccucaucuuccagcucaaccaggagaagcccaaggucaagaagcgcaagggcaaguucaagcgcucccgccucaagcucaaggacggccaccgcaucucccuccccuccgacuuccagcacaagaucaccguccaggccucccccaaccucgacaagcgccgcucccucaacuccuccuccuccuccccccccuccucccccaccaugaugccccgccuccgcgccauccagcucaccuccgacgaguccaacaagaccuggggccgcaacaccgucuuccgccaggaggaguucgaggacgucaagcgcaacuucaagaagaagggcugcaccuggggccccaacuccauccagaugaaggaccgcaccgacugcaaggagcgcauccgcccccucuccgacggcaacucccccugguccaccauccucaucaagaaccagaagaccaugccccucgccucccucuucgucgaccagcccggcuccugcgaggagcccaagcucucccccgacggccucgagcaccgcaagcccaagcagaucaagcuccccucccaggccuacaucgaccucccccucggcaaggacgcccagcgcgagaaccccgccgaggccgaguccugggaggaggccgccuccgccaacgccgccaccgucuccaucgagaugacccccaccaacucccucucccgcuccccccagcgcaagaagaccgaguccgcccucuacggcugcaccguccuccucgccuccgucgcccucggccucgaccuccgcgagcuccacaaggcccaggccgccgaggagccccuccccaaggaggagaagaagaagcgcgagggcaucuuccagcgcgccuccaagucccgccgcuccgccuccccccccaccucccuccccuccaccugcggcgaggccuccuccccccccucccucccccucuccuccgcccucggcauccucuccacccccuccuucuccaccaagugccuccuccagauggacuccgaggacccccucgucgacuccgcccccgucaccugcgacuccgagaugcucacccccgacuucugccccaccgcccccggcuccggccgcgagcccgcccucaugccccgccucgacaccgacugcuccgucucccgcaaccuccccuccuccuuccuccagcagaccugcggcaacguccccuacugcgccuccuccaagcaccgccccucccaccaccgccgcaccauguccgacggcaaccccacccccaccggcgccaccaucaucuccgccaccggcgccuccgcccucccccucugccccucccccgccccccacucccaccucccccgcgaggucucccccaagaagcacuccaccguccacaucgucccccagcgccgccccgccucccuccgcucccgcuccgaccucccccaggccuacccccagaccgccgucucccagcucgcccagaccgccugcgucgucggccgccccggcccccaccccacccaguuccucgccgccaaggagcgcaccaagucccacguccccucccuccucgacgccgacgucgagggccagucccgcgacuacaccgucccccucugccgcaugcgcuccaagaccucccgccccuccaucuacgagcucgagaaggaguuccucuccuga

SEQ ID NO: 45035 - RNA, 2124 nt, Artificial Sequence
  derived and/or modified sequence opt2 from KIAA1841__Homo_sapiens__XP_005264663
augucccgcggcuacuccgagaacaacaacuuccucaacaacaacaaccagaugguccucgacaugauccucuacccccucaucggcaucccccagaccaucaacugggagaccaucgcccgccucguccccggccucacccccaaggagugcgccaagcgcuucgacgagcucaaguccuccggcuccucccccgucgacaaccaguacaacucccucauggccgccggcgagucccccgucgagacccucgccaccuacaucaaguccucccuccucgacauccacggcgaguuccaggagacccccgucggccacgacgccgucuccaagaccggccgccacuccaucgccuccacccgcaacugcuccuccgaguccgagaacugcaccacccacaacggcggcgagaugaccgaggaguccgagggccccaacauggucauccacgucugcgacgaggccaagaaccucaaggaggacuucaccugcccccgcgaccuccucaucuccgagaugaaguacuucgccgaguaccucuccauggacgcccagcgcugggaggaggucgacaucuccguccacugcgacguccacaucuucaacuggcucaucaaguacaucaagcgcaacaccaaggagaacaaggacugcgagaugcccacccucgagcccggcaacgucaucuccauccucaucuccuccgaguuccucaagauggacucccucgucgagcagugcauccaguacugccacaagaacaugaacgccaucgucgccacccccugcaacaugaacugcaucaacgccaaccuccucacccgcaucgccgaccucuucucccacaacgaggucgacgaccucaaggacaagaaggacaaguucaaguccaagcucuucugcaagaagaucgagcgccucuucgaccccgaguaccucaaccccgacucccgcuccaacgccgccacccucuaccgcugcugccucugcaagaagcuccucaccaaggagaccgagcgccgcauccccugcauccccggcaagaucaacgucgaccgccgcggcaacaucgucuacauccacauccgcgacaagaccugggacguccacgaguaccucaacucccucuucgaggagcucaaguccuggcgcgacgucuacuggcgccucuggggcaccaucaacuggcucaccugcucccgcugcuaccaggccuuccucugcaucgaguucucccacugccaguaccacuccgagaccgucgucuaccccaccgccgccuccucccucaacaccgucggcaccggcaucuaccccugcugcaaccagaagguccuccgcuucgaccccacccagcucaccaagggcugcaagguccgcgaccacauggucacccuccgcgaccagggcgagggcggcgaccuccccuccugccccaccgcccgcaugcucgacgaccuccacaaguaccgcgacgucaucgucguccccuucuccaaggacaccgucuccgacgucggcgucggccucugcgacgagaagggcaucgagugcgacguccuccucgagcccaacacccccuggggccccaagaccggcgagcucaacgccuuccucucccucaagaacuggacccuccagcucaagcagcagucccucuucuccgaggaggaggaguacaccaccggcuccgaggucaccgaggacgaggucggcgacgaggaggaggucuccaagaagcagcgcaagaaggagaagcccaagaaguucacccgccagcccaagaagcaggucuccucccccugcgcccagcgcaaggagaaggcccucgagaaguccgccucccgcgacgucucccccuucgucauguccaugcagaagaacaagugggacgccacccgcucccuccgcuucaaccaggacgcccagcgcgaggacgaccagcgccgcaugaccgagaucaccggccaccucaucaagaugcgccucggcgaccucgaccgcgucaaguccaaggaggccaaggagaccgacaagcuccgcccccgcgacggcaccgucuccaaguccaaccgcaaguccggccucuccuccguccuccucaugaccguccuccucugcuga

SEQ ID NO: 45036 - RNA, 1557 nt, Artificial Sequence
  derived and/or modified sequence opt2 from KIAA1919__Homo_sapiens__NP_699200
augcucugcgccuccuuccucggccucggccucuccgucgccaucgucggccccaccuuccaggaccucgccaccaacgucaaccgcaacaucuccucccucuccuucaucuucgucggccgcgcccucggcuaccucuccggcuccgucaucggcggcuuccucgucgacgucaugaacuacuuccuccuccucggcaucuccauguccgccaccaccgucggccucuaccucguccccuucugcaagaccgccauccuccucaccgucaugauguccaucuucggcgucuccaucggcauccucgacaccggcggcaacguccucauccucgccaucuggggcgacaagggcgccccccacaugcaggcccuccacuucuccuucgcccucggcgccuuccucgccccccuccucgccaagcucgcccucggccccaccgccuccgccgagaaccacaccgaguccgacuuccaccccgcccucaaccaguccuccgacgccgacuccgaggcccucuucggcguccccaacgacaagaaccuccucugggccuacgccgucaucggcaccuacauguuccucgucuccgucaucuucuucugccucuuccucaagaacuccuccaagcaggagaaggcccgcgccuccgccgagaccuuccgccgcgccaaguaccacaacgcccuccucugccuccucuuccucuucuucuucuucuacgucggcgccgaggucaccuacggcuccuacgucuucuccuucgccaccacccacgccggcaugaaggaguccgaggccgccggccucaacuccaucuucuggggcaccuucgccgccugccgcggccucgccaucuucuucgccaccugccuccagcccggcaccaugaucguccucuccaacaucggcucccucaccuccucccucuuccucguccucuucgacaagaaccccaucugccucuggaucgccaccuccgucuacggcgccuccauggccaccaccuuccccuccggcgucuccuggaucgagcaguacaccaccauccacggcaaguccgccgccuucuucgucaucggcgccucccucggcgagauggccauccccgccgucaucggcauccuccagggcaaguaccccgaccuccccgucguccucuacaccucccucggcgccuccaucgccaccggcauccucuuccccguccucuacaagcucgccaccuccccccucgaccgccagcgcaaggaggaccgcaaguccgaggaccagaaggcccuccucuccuccuccggccucaacgaguacgaggaggagaacgaggaggaggacgccgagaaguggaacgagauggacuucgagaugaucgagaccaacgacaccaugcgccacuccaucaucgagaccucccgcuccucccucaccgagcccaccgccgaggucuacaaccaguaccccuccaacgcccucgucuucgaguccucccccuucaacaccggcuccgcccacgucaagcaccuccccgagacccgcaccaagggcaccaacgucuga

SEQ ID NO: 45037 - RNA, 4551 nt, Artificial Sequence
  derived and/or modified sequence opt2 from KIAA2022__Homo_sapiens__NP_001008537
auggacaaccagcaggacaaggccaucgucgccuccgccaacggcgagaacacccucaucaacggcgucaaggagaacgacuccgaggaccaggacgucgccaugaaguccuucgccgcccucgaggccgccgcccccauccagcccacccccgucgcccagaaggagacccucauguacccccgcggccuccucccccuccccuccaagaagcccugcaugcaguccccccccuccccccucggccucaucgaggcccccgagcacgccgccaacuccgccuccgucaacgccaucucccucaccuccggcaucgccaagggccucaacaccuggucccuccccaacgagugcgagaaggcccccuucgccaucauggagcccgccggcauguccgcccucaacggcgacugccucaugcagcccucccgcaccugccucggcugcuucauggaguccaaggacgccgucgaccccgagcccggcaucucccucaaggucggcgaccucaaccgcgacuacgagaccugcgccgucuccgacaucggcauccagugcaucaacgccggcgagaacaugaaguacggcgagcagcuccucuccgaccagcuccucggcuucccccuccacaagucccgcgccggcgaccgccgcgagaccgagaagcccgacaucgaccucgaggaccccgcccagaaguccuacuacgaggcccuccuccucgacaagugcaacaccgaggaggcccuccucgccaacuccaaccaggacuggggcuacuucgagaccuucaucuccgaguccaagaucgagcuccucgaccucugcuccaagaacgagcucuccgucaaccucuucuccgaggaggacgucgacaacuacauguucgacgacgacgaguccacccucggcuccgacgucugcucccucaagauccgcuacgaguccuuccaggacaacguccgcgacaagaccacccuccucaugcaggaggacgcccaguucaacuucuuccccuccgucuucaccaccugccccaagcgcgaguccaaguccggcgcccucaagcaguccuccgacuucucccaguucaagguccccgacgucuccaucaucuggggcgaggaggacaagaaccucgacaagaagaagggcaaggaggagggccaggaggacaagggcgucgagaagaaggacggcaaggacaacggcgagaagcccgcccucaacaagcccugcuccggcaccgaggucgagcagcucaagaaccccaagcagggccaccucgccaacucccucgagaccuccggcuccuucuccgacgacuccuccuucaucgagaucuccuacgacgccaugggcgagaucaaggacugcucccgcuacauggcccgcgacaccaacuccggcuccuccuccucccagcagaacuacggccuccgcgccaagcgcaagguccgcuacuccgaggacuaccucuacgacgucgacucccucgagggcgagaaggucaacgagcgcaaggaguggcuccccgucggcuccaaggaggaggacgacgacgaguggugccccaagaagcgccgcaaggucacccgcaaggagccccccgucaucaucaaguacaucaucaucaaccgcuucaagggcgagaagaacaugcucgucaagcucggcaaggucgacgccuccgagaccaccgucaaccucuccgagaaccagcucaacaaguacgccaagcucgccccccucaagggcuucuggcagaagaagaagaagcagcgcaacaccaacaccgacuccaucaagacccccuucucccagaagcaguccuucgagcccggcuccuucgaggucuccuuccucccccccgcccgcaagcgcaaguccaagcucggcaaccgccaccgcauccagcgcauccccuccaucgagaucuccgccuccuccaagcagaucucccucugcaacgaccagcgccacgccuccaaccacaaggaggacggcggccucaagggcacccucaaguccgccccccucggcgcccccuccugcgccaacggcucccaccucaacgacaucaccggccccgacuccgucaaggucaaggcccaggacaccgaguucaagggccccgagcgcaagguccucaacaagaucaaguucaaguccgaggcccgccucaaguccaagaaggucaaggccgccggccaggaguccaagcccaucguccagauguccccccuccucgagaaccaguccuccaaggccaaccucaagaacgaggucauccccggcaccuccaacuccucccgccucuccgaguuccacgaggccaaggccgccaaguccuccaccuuccuccccaccaccugcuccuccgagaugccccucuccuccgccaacgucaccaccaacauccccgucauccccggcggcuaccuccagacccuccucgacgccuccgaccucuccaacaacaccuccaucuccuacuucucccaccacucccccgagcagaacgagggcucccucacccagaccgagaaguccuucgucccccuccagcccacccaggacugcguccucaccuccuccuccgacuccgagcuccagcaguccucccacaacuucaagauggaguccuccaacuaccgcaacgucuggcccaacaaggccaccuccggcacccaggaguucauggccgaggucucccgcgagaucgcccccacccaguccuccgaguucggcgccucccaggucgucuccauggagaacaaccucacccccaccaccuacaaccccaucugccucaacuccggcggcuccaacugcaacaagguccucuacgacuccaugcaggacacccagcuccccuccgacgacuccuaccagcucugccacuucaacaacggcgagaucugcuuccccuuccagcagggccccgucaacauggacgacggccgccucuucuccuucgacuccauggccccccucuccgucuccuccuccaacuacugcucccucucccucaaguccugcgagaaggacggcgacgacgacaucaccgacgacuuccucgcccacugcucccccaagcucgucauccagcaguccaucgacgagaucgccccccucaaggaguccaccgaccuccucgacaucuccaacuucacccccgacaaguuccgccacuccucccucuccgagauguccccccccgacacccccucccucuccccccagaucacccgcugcgaguccaugaagacccucggcacccucaagggcuuccaggagggcguccccggcccccucgacuccgucgagaagaucaagugggacugcuccacccucucccgccagguccagauggaggacggcuucacccucaacaaccaccaguuccaguuccacauguucaacgacgaggacuccgucucccuccuccagaagaaccccugccucuccaccuucaacgaccccuccggccagaucuccaccaacaacaaggucuccaagucccgcaagaaguccucccccuccaaguccggcgccaugaaccaguccuccucccagaagaacacccgcaagaagucccucaagggcaacaacaagggcaucgagaagccccccggcaagaacucccgccagguccccaaguccaccaagaagggcaaguacauggccgccaucaacggcgagaagaugcagaucggcaucggccgcggcggcucccagaccaacaccaucuccuccaccggcaagacccucgccgagugcauccagcacggcggccccauggccuccaugaagaugcccucccagaagggccucuccggcgacugggcccucggcaaggaguccucccccggcugguccgacauguccaugggcaccaacaccaacucccuccucgacgacgaccagcgcgaguuccaggagcccuccuacauccucuccaacaucgccuccggcauggccgacguccagcgcuucaugauggccuccaucgagccccucugggagcccauggagcaccacggcgaccccaacaucuucuacucccccgaguccaacucccucaagcucaagacccucaagauccucgccggcaccccccaggaguccaagaagaagaucaacuccggcucccagggcgccaccaagaaccaccgcuccaucaagggcgucuccaaguccaacggcaagaccgccaucggcgaccccggccgcgccaacaugcccggcuacaacgaggacucccgcuccaccuucuucgacaagaaguacuccaacauguccacccucggcaacaacggccccacccacaagaagcucuaccgccacaaguccuccuccaaggcccuccgcgacgagaagugcaagggcaagcacauggagcgcgagcagguccacaaggacgaguccggcaccgccuccuucgagaagcuccgcgacuccgacuacaaccuccucaaggccgagaccaccuucuggguccuccccgucuucgaggaggagacccgcaucuuccagaaggacaucuga

SEQ ID NO: 45038 - RNA, 5316 nt, Artificial Sequence
  derived and/or modified sequence opt2 from KIDINS220__Homo_sapiens__NP_065789
auguccguccucaucucccaguccgucaucaacuacgucgaggaggagaacauccccgcccucaaggcccuccucgagaagugcaaggacgucgacgagcgcaacgagugcggccagaccccccucaugaucgccgccgagcagggcaaccucgagaucgucaaggagcucaucaagaacggcgccaacugcaaccucgaggaccucgacaacuggaccgcccucaucuccgccuccaaggagggccacguccacaucgucgaggagcuccucaagugcggcgucaaccucgagcaccgcgacaugggcggcuggaccgcccucaugugggccugcuacaagggccgcaccgacgucgucgagcuccuccucucccacggcgccaaccccuccgucaccggccucuacuccgucuaccccaucaucugggccgccggccgcggccacgccgacaucguccaccuccuccuccagaacggcgccaaggucaacugcuccgacaaguacggcaccaccccccucgucugggccgcccgcaagggccaccucgagugcgucaagcaccuccucgccaugggcgccgacgucgaccaggagggcgccaacuccaugaccgcccucaucgucgccgucaagggcggcuacacccaguccgucaaggagauccucaagcgcaaccccaacgucaaccucaccgacaaggacggcaacaccgcccucaugaucgccuccaaggagggccacaccgagaucguccaggaccuccucgacgccggcaccuacgucaacauccccgaccgcuccggcgacaccguccucaucggcgccguccgcggcggccacgucgagaucguccgcgcccuccuccagaaguacgccgacaucgacauccgcggccaggacaacaagaccgcccucuacugggccgucgagaagggcaacgccaccaugguccgcgacauccuccagugcaaccccgacaccgagaucugcaccaaggacggcgagaccccccucaucaaggccaccaagaugcgcaacaucgaggucgucgagcuccuccucgacaagggcgccaaggucuccgccgucgacaagaagggcgacaccccccuccacaucgccauccgcggccgcucccgcaagcucgccgagcuccuccuccgcaaccccaaggacggccgccuccucuaccgccccaacaaggccggcgagacccccuacaacaucgacugcucccaccagaaguccauccucacccagaucuucggcgcccgccaccucucccccaccgagaccgacggcgacaugcucggcuacgaccucuacuccuccgcccucgccgacauccucuccgagcccaccaugcagccccccaucugcgucggccucuacgcccaguggggcuccggcaaguccuuccuccucaagaagcucgaggacgagaugaagaccuucgccggccagcagaucgagccccucuuccaguucuccuggcucaucgucuuccucacccuccuccucugcggcggccucggccuccucuucgccuucaccguccaccccaaccucggcaucgccgucucccucuccuuccucgcccuccucuacaucuucuucaucgucaucuacuucggcggccgccgcgagggcgaguccuggaacugggccuggguccucuccacccgccucgcccgccacaucggcuaccucgagcuccuccucaagcucauguucgucaacccccccgagcuccccgagcagaccaccaaggcccuccccguccgcuuccucuucaccgacuacaaccgccucuccuccgucggcggcgagaccucccucgccgagaugaucgccacccucuccgacgccugcgagcgcgaguucggcuuccucgccacccgccucuuccgcgucuucaagaccgaggacacccagggcaagaagaaguggaagaagaccugcugccuccccuccuucgucaucuuccucuucaucaucggcugcaucaucuccggcaucacccuccucgccaucuuccgcgucgaccccaagcaccucaccgucaacgccguccucaucuccaucgccuccgucgucggccucgccuucguccucaacugccgcaccugguggcagguccucgacucccuccucaacucccagcgcaagcgccuccacaacgccgccuccaagcuccacaagcucaaguccgagggcuucaugaagguccucaagugcgaggucgagcucauggcccgcauggccaagaccaucgacuccuucacccagaaccagacccgccucgucgucaucaucgacggccucgacgccugcgagcaggacaagguccuccagaugcucgacaccguccgcguccucuucuccaagggccccuucaucgccaucuucgccuccgacccccacaucaucaucaaggccaucaaccagaaccucaacuccguccuccgcgacuccaacaucaacggccacgacuacaugcgcaacaucguccaccuccccgucuuccucaacucccgcggccucuccaacgcccgcaaguuccucgucaccuccgccaccaacggcgacguccccugcuccgacaccaccggcauccaggaggacgccgaccgccgcgucucccagaacucccucggcgagaugaccaagcucggcuccaagaccgcccucaaccgccgcgacaccuaccgccgccgccagaugcagcgcaccaucacccgccagauguccuucgaccucaccaagcuccucgucaccgaggacugguucuccgacaucuccccccagaccaugcgccgccuccucaacaucgucuccgucaccggccgccuccuccgcgccaaccagaucuccuucaacugggaccgccucgccuccuggaucaaccucaccgagcaguggcccuaccgcaccuccuggcucauccucuaccucgaggagaccgagggcauccccgaccagaugacccucaagaccaucuacgagcgcaucuccaagaacauccccaccaccaaggacgucgagccccuccucgagaucgacggcgacauccgcaacuucgaggucuuccucuccucccgcacccccguccucgucgcccgcgacgucaaggucuuccuccccugcaccgucaaccucgaccccaagcuccgcgagaucaucgccgacguccgcgccgcccgcgagcagaucuccaucggcggccucgccuaccccccccucccccuccacgagggccccccccgcgcccccuccggcuacucccagccccccuccgucugcuccuccaccuccuucaacggccccuucgccggcggcgucgucuccccccagccccacuccuccuacuacuccggcaugaccggcccccagcaccccuucuacaaccgccccuucuucgcccccuaccucuacaccccccgcuacuaccccggcggcucccagcaccucaucucccgccccuccgucaagaccucccucccccgcgaccagaacaacggccucgaggucaucaaggaggacgccgccgagggccucuccucccccaccgacuccucccgcggcuccggccccgcccccggccccgucguccuccucaacucccucaacgucgacgccgucugcgagaagcucaagcagaucgagggccucgaccaguccaugcucccccaguacugcaccaccaucaagaaggccaacaucaacggccgcguccucgcccagugcaacaucgacgagcucaagaaggagaugaacaugaacuucggcgacuggcaccucuuccgcuccaccguccucgagaugcgcaacgccgagucccacgucguccccgaggacccccgcuuccucuccgaguccuccuccggccccgccccccacggcgagcccgcccgccgcgccucccacaacgagcucccccacaccgagcucuccucccagacccccuacacccucaacuucuccuucgaggagcucaacacccucggccucgacgagggcgccccccgccacuccaaccucuccuggcagucccagacccgccgcacccccucccucuccucccucaacucccaggacuccuccaucgagaucuccaagcucaccgacaagguccaggccgaguaccgcgacgccuaccgcgaguacaucgcccagaugucccagcucgagggcggccccggcuccaccaccaucuccggccgcuccuccccccacuccaccuacuacaugggccaguccuccuccggcggcuccauccacuccaaccucgagcaggagaagggcaaggacuccgagcccaagcccgacgacggccgcaaguccuuccucaugaagcgcggcgacgucaucgacuacuccuccuccggcgucuccaccaacgacgccuccccccucgaccccaucaccgaggaggacgagaaguccgaccaguccggcuccaagcuccuccccggcaagaaguccuccgagcgcuccucccucuuccagaccgaccucaagcucaagggcuccggccuccgcuaccagaagcuccccuccgacgaggacgaguccggcaccgaggaguccgacaacaccccccuccucaaggacgacaaggaccgcaaggccgagggcaaggucgagcgcguccccaagucccccgagcacuccgccgagcccauccgcaccuucaucaaggccaaggaguaccucuccgacgcccuccucgacaagaaggacuccuccgacuccggcguccgcuccuccgaguccucccccaaccacucccuccacaacgaggucgccgacgacucccagcucgagaaggccaaccucaucgagcucgaggacgacucccacuccggcaagcgcggcaucccccacucccucuccggccuccaggaccccaucaucgcccgcauguccaucugcuccgaggacaagaagucccccuccgagugcucccucaucgccuccucccccgaggagaacuggcccgccugccagaaggccuacaaccucaaccgcacccccuccaccgucacccucaacaacaacuccgcccccgccaaccgcgccaaccagaacuucgacgagauggagggcauccgcgagaccucccaggucauccuccgccccuccuccucccccaaccccaccaccauccagaacgagaaccucaaguccaugacccacaagcgcucccagcgcuccuccuacacccgccucuccaaggacccccccgagcuccacgccgccgccuccuccgaguccaccggcuucggcgaggagcgcgaguccauccucuga

SEQ ID NO: 45039 - RNA, 3171 nt, Artificial Sequence
  derived and/or modified sequence opt2 from KIF11__Homo_sapiens__NP_004514
auggccucccagcccaacuccuccgccaagaagaaggaggagaagggcaagaacauccaggucgucguccgcugccgccccuucaaccucgccgagcgcaaggccuccgcccacuccaucgucgagugcgaccccguccgcaaggaggucuccguccgcaccggcggccucgccgacaaguccucccgcaagaccuacaccuucgacauggucuucggcgccuccaccaagcagaucgacgucuaccgcuccgucgucugccccauccucgacgaggucaucaugggcuacaacugcaccaucuucgccuacggccagaccggcaccggcaagaccuucaccauggagggcgagcgcucccccaacgaggaguacaccugggaggaggacccccucgccggcaucaucccccgcacccuccaccagaucuucgagaagcucaccgacaacggcaccgaguucuccgucaaggucucccuccucgagaucuacaacgaggagcucuucgaccuccucaaccccuccuccgacgucuccgagcgccuccagauguucgacgacccccgcaacaagcgcggcgucaucaucaagggccucgaggagaucaccguccacaacaaggacgaggucuaccagauccucgagaagggcgccgccaagcgcaccaccgccgccacccucaugaacgccuacuccucccgcucccacuccgucuucuccgucaccauccacaugaaggagaccaccaucgacggcgaggagcucgucaagaucggcaagcucaaccucgucgaccucgccggcuccgagaacaucggccgcuccggcgccgucgacaagcgcgcccgcgaggccggcaacaucaaccagucccuccucacccucggccgcgucaucaccgcccucgucgagcgcaccccccacguccccuaccgcgaguccaagcucacccgcauccuccaggacucccucggcggccgcacccgcaccuccaucaucgccaccaucucccccgccucccucaaccucgaggagacccucuccacccucgaguacgcccaccgcgccaagaacauccucaacaagcccgaggucaaccagaagcucaccaagaaggcccucaucaaggaguacaccgaggagaucgagcgccucaagcgcgaccucgccgccgcccgcgagaagaacggcgucuacaucuccgaggagaacuuccgcgucauguccggcaagcucaccguccaggaggagcagaucgucgagcucaucgagaagaucggcgccgucgaggaggagcucaaccgcgucaccgagcucuucauggacaacaagaacgagcucgaccagugcaaguccgaccuccagaacaagacccaggagcucgagaccacccagaagcaccuccaggagaccaagcuccagcucgucaaggaggaguacaucaccuccgcccucgaguccaccgaggagaagcuccacgacgccgccuccaagcuccucaacaccgucgaggagaccaccaaggacgucuccggccuccacuccaagcucgaccgcaagaaggccgucgaccagcacaacgccgaggcccaggacaucuucggcaagaaccucaacucccucuucaacaacauggaggagcucaucaaggacggcuccuccaagcagaaggccaugcucgagguccacaagacccucuucggcaaccuccucuccuccuccgucuccgcccucgacaccaucaccaccgucgcccucggcucccucaccuccauccccgagaacgucuccacccacgucucccagaucuucaacaugauccucaaggagcagucccucgccgccgaguccaagaccguccuccaggagcucaucaacguccucaagaccgaccuccucuccucccucgagaugauccucucccccaccgucgucuccauccucaagaucaacucccagcucaagcacaucuucaagaccucccucaccgucgccgacaagaucgaggaccagaagaaggagcucgacggcuuccucuccauccucugcaacaaccuccacgagcuccaggagaacaccaucugcucccucgucgagucccagaagcagugcggcaaccucaccgaggaccucaagaccaucaagcagacccacucccaggagcucugcaagcucaugaaccucuggaccgagcgcuucugcgcccucgaggagaagugcgagaacauccagaagccccucuccuccguccaggagaacauccagcagaaguccaaggacaucgucaacaagaugaccuuccacucccagaaguucugcgccgacuccgacggcuucucccaggagcuccgcaacuucaaccaggagggcaccaagcucgucgaggaguccgucaagcacuccgacaagcucaacggcaaccucgagaagaucucccaggagaccgagcagcgcugcgagucccucaacacccgcaccgucuacuucuccgagcagugggucuccucccucaacgagcgcgagcaggagcuccacaaccuccucgaggucgucucccagugcugcgaggccuccuccuccgacaucaccgagaaguccgacggccgcaaggccgcccacgagaagcagcacaacaucuuccucgaccagaugaccaucgacgaggacaagcucaucgcccagaaccucgagcucaacgagaccaucaagaucggccucaccaagcucaacugcuuccucgagcaggaccucaagcucgacauccccaccggcaccaccccccagcgcaaguccuaccucuaccccuccacccucguccgcaccgagccccgcgagcaccuccucgaccagcucaagcgcaagcagcccgagcuccucaugaugcucaacugcuccgagaacaacaaggaggagaccauccccgacgucgacgucgaggaggccguccucggccaguacaccgaggagccccucucccaggagcccuccgucgacgccggcgucgacugcuccuccaucggcggcguccccuucuuccagcacaagaagucccacggcaaggacaaggagaaccgcggcaucaacacccucgagcgcuccaaggucgaggagaccaccgagcaccucgucaccaagucccgccucccccuccgcgcccagaucaaccucuga

SEQ ID NO: 45040 - RNA, 5313 nt, Artificial Sequence
  derived and/or modified sequence opt2 from KIF13A__Homo_sapiens__NP_001099036
auguccgacaccaaggucaaggucgccguccgcguccgccccaugaaccgccgcgagcucgagcucaacaccaagugcgucgucgagauggagggcaaccagaccguccuccaccccccccccuccaacaccaagcagggcgagcgcaagccccccaaggucuucgccuucgacuacugcuucugguccauggacgaguccaacaccaccaaguacgccggccaggaggucgucuucaagugccucggcgagggcauccucgagaaggccuuccagggcuacaacgccugcaucuucgccuacggccagaccggcuccggcaaguccuucuccaugaugggccacgccgagcagcucggccucaucccccgccucugcugcgcccucuucaagcgcaucucccucgagcagaacgagucccagaccuucaaggucgaggucuccuacauggagaucuacaacgagaagguccgcgaccuccucgaccccaagggcucccgccagucccucaagguccgcgagcacaagguccucggccccuacgucgacggccucucccagcucgccgucaccuccuucgaggacaucgagucccucauguccgagggcaacaagucccgcaccgucgccgccaccaacaugaacgaggaguccucccgcucccacgccgucuucaacaucaucaucacccagacccucuacgaccuccaguccggcaacuccggcgagaaggucuccaaggucucccucgucgaccucgccggcuccgagcgcgucuccaagaccggcgccgccggcgagcgccucaaggagggcuccaacaucaacaagucccucaccacccucggccucgucaucuccucccucgccgaccaggccgccggcaagggcaaguccaaguucguccccuaccgcgacuccguccucaccuggcuccucaaggacaaccucggcggcaacucccagaccuccaugaucgccaccaucucccccgccgccgacaacuacgaggagacccucuccacccuccgcuacgccgaccgcgccaagcgcaucgucaaccacgccgucgucaacgaggaccccaacgccaaggucauccgcgagcuccgcgaggaggucgagaagcuccgcgagcagcucucccaggccgaggccaugaaggcccccgagcucaaggagaagcucgaggaguccgagaagcucaucaaggagcucaccgucaccugggaggagaagcuccgcaagaccgaggagaucgcccaggagcgccagcgccagcucgaguccaugggcaucucccucgagauguccggcaucaaggucggcgacgacaagugcuaccucgucaaccucaacgccgaccccgcccucaacgagcuccucgucuacuaccucaaggaccacacccgcgucggcgccgacaccucccaggacauccagcucuucggcaucggcauccagccccagcacugcgagaucgacaucgccuccgacggcgacgucacccucacccccaaggagaacgcccgcuccugcgucaacggcacccucgucugcuccaccacccagcucuggcacggcgaccgcauccucuggggcaacaaccacuucuuccgcaucaaccuccccaagcgcaagcgccgcgacuggcucaaggacuucgagaaggagaccggcccccccgagcacgaccucgacgccgccuccgaggccuccuccgagcccgacuacaacuacgaguucgcccagauggaggucaucaugaagacccucaacuccaacgaccccguccagaacgucguccagguccucgagaagcaguaccucgaggagaagcgcuccgcccucgaggagcagcgccucauguacgagcgcgagcucgagcagcuccgccagcagcucucccccgaccgccagccccaguccuccggccccgaccgccucgccuacuccucccagaccgcccagcagaaggucacccagugggccgaggagcgcgacgagcucuuccgccagucccucgccaagcuccgcgagcagcucgucaaggccaacacccucguccgcgaggccaacuuccucgccgaggagauguccaagcucaccgacuaccaggucacccuccagauccccgccgccaaccucuccgccaaccgcaagcgcggcgccaucgucuccgagcccgccauccagguccgccgcaagggcaaguccacccaggucuggaccaucgagaagcucgagaacaagcucaucgacaugcgcgaccucuaccaggaguggaaggagaagguccccgaggccaagcgccucuacggcaagcgcggcgaccccuucuacgaggcccaggagaaccacaaccucaucggcgucgccaacgucuuccucgagugccucuucugcgacgucaagcuccaguacgccguccccaucaucucccagcagggcgaggucgccggccgccuccacgucgaggucaugcgcgucaccggcgccguccccgagcgcgucgucgaggacgacuccuccgagaacuccuccgaguccggcucccucgaggucgucgacuccuccggcgagaucauccaccgcgucaagaagcucaccugccgcgucaagaucaaggaggccaccggccucccccucaaccucuccaacuucgucuucugccaguacaccuucugggaccagugcgaguccaccgucgccgcccccgucgucgaccccgagguccccuccccccaguccaaggacgcccaguacaccgucaccuucucccacugcaaggacuacgucgucaacgucaccgaggaguuccucgaguucaucuccgacggcgcccucgccaucgaggucuggggccaccgcugcgccggcaacggcuccuccaucugggaggucgacucccuccacgccaagacccgcacccuccacgaccgcuggaacgaggucacccgccgcaucgagauguggaucuccauccucgagcucaacgagcucggcgaguacgccgccgucgagcuccaccaggccaaggacgucaacaccggcggcaucuuccagcuccgccagggccacucccgccgcguccaggucaccgucaagcccguccagcacuccggcacccucccccucauggucgaggccauccucuccgucuccaucggcugcgucaccgcccgcuccaccaagcuccagcgcggccucgacuccuaccagcgcgacgacgaggacggcgacgacauggacuccuaccaggaggaggaccucaacugcguccgcgagcgcugguccgacgcccucaucaagcgccgcgaguaccucgacgagcagaucaagaaggucuccaacaagaccgagaagaccgaggacgacgucgagcgcgaggcccagcucgucgagcagugggucggccucaccgaggagcgcaacgccguccucguccccgcccccggcuccggcauccccggcgcccccgccgacuggauccccccccccggcauggagacccacauccccguccucuuccucgaccucaacgccgacgaccucuccgccaacgagcagcucgucggcccccacgccuccggcgucaacuccauccuccccaaggagcacggcucccaguucuucuaccuccccaucaucaagcacuccgacgacgaggucuccgccaccgccuccugggacuccuccguccacgacuccguccaccucaaccgcgucaccccccagaacgagcgcaucuaccucaucgucaagaccaccguccagcucucccaccccgccgccauggagcucguccuccgcaagcgcaucgccgccaacaucuacaacaagcaguccuucacccagucccucaagcgccgcaucucccucaagaacaucuucuacuccugcggcgucaccuacgagaucgucuccaacauccccaaggccaccgaggagaucgaggaccgcgagacccucgcccuccucgccgcccgcuccgagaacgagggcaccuccgacggcgagaccuacaucgagaaguacacccgcggcguccuccaggucgagaacauccucucccucgagcgccuccgccaggccgucaccgucaaggaggcccucuccaccaaggcccgccacauccgccgcucccucuccacccccaacguccacaacgucuccuccucccgccccgaccucuccggcuucgacgaggacgacaagggcuggcccgagaaccagcucgacauguccgacuacuccuccuccuaccaggacgucgccugcuacggcacccucccccgcgacuccccccgccgcaacaaggagggcugcaccuccgagaccccccacgcccucaccgucucccccuucaaggccuucuccccccagccccccaaguucuucaagccccucaugcccgucaaggaggagcacaagaagcgcaucgcccucgaggcccgcccccuccucucccaggaggacuccgaggaggaggagaacgagcucgaggccaucaaccgcaagcucaucuccucccagcccuacguccccgucgaguucgccgacuucuccgucuacaacgccucccucgagaaccgcgagugguucuccuccaaggucgaccucuccaacucccgcguccucgagaaggaggucucccgcucccccaccaccuccuccaucaccuccggcuacuucucccacuccgccuccaacgccacccucuccgacauggucguccccuccuccgacuccuccgaccagcucgccauccagaccaaggacgccgacuccaccgagcacuccacccccucccucguccacgacuuccgccccuccuccaacaaggagcucaccgaggucgagaagggccucgucaaggacaagaucaucgucgucccccucaaggagaacuccgcccucgccaagggcucccccuccucccaguccauccccgagaagaacuccaagucccucugccgcaccggcuccugcuccgagcucgacgccugccccuccaagaucucccagcccgcccgcggcuucugcccccgcgaggucaccgucgagcacaccaccaacauccucgaggaccacuccuucaccgaguucaugggcgucuccgagggcaaggacuucgacggccucaccgacuccuccgccggcgagcucuccucccgccgcucccuccccaacaagaccggcggcaagaccgucuccgacggccuccaccaccccucccagcuccacuccaagcucgagaacgaccaggucaucauccccgaggccgccuucuggguccucugcugccaguga

SEQ ID NO: 45041 - RNA, 4947 nt, Artificial Sequence
  derived and/or modified sequence opt2 from KIF14__Homo_sapiens__NP_055690
augucccuccacuccacccacaaccgcaacaacuccggcgacauccucgacauccccuccucccagaacuccuccucccucaacgcccucacccacuccucccgccucaagcuccaccucaaguccgacauguccgagugcgagaacgacgacccccuccuccgcuccgccggcaagguccgcgacaucaaccgcaccuacgucaucuccgccucccgcaagaccgccgacaugccccucacccccaaccccgucggccgccucgcccuccagcgccgcaccacccgcaacaaggaguccucccuccucgucuccgagcucgaggacaccaccgagaagaccgccgagacccgccucacccuccagcgccgcgccaagaccgacuccgccgagaaguggaagaccgccgagaucgacuccgucaagaugacccucaacgucggcggcgagaccgagaacaacggcgucuccaaggagucccgcaccaacguccgcaucgucaacaacgccaagaacuccuucgucgccuccuccgucccccucgacgaggacccccaggucaucgagaugauggccgacaagaaguacaaggagaccuucuccgcccccucccgcgccaacgagaacgucgcccucaaguacuccuccaaccgcccccccaucgccucccucucccagaccgaggucguccgcuccggccaccucaccaccaagcccacccaguccaagcucgacaucaagguccucggcaccggcaaccucuaccaccgcuccaucggcaaggagaucgccaagaccuccaacaaguucggcucccucgagaagcgcacccccaccaagugcaccaccgagcacaagcucaccaccaagugcucccucccccagcucaagucccccgcccccuccauccucaagaaccgcauguccaaccuccaggucaagcagcgccccaaguccuccuuccucgccaacaagcaggagcgcuccgccgagaacaccauccuccccgaggaggagaccgucguccagaacaccuccgccggcaaggacccccucaaggucgagaacucccaggucaccgucgccguccgcguccgccccuucaccaagcgcgagaagaucgagaaggccucccaggucgucuucauguccggcaaggagaucaccgucgagcaccccgacaccaagcaggucuacaacuucaucuacgacgucuccuucugguccuucgacgagugccacccccacuacgccucccagaccaccgucuacgagaagcucgccgccccccuccucgagcgcgccuucgagggcuucaacaccugccucuucgccuacggccagaccggcuccggcaaguccuacaccaugaugggcuucuccgaggagcccggcaucaucccccgcuucugcgaggaccucuucucccaggucgcccgcaagcagacccaggaggucuccuaccacaucgagauguccuucuucgaggucuacaacgagaagauccacgaccuccucgucugcaaggacgagaacggccagcgcaagcagccccuccgcguccgcgagcaccccgucuacggccccuacgucgaggcccucuccaugaacaucgucuccuccuacgccgacauccaguccuggcucgagcucggcaacaagcagcgcgccaccgccgccaccggcaugaacgacaaguccucccgcucccacuccgucuucacccucgucaugacccagaccaagaccgaguucgucgagggcgaggagcacgaccaccgcaucaccucccgcaucaaccucaucgaccucgccggcuccgagcgcugcuccaccgcccacaccaacggcgaccgccucaaggagggcgucuccaucaacaagucccuccucacccucggcaaggucaucuccgcccucuccgagcaggccaaccagcgcuccgucuucauccccuaccgcgaguccguccucaccuggcuccucaaggagucccucggcggcaacuccaagaccgccaugaucgccaccaucucccccgccgccuccaacaucgaggagacccucuccacccuccgcuacgccaaccaggcccgccucaucgucaacaucgccaaggucaacgaggacaugaacgccaagcucauccgcgagcucaaggccgagaucgccaagcucaaggccgcccagcgcaacucccgcaacaucgaccccgagcgcuaccgccucugccgccaggagaucaccucccuccgcaugaagcuccaccagcaggagcgcgacauggccgagaugcagcgcgucuggaaggagaaguucgagcaggccgagaagcgcaagcuccaggagaccaaggagcuccagaaggccggcaucauguuccagauggacaaccaccuccccaaccucgucaaccucaacgaggacccccagcucuccgagaugcuccucuacaugaucaaggagggcaccaccaccgucggcaaguacaagcccaacuccucccacgacauccagcucuccggcguccucaucgccgacgaccacugcaccaucaagaacuucggcggcaccgucuccaucauccccgucggcgaggccaagaccuacgucaacggcaagcacauccucgagaucaccguccuccgccacggcgaccgcgucauccucggcggcgaccacuacuuccgcuucaaccaccccgucgagguccagaagggcaagcgccccuccggccgcgacacccccaucuccgagggccccaaggacuucgaguucgccaagaacgagcuccucauggcccagcgcucccagcucgaggccgagaucaaggaggcccagcucaaggccaaggaggagaugaugcagggcauccagaucgccaaggagauggcccagcaggagcucuccucccagaaggccgccuacgaguccaagaucaaggcccucgaggccgagcuccgcgaggagucccagcgcaagaagaugcaggagaucaacaaccagaaggccaaccacaagaucgaggagcucgagaaggccaagcagcaccucgagcaggagaucuacgucaacaagaagcgccucgagauggagacccucgccaccaagcaggcccucgaggaccacuccauccgccacgcccgcauccucgaggcccucgagaccgagaagcagaagaucgccaaggagguccagauccuccagcagaaccgcaacaaccgcgacaagaccuucaccguccagaccaccugguccuccaugaagcucuccaugaugauccaggaggccaacgccaucuccuccaagcucaagaccuacuacgucuucggccgccacgacaucuccgacaaguccuccuccgacaccuccauccgcguccgcaaccucaagcucggcaucuccaccuucuggucccucgagaaguucgaguccaagcucgccgccaugaaggagcucuacgaguccaacggcuccaaccgcggcgaggacgccuucugcgaccccgaggacgagugggagcccgacaucaccgacgcccccgucuccucccucucccgccgccgcucccgcucccucaugaagaaccgccgcaucuccggcugccuccacgacauccagguccaccccaucaagaaccuccacuccucccacuccuccggccucauggacaaguccuccaccaucuacuccaacuccgccgaguccuuccuccccggcaucugcaaggagcucaucggcuccucccucgacuucuucggccaguccuacgacgaggagcgcaccaucgccgacucccucaucaacuccuuccucaagaucuacaacggccucuucgccaucuccaaggcccacgaggagcaggacgaggagucccaggacaaccucuucuccuccgaccgcgccauccagucccucaccauccagaccgccugcgccuucgagcagcucgucguccucaugaagcacuggcucuccgaccuccuccccugcaccaacaucgcccgccucgaggacgagcuccgccaggaggucaagaagcucggcggcuaccuccagcucuuccuccagggcugcugccucgacaucuccuccaugaucaaggaggcccagaagaacgccauccagaucguccagcaggccgucaaguacgucggccagcucgccguccucaagggcuccaagcuccacuuccucgagaacggcaacaacaaggccgccuccguccaggaggaguucauggacgccgucugcgacggcgucggccucggcaugaagauccuccucgacuccggccucgagaaggccaaggagcuccagcacgagcucuuccgccagugcaccaagaacgaggucaccaaggagaugaagaccaacgccaugggccucauccgcucccucgagaacaucuucgccgaguccaagaucaaguccuuccgccgccagguccaggaggagaacuucgaguaccaggacuucaagcgcauggucaaccgcgcccccgaguuccucaagcucaagcacugccucgagaaggccaucgagaucaucaucuccgcccucaagggcugccacuccgacaucaaccuccuccagaccugcgucgaguccauccgcaaccucgccuccgacuucuacuccgacuucuccguccccuccaccuccgucggcuccuacgagucccgcgucacccacaucguccaccaggagcucgagucccucgccaagucccuccucuucugcuucgaguccgaggagucccccgaccuccucaagcccugggagaccuacaaccagaacaccaaggaggagcaccagcaguccaaguccuccggcaucgacggcuccaagaacaagggcguccccaagcgcgucuacgagcuccacggcuccucccccgccgucuccuccgaggagugcacccccucccgcauccagugggucuga

SEQ ID NO: 45042 - RNA, 4167 nt, Artificial Sequence
  derived and/or modified sequence opt2 from KIF15__Homo_sapiens__NP_064627
auggcccccggcugcaagaccgagcuccgcuccgucaccaacggccaguccaaccagcccuccaacgagggcgacgccaucaaggucuucguccgcauccgcccccccgccgagcgcuccggcuccgccgacggcgagcagaaccucugccucuccguccucuccuccaccucccuccgccuccacuccaaccccgagcccaagaccuucaccuucgaccacgucgccgacgucgacaccacccaggaguccgucuucgccaccgucgccaaguccaucgucgaguccugcauguccggcuacaacggcaccaucuucgccuacggccagaccggcuccggcaagaccuucaccaugaugggccccuccgaguccgacaacuucucccacaaccuccgcggcgucaucccccgcuccuucgaguaccucuucucccucaucgaccgcgagaaggagaaggccggcgccggcaaguccuuccucugcaagugcuccuucaucgagaucuacaacgagcagaucuacgaccuccucgacuccgccuccgccggccucuaccuccgcgagcacaucaagaagggcgucuucgucgucggcgccgucgagcaggucgucaccuccgccgccgaggccuaccagguccucuccggcggcuggcgcaaccgccgcgucgccuccaccuccaugaaccgcgaguccucccgcucccacgccgucuucaccaucaccaucgaguccauggagaaguccaacgagaucgucaacauccgcaccucccuccucaaccucgucgaccucgccggcuccgagcgccagaaggacacccacgccgagggcaugcgccucaaggaggccggcaacaucaaccgcucccucuccugccucggccaggucaucaccgcccucgucgacgucggcaacggcaagcagcgccacgucugcuaccgcgacuccaagcucaccuuccuccuccgcgacucccucggcggcaacgccaagaccgccaucaucgccaacguccaccccggcucccgcugcuucggcgagacccucuccacccucaacuucgcccagcgcgccaagcucaucaagaacaaggccgucgucaacgaggacacccagggcaacgucucccagcuccaggccgaggucaagcgccucaaggagcagcucgccgagcucgccuccggccagaccccccccgaguccuuccucacccgcgacaagaagaagaccaacuacauggaguacuuccaggaggccaugcucuucuucaagaaguccgagcaggagaagaagucccucaucgagaaggucacccagcucgaggaccucacccucaagaaggagaaguucauccaguccaacaagaugaucgucaaguuccgcgaggaccagaucauccgccucgagaagcuccacaaggagucccgcggcggcuuccuccccgaggagcaggaccgccuccucuccgagcuccgcaacgagauccagacccuccgcgagcagaucgagcaccacccccgcgucgccaaguacgccauggagaaccacucccuccgcgaggagaaccgccgccuccgccuccucgagcccgucaagcgcgcccaggagauggacgcccagaccaucgccaagcucgagaaggccuucuccgagaucuccggcauggagaaguccgacaagaaccagcagggcuucucccccaaggcccagaaggagcccugccucuucgccaacaccgagaagcucaaggcccagcuccuccagauccagaccgagcucaacaacuccaagcaggaguacgaggaguucaaggagcucacccgcaagcgccagcucgagcucgaguccgagcuccagucccuccagaaggccaaccucaaccucgagaaccuccucgaggccaccaaggccugcaagcgccaggaggucucccagcucaacaagauccacgccgagacccucaagaucaucaccacccccaccaaggccuaccagcuccacucccgccccguccccaagcucucccccgagaugggcuccuucggcucccucuacacccagaacuccuccauccucgacaacgacauccucaacgagcccgucccccccgagaugaacgagcaggccuucgaggccaucuccgaggagcuccgcaccguccaggagcagauguccgcccuccaggccaagcucgacgaggaggagcacaagaaccucaagcuccagcagcacgucgacaagcucgagcaccacuccacccagaugcaggagcucuucuccuccgagcgcaucgacuggaccaagcagcaggaggagcuccucucccagcucaacguccucgagaagcagcuccaggagacccagaccaagaacgacuuccucaaguccgagguccacgaccuccgcgucguccuccacuccgccgacaaggagcucuccuccgucaagcucgaguacuccuccuucaagaccaaccaggagaaggaguucaacaagcucuccgagcgccacaugcacguccagcuccagcucgacaaccuccgccucgagaacgagaagcuccucgaguccaaggccugccuccaggacuccuacgacaaccuccaggagaucaugaaguucgagaucgaccagcucucccgcaaccuccagaacuucaagaaggagaacgagacccucaaguccgaccucaacaaccucauggagcuccucgaggccgagaaggagcgcaacaacaagcucucccuccaguucgaggaggacaaggagaacuccuccaaggagauccucaagguccucgaggccguccgccaggagaagcagaaggagaccgccaagugcgagcagcagauggccaagguccagaagcucgaggagucccuccucgccaccgagaaggucaucuccucccucgagaagucccgcgacuccgacaagaaggucgucgccgaccucaugaaccagauccaggagcuccgcaccuccgucugcgagaagaccgagaccaucgacacccucaagcaggagcucaaggacaucaacugcaaguacaacuccgcccucgucgaccgcgaggagucccgcguccucaucaagaagcaggaggucgacauccucgaccucaaggagacccuccgccuccgcauccucuccgaggacaucgagcgcgacaugcucugcgaggaccucgcccacgccaccgagcagcucaacaugcucaccgaggccuccaagaagcacuccggccuccuccaguccgcccaggaggagcucaccaagaaggaggcccucauccaggagcuccagcacaagcucaaccagaagaaggaggaggucgagcagaagaagaacgaguacaacuucaagaugcgccagcucgagcacgucauggacuccgccgccgaggacccccagucccccaagacccccccccacuuccagacccaccucgccaagcuccucgagacccaggagcaggagaucgaggacggccgcgccuccaagaccucccucgagcaccucgucaccaagcucaacgaggaccgcgaggucaagaacgccgagauccuccgcaugaaggagcagcuccgcgagauggagaaccuccgccucgagucccagcagcucaucgagaagaacuggcuccuccagggccagcucgacgacaucaagcgccagaaggagaacuccgaccagaaccaccccgacaaccagcagcucaagaacgagcaggaggaguccaucaaggagcgccucgccaaguccaagaucgucgaggagaugcucaagaugaaggccgaccucgaggagguccaguccgcccucuacaacaaggagauggagugccuccgcaugaccgacgaggucgagcgcacccagacccucgaguccaaggccuuccaggagaaggagcagcuccgcuccaagcucgaggagauguacgaggagcgcgagcgcaccucccaggagauggagaugcuccgcaagcaggucgagugccucgccgaggagaacggcaagcucgucggccaccagaaccuccaccagaagauccaguacgucguccgccucaagaaggagaacguccgccucgccgaggagaccgagaagcuccgcgccgagaacgucuuccucaaggagaagaagcgcuccgaguccuga

SEQ ID NO: 45043 - RNA, 4179 nt, Artificial Sequence
  derived and/or modified sequence opt2 from KIF16B__Homo_sapiens__NP_001186795
auggccuccgucaaggucgccguccgcguccgccccaugaaccgccgcgagaaggaccucgaggccaaguucaucauccagauggagaaguccaagaccaccaucaccaaccucaagauccccgagggcggcaccggcgacuccggccgcgagcgcaccaagaccuucaccuacgacuucuccuucuacuccgccgacaccaagucccccgacuacgucucccaggagauggucuucaagacccucggcaccgacgucgucaaguccgccuucgagggcuacaacgccugcgucuucgccuacggccagaccggcuccggcaaguccuacaccaugaugggcaacuccggcgacuccggccucaucccccgcaucugcgagggccucuucucccgcaucaacgagaccacccgcugggacgaggccuccuuccgcaccgaggucuccuaccucgagaucuacaacgagcgcguccgcgaccuccuccgccgcaaguccuccaagaccuucaaccuccgcguccgcgagcaccccaaggagggccccuacgucgaggaccucuccaagcaccucguccagaacuacggcgacgucgaggagcucauggacgccggcaacaucaaccgcaccaccgccgccaccggcaugaacgacgucuccucccgcucccacgccaucuucaccaucaaguucacccaggccaaguucgacuccgagaugcccugcgagaccgucuccaagauccaccucgucgaccucgccggcuccgagcgcgccgacgccaccggcgccaccggcguccgccucaaggagggcggcaacaucaacaagucccucgucacccucggcaacgucaucuccgcccucgccgaccucucccaggacgccgccaacacccucgccaagaagaagcaggucuucguccccuaccgcgacuccguccucaccuggcuccucaaggacucccucggcggcaacuccaagaccaucaugaucgccaccaucucccccgccgacgucaacuacggcgagacccucuccacccuccgcuacgccaaccgcgccaagaacaucaucaacaagcccaccaucaacgaggacgccaacgucaagcucauccgcgagcuccgcgccgagaucgcccgccucaagacccuccucgcccagggcaaccagaucgcccuccucgacucccccaccgcccucuccauggaggagaagcuccagcagaacgaggcccgcguccaggagcucaccaaggaguggaccaacaaguggaacgagacccagaacauccucaaggagcagacccucgcccuccgcaaggagggcaucggcgucguccucgacuccgagcucccccaccucaucggcaucgacgacgaccuccucuccaccggcaucauccucuaccaccucaaggagggccagaccuacgucggccgcgacgacgccuccaccgagcaggacaucguccuccacggccucgaccucgaguccgagcacugcaucuucgagaacaucggcggcaccgucacccucaucccccucuccggcucccagugcuccgucaacggcguccagaucgucgaggccacccaccucaaccagggcgccgucauccuccucggccgcaccaacauguuccgcuucaaccaccccaaggaggccgccaagcuccgcgagaagcgcaaguccggccuccucuccuccuucucccucuccaugaccgaccucuccaagucccgcgagaaccucuccgccgucaugcucuacaaccccggccucgaguucgagcgccagcagcgcgaggagcucgagaagcucgaguccaagcgcaagcucaucgaggagauggaggagaagcagaaguccgacaaggccgagcucgagcgcaugcagcaggaggucgagacccagcgcaaggagaccgagaucguccagcuccagauccgcaagcaggaggagucccucaagcgccgcuccuuccacaucgagaacaagcucaaggaccuccucgccgagaaggagaaguucgaggaggagcgccuccgcgagcagcaggagaucgagcuccagaagaagcgccaggaggaggagaccuuccuccgcguccaggaggagcuccagcgccucaaggagcucaacaacaacgagaaggccgagaaguuccagaucuuccaggagcucgaccagcuccagaaggagaaggacgagcaguacgccaagcucgagcucgagaagaagcgccucgaggagcaggagaaggagcaggucaugcucgucgcccaccucgaggagcagcuccgcgagaagcaggagaugauccagcuccuccgccgcggcgagguccagugggucgaggaggagaagcgcgaccucgagggcauccgcgagucccuccuccgcgucaaggaggcccgcgccggcggcgacgaggacggcgaggagcucgagaaggcccagcuccgcuucuucgaguucaagcgccgccagcucgucaagcucgucaaccucgagaaggaccucguccagcagaaggacauccucaagaaggagguccaggaggagcaggagauccucgagugccucaagugcgagcacgacaaggagucccgccuccucgagaagcacgacgaguccgucaccgacgucaccgaggucccccaggacuucgagaagaucaagcccgucgaguaccgccuccaguacaaggagcgccagcuccaguaccuccuccagaaccaccuccccacccuccucgaggagaagcagcgcgccuucgagauccucgaccgcggcccccucucccucgacaacacccucuaccaggucgagaaggagauggaggagaaggaggagcagcucgcccaguaccaggccaacgccaaccagcuccagaagcuccaggccaccuucgaguucaccgccaacaucgcccgccaggaggagaagguccgcaagaaggagaaggagauccucgagucccgcgagaagcagcagcgcgaggcccucgagcgcgcccucgcccgccucgagcgccgccacuccgcccuccagcgccacuccacccucggcauggagaucgaggagcagcgccagaagcucgccucccucaacuccggcucccgcgagcaguccggccuccaggccucccucgaggccgagcaggaggcccucgagaaggaccaggagcgccucgaguacgagauccagcagcucaagcagaagaucuacgaggucgacggcguccagaaggaccaccacggcacccucgagggcaaggucgccuccuccucccuccccgucuccgccgagaagucccaccucgucccccucauggacgcccgcaucaacgccuacaucgaggaggagguccagcgccgccuccaggaccuccaccgcgucaucuccgagggcugcuccaccuccgccgacaccaugaaggacaacgagaagcuccacaacggcaccauccagcgcaagcucaaguacgagcucugccgcgaccuccucugcguccucaugcccgagcccgacgccgccgccugcgccaaccacccccuccuccagcaggaccucguccagcucucccucgacuggaagaccgagauccccgaccucguccuccccaacggcguccaggucuccuccaaguuccagaccacccucgucgacaugaucuacuuccuccacggcaacauggaggucaacguccccucccucgccgagguccagcuccuccucuacaccaccgucaaggucaugggcgacuccggccacgaccagugccagucccucguccuccucaacacccacaucgcccucgucaaggaggacugcgucuucuacccccgcauccgcucccgcaacauccccccccccggcgcccaguucgacgucaucaagugccacgcccucuccgaguuccgcugcgucgucguccccgagaagaagaacgucuccaccgucgagcucgucuuccuccagaagcucaagcccuccgucggcucccgcaacuccccccccgagcaccuccaggaggcccccaacguccagcucuucaccaccccccucuaccuccagggcucccagaacgucgcccccgaggucuggaagcucaccuucaacucccaggacgaggcccucuggcucaucucccaccucacccgccucuga

SEQ ID NO: 45044 - RNA, 3117 nt, Artificial Sequence
  derived and/or modified sequence opt2 from KIF17__Homo_sapiens__XP_011540143
auggccuccgaggccgucaaggucgucguccgcugccgccccaugaaccagcgcgagcgcgagcuccgcugccagcccgucgucaccgucgacugcgcccgcgcccagugcugcauccagaaccccggcgccgccgacgagccccccaagcaguucaccuucgacggcgccuaccacgucgaccacgucaccgagcagaucuacaacgagaucgccuacccccucgucgagggcgucaccgagggcuacaacggcaccaucuucgccuacggccagaccggcuccggcaaguccuucaccaugcagggccuccccgacccccccucccagcgcggcaucaucccccgcgccuucgagcacgucuucgaguccguccagugcgccgagaacaccaaguuccucguccgcgccuccuaccucgagaucuacaacgaggacguccgcgaccuccucggcgccgacaccaagcagaagcucgagcucaaggagcaccccgagaagggcgucuacgucaagggccucuccaugcacaccguccacuccgucgcccagugcgagcacaucauggagaccggcuggaagaaccgcuccgucggcuacacccucaugaacaaggacuccucccgcucccacuccaucuucaccaucuccaucgagauguccgccgucgacgagcgcggcaaggaccaccuccgcgccggcaagcucaaccucgucgaccucgccggcuccgagcgccaguccaagaccggcgccaccggcgagcgccucaaggaggccaccaagaucaaccucucccucuccgcccucggcaacgucaucuccgcccucgucgacggccgcugcaagcacguccccuaccgcgacuccaagcucacccgccuccuccaggacucccucggcggcaacaccaagacccucauggucgccugccucucccccgccgacaacaacuacgacgagacccucuccacccuccgcuacgccaaccgcgccaagaacauccgcaacaagccccgcaucaacgaggaccccaaggacgcccuccuccgcgaguaccaggaggagaucaagaagcucaaggccauccucacccagcagaugucccccuccucccucuccgcccuccucucccgccaggucccccccgaccccguccaggucgaggagaagcuccucccccagcccgucauccagcacgacgucgaggccgagaagcagcucauccgcgaggaguacgaggagcgccucgcccgccucaaggccgacuacaaggccgagcaggagucccgcgcccgccucgaggaggacaucaccgccaugcgcaacuccuacgacguccgccucuccacccucgaggagaaccuccgcaaggagaccgaggccguccuccaggucggcguccucuacaaggccgaggucaugucccgcgccgaguucgccuccuccgccgaguacccccccgccuuccaguacgagaccgucgucaagcccaaggucuucuccaccaccgacacccuccccuccgacgacgucuccaagacccaggucuccucccgcuucgccgagcuccccaaggucgagcccuccaaguccgagaucucccucggcuccuccgaguccuccucccucgaggagaccuccgucuccgaggccuuccccggccccgaggagcccuccaacgucgaggucuccaugcccaccgaggagucccgcucccgcuacuuccucgacgagugccucggccaggaggccgccggccaccuccucggcgagcagaacuaccucccccaggaggagccccaggaggucccccuccagggccuccucggccuccaggaccccuucgccgaggucgaggccaagcucgcccgccucuccuccaccgucgcccgcaccgacgccccccaggccgacguccccaagguccccguccagguccccgcccccaccgaccuccucgagcccuccgacgcccgccccgaggccgaggccgccgacgacuuccccccccgccccgaggucgaccucgccuccgaggucgcccucgaggucguccgcaccgccgagcccggcgucuggcucgaggcccaggcccccgucgcccucgucgcccagcccgagccccuccccgccaccgccggcgucaagcgcgaguccgucggcauggaggucgccguccucaccgacgacccccuccccgucgucgaccagcagcagguccucgcccgccuccagcuccucgagcagcaggucgucggcggcgagcaggccaagaacaaggaccucaaggagaagcacaagcgccgcaagcgcuacgccgacgagcgccgcaagcagcucgucgccgcccuccagaacuccgacgaggacuccggcgacuggguccuccucaacgucuacgacuccauccaggaggagguccgcgccaaguccaagcuccucgagaagaugcagcgcaagcuccgcgccgccgaggucgagaucaaggaccuccaguccgaguuccagcucgagaagaucgacuaccucgccaccauccgccgccaggagcgcgacuccaugcuccuccagcagcuccucgagcagguccagccccucauccgccgcgacugcaacuacuccaaccucgagaagauccuccgcgaguccugcugggacgaggacaacggcuucuggaagaucccccaccccgucaucaccaagaccucccucccccaguuccagcucggccaccgcaccaaccagcccgccaagccccuccagcagaccauggccucccgcaccuggcgcaccaccgccaccggcuccugcuccgucggcgccaccgucaagacccuccccgccaccaccuccgaccucuccggccccgcccgcuccuccgcccagacccccggccgcgccucccacaucaccacccgccaccaggccuccgccgcccacuccgccaccacccuccccucccaccccccccgcccccucaagugccccucccccggccccuccgccuccucccccuccaccucccucuccccccgccccucccuccccuccccccucgccuccggccucuggcucggcccccgcggccgcuggaaguccugcugccucugguga

SEQ ID NO: 45045 - RNA, 2697 nt, Artificial Sequence
  derived and/or modified sequence opt2 from KIF18A__Homo_sapiens__NP_112494
auguccgucaccgaggaggaccucugccaccacaugaaggucgucguccgcguccgccccgagaacaccaaggagaaggccgccggcuuccacaaggucguccacgucgucgacaagcacauccucgucuucgaccccaagcaggaggaggucuccuucuuccacggcaagaagaccaccaaccagaacgucaucaagaagcagaacaaggaccucaaguucgucuucgacgccgucuucgacgagaccuccacccaguccgaggucuucgagcacaccaccaagcccauccuccgcuccuuccucaacggcuacaacugcaccguccucgccuacggcgccaccggcgccggcaagacccacaccaugcucggcuccgccgacgagcccggcgucauguaccucaccaugcuccaccucuacaagugcauggacgagaucaaggaggagaagaucugcuccaccgccgucuccuaccucgaggucuacaacgagcagauccgcgaccuccucgucaacuccggcccccucgccguccgcgaggacacccagaagggcgucgucguccacggccucacccuccaccagcccaaguccuccgaggagauccuccaccuccucgacaacggcaacaagaaccgcacccagcaccccaccgacaugaacgccaccuccucccgcucccacgccgucuuccagaucuaccuccgccagcaggacaagaccgccuccaucaaccagaacguccgcaucgccaagaugucccucaucgaccucgccggcuccgagcgcgccuccaccuccggcgccaagggcacccgcuucgucgagggcaccaacaucaaccgcucccuccucgcccucggcaacgucaucaacgcccucgccgacuccaagcgcaagaaccagcacauccccuaccgcaacuccaagcucacccgccuccucaaggacucccucggcggcaacugccagaccaucaugaucgccgccgucucccccuccuccgucuucuacgacgacaccuacaacacccucaaguacgccaaccgcgccaaggacaucaaguccucccucaaguccaacguccucaacgucaacaaccacaucacccaguacgucaagaucugcaacgagcagaaggccgagauccuccuccucaaggagaagcucaaggccuacgaggagcagaaggccuucaccaacgagaacgaccaggccaagcucaugaucuccaacccccaggagaaggagaucgagcgcuuccaggagauccucaacugccucuuccagaaccgcgaggagauccgccaggaguaccucaagcucgagaugcuccucaaggagaacgagcucaaguccuucuaccagcagcagugccacaagcagaucgagaugaugugcuccgaggacaaggucgagaaggccaccggcaagcgcgaccaccgccucgccaugcucaagacccgccgcuccuaccucgagaagcgccgcgaggaggagcucaagcaguucgacgagaacaccaacuggcuccaccgcgucgagaaggagaugggccuccucucccagaacggccacauccccaaggagcucaagaaggaccuccacugccaccaccuccaccuccagaacaaggaccucaaggcccagauccgccacaugauggaccucgccugccuccaggagcagcagcaccgccagaccgaggccguccucaacgcccuccuccccacccuccgcaagcaguacugcacccucaaggaggccggccucuccaacgccgccuucgaguccgacuucaaggagaucgagcaccucgucgagcgcaagaaggucgucgucugggccgaccagaccgccgagcagcccaagcagaacgaccuccccggcaucuccguccucaugaccuucccccagcucggccccguccagcccauccccugcugcuccuccuccggcggcaccaaccucgucaagauccccaccgagaagcgcacccgccgcaagcucaugcccuccccccucaagggccagcacacccucaaguccccccccucccaguccguccagcucaacgacucccucuccaaggagcuccagcccaucgucuacacccccgaggacugccgcaaggccuuccagaaccccuccaccgucacccucaugaagcccuccuccuucaccaccuccuuccaggccaucuccuccaacaucaacuccgacaacugccucaagaugcucugcgaggucgccaucccccacaaccgccgcaaggagugcggccaggaggaccucgacuccaccuucaccaucugcgaggacaucaaguccuccaagugcaagcuccccgagcaggagucccuccccaacgacaacaaggacauccuccagcgccucgaccccuccuccuucuccaccaagcacuccaugcccguccccuccaugguccccuccuacauggccaugaccaccgccgccaagcgcaagcgcaagcucaccuccuccaccuccaacuccucccucaccgccgacgucaacuccggcuucgccaagcgcguccgccaggacaacuccuccgagaagcaccuccaggagaacaagcccaccauggagcacaagcgcaacaucugcaagaucaaccccuccaugguccgcaaguucggccgcaacaucuccaagggcaaccuccgcuga

SEQ ID NO: 45046 - RNA, 5376 nt, Artificial Sequence
  derived and/or modified sequence opt2 from KIF1A__Homo_sapiens__NP_001230937
auggccggcgccuccgucaaggucgccguccgcguccgccccuucaacucccgcgagaugucccgcgacuccaagugcaucauccagauguccggcuccaccaccaccaucgucaaccccaagcagcccaaggagacccccaaguccuucuccuucgacuacuccuacuggucccacaccucccccgaggacaucaacuacgccucccagaagcaggucuaccgcgacaucggcgaggagaugcuccagcacgccuucgagggcuacaacgucugcaucuucgccuacggccagaccggcgccggcaaguccuacaccaugaugggcaagcaggagaaggaccagcagggcaucaucccccagcucugcgaggaccucuucucccgcaucaacgacaccaccaacgacaacauguccuacuccgucgaggucuccuacauggagaucuacugcgagcgcguccgcgaccuccucaaccccaagaacaagggcaaccuccgcguccgcgagcacccccuccucggccccuacgucgaggaccucuccaagcucgccgucaccuccuacaacgacauccaggaccucauggacuccggcaacaaggcccgcaccgucgccgccaccaacaugaacgagaccuccucccgcucccacgccgucuucaacaucaucuucacccagaagcgccacgacgccgagaccaacaucaccaccgagaaggucuccaagaucucccucgucgaccucgccggcuccgagcgcgccgacuccaccggcgccaagggcacccgccucaaggagggcgccaacaucaacaagucccucaccacccucggcaaggucaucuccgcccucgccgagauggacuccggccccaacaagaacaagaagaagaagaagaccgacuucauccccuaccgcgacuccguccucaccuggcuccuccgcgagaaccucggcggcaacucccgcaccgccauggucgccgcccucucccccgccgacaucaacuacgacgagacccucuccacccuccgcuacgccgaccgcgccaagcagauccgcugcaacgccgucaucaacgaggaccccaacaacaagcucauccgcgagcucaaggacgaggucacccgccuccgcgaccuccucuacgcccagggccucggcgacaucaccgacaccaacaccguccccggcggccccaagcucaccaacgcccucgucggcaugucccccuccuccucccucuccgcccucuccucccgcgccgccuccgucuccucccuccacgagcgcauccucuucgcccccggcuccgaggaggccaucgagcgccucaaggagaccgagaagaucaucgccgagcucaacgagaccugggaggagaagcuccgccgcaccgaggccauccgcauggagcgcgaggcccuccucgccgagaugggcgucgccaugcgcgaggacggcggcacccucggcgucuucucccccaagaagaccccccaccucgucaaccucaacgaggacccccucauguccgagugccuccucuacuacaucaaggacggcaucacccgcgucggccgcgaggacggcgagcgccgccaggacaucguccucuccggccacuucaucaaggaggagcacugcgucuuccgcuccgacucccgcggcggcuccgaggccgucgucacccucgagcccugcgagggcgccgacaccuacgucaacggcaagaaggucaccgagcccuccauccuccgcuccggcaaccgcaucaucaugggcaagucccacgucuuccgcuucaaccaccccgagcaggcccgccaggagcgcgagcgcacccccugcgccgagacccccgccgagcccgucgacugggccuucgcccagcgcgagcuccucgagaagcagggcaucgacaugaagcaggagauggagcagcgccuccaggagcucgaggaccaguaccgccgcgagcgcgaggaggccaccuaccuccucgagcagcagcgccucgacuacgaguccaagcucgaggcccuccagaagcagauggacucccgcuacuaccccgaggucaacgaggaggaggaggagcccgaggacgagguccaguggaccgagcgcgagugcgagcucgcccucugggccuuccgcaaguggaagugguaccaguucaccucccuccgcgaccuccucuggggcaacgccaucuuccucaaggaggccaacgccaucuccgucgagcucaagaagaagguccaguuccaguucguccuccucaccgacacccucuacuccccccucccccccgaccuccucccccccgaggccgccaaggaccgcgagacccgccccuucccccgcaccaucgucgccgucgagguccaggaccagaagaacggcgccacccacuacuggacccucgagaagcuccgccagcgccucgaccucaugcgcgagauguacgaccgcgccgccgagguccccuccuccgucaucgaggacugcgacaacgucgucaccggcggcgaccccuucuacgaccgcuuccccugguuccgccucgucggcuccuccgccaucuccggcugcaacuccuacccccuccucaacaccugcauguccgagcgcauggccgcccucacccccucccccaccuucuccucccccgacuccgacgccaccgagcccgccgaggagcaguccgucggcgaggaggaggaggaggaggaggaggaggaggacgaggaggaggaggaccucgaggacgacgucuuccccgagcacgcccucugcgacggccgcgaccccuucuacgaccgccccccccucuucucccucgucggccgcgccuucgucuaccucuccaaccuccucuaccccgucccccucguccaccgcgucgccaucgucuccgagaagggcgaggucaagggcuuccuccgcgucgccguccaggccaucuccgccgacgaggaggcccccgacuacggcuccggcguccgccaguccggcaccgccaagaucuccuucgacgaccagcacuucgagaaguuccaguccgaguccugccccgucgucggcaugucccgcuccggcaccucccaggaggagcuccgcaucgucgagggccagggccagggcgccgacgucggccccuccgccgacgaggucaacaacaacaccugcuccgccgucccccccgagggccuccuccucgacuccuccgagaaggccgcccucgacggcccccucgacgccgcccucgaccaccuccgccucggcaacaccuucaccuuccgcgucaccguccuccaggccuccuccaucuccgccgaguacgccgacaucuucugccaguucaacuucauccaccgccacgacgaggccuucuccaccgagccccucaagaacaccggccgcggccccccccucggcuucuaccacguccagaacaucgccgucgaggucaccaaguccuucaucgaguacaucaagucccagcccaucgucuucgaggucuucggccacuaccagcagcaccccuuccccccccucugcaaggacguccucuccccccuccgccccucccgccgccacuucccccgcgucaugccccucuccaagcccguccccgccaccaagcucuccacccucacccgccccugccccggccccugccacugcaaguacgaccuccucgucuacuucgagaucugcgagcucgaggccaacggcgacuacauccccgccgucgucgaccaccgcggcggcaugcccugcaugggcaccuuccuccuccaccagggcauccagcgccgcaucaccgucacccuccuccacgagaccggcucccacauccgcuggaaggagguccgcgagcucgucgucggccgcauccgcaacacccccgagaccgacgagucccucaucgaccccaacauccucucccucaacauccucuccuccggcuacauccaccccgcccaggacgaccgcaccuucuaccaguucgaggccgccugggacuccuccaugcacaacucccuccuccucaaccgcgucacccccuaccgcgagaagaucuacaugacccucuccgccuacaucgagauggagaacugcacccagcccgccgucgucaccaaggacuucugcauggucuucuacucccgcgacgccaagcuccccgccucccgcuccauccgcaaccucuucggcuccggcucccuccgcgccuccgaguccaaccgcgucaccggcgucuacgagcucucccucugccacgucgccgacgccggcucccccggcaugcagcgccgccgccgccgcguccucgacaccuccgucgccuacguccgcggcgaggagaaccucgccggcuggcgcccccgcuccgacucccucauccucgaccaccagugggagcucgagaagcucucccuccuccaggaggucgagaagacccgccacuaccuccuccuccgcgagaagcucgagaccgcccagcgccccguccccgaggcccucucccccgccuucuccgaggacuccgagucccacggcuccuccuccgccuccuccccccucuccgccgagggccgccccuccccccucgaggcccccaacgagcgccagcgcgagcucgccgucaagugccuccgccuccucacccacaccuucaaccgcgaguacacccacucccacgucugcgucuccgccuccgaguccaagcucuccgagauguccgucacccuccuccgcgaccccuccauguccccccucggcgucgccacccucacccccuccuccaccugccccucccucgucgagggccgcuacggcgccaccgaccuccgcaccccccagcccugcucccgccccgccucccccgagcccgagcuccuccccgaggccgacuccaagaagcuccccucccccgcccgcgccaccgagaccgacaaggagccccagcgccuccucguccccgacauccaggagauccgcgucucccccaucgucuccaagaagggcuaccuccacuuccucgagccccacaccuccggcugggcccgccgcuucgucgucguccgccgccccuacgccuacauguacaacuccgacaaggacaccgucgagcgcuucguccucaaccucgccaccgcccaggucgaguacuccgaggaccagcaggccaugcucaagacccccaacaccuucgccgucugcaccgagcaccgcggcauccuccuccaggccgccuccgacaaggacaugcacgacuggcucuacgccuucaacccccuccucgccggcaccauccgcuccaagcucucccgccgccgcuccgcccagaugcgcgucuga

SEQ ID NO: 45047 - RNA, 3312 nt, Artificial Sequence
  derived and/or modified sequence opt2 from KIF1C__Homo_sapiens__NP_006603
auggccggcgccuccgucaaggucgccguccgcguccgccccuucaacgcccgcgagaccucccaggacgccaagugcgucgucuccaugcagggcaacaccaccuccaucaucaaccccaagcaguccaaggacgcccccaaguccuucaccuucgacuacuccuacuggucccacaccuccaccgaggacccccaguucgccucccagcagcaggucuaccgcgacaucggcgaggagaugcuccuccacgccuucgagggcuacaacgucugcaucuucgccuacggccagaccggcgccggcaaguccuacaccaugaugggccgccaggagcccggccagcagggcaucgucccccagcucugcgaggaccucuucucccgcgucuccgagaaccaguccgcccagcucuccuacuccgucgaggucuccuacauggagaucuacugcgagcgcguccgcgaccuccucaaccccaagucccgcggcucccuccgcguccgcgagcaccccauccucggccccuacguccaggaccucuccaagcucgccgucaccuccuacgccgacaucgccgaccucauggacugcggcaacaaggcccgcaccgucgccgccaccaacaugaacgagaccuccucccgcucccacgccgucuucaccaucgucuucacccagcgcugccacgaccagcucaccggccucgacuccgagaaggucuccaagaucucccucgucgaccucgccggcuccgagcgcgccgacuccuccggcgcccgcggcaugcgccucaaggagggcgccaacaucaacaagucccucaccacccucggcaaggucaucuccgcccucgccgacaugcaguccaagaagcgcaaguccgacuucauccccuaccgcgacuccguccucaccuggcuccucaaggagaaccucggcggcaacucccgcaccgccaugaucgccgcccucucccccgccgacaucaacuacgaggagacccucuccacccuccgcuacgccgaccgcaccaagcagauccgcugcaacgccaucaucaacgaggaccccaacgcccgccucauccgcgagcuccaggaggaggucgcccgccuccgcgagcuccucauggcccagggccucuccgccuccgcccucgagggccucaagaccgaggagggcuccguccgcggcgcccuccccgccgucuccuccccccccgcccccgucucccccuccucccccaccacccacaacggcgagcucgagcccuccuucucccccaacaccgagucccagaucggccccgaggaggccauggagcgccuccaggagaccgagaagaucaucgccgagcucaacgagaccugggaggagaagcuccgcaagaccgaggcccuccgcauggagcgcgaggcccuccucgccgagaugggcgucgccguccgcgaggacggcggcaccgucggcgucuucucccccaagaagaccccccaccucgucaaccucaacgaggacccccucauguccgagugccuccucuaccacaucaaggacggcgucacccgcgucggccaggucgacauggacaucaagcucaccggccaguucauccgcgagcagcacugccucuuccgcuccaucccccagcccgacggcgaggucgucgucacccucgagcccugcgagggcgccgagaccuacgucaacggcaagcucgucaccgagccccucguccucaaguccggcaaccgcaucgucaugggcaagaaccacgucuuccgcuucaaccaccccgagcaggcccgccucgagcgcgagcgcggcgucccccccccccccggcccccccuccgagcccgucgacuggaacuucgcccagaaggagcuccucgagcagcagggcaucgacaucaagcucgagauggagaagcgccuccaggaccucgagaaccaguaccgcaaggagaaggaggaggccgaccuccuccucgagcagcagcgccucuacgccgacuccgacuccggcgacgacuccgacaagcgcuccugcgaggaguccuggcgccucaucuccucccuccgcgagcagcucccccccaccaccguccagaccaucgucaagcgcugcggccuccccuccuccggcaagcgccgcgccccccgccgcgucuaccagaucccccagcgccgccgccuccagggcaaggacccccgcugggccaccauggccgaccucaagaugcaggccgucaaggagaucugcuacgaggucgcccucgccgacuuccgccacggccgcgccgagaucgaggcccucgccgcccucaagaugcgcgagcucugccgcaccuacggcaagcccgacggccccggcgacgccuggcgcgccgucgcccgcgacgucugggacaccgucggcgaggaggagggcggcggcgccggcuccggcggcggcuccgaggagggcgcccgcggcgccgaggucgaggaccuccgcgcccacaucgacaagcucaccggcauccuccaggaggucaagcuccagaacuccuccaaggaccgcgagcuccaggcccuccgcgaccgcaugcuccgcauggagcgcgucaucccccucgcccaggaccacgaggacgagaacgaggagggcggcgagguccccugggccccccccgagggcuccgaggccgccgaggaggccgcccccuccgaccgcaugcccuccgcccgcccccccucccccccccucuccuccugggagcgcgucucccgccucauggaggaggaccccgccuuccgccgcggccgccuccgcuggcucaagcaggagcagcuccgccuccagggccuccagggcuccggcggccgcggcggcggccuccgccgcccccccgcccgcuucguccccccccacgacugcaagcuccgcuuccccuucaaguccaacccccagcaccgcgaguccuggcccggcaugggcuccggcgaggcccccaccccccuccagccccccgaggaggucaccccccaccccgccacccccgcccgccgcccccccuccccccgccgcucccaccacccccgccgcaacucccucgacggcggcggccgcucccgcggcgccggcuccgcccagcccgagccccagcacuuccagcccaagaagcacaacuccuacccccagcccccccagcccuaccccgcccagcgcccccccggcccccgcuacccccccuacaccacccccccccgcaugcgccgccagcgcuccgcccccgaccucaaggaguccggcgccgccgucuga

SEQ ID NO: 45048 - RNA, 2673 nt, Artificial Sequence
  derived and/or modified sequence opt2 from KIF20A__Homo_sapiens__NP_005724
augucccagggcauccucuccccccccgccggccuccucuccgacgacgacgucgucgucucccccauguucgaguccaccgccgccgaccucggcuccgucguccgcaagaaccuccucuccgacugcuccgucgucuccaccucccucgaggacaagcagcagguccccuccgaggacuccauggagaaggucaaggucuaccuccgcguccgcccccuccuccccuccgagcucgagcgccaggaggaccagggcugcguccgcaucgagaacgucgagacccucguccuccaggcccccaaggacuccuucgcccucaaguccaacgagcgcggcaucggccaggccacccaccgcuucaccuucucccagaucuucggccccgaggucggccaggccuccuucuucaaccucaccgucaaggagauggucaaggacguccucaagggccagaacuggcucaucuacaccuacggcgucaccaacuccggcaagacccacaccauccagggcaccaucaaggacggcggcauccucccccgcucccucgcccucaucuucaacucccuccagggccagcuccaccccacccccgaccucaagccccuccucuccaacgaggucaucuggcucgacuccaagcagauccgccaggaggagaugaagaagcucucccuccucaacggcggccuccaggaggaggagcucuccaccucccucaagcgcuccgucuacaucgagucccgcaucggcaccuccaccuccuucgacuccggcaucgccggccucuccuccaucucccagugcaccuccuccucccagcucgacgagaccucccaccgcugggcccagcccgacaccgccccccuccccguccccgccaacauccgcuucuccaucuggaucuccuucuucgagaucuacaacgagcuccucuacgaccuccucgagccccccucccagcagcgcaagcgccagacccuccgccucugcgaggaccagaacggcaaccccuacgucaaggaccucaacuggauccacguccaggacgccgaggaggccuggaagcuccucaaggucggccgcaagaaccaguccuucgccuccacccaccucaaccagaacuccucccgcucccacuccaucuucuccauccgcauccuccaccuccagggcgagggcgacaucguccccaagaucuccgagcucucccucugcgaccucgccggcuccgagcgcugcaaggaccagaaguccggcgagcgccucaaggaggccggcaacaucaacaccucccuccacacccucggccgcugcaucgccgcccuccgccagaaccagcagaaccgcuccaagcagaaccucguccccuuccgcgacuccaagcucacccgcgucuuccagggcuucuucaccggccgcggccgcuccugcaugaucgucaacgucaaccccugcgccuccaccuacgacgagacccuccacgucgccaaguucuccgccaucgccucccagcucguccacgccccccccaugcagcucggcuuccccucccuccacuccuucaucaaggagcacucccuccaggucucccccucccucgagaagggcgccaaggccgacaccggccucgacgacgacaucgagaacgaggccgacaucuccauguacggcaaggaggagcuccuccaggucgucgaggccaugaagacccuccuccucaaggagcgccaggagaagcuccagcucgagaugcaccuccgcgacgagaucugcaacgagauggucgagcagaugcagcagcgcgagcaguggugcuccgagcaccucgacacccagaaggagcuccucgaggagauguacgaggagaagcucaacauccucaaggagucccucaccuccuucuaccaggaggagauccaggagcgcgacgagaagaucgaggagcucgaggcccuccuccaggaggcccgccagcaguccgucgcccaccagcaguccggcuccgagcucgcccuccgccgcucccagcgccucgccgccuccgccuccacccagcagcuccaggaggucaaggccaagcuccagcagugcaaggccgagcucaacuccaccaccgaggagcuccacaaguaccagaagaugcucgagcccccccccuccgccaagcccuucaccaucgacgucgacaagaagcucgaggagggccagaagaacauccgccuccuccgcaccgagcuccagaagcucggcgagucccuccaguccgccgagcgcgccugcugccacuccaccggcgccggcaagcuccgccaggcccucaccaccugcgacgacauccucaucaagcaggaccagacccucgccgagcuccagaacaacaugguccucgucaagcucgaccuccgcaagaaggccgccugcaucgccgagcaguaccacaccguccucaagcuccagggccaggucuccgccaagaagcgccucggcaccaaccaggagaaccagcagcccaaccagcagccccccggcaagaagcccuuccuccgcaaccuccucccccgcacccccaccugccaguccuccaccgacugcucccccuacgcccgcauccuccgcucccgccgcuccccccuccucaaguccggccccuucggcaagaaguacuga

SEQ ID NO: 45049 - RNA, 5463 nt, Artificial Sequence
  derived and/or modified sequence opt2 from KIF20B__Homo_sapiens__NP_001271188
auggaguccaacuucaaccaggagggcgucccccgccccuccuacgucuucuccgccgaccccaucgcccgccccuccgagaucaacuucgacggcaucaagcucgaccucucccacgaguucucccucgucgcccccaacaccgaggccaacuccuucgaguccaaggacuaccuccaggucugccuccgcauccgccccuucacccaguccgagaaggagcucgaguccgagggcugcguccacauccucgacucccagaccgucguccucaaggagccccagugcauccucggccgccucuccgagaaguccuccggccagauggcccagaaguucuccuucuccaaggucuucggccccgccaccacccagaaggaguucuuccagggcugcaucaugcagcccgucaaggaccuccucaagggccagucccgccucaucuucaccuacggccucaccaacuccggcaagaccuacaccuuccagggcaccgaggagaacaucggcauccucccccgcacccucaacguccucuucgacucccuccaggagcgccucuacaccaagaugaaccucaagccccaccgcucccgcgaguaccuccgccucuccuccgagcaggagaaggaggagaucgccuccaaguccgcccuccuccgccagaucaaggaggucaccguccacaacgacuccgacgacacccucuacggcucccucaccaacucccucaacaucuccgaguucgaggaguccaucaaggacuacgagcaggccaaccucaacauggccaacuccaucaaguucuccgucugggucuccuucuucgagaucuacaacgaguacaucuacgaccucuucguccccgucuccuccaaguuccagaagcgcaagaugcuccgccucucccaggacgucaagggcuacuccuucaucaaggaccuccaguggauccaggucuccgacuccaaggaggccuaccgccuccucaagcucggcaucaagcaccaguccgucgccuucaccaagcucaacaacgccuccucccgcucccacuccaucuucaccgucaagauccuccagaucgaggacuccgagaugucccgcgucauccgcgucuccgagcucucccucugcgaccucgccggcuccgagcgcaccaugaagacccagaacgagggcgagcgccuccgcgagaccggcaacaucaacaccucccuccucacccucggcaagugcaucaacguccucaagaacuccgagaaguccaaguuccagcagcacguccccuuccgcgaguccaagcucacccacuacuuccaguccuucuucaacggcaagggcaagaucugcaugaucgucaacaucucccagugcuaccucgccuacgacgagacccucaacguccucaaguucuccgccaucgcccagaaggucugcguccccgacacccucaacuccucccaggagaagcucuucggccccgucaaguccucccaggacgucucccucgacuccaacuccaacuccaagauccucaacgucaagcgcgccaccaucuccugggagaacucccucgaggaccucauggaggacgaggaccucgucgaggagcucgagaacgccgaggagacccagaacgucgagaccaagcuccucgacgaggaccucgacaagacccucgaggagaacaaggccuucaucucccacgaggagaagcgcaagcuccucgaccucaucgaggaccucaagaagaagcucaucaacgagaagaaggagaagcucacccucgaguucaagauccgcgaggaggucacccaggaguucacccaguacugggcccagcgcgaggccgacuucaaggagacccuccuccaggagcgcgagauccucgaggagaacgccgagcgccgccucgccaucuucaaggaccucgucggcaagugcgacacccgcgaggaggccgccaaggacaucugcgccaccaaggucgagaccgaggagacccacaacuacgucggcuucgaggacaucaucgacucccuccaggacaacgucgccgacaucaagaagcaggccgagaucgcccaccucuacaucgccucccuccccgacccccaggaggccaccgccugccucgagcucaaguucaaccagaucaaggccgagcucgccaagaccaagggcgagcucaucaagaccaaggaggagcucaagaagcgcgagaacgaguccgacucccucauccaggagcucgagaccuccaacaagaagaucaucacccagaaccagcgcaucaaggagcucaucaacaucaucgaccagaaggaggacaccaucaacgaguuccagaaccucaagucccacauggagaacaccuucaagugcaacgacaaggccgacaccuccucccucaucaucaacaacaagcucaucugcaacgagaccgucgagguccccaaggacuccaaguccaagaucugcuccgagcgcaagcgcgucaacgagaacgagcuccagcaggacgagccccccgccaagaagggcuccauccacgucuccuccgccaucaccgaggaccagaagaaguccgaggagguccgccccaacaucgccgagaucgaggacauccgcguccuccaggagaacaacgagggccuccgcgccuuccuccucaccaucgagaacgagcucaagaacgagaaggaggagaaggccgagcucaacaagcagaucguccacuuccagcaggagcucucccucuccgagaagaagaaccucacccucuccaaggagguccagcagauccaguccaacuacgacaucgccaucgccgagcuccacguccagaaguccaagaaccaggagcaggaggagaagaucaugaagcucuccaacgagaucgagaccgccacccgcuccaucaccaacaacgucucccagaucaagcucaugcacaccaagaucgacgagcuccgcacccucgacuccgucucccagaucuccaacaucgaccuccucaaccuccgcgaccucuccaacggcuccgaggaggacaaccuccccaacacccagcucgaccuccucggcaacgacuaccucgucuccaagcaggucaaggaguaccgcauccaggagcccaaccgcgagaacuccuuccacuccuccaucgaggccaucugggaggagugcaaggagaucgucaaggccuccuccaagaagucccaccagaucgaggagcucgagcagcagaucgagaagcuccaggccgaggucaagggcuacaaggacgagaacaaccgccucaaggagaaggagcacaagaaccaggacgaccuccucaaggagaaggagacccucauccagcagcucaaggaggagcuccaggagaagaacgucacccucgacguccagauccagcacgucgucgagggcaagcgcgcccucuccgagcucacccagggcgucaccugcuacaaggccaagaucaaggagcucgagaccauccucgagacccagaaggucgagugcucccacuccgccaagcucgagcaggacauccucgagaaggaguccaucauccucaagcucgagcgcaaccucaaggaguuccaggagcaccuccaggacuccgucaagaacaccaaggaccucaacgucaaggagcucaagcucaaggaggagaucacccagcucaccaacaaccuccaggacaugaagcaccuccuccagcucaaggaggaggaggaggagaccaaccgccaggagaccgagaagcucaaggaggagcucuccgccuccuccgcccgcacccagaaccucaaggccgaccuccagcgcaaggaggaggacuacgccgaccucaaggagaagcucaccgacgccaagaagcagaucaagcagguccagaaggaggucuccgucaugcgcgacgaggacaagcuccuccgcaucaagaucaacgagcucgagaagaagaagaaccagugcucccaggagcucgacaugaagcagcgcaccauccagcagcucaaggagcagcucaacaaccagaaggucgaggaggccauccagcaguacgagcgcgccugcaaggaccucaacgucaaggagaagaucaucgaggacaugcgcaugacccucgaggagcaggagcagacccaggucgagcaggaccagguccucgaggccaagcucgaggaggucgagcgccucgccaccgagcucgagaaguggaaggagaagugcaacgaccucgagaccaagaacaaccagcgcuccaacaaggagcacgagaacaacaccgacguccucggcaagcucaccaaccuccaggacgagcuccaggaguccgagcagaaguacaacgccgaccgcaagaaguggcucgaggagaagaugaugcucaucacccaggccaaggaggccgagaacauccgcaacaaggagaugaagaaguacgccgaggaccgcgagcgcuucuucaagcagcagaacgagauggagauccucaccgcccagcucaccgagaaggacuccgaccuccagaaguggcgcgaggagcgcgaccagcucgucgccgcccucgagauccagcucaaggcccucaucuccuccaacguccagaaggacaacgagaucgagcagcucaagcgcaucaucuccgagaccuccaagaucgagacccagaucauggacaucaagcccaagcgcaucuccuccgccgaccccgacaagcuccagaccgagccccucuccaccuccuucgagaucucccgcaacaagaucgaggacggcuccgucguccucgacuccugcgaggucuccaccgagaacgaccaguccacccgcuuccccaagcccgagcucgagauccaguucaccccccuccagcccaacaagauggccgucaagcaccccggcugcaccacccccgucaccgucaagauccccaaggcccgcaagcgcaaguccaacgagauggaggaggaccucgucaagugcgagaacaagaagaacgccaccccccgcaccaaccucaaguuccccaucuccgacgaccgcaacuccuccgucaagaaggagcagaaggucgccauccgccccuccuccaagaagaccuacucccuccgcucccaggccuccaucaucggcgucaaccucgccaccaagaagaaggagggcacccuccagaaguucggcgacuuccuccagcacucccccuccauccuccaguccaaggccaagaagaucaucgagaccauguccuccuccaagcucuccaacgucgaggccuccaaggagaacgucucccagcccaagcgcgccaagcgcaagcucuacaccuccgagaucuccucccccaucgacaucuccggccaggucauccucauggaccagaagaugaaggaguccgaccaccagaucaucaagcgccgccuccgcaccaagaccgccaaguga

SEQ ID NO: 45050 - RNA, 4914 nt, Artificial Sequence
  derived and/or modified sequence opt2 from KIF21A__Homo_sapiens__NP_001166934
augcucggcgcccccgacgaguccuccguccgcgucgccguccgcauccgcccccagcucgccaaggagaagaucgagggcugccacaucugcaccuccgucacccccggcgagccccaggucuuccucggcaaggacaaggccuucaccuucgacuacgucuucgacaucgacucccagcaggagcagaucuacauccagugcaucgagaagcucaucgagggcugcuucgagggcuacaacgccaccgucuucgccuacggccagaccggcgccggcaagaccuacaccaugggcaccggcuucgacgucaacaucgucgaggaggagcucggcaucaucucccgcgccgucaagcaccucuucaaguccaucgaggagaagaagcacaucgccaucaagaacggccuccccgcccccgacuucaaggucaacgcccaguuccucgagcucuacaacgaggagguccucgaccucuucgacaccacccgcgacaucgacgccaaguccaagaaguccaacauccgcauccacgaggacuccaccggcggcaucuacaccgucggcgucaccacccgcaccgucaacaccgaguccgagaugaugcagugccucaagcucggcgcccucucccgcaccaccgccuccacccagaugaacguccaguccucccgcucccacgccaucuucaccauccacgucugccagacccgcgucugcccccagaucgacgccgacaacgccaccgacaacaagaucaucuccgaguccgcccagaugaacgaguucgagacccucaccgccaaguuccacuucgucgaccucgccggcuccgagcgccucaagcgcaccggcgccaccggcgagcgcgccaaggagggcaucuccaucaacugcggccuccucgcccucggcaacgucaucuccgcccucggcgacaaguccaagcgcgccacccacguccccuaccgcgacuccaagcucacccgccuccuccaggacucccucggcggcaacucccagaccaucaugaucgccugcgucucccccuccgaccgcgacuucauggagacccucaacacccucaaguacgccaaccgcgcccgcaacaucaagaacaaggucauggucaaccaggaccgcgccucccagcagaucaacgcccuccgcuccgagaucacccgccuccagauggagcucauggaguacaagaccggcaagcgcaucaucgacgaggagggcgucgaguccaucaacgacauguuccacgagaacgccaugcuccagaccgagaacaacaaccuccgcguccgcaucaaggccaugcaggagaccgucgacgcccuccgcucccgcaucacccagcucgucuccgaccaggccaaccacguccucgcccgcgccggcgagggcaacgaggagaucuccaacaugauccacuccuacaucaaggagaucgaggaccuccgcgccaagcuccucgaguccgaggccgucaacgagaaccuccgcaagaaccucacccgcgccaccgcccgcgcccccuacuucuccggcuccuccaccuucucccccaccauccucuccuccgacaaggagaccaucgagaucaucgaccucgccaagaaggaccucgagaagcucaagcgcaaggagaagcgcaagaagaaguccgucgccggcaaggaggacaacaccgacaccgaccaggagaagaaggaggagaagggcgucuccgagcgcgagaacaacgagcucgaggucgaggagucccaggaggucuccgaccacgaggacgaggaggaggaggaggaggaggaggaggacgacaucgacggcggcgaguccuccgacgaguccgacuccgaguccgacgagaaggccaacuaccaggccgaccucgccaacaucaccugcgagaucgccaucaagcagaagcucaucgacgagcucgagaacucccagaagcgccuccagacccucaagaagcaguacgaggagaagcucaugaugcuccagcacaagauccgcgacacccagcucgagcgcgaccagguccuccagaaccucggcuccgucgaguccuacuccgaggagaaggccaagaagguccgcuccgaguacgagaagaagcuccaggccaugaacaaggagcuccagcgccuccaggccgcccagaaggagcacgcccgccuccucaagaaccagucccaguacgagaagcagcucaagaagcuccagcaggacgucauggagaugaagaagaccaagguccgccucaugaagcagaugaaggaggagcaggagaaggcccgccucaccgagucccgccgcaaccgcgagaucgcccagcucaagaaggaccagcgcaagcgcgaccaccagcuccgccuccucgaggcccagaagcgcaaccaggaggucguccuccgccgcaagaccgaggaggucaccgcccuccgccgccagguccgccccauguccgacaaggucgccggcaaggucacccgcaagcucuccuccuccgacgcccccgcccaggacaccggcuccuccgccgccgccgucgagaccgacgccucccgcaccggcgcccagcagaagaugcgcauccccgucgcccgcguccaggcccuccccacccccgccaccaacggcaaccgcaagaaguaccagcgcaagggccucaccggccgcgucuucaucuccaagaccgcccgcaugaaguggcagcuccucgagcgccgcgucaccgacaucaucaugcagaagaugaccaucuccaacauggaggccgacaugaaccgccuccucaagcagcgcgaggagcucaccaagcgccgcgagaagcucuccaagcgccgcgagaagaucgucaaggagaacggcgagggcgacaagaacgucgccaacaucaacgaggagauggagucccucaccgccaacaucgacuacaucaacgacuccaucuccgacugccaggccaacaucaugcagauggaggaggccaaggaggagggcgagacccucgacgucaccgccgucaucaacgccugcacccucaccgaggcccgcuaccuccucgaccacuuccucuccaugggcaucaacaagggccuccaggccgcccagaaggaggcccagaucaagguccucgagggccgccucaagcagaccgagaucaccuccgccacccagaaccagcuccucuuccacaugcucaaggagaaggccgagcucaaccccgagcucgacgcccuccucggccacgcccuccaggagaacgucgaggacuccaccgacgaggacgccccccucaacucccccggcuccgagggcuccacccucuccuccgaccucaugaagcucugcggcgaggucaagcccaagaacaaggcccgccgccgcaccaccacccagauggagcuccucuacgccgacuccuccgagcucgccuccgacaccuccaccggcgacgccucccuccccggcccccucacccccgucgccgagggccaggagaucggcaugaacaccgagaccuccggcaccuccgcccgcgagaaggagcucucccccccccccggccuccccuccaagaucggcuccaucucccgccaguccucccucuccgagaagaagauccccgagcccucccccgucacccgccgcaaggccuacgagaaggccgagaaguccaaggccaaggagcagaagcacuccgacuccggcaccuccgaggccucccucuccccccccuccuccccccccucccgcccccgcaacgagcucaacgucuucaaccgccucaccgucucccagggcaacaccuccguccagcaggacaagggcaucaucaaccccuuccccgccuccaagggcauccgcgccuucccccuccagugcauccacaucgccgagggccacaccaaggccguccucugcgucgacuccaccgacgaccuccucuucaccggcuccaaggaccgcaccugcaaggucuggaaccucgucaccggccaggagaucaugucccucggcggccaccccaacaacgucgucuccgucaaguacugcaacuacaccucccucgucuucaccgucuccaccuccuacaucaaggucugggacauccgcgacuccgccaagugcauccgcacccucaccuccuccggccaggucacccucggcgacgccugcuccgccuccaccucccgcaccgucgccauccccuccggcgagaaccagaucaaccagaucgcccucaaccccaccggcaccuuccucuacgccgccuccggcaacgccguccgcaugugggaccucaagcgcuuccaguccaccggcaagcucaccggccaccucggccccgucaugugccucaccgucgaccagaucuccuccggccaggaccucaucaucaccggcuccaaggaccacuacaucaagauguucgacgucaccgagggcgcccucggcaccgucucccccacccacaacuucgagcccccccacuacgacggcaucgaggcccucaccauccagggcgacaaccucuucuccggcucccgcgacaacggcaucaagaagugggaccucacccagaaggaccuccuccagcagguccccaacgcccacaaggacugggucugcgcccucggcgucguccccgaccaccccguccuccucuccggcugccgcggcggcauccucaaggucuggaacauggacaccuucaugcccgucggcgagaugaagggccacgacucccccaucaacgccaucugcgucaacuccacccacaucuucaccgccgccgacgaccgcaccguccgcaucuggaaggcccgcaaccuccaggacggccagaucuccgacaccggcgaccucggcgaggacaucgccuccaacuga

SEQ ID NO: 45051 - RNA, 4914 nt, Artificial Sequence
  derived and/or modified sequence opt2 from KIF21B__Homo_sapiens__NP_001239029
auggccggccagggcgacugcugcgucaaggucgccguccgcauccgcccccagcucuccaaggagaagaucgagggcugccacaucugcaccuccgucacccccggcgagccccagguccuccucggcaaggacaaggccuucaccuacgacuucgucuucgaccucgacaccuggcaggagcagaucuacuccaccugcgucuccaagcucaucgagggcugcuucgagggcuacaacgccaccguccucgccuacggccagaccggcgccggcaagaccuacaccaugggcaccggcuucgacauggccaccuccgaggaggagcagggcaucaucccccgcgccaucgcccaccucuucggcggcaucgccgagcgcaagcgccgcgcccaggagcagggcgucgccggccccgaguucaaggucuccgcccaguuccucgagcucuacaacgaggagauccucgaccucuucgacuccacccgcgaccccgacacccgccaccgccgcuccaacaucaagauccacgaggacgccaacggcggcaucuacaccaccggcgucaccucccgccucauccacucccaggaggagcucauccagugccucaagcagggcgcccucucccgcaccaccgccuccacccagaugaacguccaguccucccgcucccacgccaucuucaccauccaccucugccagaugcgcaugugcacccagcccgaccucgucaacgaggccgucaccggccuccccgacggcaccccccccuccuccgaguacgagacccucaccgccaaguuccacuucgucgaccucgccggcuccgagcgccucaagcgcaccggcgccaccggcgagcgcgccaaggagggcaucuccaucaacugcggccuccucgcccucggcaacgucaucuccgcccucggcgaccaguccaagaaggucguccacguccccuaccgcgacuccaagcucacccgccuccuccaggacucccucggcggcaacucccagaccaucaugaucgccugcgucucccccuccgaccgcgacuucauggagacccucaacacccucaaguacgccaaccgcgcccgcaacaucaagaacaaggucgucgucaaccaggacaagaccucccagcagaucuccgcccuccgcgccgagaucgcccgccuccagauggagcucauggaguacaaggccggcaagcgcgucaucggcgaggacggcgccgagggcuacuccgaccucuuccgcgagaacgccaugcuccagaaggagaacggcgcccuccgccuccgcgucaaggccaugcaggaggccaucgacgccaucaacaaccgcgucacccagcucaugucccaggaggccaaccuccuccucgccaaggccggcgacggcaacgaggccaucggcgcccucauccagaacuacauccgcgagaucgaggagcuccgcaccaagcuccucgaguccgaggccaugaacgagucccuccgccgcucccucucccgcgccuccgcccgcucccccuacucccucggcgccucccccgccgcccccgccuucggcggcucccccgccuccuccauggaggacgccuccgaggucauccgccgcgccaagcaggaccucgagcgccucaagaagaaggagguccgccagcgccgcaagucccccgagaaggaggccuucaagaagcgcgccaagcuccagcaggagaacuccgaggagaccgacgagaacgaggccgaggaggaggaggaggagcgcgacgaguccggcugcgaggaggaggagggccgcgaggacgaggacgaggacuccggcuccgaggagucccucgucgacuccgacuccgaccccgaggagaaggaggucaacuuccaggccgaccucgccgaccucaccugcgagaucgagaucaagcagaagcucaucgacgagcucgagaacucccagcgccgccuccagacccucaagcaccaguacgaggagaagcucauccuccuccagaacaagauccgcgacacccagcucgagcgcgaccgcguccuccagaaccucuccaccauggagugcuacaccgaggagaaggccaacaagaucaaggccgacuacgagaagcgccuccgcgagaugaaccgcgaccuccagaagcuccaggccgcccagaaggagcacgcccgccuccucaagaaccagucccgcuacgagcgcgagcucaagaagcuccaggccgaggucgccgagaugaagaaggccaaggucgcccucaugaagcagaugcgcgaggagcagcagcgccgccgccucgucgagaccaagcgcaaccgcgagaucgcccagcucaagaaggagcagcgccgccaggaguuccagauccgcgcccucgagucccagaagcgccagcaggagaugguccuccgccgcaagacccaggaggucuccgcccuccgccgccucgccaagcccauguccgagcgcgucgccggccgcgccggccucaagccccccaugcucgacuccggcgccgaggucuccgccuccaccaccuccuccgaggccgaguccggcgcccgcuccgucuccuccaucguccgccaguggaaccgcaagaucaaccacuuccucggcgaccaccccgcccccaccgucaacggcacccgccccgcccgcaagaaguuccagaagaagggcgccucccaguccuucuccaaggccgcccgccucaaguggcagucccucgagcgccgcaucaucgacaucgucaugcagcgcaugaccaucgucaaccucgaggccgacauggagcgccucaucaagaagcgcgaggagcucuuccuccuccaggaggcccuccgccgcaagcgcgagcgccuccaggccgagucccccgaggaggagaagggccuccaggagcucgccgaggagaucgagguccucgccgccaacaucgacuacaucaacgacggcaucaccgacugccaggccaccaucguccagcucgaggagaccaaggaggagcucgacuccaccgacaccuccgucgucaucuccuccugcucccucgccgaggcccgccuccuccucgacaacuuccucaaggccuccaucgacaagggccuccaggucgcccagaaggaggcccagauccgccuccucgagggccgccuccgccagaccgacauggccggcuccucccagaaccaccuccuccucgacgcccuccgcgagaaggccgaggcccaccccgagcuccaggcccucaucuacaacguccagcaggagaacggcuacgccuccaccgacgaggagaucuccgaguucuccgagggcuccuucucccaguccuucaccaugaagggcuccaccucccacgacgacuucaaguucaaguccgagcccaagcucuccgcccagaugaaggccgucuccgccgagugccucggccccccccucgacaucuccaccaagaacaucaccaagucccucgccucccucgucgagaucaaggaggacggcgucggcuucuccguccgcgaccccuacuaccgcgaccgcgucucccgcaccgucucccuccccacccgcggcuccaccuucccccgccagucccgcgccaccgagaccuccccccucacccgccgcaaguccuacgaccgcggccagcccauccgcuccaccgacgucggcuucaccccccccuccuccccccccacccgcccccgcaacgaccgcaacgucuucucccgccucaccuccaaccagucccagggcuccgcccucgacaaguccgacgacuccgacuccucccucuccgagguccuccgcggcaucaucucccccgucggcggcgccaagggcgcccgcaccgccccccuccagugcgucuccauggccgagggccacaccaagcccauccucugccucgacgccaccgacgagcuccucuucaccggcuccaaggaccgcuccugcaagauguggaaccucgucaccggccaggagaucgccgcccucaagggccaccccaacaacgucgucuccaucaaguacugcucccacuccggccucgucuucuccgucuccaccuccuacaucaaggucugggacauccgcgacuccgccaagugcauccgcacccucaccuccuccggccaggucaucuccggcgacgccugcgccgccaccuccacccgcgccaucaccuccgcccagggcgagcaccagaucaaccagaucgcccucucccccuccggcaccaugcucuacgccgccuccggcaacgccguccgcaucugggagcucucccgcuuccagcccgucggcaagcucaccggccacaucggccccgucaugugccucaccgucacccagaccgccucccagcacgaccucgucgucaccggcuccaaggaccacuacgucaagauguucgagcucggcgagugcgucaccggcaccaucggccccacccacaacuucgagcccccccacuacgacggcaucgagugccucgccauccagggcgacauccucuucuccggcucccgcgacaacggcaucaagaagugggaccucgaccagcaggagcucauccagcagauccccaacgcccacaaggacugggucugcgcccucgccuucauccccggccgccccaugcuccucuccgccugccgcgccggcgucaucaaggucuggaacgucgacaacuucacccccaucggcgagaucaagggccacgacucccccaucaacgccaucugcaccaacgccaagcacaucuucaccgccuccuccgacugccgcgucaagcucuggaacuacguccccggccucacccccugccucccccgccgcguccucgccaucaagggccgcgccaccacccuccccuga

SEQ ID NO: 45052 - RNA, 1794 nt, Artificial Sequence
  derived and/or modified sequence opt2 from KIF22__Homo_sapiens__NP_001243199
auggacuccugcucccucgagaucgccaacuggcgcaaccaccaggagacccucaaguaccaguucgacgccuucuacggcgagcgcuccacccagcaggacaucuacgccggcuccguccagcccauccuccgccaccuccucgagggccagaacgccuccguccucgccuacggccccaccggcgccggcaagacccacaccaugcucggcucccccgagcagcccggcgucaucccccgcgcccucauggaccuccuccagcucacccgcgaggagggcgccgagggccgccccugggcccucuccgucaccauguccuaccucgagaucuaccaggagaagguccucgaccuccucgaccccgccuccggcgaccucgucauccgcgaggacugccgcggcaacauccucauccccggccucucccagaagcccaucuccuccuucgccgacuucgagcgccacuuccuccccgccucccgcaaccgcaccgucggcgccacccgccucaaccagcgcuccucccgcucccacgccguccuccucgucaaggucgaccagcgcgagcgccucgcccccuuccgccagcgcgagggcaagcucuaccucaucgaccucgccggcuccgaggacaaccgccgcaccggcaacaagggccuccgccucaaggaguccggcgccaucaacaccucccucuucguccucggcaaggucgucgacgcccucaaccagggccucccccgcguccccuaccgcgacuccaagcucacccgccuccuccaggacucccucggcggcuccgcccacuccauccucaucgccaacaucgcccccgagcgccgcuucuaccucgacaccgucuccgcccucaacuucgccgcccgcuccaaggaggucaucaaccgccccuucaccaacgagucccuccagccccacgcccucggccccgucaagcucucccagaaggagcuccucggcccccccgaggccaagcgcgcccgcggccccgaggaggaggagaucggcucccccgagcccauggccgcccccgccuccgccucccagaagcucuccccccuccagaagcucuccuccauggaccccgccaugcucgagcgccuccucucccucgaccgccuccucgccucccagggcucccagggcgccccccuccucuccacccccaagcgcgagcgcaugguccucaugaagaccgucgaggagaaggaccucgagaucgagcgccucaagaccaagcagaaggagcucgaggccaagaugcucgcccagaaggccgaggagaaggagaaccacugccccaccaugcuccgcccccucucccaccgcaccgucaccggcgccaagccccucaagaaggccgucgucaugccccuccagcucauccaggagcaggccgccucccccaacgccgagauccacauccucaagaacaagggccgcaagcgcaagcucgagucccucgacgcccucgagcccgaggagaaggccgaggacugcugggagcuccagaucucccccgagcuccucgcccacggccgccagaagauccucgaccuccucaacgagggcuccgcccgcgaccuccgcucccuccagcgcaucggccccaagaaggcccagcucaucgucggcuggcgcgagcuccacggccccuucucccaggucgaggaccucgagcgcgucgagggcaucaccggcaagcagauggaguccuuccucaaggccaacauccucggccucgccgccggccagcgcugcggcgccuccuga

SEQ ID NO: 45053 - RNA, 2571 nt, Artificial Sequence
  derived and/or modified sequence opt2 from KIF23__Homo_sapiens__NP_004847
augaaguccgcccgcgccaagaccccccgcaagcccaccgucaagaagggcucccagaccaaccucaaggaccccgucggcgucuacugccgcguccgcccccucggcuuccccgaccaggagugcugcaucgaggucaucaacaacaccaccguccagcuccacacccccgagggcuaccgccucaaccgcaacggcgacuacaaggagacccaguacuccuucaagcaggucuucggcacccacaccacccagaaggagcucuucgacgucgucgccaacccccucgucaacgaccucauccacggcaagaacggccuccucuucaccuacggcgucaccggcuccggcaagacccacaccaugaccggcucccccggcgagggcggccuccucccccgcugccucgacaugaucuucaacuccaucggcuccuuccaggccaagcgcuacgucuucaaguccaacgaccgcaacuccauggacauccagugcgaggucgacgcccuccucgagcgccagaagcgcgaggccaugcccaaccccaagaccuccuccuccaagcgccaggucgaccccgaguucgccgacaugaucaccguccaggaguucugcaaggccgaggaggucgacgaggacuccgucuacggcgucuucgucuccuacaucgagaucuacaacaacuacaucuacgaccuccucgaggagguccccuucgaccccaucaagcccaagcccccccaguccaagcuccuccgcgaggacaagaaccacaacauguacgucgccggcugcaccgaggucgaggucaaguccaccgaggaggccuucgaggucuucuggcgcggccagaagaagcgccgcaucgccaacacccaccucaaccgcgaguccucccgcucccacuccgucuucaacaucaagcucguccaggccccccucgacgccgacggcgacaacguccuccaggagaaggagcagaucaccaucucccagcucucccucgucgaccucgccggcuccgagcgcaccaaccgcacccgcgccgagggcaaccgccuccgcgaggccggcaacaucaaccagucccucaugacccuccgcaccugcauggacguccuccgcgagaaccagauguacggcaccaacaagaugguccccuaccgcgacuccaagcucacccaccucuucaagaacuacuucgacggcgagggcaagguccgcaugaucgucugcgucaaccccaaggccgaggacuacgaggagaaccuccaggucaugcgcuucgccgaggucacccaggaggucgaggucgcccgccccgucgacaaggccaucugcggccucacccccggccgccgcuaccgcaaccagccccgcggccccgucggcaacgagccccucgucaccgacgucguccuccaguccuuccccccccuccccuccugcgagauccucgacaucaacgacgagcagacccucccccgccucaucgaggcccucgagaagcgccacaaccuccgccagaugaugaucgacgaguucaacaagcaguccaacgccuucaaggcccuccuccaggaguucgacaacgccguccucuccaaggagaaccacaugcagggcaagcucaacgagaaggagaagaugaucuccggccagaagcucgagaucgagcgccucgagaagaagaacaagacccucgaguacaagaucgagauccucgagaagaccaccaccaucuacgaggaggacaagcgcaaccuccagcaggagcucgagacccagaaccagaagcuccagcgccaguucuccgacaagcgccgccucgaggcccgccuccagggcauggucaccgagaccaccaugaagugggagaaggagugcgagcgccgcgucgccgccaagcagcucgagaugcagaacaagcucugggucaaggacgagaagcucaagcagcucaaggccaucgucaccgagcccaagaccgagaagcccgagcgccccucccgcgagcgcgaccgcgagaaggucacccagcgcuccgucucccccucccccgucccccuccucuuccagcccgaccagaacgccccccccauccgccuccgccaccgccgcucccgcuccgccggcgaccgcugggucgaccacaagcccgccuccaacaugcagaccgagaccgucaugcagccccacgucccccacgccaucaccgucuccgucgccaacgagaaggcccucgccaagugcgagaaguacaugcucacccaccaggagcucgccuccgacggcgagaucgagaccaagcucaucaagggcgacaucuacaagacccgcggcggcggccaguccguccaguucaccgacaucgagacccucaagcaggagucccccaacggcucccgcaagcgccgcuccuccaccgucgcccccgcccagcccgacggcgccgaguccgaguggaccgacgucgagacccgcugcuccgucgccgucgagaugcgcgccggcucccagcucggccccggcuaccagcaccacgcccagcccaagcgcaagaagcccuga

SEQ ID NO: 45054 - RNA, 4107 nt, Artificial Sequence
  derived and/or modified sequence opt2 from KIF24__Homo_sapiens__NP_919289
auggccuccuggcucuacgagugccucugcgaggccgagcucgcccaguacuacucccacuucaccgcccucggccuccagaagaucgacgagcucgccaagaucaccaugaaggacuacuccaagcucggcguccacgacaugaacgaccgcaagcgccucuuccagcucaucaagaucaucaagaucaugcaggaggaggacaaggccgucuccauccccgagcgccaccuccagaccuccucccuccgcaucaagucccaggagcuccgcuccggcccccgccgccagcucaacuucgacucccccgccgacaacaaggaccgcaacgccuccaacgacggcuucgagaugugcucccucuccgacuucuccgccaacgagcagaaguccaccuaccucaagguccucgagcacaugcuccccgacgacucccaguaccacaccaagaccggcauccucaacgccaccgccggcgacuccuacguccagaccgagaucuccaccucccucuucucccccaacuaccucuccgccauccucggcgacugcgacauccccaucauccagcgcaucucccacgucuccggcuacaacuacggcaucccccacuccugcauccgccagaacaccuccgagaagcagaaccccuggaccgagauggagaagauccgcgucugcguccgcaagcgcccccucggcaugcgcgagguccgccgcggcgagaucaacaucaucaccgucgaggacaaggagacccuccucguccacgagaagaaggaggccgucgaccucacccaguacauccuccagcacgucuucuacuucgacgaggucuucggcgaggccugcaccaaccaggacgucuacaugaagaccacccacccccucauccagcacaucuucaacggcggcaacgccaccugcuucgccuacggccagaccggcgccggcaagaccuacaccaugaucggcacccacgagaaccccggccucuacgcccucgccgccaaggacaucuuccgccagcucgaggucucccagccccgcaagcaccucuucgucuggaucuccuucuacgagaucuacugcggccagcucuacgaccuccucaaccgccgcaagcgccucuucgcccgcgaggacuccaagcacaugguccagaucgucggccuccaggagcuccaggucgacuccgucgagcuccuccucgaggucauccucaagggcuccaaggagcgcuccaccggcgccaccggcgucaacgccgacuccucccgcucccacgccgucauccagauccagaucaaggacuccgccaagcgcaccuucggccgcaucuccuucaucgaccucgccggcuccgagcgcgccgccgacgcccgcgacuccgaccgccagaccaagauggagggcgccgagaucaaccagucccuccucgcccucaaggagugcauccgcgcccucgaccaggagcacacccacacccccuuccgccaguccaagcucacccagguccucaaggacuccuucaucggcaacgccaagaccugcaugaucgccaacaucucccccucccacgucgccaccgagcacacccucaacacccuccgcuacgccgaccgcgucaaggagcucaagaagggcaucaagugcugcaccuccgucaccucccgcaaccgcaccuccggcaacuccucccccaagcgcauccaguccucccccggcgcccucuccgaggacaagugcucccccaagaaggucaagcucggcuuccagcagucccucaccgucgccgcccccggcuccacccgcggcaagguccacccccucaccucccacccccccaacauccccuucaccuccgcccccaaggucuccggcaagcgcggcggcucccgcggcucccccucccaggagugggucauccacgccucccccgucaagggcaccguccgcuccggccacgucgccaagaagaagcccgaggaguccgccccccucugcuccgagaagaaccgcaugggcaacaagaccguccucggcugggagucccgcgccuccggccccggcgagggccucguccgcggcaagcucuccaccaagugcaagaagguccagaccguccagcccguccagaagcagcucgucucccgcgucgagcucuccuucggcaacgcccaccaccgcgccgaguacucccaggacucccagcgcggcacccccgcccgccccgccuccgaggccuggaccaacauccccccccaccagaaggagcgcgaggagcaccuccgcuucuaccaccagcaguuccagcagcccccccuccuccagcagaagcucaaguaccagccccucaagcgcucccuccgccaguaccgcccccccgagggccagcucaccaacgagacccccccccucuuccacuccuacuccgagaaccacgacggcgcccaggucgaggagcucgacgacuccgacuucuccgaggacuccuucucccacaucuccucccagcgcgccaccaagcagcgcaacacccucgagaacuccgaggacuccuucuuccuccaccagaccuggggccagggccccgagaagcaggucgccgagcgccagcagucccucuucuccuccccccgcaccggcgacaagaaggaccucaccaaguccugggucgacucccgcgaccccaucaaccaccgccgcgccgcccucgaccacuccugcucccccuccaagggccccgucgacuggucccgcgagaacuccaccuccuccggccccuccccccgcgacucccucgccgagaagcccuacugcucccaggucgacuucaucuaccgccaggagcgcggcggcggcuccuccuucgaccuccgcaaggacgccucccaguccgaggucuccggcgagaacgagggcaaccuccccucccccgaggaggacggcuucaccaucucccucucccacgucgccguccccggcucccccgaccagcgcgacaccgucaccaccccccuccgcgaggucuccgccgacggccccauccaggucaccuccaccgucaagaacggccacgccguccccggcgaggacccccgcggccagcucggcacccacgccgaguacgccuccggccucauguccccccucaccaugucccuccucgagaaccccgacaacgagggcuccccccccuccgagcagcucguccaggacggcgccacccacucccucgucgccgaguccaccggcggccccgucgucucccacaccguccccuccggcgaccaggaggccgcccuccccgucuccuccgccacccgccaccucuggcucuccuccuccccccccgacaacaagcccggcggcgaccuccccgcccucucccccucccccauccgccagcaccccgccgacaagcuccccucccgcgaggccgaccucggcgaggccugccagucccgcgagaccguccucuucucccacgagcacaugggcuccgagcaguacgacgccgacgccgaggagaccggccucgacggcuccuggggcuuccccggcaagcccuucaccaccauccacaugggcgucccccacuccggccccacccucaccccccgcaccggcuccuccgacgucgccgaccagcucugggcccaggagcgcaagcaccccacccgccucggcuggcaggaguucggccucuccaccgaccccaucaagcuccccugcaacuccgagaacgucaccuggcucaagccccgccccaucucccgcugccucgcccgccccuccuccccccucguccccuccugcucccccaagaccgccggcacccuccgccagcccacccucgagcaggcccagcaggucgucauccgcgcccaccaggagcagcucgacgagauggccgagcucggcuucaaggaggagacccucaugucccagcucgccuccaacgacuucgaggacuucgucacccagcucgacgagaucaugguccucaaguccaagugcauccagucccuccgcucccagcuccagcucuaccucaccugccacggccccaccgccgcccccgagggcaccguccccuccuga

SEQ ID NO: 45055 - RNA, 999 nt, Artificial Sequence
  derived and/or modified sequence opt2 from KIF25__Homo_sapiens__NP_005346
augaccuggaccuccggccagcuccagcgcgagaagcaggcccgccccggcuccggcgccguccucgccuuccccgacgacaaggaccuccgcgucuacggccccgccgagucccaguccgccgucuucggcgacgucugcccccuccucaccucccuccucgacggcuacaacgucugcgucauggccuacggccagaccggcuccggcaaguccuacaccaugcucggccgccacuccgacgacggccccguccucccccucgacccccaguccgaccucggcaucaucccccgcgucgccgaggagcucuuccgccucauccucgagaacaccucccgcucccccaaggucgaggucuccaucgucgaggucuacaacaacgacaucuucgaccuccucgccaaggacuccaucgccgccgucuccggcgucaagcgcgaggucgucaccgccaaggacggccgcaccgaggucgcccuccucgccuccgaggccgucggcuccgccuccaagcucauggagcucguccacggcggccuccagcuccgcgccaagcaccccacccucguccacgccgacuccucccgcucccaccucaucaucaccgucacccucaccaccgccuccugcuccgacuccaccgccgaccaggccugcuccgccacccucccccgcgagcagaccgaggccggccgcgccggccgcucccgccgcgccucccagggcgcccucgccccccagcucguccccggcaaccccgccggccacgccgagcagguccaggcccgccuccagcucgucgacuccgccggcuccgagugcgucggcggcgacgccaagcuccucgucauccucugcaucucccccucccagcgccaccucgcccagacccuccagggccucggcuucggcauccgcgcccgccagguccagcgcggccccgcccgcaagaagccccccuccucccagaccgagggcaagcgccgccccgacuga

SEQ ID NO: 45056 - RNA, 5649 nt, Artificial Sequence
  derived and/or modified sequence opt2 from KIF26A__Homo_sapiens__NP_056471
auggucggccgcggcgucccccucugcgccgcccagcccgccgucgccgagggcggccccgcccgcgagccccccccccuccucgaggucuccccccgcaagcgccuccccgccggccccgaccaggaccccugcggcucccgccccgcccccgagggcgccggcgccggccccgagcagggccacuccgccggcggcggcggcuggugccgccacugccacaccaagcucgucgagcucaagcgccaggccuggaagcucgucuccggccccggcaccacccuccgcgaccccugccucuccgcccuccuccucgacaagcuccccgcccccggcgcccuccccgccugccgccccgaggccgagcgccgcugcgacgucugcgccacccaccuccagcagcucacccgcgaggccaugcaccuccuccaggcccccgccucccacgaggaccucgacgccccccacggcggccccucccucgccccccccuccaccaccaccuccucccgcgacacccccggccccgccggccccgccggccgccagcccggccgcgccggccccgaccgcaccaagggccucgccuggucccccggccccuccguccaggucuccgucgcccccgccggccucggcggcgcccucuccaccgucaccauccaggcccagcagugccucgagggcaugugguccgucucccgcgucaacuccuuccucccccccgccugccucgccgaggccgccgucgccgccgucgccgucgccgacaccguccgcgagugcccccccgucgccggccccgacggccucuccaaggccuggggccgcggcggcgucugcaccuccgcccucgucacccccacccccggcuccgucggcggcuccaccggccccuccgccgccgccuccuucuucauccgcgccaugcagaagcucucccucgccuccaagcgcaagaagccccaccccccccccccccccgccacccgcggcaccuccaccuaccccaccgacuucuccggcguccuccagcucuggcccccccccgccccccccugccuccuccgcgccgccuccaagaccaaggacaaccccggcuccaucggcaaggucaaggucaugcuccgcaucuggcccgcccagggcgcccagcgcuccgccgaggccauguccuuccucaaggucgacccccgcaagaagcaggucauccucuacgaccccgccgccggcccccccggcuccgccggcccccgccgcgccgccaccgccgccguccccaagauguucgccuucgacgccgucuucccccaggacuccgagcaggccgaggucugcuccggcaccgucgccgacguccuccaguccgucgucuccggcgccgacggcugcaucuucuccuucggccacaugucccucggcaaguccuacaccaugaucggcaaggacuccuccccccagucccucggcaucguccccugcgccaucuccuggcucuuccgccucaucgaggagcgccgcgagcgcaccggcacccgcuucuccguccgcgucuccgccgucgaggucugcggccgcgaccagucccuccgcgaccuccucgccgaggucgcccccggcucccuccaggacacccagucccccggcgucuaccuccgcgaggaccccgucugcggcgcccagcuccagaaccaguccgagcuccgcgcccccaccgccgagaaggccgccuucuaccucgacgccgcccucgccgcccgcuccaccucccgcgccggcugcggcgaggacgcccgccgcuccucccacaugcucuucacccuccacgucuaccaguaccgcauggagaagugcggccgcggcggcauguccggcggccgcucccgccuccaccucaucgaccucggcuccugcgaggccgccgccggccgcgccggcgaggccgccggcggcccccucugccucucccucuccgcccucggcuccgucauccucgcccucgucaacggcgccaagcacguccccuaccgcgaccaccgccucaccaugcuccuccgcgagucccucgccaccgccggcugccgcaccaccaugaucgcccacgucuccgacgcccccgcccagcacgccgagacccucuccaccguccagcucgccgcccgcauccaccgccuccgccgcaagaaggccaaguacgccuccuccuccuccggcggcgaguccuccugcgaggagggccgcgcccgccgccccccccaccuccgccccuuccacccccgcaccgucgcccucgaccccgaccgcaccccccccugccuccccggcgaccccgacuacuccuccuccuccgagcaguccugcgacaccgucaucuacgucggccccggcggcgccgcccucuccgaccgcgagcucaccgacaacgagggcccccccgacuucguccccaucauccccgcccucucccgccaccgccccuccaagggcccccgcgacgccgaccacuuccgcugcuccaccuucgccgagcuccaggagcgccucgagugcauggacggcaacgagggccccuccggcggccccggcggcaccgacggcgcccaggccucccccgcccgcggcggccgcaagcccuccccccccgaggccgccuccccccgcaaggccgucggcacccccauggccgccuccaccccccgcggcuccuccggccccgacacccaccagggcacccccgagcccugcaaggccaucgucuggggcgaccagcgcgaggacuccuccgccuggcccgagcuccucguccccgagaaggccgccgucuccggcggccgccgcccccuccccucccccgcccccccccccccccagcuccucgaggccugccgcgcccccgaggagcccggcggcggcggcaccgacggcgucgcccgcaccccccccgucggcauguccggccaggucgccggcucccccaugcuccccggcgccaccugcccccgccucgccgccggcucccgcugccccgagcgcggccuccucaccaccaccgucacccuccagcgccccgucgagcucaacggcgaggacgagcucgucuucaccgucgucgaggagcucucccucggcgcccucgccggcgccggccgccccaccucccucgccuccuucgacuccgacugcucccuccgcgcccucgccuccggcucccgccccgucuccaucaucuccuccaucaacgacgaguucgacgccuacaccucccaggcccccgagggcggcccccucgagggcgccgccugggccggcuccucccacggcuccuccaucuccuccuggcucuccgaggucuccgucugcaccgccgacucccgcgaccccaccccccagccccgcuucucccccgacucccucgccggccucgaccccggcggcccccccgcccucgacggcucccucggcgacggcuccuccggcuuccucggccccgaccgccccgacucccccggccccaccuggggccccugccccggcgaggucgccgccgucgcccccucccgccccggccgcgagccccaggccggccccucccgcugggccuccgccgcccagaccauccacuccucccucccccgcaagccccgcaccgccuccgccaccacccgcgucggcugcgcccgccucggccaguccccccccggccgcggcggccucuucgaggaccccuggcuccuccgcgucggcgagugcgacacccaggccgccuccgccggccgcgcccccucccccacccucggcuccccccgccuccccgaggcccaggucaugcucgccugcgcccagcgcgucgucgacggcugcgaggucgccgcccgcgccgcccgccgccccgaggccgucgcccgcauccccccccuccgccgcggcgccaccacccucggcgucaccacccccgccgucuccuggggcgacgcccccaccgaggucgucgccugcuccggcucccucaaggccucccccaccuccaagaagggccucgcccccaaggccggcuuccucccccgccccuccggcgccgccccccccgccccccccacccgcaaguccucccucgagcagcgcuccucccccgccuccgcccccccccacgccgucaaccccgcccgcgucggcgccgccgccguccuccgcggcgaggaggagccccgccccuccucccgcgccgaccacuccgucccccgcgccaccuccucccucaaggcccgcgccuccaaggucgaggccgcccaccgccucgccggccacgccucccucgagcgcuacgagggccucgcccacuccuccuccaagggccgcgaggcccccggccgccccccccgcgccguccccaagcucggcgucccccccuccucccccacccacggccccgcccccgccugccgcuccggcgccgccaaggccgucggcgcccccaagccccccgucggcggcggcaagggccgcggccucgucgccggcggcucccgcgcccucggccccuccgucaagcucuccaccgccuccgucaccggccgcucccccggcggccccgucgccggcccccgcgccgccccccgcgccggccccuccgucggcgccaaggccggccgcggcaccgucaugggcaccaagcaggcccuccgcgccgcccacucccgcguccacgagcucuccgccuccggcgcccccggccgcggcggcuccuccuggggcuccgccgacuccgacuccggccacgacuccggcgucaacgucggcgaggagcgcccccccaccggccccgcccuccccucccccuacuccaaggucaccgccccccgccgcccccagcgcuacuccuccggccacggcuccgacaacuccuccguccucuccggcgagcucccccccgccaugggccgcaccgcccucuuccaccacuccggcggcuccuccggcuacgagucccuccgccgcgacuccgaggccaccggcuccgccuccuccgcccccgacuccauguccgaguccggcgccgccucccccggcgcccgcacccgcucccucaagucccccaagaagcgcgccaccggccuccagcgccgccgccucauccccgccccccuccccgacaccaccgcccucggccgcaagcccucccuccccggccagugggucgaccucccccccccccucgccggcucccucaaggagcccuucgagaucaaggucuacgagaucgacgacgucgagcgccuccagcgcccccgccccaccccccgcgaggcccccacccagggccucgccugcgucuccacccgccuccgccucgccgagcgccgccagcagcgccuccgcgagguccaggccaagcacaagcaccucugcgaggagcucgccgagacccagggccgccucaugcucgagcccggccgcuggcucgagcaguucgaggucgaccccgagcucgagcccgaguccgccgaguaccucgccgcccucgagcgcgccaccgccgcccucgagcagugcgucaaccucugcaaggcccacgucaugauggucaccugcuucgacaucuccgucgccgccuccgccgccauccccggcccccaggaggucgacgucuga

SEQ ID NO: 45057 - RNA, 6327 nt, Artificial Sequence
  derived and/or modified sequence opt2 from KIF26B__Homo_sapiens__NP_060482
augaacuccgucgccggcaacaaggagcgccucgccgucuccacccgcggcaagaaguacggcgucaacgaggucugcucccccaccaagcccgccgcccccuucucccccgaguccugguaccgcaaggccuacgaggagucccgcgccggcucccgccccacccccgagggcgccggcuccgcccucggcuccuccggcacccccucccccggcuccggcaccuccucccccuccuccuucaccggcucccccggccccgccucccccggcaucggcaccuccucccccggcucccucggcggcucccccggcuucggcaccggcucccccggcuccggcuccggcggcggcuccucccccggcuccgaccgcggcgucuggugcgagaacugcaacgcccgccucgucgagcucaagcgccaggcccuccgccuccuccuccccggccccuuccccggcaaggaccccgccuucuccgccgucauccacgacaagcuccagguccccaacaccauccgcaaggccuggaacgaccgcgacaaccgcugcgacaucugcgccacccaccucaaccagcucaagcaggaggccauccagaugguccucacccucgagcaggccgccggcuccgagcacuacgacgccucccccugcuccccccccccccucuccaacauccccacccucgucggcucccgccacgucggcggccuccagcagccccgcgacugggccuucguccccgcccccugcgccaccuccaacuacaccggcuucgccaacaagcacggcuccaagcccuccucccucggcgucuccaacggcgccgagaagaaguccggcucccccacccaccaggccaaggucucccuccagauggccaccucccccuccaacggcaacauccucaacuccgucgccauccaggcccaccaguaccucgacggcaccuggucccucucccgcaccaacggcgucacccucuaccccuaccagaucucccagcucaugaccgaguccucccgcgagggccucaccgaggccguccucaaccgcuacaacgccgacaagcccuccgccugcuccguccccgccucccagggcuccugcgucgccuccgagaccuccaccggcaccuccgucgccgccuccuucuucgcccgcgccgcccagaagcucaaccucuccuccaagaagaagaagcaccgccccuccaccuccuccgccgccgagcccccccucuucgccaccuccuucuccggcauccuccagaccucccccccccccgccccccccugccuccuccgcgccgucaacaaggucaaggacacccccggccucggcaaggucaaggucaugcuccgcaucugcuccacccucgcccgcgacaccuccgaguccuccuccuuccucaaggucgacccccgcaagaagcagaucacccucuacgacccccucaccugcggcggccagaacgccuuccagaagcgcggcaaccaggucccccccaagauguucgccuucgacgccgucuucccccaggacgccucccaggccgaggucugcgccggcaccgucgccgaggucauccaguccgucgucaacggcgccgacggcugcgucuucugcuucggccacgccaagcucggcaaguccuacaccaugaucggcaaggacgacuccaugcagaaccucggcaucauccccugcgccaucuccuggcucuucaagcucaucaacgagcgcaaggagaagaccggcgcccgcuucuccguccgcgucuccgccgucgaggucuggggcaaggaggagaaccuccgcgaccuccucuccgaggucgccaccggcucccuccaggacggccagucccccggcgucuaccucugcgaggaccccaucugcggcacccagcuccagaaccaguccgagcuccgcgcccccaccgccgagaaggccgccuucuuccucgacgccgccaucgccucccgccgcucccaccagcaggacugcgacgaggacgaccaccgcaacucccacgucuucuucacccuccacaucuaccaguaccgcauggagaaguccggcaagggcggcauguccggcggccgcucccgccuccaccucaucgaccucggcuccugcgucaaggcccucuccaagaaccgcgagggcggcuccggccucugccucucccucuccgcccucggcaacgucauccucgcccucgucaacggcuccaagcacauccccuacaaggaguccaagcucgccaugcuccuccgcgagucccucggcaacaugaacugccgcaccaccaugaucgcccacaucuccgccgccgucggcuccuacgccgagacccucuccaccauccagaucgccucccgcguccuccgcaugaagaagaagaagaccaaguacaccuccuccuccuccggcggcgaguccuccugcgaggagggccgcaugcgccgccccacccagcuccgccccuuccacacccgcgccaccgucgaccccgacuuccccaucgcccaccucuccuccgaccccgacuacuccuccuccuccgagcaguccugcgacaccgucaucuacaucggccccaacggcaccgcccucuccgacaaggagcucaccgacaacgagggcccccccgacuucguccccaucguccccgcccuccagaagacccgcggcgacucccgccccgccgaggccggcgaggccgccgccggcaaguccgagcgcgacugccucaagugcaacaccuucgccgagcuccaggagcgccucgacugcaucgacggcuccgaggagcccuccuccuuccccuucgaggagcuccccgcccaguucggccccgagcaggccucccgcggcccccgccucucccaggccgccggcgccuccccccucuccgaguccgacaaggaggacaacggcuccgagggccagcucaccaaccgcgagggccccgagcuccccgccuccaagaugcagcgcucccacucccccguccccgccgccgcccccgcccacucccccucccccgccuccccccgcuccguccccggcuccuccucccagcacuccgccuccccccucguccagucccccucccuccaguccucccgcgagucccucaacuccugcggcuucgucgagggcaagccccgccccaugggcuccccccgccucggcaucgccucccucuccaagaccuccgaguacaagccccccuccucccccucccagcgcugcaaggucuacacccagaagggcguccuccccucccccgccccccucccccccuccuccaaggacuccggcgucgccucccgcgagucccuccuccagcccgagguccgcaccccccccgucggcauguccccccagguccucaagaaguccauguccgccggcuccgagggcuuccccgagacccccgucgacgacgagcagcaggccgccacccccuccgaguccaagaaggagauccucuccaccaccauggucaccguccagcagccccucgagcucaacggcgaggacgagcucgucuucacccucgucgaggagcucaccaucuccggcguccucgacuccggccgccccaccuccaucaucuccuucaacuccgacugcuccgcccgcgcccucgccuccggcucccgccccgucuccaucaucuccuccaucuccgaggaccucgagugcuacuccuccaccgcccccgucuccgaggucuccaucacccaguuccucccccuccccaagaugucccucgacgagaaggcccaggacgccggcucccgccgcuccuccaucuccuccuggcucuccgagauguccgccggcuccgagggcgagcaguccugccacuccuucaucgcccagaccugcuucggccacggcgaggccauggccgagcccgucgccuccgaguucgucuccucccuccagaacaccgccgucgucugccgcgagaagcccaaggccucccccgacaaccuccucauccucuccgagaugggcgacgacuccuucaacaaggccgcccccaucaagggcugcaagaucuccaccgucuccaaggccauggucaccaucuccaacaccgccaaccucuccuccugcgagggcuacauccccaugaagaccaacaucaccgucuaccccugcaucgccauguccccccgcaacauccaggagcccgaggcccccaccgccacccccaaggccggccccacccucgcccagucccgcgaguccaaggagaacuccgccaagaaggagaugaaguucgaggaccccuggcucaagcgcgaggaggaggucaagaaggagaccgcccaccccaacgaggagggcaugaugcgcugcgagaccgccaccggccccuccaacgccgagacccgcgccgagcaggagcaggacggcaagcccucccccggcgaccgccucuccuccuccuccggcgaggucuccgccucccccgucaccgacaacuuccgccgcgucgucgacggcugcgagauggcccuccccggccucgccacccagucccccguccaccccaacaaguccgucaaguccuccucccucccccgcgccuuccagaaggccucccgccaggaggagcccgacucccucuccuacuacugcgccgccgagaccaacggcgucggcgccgccuccggcaccccccccuccaaggccacccucgagggcaaggucgccucccccaagcacugcguccucgcccgccccaagggcacccccccccucccccccguccgcaaguccucccucgaccagaagaaccgcgccuccccccagcacuccgccuccggcuccggcaccuccuccccccucaaccagcccgccgccuuccccgccggccuccccgacgagcccuccggcaagaccaaggacgccuccuccuccuccaagcucuucuccgccaagcucgagcagcucgccucccgcuccaacucccucggccgcgccaccgucucccacuacgagugccucucccucgagcgcgccgagucccucuccuccgucuccucccgccuccacgccggcaaggacggcaccaugccccgcgccggccgcucccucggccgcuccgccggcaccuccccccccuccuccggcgccucccccaaggccggccaguccaagaucuccgccgucucccgccuccuccucgccuccccccgcgcccgcggccccuccgccuccaccaccaagacccucuccuucuccaccaagucccucccccaggccgucggccagggcuccuccuccccccccggcggcaagcacacccccugguccacccagucccucucccgcaaccgcuccuccggccucgccuccaagcucccccuccgcgccgucuccggccgcaucuccgagcuccuccagggcggcgccggcgcccgcggccuccagcuccgcgccggccccgaggccgaggcccgcggcggcgcccucgccgaggacgagcccgccgccgcccaccuccuccccucccccuacuccaagaucacccccccccgccgcccccaccgcugcuccuccggccacggcuccgacaacuccuccguccucuccggcgagcucccccccgccaugggcaagaccgcccucuucuaccacuccggcggcuccuccggcuacgaguccgucaugcgcgacuccgaggccaccggcuccgccuccuccgcccaggacuccaccuccgagaacuccuccuccgucggcggccgcugccgcucccucaagacccccaagaagcgcuccaaccccggcucccagcgccgccgccucauccccgcccucucccucgacaccuccucccccguccgcaagccccccaacuccaccggcguccgcugggucgacggcccccuccgcuccuccccccgcggccucggcgagcccuucgagaucaaggucuacgagaucgacgacgucgagcgccuccagcgccgccgcggcggcgccuccaaggaggccaugugcuucaacgccaagcucaagauccucgagcaccgccagcagcgcaucgccgagguccgcgccaaguacgaguggcucaugaaggagcucgaggccaccaagcaguaccucaugcucgaccccaacaaguggcucuccgaguucgaccucgagcaggucugggagcucgacucccucgaguaccucgaggcccucgagugcgucaccgagcgccucgagucccgcgucaacuucugcaaggcccaccucaugaugaucaccugcuucgacaucaccucccgccgccgcuga

SEQ ID NO: 45058 - RNA, 2235 nt, Artificial Sequence
  derived and/or modified sequence opt2 from KIF2A__Homo_sapiens__NP_001091981
auggccaccgccaacuucggcaagauccagaucggcaucuacgucgagaucaagcgcuccgacggccgcauccaccaggccauggucaccucccucaacgaggacaacgaguccgucaccgucgaguggaucgagaacggcgacaccaagggcaaggagaucgaccucgaguccaucuucucccucaaccccgaccucguccccgacgaggagaucgagcccucccccgagaccccccccccccccgccuccuccgccaaggucaacaagaucgucaagaaccgccgcaccgucgccuccaucaagaacgacccccccucccgcgacaaccgcgucgucggcuccgcccgcgcccgccccucccaguuccccgagcaguccuccuccgcccagcagaacggcuccgucuccgacaucucccccguccaggccgccaagaaggaguucggcccccccucccgccgcaaguccaacugcgucaaggaggucgagaagcuccaggagaagcgcgagaagcgccgccuccagcagcaggagcuccgcgagaagcgcgcccaggacgucgacgccaccaaccccaacuacgagaucaugugcaugauccgcgacuuccgcggcucccucgacuaccgcccccucaccaccgccgaccccaucgacgagcaccgcaucugcgucugcguccgcaagcgcccccucaacaagaaggagacccagaugaaggaccucgacgucaucaccauccccuccaaggacgucgucaugguccacgagcccaagcagaaggucgaccucacccgcuaccucgagaaccagaccuuccgcuucgacuacgccuucgacgacuccgcccccaacgagauggucuaccgcuucaccgcccgcccccucgucgagaccaucuucgagcgcggcauggccaccugcuucgccuacggccagaccggcuccggcaagacccacaccaugggcggcgacuucuccggcaagaaccaggacugcuccaagggcaucuacgcccucgccgcccgcgacgucuuccucaugcucaagaagcccaacuacaagaagcucgagcuccaggucuacgccaccuucuucgagaucuacuccggcaaggucuucgaccuccucaaccgcaagaccaagcuccgcguccucgaggacggcaagcagcagguccaggucgucggccuccaggagcgcgaggucaagugcgucgaggacguccucaagcucaucgacaucggcaacuccugccgcaccuccggccagaccuccgccaacgcccacuccucccgcucccacgccgucuuccagaucauccuccgccgcaagggcaagcuccacggcaaguucucccucaucgaccucgccggcaacgagcgcggcgccgacaccuccuccgccgaccgccagacccgccucgagggcgccgagaucaacaagucccuccucgcccucaaggagugcauccgcgcccucggccgcaacaagccccacacccccuuccgcgccuccaagcucacccagguccuccgcgacuccuucaucggcgagaacucccgcaccugcaugaucgccaccaucucccccggcauggccuccugcgagaacacccucaacacccuccgcuacgccaaccgcgucaaggaguucggcaucucccccuccgacauccccuucucccagggcuccggcucccgccccgaccucucccccuccuacgaguacgacgacuucucccccuccgucacccgcgucaaggagcucaccgucgaccccaccgccgccggcgacguccgccccaucaugcaccacccccccaaccagaucgacgaccucgagacccaguggggcgucggcuccuccccccagcgcgacgaccucaagcuccucugcgagcagaacgaggaggaggucuccccccagcucuucaccuuccacgaggccgucucccagauggucgagauggaggagcaggucgucgaggaccaccgcgccgucuuccaggaguccauccgcuggcucgaggacgagaaggcccuccucgagaugaccgaggaggucgacuacgacgucgacuccuacgccacccagcucgaggccauccucgagcagaagaucgacauccucaccgagcuccgcgacaaggucaaguccuuccgcgccgcccuccaggaggaggagcaggccuccaagcagaucaaccccaagcgcccccgcgcccucuga

SEQ ID NO: 45059 - RNA, 2022 nt, Artificial Sequence
  derived and/or modified sequence opt2 from KIF2B__Homo_sapiens__NP_115948
auggccucccaguucugccuccccgagucccccugccucuccccccucaagccccucaagccccacuucggcgacauccaggagggcaucuacgucgccauccagcgcuccgacaagcgcauccaccucgccgucgucaccgagaucaaccgcgagaacuacugggucaccgucgagugggucgagaaggccgucaagaagggcaagaagaucgaccucgagaccauccuccuccucaaccccgcccucgacuccgccgagcaccccaugcccccccccccccucuccccccucgcccucgcccccuccuccgccauccgcgaccagcgcaccgccaccaagugggucgccaugaucccccagaagaaccagaccgccuccggcgacucccucgacguccgcguccccuccaagcccugccucaugaagcagaagaagucccccugccucugggagauccagaagcuccaggagcagcgcgagaagcgccgccgccuccagcaggagauccgcgcccgccgcgcccucgacgucaacacccgcaaccccaacuacgagaucaugcacaugaucgaggaguaccgccgccaccucgacuccuccaagaucuccguccucgagcccccccaggagcaccgcaucugcgucugcguccgcaagcgcccccucaaccagcgcgagaccacccucaaggaccucgacaucaucaccguccccuccgacaacgucgucaugguccacgaguccaagcagaaggucgaccucacccgcuaccuccagaaccagaccuucugcuucgaccacgccuucgacgacaaggccuccaacgagcucgucuaccaguucaccgcccagccccucgucgaguccaucuuccgcaagggcauggccaccugcuucgccuacggccagaccggcuccggcaagaccuacaccaugggcggcgacuucuccggcaccgcccaggacugcuccaagggcaucuacgcccucgucgcccaggacgucuuccuccuccuccgcaacuccaccuacgagaagcucgaccucaaggucuacggcaccuucuucgagaucuacggcggcaaggucuacgaccuccucaacuggaagaagaagcuccagguccucgaggacggcaaccagcagauccaggucgucggccuccaggagaaggaggucugcugcgucgaggagguccucaaccucgucgagaucggcaacuccugccgcaccucccgccagacccccgucaacgcccacuccucccgcucccacgccgucuuccagaucauccucaaguccggccgcaucaugcacggcaaguucucccucgucgaccucgccggcaacgagcgcggcgccgacaccaccaaggccucccgcaagcgccagcucgagggcgccgagaucaacaagucccuccucgcccucaaggagugcauccucgcccucggccagaacaagccccacacccccuuccgcgccuccaagcucacccucguccuccgcgacuccuucaucggccagaacuccuccaccugcaugaucgccaccaucucccccggcaugaccuccugcgagaacacccucaacacccuccgcuacgccaaccgcgucaagaagcucaacgucgacguccgccccuaccaccgcggccacuaccccaucggccacgaggccccccgcaugcucaagucccacaucggcaacuccgagaugucccuccagcgcgacgaguucaucaagauccccuacguccaguccgaggagcagaaggagaucgaggaggucgagacccuccccacccuccucggcaaggacaccaccaucuccggcaagggcuccucccaguggcucgagaacauccaggagcgcgccggcggcguccaccacgacaucgacuucugcaucgcccgcucccucuccauccucgagcagaagaucgacgcccucaccgagauccagaagaagcucaagcuccuccucgccgaccuccacgucaaguccaaggucgaguga

SEQ ID NO: 45060 - RNA, 2055 nt, Artificial Sequence
  derived and/or modified sequence opt2 from KIF2C__Homo_sapiens__NP_001284584
auggccauggacuccucccuccaggcccgccucuuccccggccucgccaucaagauccagcgcuccaacggccucauccacuccgccaacguccgcaccgucaaccucgagaaguccugcgucuccgucgagugggccgagggcggcgccaccaagggcaaggagaucgacuucgacgacgucgccgccaucaaccccgagcuccuccagcuccucccccuccaccccaaggacaaccucccccuccaggagaacgucaccauccagaagcagaagcgccgcuccgucaacuccaagauccccgcccccaaggagucccuccgcucccgcuccacccgcauguccaccgucuccgagcuccgcaucaccgcccaggagaacgacauggaggucgagcuccccgccgccgccaacucccgcaagcaguucuccgucccccuccgccgcaaguccugccucgucaaggaggucgagaagaugaagaacaagcgcgaggagaagaaggcccagaacuccgagaugcgcaugaagcgcgcccaggaguacgacuccuccuuccccaacugggaguucgcccgcaugaucaaggaguuccgcgccacccucgagugccacccccucaccaugaccgaccccaucgaggagcaccgcaucugcgucugcguccgcaagcgcccccucaacaagcaggagcucgccaagaaggagaucgacgucaucuccauccccuccaagugccuccuccucguccacgagcccaagcucaaggucgaccucaccaaguaccucgagaaccaggccuucugcuucgacuucgccuucgacgagaccgccuccaacgaggucgucuaccgcuucaccgcccgcccccucguccagaccaucuucgagggcggcaaggccaccugcuucgccuacggccagaccggcuccggcaagacccacaccaugggcggcgaccucuccggcaaggcccagaacgccuccaagggcaucuacgccauggccucccgcgacgucuuccuccucaagaaccagcccugcuaccgcaagcucggccucgaggucuacgucaccuucuucgagaucuacaacggcaagcucuucgaccuccucaacaagaaggccaagcuccgcguccucgaggacggcaagcagcagguccaggucgucggccuccaggagcaccucgucaacuccgccgacgacgucaucaagaugaucgacaugggcuccgccugccgcaccuccggccagaccuucgccaacuccaacuccucccgcucccacgccugcuuccagaucauccuccgcgccaagggccgcaugcacggcaaguucucccucgucgaccucgccggcaacgagcgcggcgccgacaccuccuccgccgaccgccagacccgcauggagggcgccgagaucaacaagucccuccucgcccucaaggagugcauccgcgcccucggccagaacaaggcccacacccccuuccgcgaguccaagcucacccagguccuccgcgacuccuucaucggcgagaacucccgcaccugcaugaucgccaccaucucccccggcaucuccuccugcgaguacacccucaacacccuccgcuacgccgaccgcgucaaggagcucuccccccacuccggccccuccggcgagcagcucauccagauggagaccgaggagauggaggccugcuccaacggcgcccucauccccggcaaccucuccaaggaggaggaggagcucuccucccagauguccuccuucaacgaggccaugacccagauccgcgagcucgaggagaaggccauggaggagcucaaggagaucauccagcagggccccgacuggcucgagcucuccgagaugaccgagcagcccgacuacgaccucgagaccuucgucaacaaggccgaguccgcccucgcccagcaggccaagcacuucuccgcccuccgcgacgucaucaaggcccuccgccucgccaugcagcucgaggagcaggccucccgccagaucuccuccaagaagcgcccccaguga

SEQ ID NO: 45061 - RNA, 2181 nt, Artificial Sequence
  derived and/or modified sequence opt2 from KIF3A__Homo_sapiens__NP_001287720
augcccaucaacaaguccgagaagcccgaguccugcgacaacgucaaggucgucguccgcugccgcccccucaacgagcgcgagaaguccaugugcuacaagcaggccgucuccgucgacgagaugcgcggcaccaucaccguccacaagaccgacuccuccaacgagccccccaagaccuucaccuucgacaccgucuucggccccgaguccaagcagcucgacgucuacaaccucaccgcccgccccaucaucgacuccguccucgagggcuacaacggcaccaucuucgccuacggccagaccggcaccggcaagaccuucaccauggagggcguccgcgccauccccgagcuccgcggcaucauccccaacuccuucgcccacaucuucggccacaucgccaaggccgagggcgacacccgcuuccucguccgcgucuccuaccucgagaucuacaacgaggagguccgcgaccuccucggcaaggaccagacccagcgccucgaggucaaggagcgccccgacgucggcgucuacaucaaggaccucuccgccuacgucgucaacaacgccgacgacauggaccgcaucaugacccucggccacaagaaccgcuccgucggcgccaccaacaugaacgagcacuccucccgcucccacgccaucuucaccaucaccaucgagugcuccgagaagggcaucgacggcaacaugcacguccgcaugggcaagcuccaccucgucgaccucgccggcuccgagcgccaggccaagaccggcgccaccggccagcgccucaaggaggccaccaagaucaaccucucccucuccacccucggcaacgucaucuccgcccucgucgacggcaaguccacccacguccccuaccgcaacuccaagcucacccgccuccuccaggacucccucggcggcaacuccaagaccaugaugugcgccaacaucggccccgccgacuacaacuacgacgagaccaucuccacccuccgcuacgccaaccgcgccaagaacaucaagaacaaggcccgcaucaacgaggaccccaaggacgcccuccuccgccaguuccagaaggagaucgaggagcucaagaagaagcucgaggagggcgaggagaucuccggcuccgacaucuccggcuccgaggaggacgacgacgaggagggcgaggucggcgaggacggcgagaagcgcaagaagcgccgcggcuccuccuccuccuccuccuccgacuccaccugcuccgucaucgagaagccccucgacaaguuccuccccaaccaggccggcaagaagaaggucucccccgacaagaugaucgagaugcaggccaagaucgacgaggagcgcaaggcccucgagaccaagcucgacauggaggaggaggagcgcaacaaggcccgcgccgagcucgagaagcgcgagaaggaccuccucaaggcccagcaggagcaccagucccuccucgagaagcucuccgcccucgagaagaaggucaucgucggcggcgucgaccuccucgccaaggccgaggagcaggagaagcuccucgaggaguccaacauggagcucgaggagcgccgcaagcgcgccgagcagcuccgccgcgagcucgaggagaaggagcaggagcgccucgacaucgaggagaaguacaccucccuccaggaggaggcccagggcaagaccaagaagcucaagaaggucuggaccaugcucauggccgccaaguccgagauggccgaccuccagcaggagcaccagcgcgagaucgagggccuccucgagaacauccgccagcucucccgcgagcuccgccuccagaugcucaucaucgacaacuucaucccccgcgacuaccaggagaugaucgagaacuacguccacuggaacgaggacaucggcgaguggcagcucaagugcgucgccuacaccggcaacaacaugcgcaagcagacccccguccccgacaagaaggagaaggaccccuucgaggucgaccucucccacgucuaccucgccuacaccgaggagucccuccgccagucccucaugaagcucgagcgcccccgcaccuccaagggcaaggcccgccccaagaccggccgccgcaagcgcuccgccaagcccgagaccgucaucgacucccuccuccaguga

SEQ ID NO: 45062 - RNA, 2244 nt, Artificial Sequence
  derived and/or modified sequence opt2 from KIF3B__Homo_sapiens__NP_004789
auguccaagcucaaguccuccgaguccguccgcgucgucguccgcugccgccccaugaacggcaaggagaaggccgccuccuacgacaaggucgucgacgucgacgucaagcucggccaggucuccgucaagaaccccaagggcaccgcccacgagaugcccaagaccuucaccuucgacgccgucuacgacuggaacgccaagcaguucgagcucuacgacgagaccuuccgcccccucgucgacuccguccuccagggcuucaacggcaccaucuucgccuacggccagaccggcaccggcaagaccuacaccauggagggcauccgcggcgaccccgagaagcgcggcgucauccccaacuccuucgaccacaucuucacccacaucucccgcucccagaaccagcaguaccucguccgcgccuccuaccucgagaucuaccaggaggagauccgcgaccuccucuccaaggaccagaccaagcgccucgagcucaaggagcgccccgacaccggcgucuacgucaaggaccucuccuccuucgucaccaaguccgucaaggagaucgagcacgucaugaacgucggcaaccagaaccgcuccgucggcgccaccaacaugaacgagcacuccucccgcucccacgccaucuucgucaucaccaucgagugcuccgaggucggccucgacggcgagaaccacauccgcgucggcaagcucaaccucgucgaccucgccggcuccgagcgccaggccaagaccggcgcccagggcgagcgccucaaggaggccaccaagaucaaccucucccucuccgcccucggcaacgucaucuccgcccucgucgacggcaaguccacccacauccccuaccgcgacuccaagcucacccgccuccuccaggacucccucggcggcaacgccaagaccgucauggucgccaacgucggccccgccuccuacaacgucgaggagacccucaccacccuccgcuacgccaaccgcgccaagaacaucaagaacaagccccgcgucaacgaggaccccaaggacgcccuccuccgcgaguuccaggaggagaucgcccgccucaaggcccagcucgagaagcgcuccaucggccgccgcaagcgccgcgagaagcgccgcgagggcggcggcuccggcggcggcggcgaggaggaggaggaggagggcgaggagggcgaggaggagggcgacgacaaggacgacuacuggcgcgagcagcaggagaagcucgagaucgagaagcgcgccaucgucgaggaccacucccucgucgccgaggagaagaugcgccuccucaaggagaaggagaagaagauggaggaccuccgccgcgagaaggacgccgccgagaugcucggcgccaagaucaaggccauggaguccaagcuccucgucggcggcaagaacaucgucgaccacaccaacgagcagcagaagauccucgagcagaagcgccaggagaucgccgagcagaagcgccgcgagcgcgagauccagcagcagauggagucccgcgacgaggagacccucgagcucaaggagaccuacuccucccuccagcaggaggucgacaucaagaccaagaagcucaagaagcucuucuccaagcuccaggccgucaaggccgagauccacgaccuccaggaggagcacaucaaggagcgccaggagcucgagcagacccagaacgagcucacccgcgagcucaagcucaagcaccucaucaucgagaacuucaucccccucgaggagaaguccaagaucaugaaccgcgccuucuucgacgaggaggaggaccacuggaagcuccaccccaucacccgccucgagaaccagcagaugaugaagcgccccgucuccgccgucggcuacaagcgcccccucucccagcacgcccgcauguccaugaugauccgccccgaggcccgcuaccgcgccgagaacaucguccuccucgagcucgacaugcccucccgcaccacccgcgacuacgagggccccgccaucgcccccaagguccaggccgcccucgacgccgcccuccaggacgaggacgagauccaggucgacgccuccuccuucgaguccaccgccaacaagaaguccaaggcccgccccaaguccggccgcaaguccggcuccuccuccuccuccuccggcacccccgccucccagcucuacccccagucccgcggccucguccccaaguga

SEQ ID NO: 45063 - RNA, 2382 nt, Artificial Sequence
  derived and/or modified sequence opt2 from KIF3C__Homo_sapiens__NP_002245
auggccuccaagaccaaggccuccgaggcccucaaggucgucgcccgcugccgcccccucucccgcaaggaggaggccgccggccacgagcagauccucaccauggacgucaagcucggccaggucacccuccgcaacccccgcgccgcccccggcgagcuccccaagaccuucaccuucgacgccgucuacgacgccuccuccaagcaggccgaccucuacgacgagaccguccgcccccucaucgacuccguccuccagggcuucaacggcaccgucuucgccuacggccagaccggcaccggcaagaccuacaccaugcagggcaccugggucgagcccgagcuccgcggcgucauccccaacgccuucgagcacaucuucacccacaucucccgcucccagaaccagcaguaccucguccgcgccuccuaccucgagaucuaccaggaggagauccgcgaccuccucuccaaggagcccggcaagcgccucgagcucaaggagaaccccgagaccggcgucuacaucaaggaccucuccuccuucgucaccaagaacgucaaggagaucgagcacgucaugaaccucggcaaccagacccgcgccgucggcuccacccacaugaacgaggucuccucccgcucccacgccaucuucaucaucaccgucgagugcuccgagcgcggcuccgacggccaggaccacauccgcgucggcaagcucaaccucgucgaccucgccggcuccgagcgccagaacaaggccggccccaacaccgccggcggcgccgccacccccuccuccggcggcggcggcggcggcggcggcuccggcggcggcgccggcggcgagcgccccaaggaggccuccaagaucaaccucucccucuccgcccucggcaacgucaucgccgcccucgccggcaaccgcuccacccacauccccuaccgcgacuccaagcucacccgccuccuccaggacucccucggcggcaacgccaagaccaucauggucgccacccucggccccgccucccacuccuacgacgagucccucuccacccuccgcuucgccaaccgcgccaagaacaucaagaacaagccccgcgucaacgaggaccccaaggacacccuccuccgcgaguuccaggaggagaucgcccgccucaaggcccagcucgagaagcgcggcaugcucggcaagcgcccccgccgcaaguccucccgccgcaagaaggccgucuccgccccccccggcuaccccgagggccccgucaucgaggccugggucgccgaggaggaggacgacaacaacaacaaccaccgccccccccagcccauccucgaguccgcccucgagaagaacauggagaacuaccuccaggagcagaaggagcgccucgaggaggagaaggccgccauccaggacgaccgcucccucgucuccgaggagaagcagaagcuccucgaggagaaggagaagaugcucgaggaccuccgccgcgagcagcaggccaccgagcuccucgccgccaaguacaaggccauggaguccaagcuccucaucggcggccgcaacaucauggaccacaccaacgagcagcagaagaugcucgagcucaagcgccaggagaucgccgagcagaagcgccgcgagcgcgagaugcagcaggagaugaugcuccgcgacgaggagaccauggagcuccgcggcaccuacaccucccuccagcaggaggucgaggucaagaccaagaagcucaagaagcucuacgccaagcuccaggccgucaaggccgagauccaggaccagcacgacgaguacauccgcguccgccaggaccucgaggaggcccagaacgagcagacccgcgagcucaagcucaaguaccucaucaucgagaacuucaucccccccgaggagaagaacaagaucaugaaccgccucuuccucgacugcgaggaggagcaguggaaguuccagccccucguccccgccggcgucuccuccucccagaugaagaagcgccccaccuccgccgucggcuacaagcgccccaucucccaguacgcccgcgucgccauggccaugggcucccacccccgcuaccgcgccgagaacaucauguuccucgagcucgacgucuccccccccgccgucuucgagauggaguucucccacgaccaggagcaggacccccgcgcccuccacauggagcgccucaugcgccucgacuccuuccucgagcgccccuccaccuccaagguccgcaagucccgcuccuggugccaguccccccagcgccccccccccuccaccacccacgccucccucgccuccgccucccuccgccccgccaccgucgccgaccacgaguga

SEQ ID NO: 45064 - RNA, 3699 nt, Artificial Sequence
  derived and/or modified sequence opt2 from KIF4A__Homo_sapiens__XP_011529195
augaaggaggaggucaagggcauccccguccgcgucgcccuccgcugccgcccccucguccccaaggagaucuccgagggcugccagaugugccucuccuucguccccggcgagccccaggucgucgucggcaccgacaaguccuucaccuacgacuucgucuucgaccccuccaccgagcaggaggaggucuucaacaccgccgucgccccccucaucaagggcgucuucaagggcuacaacgccaccguccucgccuacggccagaccggcuccggcaagaccuacuccaugggcggcgccuacaccgccgagcaggagaacgagcccaccgucggcgucaucccccgcgucauccagcuccucuucaaggagaucgacaagaaguccgacuucgaguucacccucaaggucuccuaccucgagaucuacaacgaggagauccucgaccuccucugccccucccgcgagaaggcccagaucaacauccgcgaggaccccaaggagggcaucaagaucgucggccucaccgagaagaccguccucgucgcccucgacaccgucuccugccucgagcagggcaacaacucccgcaccgucgccuccaccgccaugaacucccaguccucccgcucccacgccaucuucaccaucucccucgagcagcgcaagaaguccgacaagaacuccuccuuccgcuccaagcuccaccucgucgaccucgccggcuccgagcgccagaagaagaccaaggccgagggcgaccgccucaaggagggcaucaacaucaaccgcggccuccucugccucggcaacgucaucuccgcccucggcgacgacaagaagggcggcuucguccccuaccgcgacuccaagcucacccgccuccuccaggacucccucggcggcaacucccacacccucaugaucgccugcgucucccccgccgacuccaaccucgaggagacccucaacacccuccgcuacgccgaccgcgcccgcaagaucaagaacaagcccaucgucaacaucgacccccagaccgccgagcucaaccaccucaagcagcagguccagcagcuccagguccuccuccuccaggcccacggcggcacccuccccggcuccaucaccgucgagcccuccgagaaccuccagucccucauggagaagaaccagucccucgucgaggagaacgagaagcucucccgcggccucuccgaggccgccggccagaccgcccagaugcucgagcgcaucauccucaccgagcaggccaacgagaagaugaacgccaagcucgaggagcuccgccagcacgccgccugcaagcucgaccuccagaagcucgucgagacccucgaggaccaggagcucaaggagaacgucgagaucaucugcaaccuccagcagcucaucacccagcucuccgacgagaccgucgccugcauggccgccgccaucgacaccgccgucgagcaggaggcccaggucgagaccucccccgagaccucccgcuccuccgacgccuucaccacccagcacgcccuccgccaggcccagauguccaaggagcucgucgagcucaacaaggcccucgcccucaaggaggcccucgcccgcaagaugacccagaacgacucccagcuccagcccauccaguaccaguaccaggacaacaucaaggagcucgagcucgaggucaucaaccuccagaaggagaaggaggagcucguccucgagcuccagaccgccaagaaggacgccaaccaggccaagcucuccgagcgccgccgcaagcgccuccaggagcucgagggccagaucgccgaccucaagaagaagcucaacgagcaguccaagcuccucaagcucaaggaguccaccgagcgcaccgucuccaagcucaaccaggagauccgcaugaugaagaaccagcgcguccagcucaugcgccagaugaaggaggacgccgagaaguuccgccaguggaagcagaagaaggacaaggaggucauccagcucaaggagcgcgaccgcaagcgccaguacgagcuccucaagcucgagcgcaacuuccagaagcaguccaacguccuccgccgcaagaccgaggaggccgccgccgccaacaagcgccucaaggacgcccuccagaagcagcgcgaggucgccgacaagcgcaaggagacccagucccgcggcauggagggcaccgccgcccgcgucaagaacuggcucggcaacgagaucgaggucauggucuccaccgaggaggccaagcgccaccucaacgaccuccucgaggaccgcaagauccucgcccaggacgucgcccagcucaaggagaagaaggaguccggcgagaaccccccccccaagcuccgccgccgcaccuucucccucaccgagguccgcggccaggucuccgaguccgaggacuccaucaccaagcagaucgagucccucgagaccgagauggaguuccgcuccgcccagaucgccgaccuccagcagaagcuccucgacgccgaguccgaggaccgccccaagcagcgcugggagaacaucgccaccauccucgaggccaagugcgcccucaaguaccucaucggcgagcucgucuccuccaagauccaggucuccaagcucgaguccucccucaagcaguccaagaccuccugcgccgacaugcagaagaugcucuucgaggagcgcaaccacuucgccgagaucgagaccgagcuccaggccgagcucguccgcauggagcagcagcaccaggagaagguccucuaccuccucucccagcuccagcagucccagauggccgagaagcagcucgaggaguccgucuccgagaaggagcagcagcuccucuccacccucaagugccaggacgaggagcucgagaagaugcgcgaggucugcgagcagaaccagcagcuccuccgcgagaacgagaucaucaagcagaagcucacccuccuccaggucgccucccgccagaagcaccuccccaaggacacccuccucucccccgacuccuccuucgaguacgucccccccaagcccaagcccucccgcgucaaggagaaguuccucgagcaguccauggacaucgaggaccucaaguacugcuccgagcacuccgucaacgagcacgaggacggcgacggcgacgacgacgagggcgacgacgaggaguggaagcccaccaagcucgucaaggucucccgcaagaacauccagggcugcuccugcaagggcuggugcggcaacaagcagugcggcugccgcaagcagaaguccgacugcggcgucgacugcugcugcgaccccaccaagugccgcaaccgccagcagggcaaggacucccucggcaccgucgagcgcacccaggacuccgagggcuccuucaagcucgaggaccccaccgaggucacccccggccucuccuucuucaaccccgucugcgccacccccaacuccaagauccucaaggagaugugcgacgucgagcagguccucuccaagaagaccccccccgcccccucccccuucgaccuccccgagcucaagcacgucgccaccgaguaccaggagaacaaggcccccggcaagaagaagaagcgcgcccucgccuccaacaccuccuucuucuccggcugcucccccaucgaggaggaggcccacuga

SEQ ID NO: 45065 - RNA, 3705 nt, Artificial Sequence
  derived and/or modified sequence opt2 from KIF4B__Homo_sapiens__NP_001092763
augaaggaggaggucaagggcauccccguccgcgucgcccuccgcugccgcccccucguccccaaggagaucuccgagggcugccagaugugccucuccuucguccccggcgagacccaggucgucgucggcaccgacaaguccuucaccuacgacuucgucuucgaccccugcaccgagcaggaggaggucuucaacaaggccgucgccccccucaucaagggcaucuucaagggcuacaacgccaccguccucgccuacggccagaccggcuccggcaagaccuacuccaugggcggcgccuacaccgccgagcaggagaacgagcccaccgucggcaucaucccccgcgucauccagcuccucuucaaggagaucgacaagaaguccgacuucgaguucacccucaaggucuccuaccucgagaucuacaacgaggagauccucgaccuccucugccccucccgcgagaaggcccagaucaacauccgcgaggaccccaaggagggcaucaagaucgucggccucaccgagaagaccguccucgucgcccucgacaccgucuccugccucgagcagggcaacaacucccgcaccgucgccuccaccgccaugaacucccaguccucccgcucccacgccaucuucaccaucuccaucgagcagcgcaagaaguccgacaagaacugcuccuuccgcuccaagcuccaccucgucgaccucgccggcuccgagcgccagaagaagaccaaggccgagggcgaccgccucaaggagggcaucaacaucaaccgcggccuccucugccucggcaacgucaucuccgcccucggcgacgacaagaagggcuccuucguccccuaccgcgacuccaagcucacccgccuccuccaggacucccucggcggcaacucccacacccucaugaucgccugcgucucccccgccgacuccaaccucgaggagacccucuccacccuccgcuacgccgaccgcgcccgcaagaucaagaacaagcccaucgucaacaucgacccccacaccgccgagcucaaccaccucaagcagcagguccagcagcuccagguccuccuccuccaggcccacggcggcacccuccccggcuccaucaacgccgagcccuccgagaaccuccagucccucauggagaagaaccagucccucgucgaggagaacgagaagcucucccgcugccucuccaaggccgccggccagaccgcccagaugcucgagcgcaucauccucaccgagcaggucaacgagaagcucaacgccaagcucgaggagcuccgccagcacgucgccugcaagcucgaccuccagaagcucgucgagacccucgaggaccaggagcucaaggagaacgucgagaucaucugcaaccuccagcagcucaucacccagcucuccgacgagaccgucgccugcaccgccgccgccaucgacaccgccgucgaggaggaggcccaggucgagaccucccccgagaccucccgcuccuccgacgccuucaccacccagcacgcccuccaccaggcccagauguccaaggaggucgucgagcucaacaacgcccucgcccucaaggaggcccucguccgcaagaugacccagaacgacaaccagcuccagcccauccaguuccaguaccaggacaacaucaagaaccucgagcucgaggucaucaaccuccagaaggagaaggaggagcucguccgcgagcuccagaccgccaagaagaacgucaaccaggccaagcucuccgagcaccgccacaagcuccuccaggagcucgagggccagaucgccgaccucaagaagaagcucaacgagcaguccaagcuccucaagcucaaggaguccaccgagcgcaccgucuccaagcucaaccaggagaucuggaugaugaagaaccagcgcguccagcucaugcgccagaugaaggaggacgccgagaaguuccgccaguggaagcagaagaaggacaaggaggucauccagcucaaggagcgcgaccgcaagcgccaguacgagcuccucaagcucgagcgcaacuuccagaagcaguccuccguccuccgccgcaagaccgaggaggccgccgccgccaacaagcgccucaaggacgcccuccagaagcagcgcgaggucaccgacaagcgcaaggagacccagucccacggcaaggagggcaucgccgcccgcguccgcaacuggcucggcaacgagaucgaggucauggucuccaccgaggaggccaagcgccaccucaacgaccuccucgaggaccgcaagauccucgcccaggacgucguccagcucaaggagaagaaggagucccgcgagaaccccccccccaagcuccgcaagugcaccuucucccucuccgagguccacggccagguccucgaguccgaggacugcaucaccaagcagaucgagucccucgagaccgagauggagcuccgcuccgcccagaucgccgaccuccagcagaagcuccucgacgccgaguccgaggaccgccccaagcagugcugggagaacaucgccaccauccucgaggccaagugcgcccucaaguaccucaucggcgagcucgucuccuccaagauccacgucaccaagcucgagaacucccuccgccaguccaaggccuccugcgccgacaugcagaagaugcucuucgaggagcagaaccacuucuccgagaucgagaccgagcuccaggccgagcucguccgcauggagcagcagcaccaggagaagguccucuaccucgucucccagcuccaggagucccagauggccgagaagcagcucgagaaguccgccuccgagaaggagcagcagcucgucuccacccuccagugccaggacgaggagcucgagaagaugcgcgaggucugcgagcagaaccagcagcuccuccaggagaacgagaucaucaagcagaagcucauccuccuccaggucgccucccgccagaagcaccuccccaacgacacccuccucucccccgacuccuccuucgaguacaucccccccaagcccaagcccucccgcgucaaggagaaguuccucgagcaguccauggacaucgaggaccucaaguacugcuccgagcacuccgucaacgagcacgaggacggcgacggcgacggcgacuccgacgagggcgacgacgaggaguggaagcccaccaagcucgucaaggucucccgcaagaacauccagggcugcuccugcaagggcuggugcggcaacaagcagugcggcugccgcaagcagaaguccgacugcggcgucgacugcuccugcgaccccaccaagugccgcaaccgccagcagggcaaggacucccucggcaccgucgagcagacccaggacuccgagggcuccuucaagcucgaggaccccaccgaggucacccccggccucuccuucuucaaccccgucugcgccacccccaacuccaagauccucaaggagaugugcgacauggagcagguccucuccaagaagaccgcccccgcccccucccccuucgaccuccccgaguccaagcacggcgccaccgaguaccagcagaacaagccccccggcaagaagaagaagcgcgcccucgccuccaacaccuccuucuucuccggcugcucccccaucgaggaggaggcccacuga

SEQ ID NO: 45066 - RNA, 3099 nt, Artificial Sequence
  derived and/or modified sequence opt2 from KIF5A__Homo_sapiens__NP_004975
auggccgagaccaacaacgagugcuccaucaagguccucugccgcuuccgcccccucaaccaggccgagauccuccgcggcgacaaguucauccccaucuuccagggcgacgacuccgucgucaucggcggcaagcccuacgucuucgaccgcgucuucccccccaacaccacccaggagcaggucuaccacgccugcgccaugcagaucgucaaggacguccucgccggcuacaacggcaccaucuucgccuacggccagaccuccuccggcaagacccacaccauggagggcaagcuccacgacccccagcucaugggcaucaucccccgcaucgcccgcgacaucuucaaccacaucuacuccauggacgagaaccucgaguuccacaucaaggucuccuacuucgagaucuaccucgacaagauccgcgaccuccucgacgucaccaagaccaaccucuccguccacgaggacaagaaccgcguccccuucgucaagggcugcaccgagcgcuucgucuccucccccgaggagauccucgacgucaucgacgagggcaaguccaaccgccacgucgccgucaccaacaugaacgagcacuccucccgcucccacuccaucuuccucaucaacaucaagcaggagaacauggagaccgagcagaagcucuccggcaagcucuaccucgucgaccucgccggcuccgagaaggucuccaagaccggcgccgagggcgccguccucgacgaggccaagaacaucaacaagucccucuccgcccucggcaacgucaucuccgcccucgccgagggcaccaaguccuacguccccuaccgcgacuccaagaugacccgcauccuccaggacucccucggcggcaacugccgcaccaccauguucaucugcugcucccccuccuccuacaacgacgccgagaccaaguccacccucauguucggccagcgcgccaagaccaucaagaacaccgccuccgucaaccucgagcucaccgccgagcaguggaagaagaaguacgagaaggagaaggagaagaccaaggcccagaaggagaccaucgccaagcucgaggccgagcucucccgcuggcgcaacggcgagaacguccccgagaccgagcgccucgccggcgaggaggccgcccucggcgccgagcucugcgaggagacccccgucaacgacaacuccuccaucgucguccgcaucgcccccgaggagcgccagaaguacgaggaggagauccgccgccucuacaagcagcucgacgacaaggacgacgagaucaaccagcagucccagcucaucgagaagcucaagcagcagaugcucgaccaggaggagcuccucgucuccacccgcggcgacaacgagaagguccagcgcgagcucucccaccuccaguccgagaacgacgccgccaaggacgaggucaaggagguccuccaggcccucgaggagcucgccgucaacuacgaccagaagucccaggaggucgaggagaagucccagcagaaccagcuccucgucgacgagcucucccagaaggucgccaccaugcucucccucgaguccgagcuccagcgccuccaggaggucuccggccaccagcgcaagcgcaucgccgagguccucaacggccucaugaaggaccucuccgaguucuccgucaucgucggcaacggcgagaucaagcuccccgucgagaucuccggcgccaucgaggaggaguucaccgucgcccgccucuacaucuccaagaucaaguccgaggucaaguccgucgucaagcgcugccgccagcucgagaaccuccaggucgagugccaccgcaagauggaggucaccggccgcgagcucuccuccugccagcuccucaucucccagcacgaggccaagauccgcucccucaccgaguacaugcaguccgucgagcucaagaagcgccaccucgaggaguccuacgacucccucuccgacgagcucgccaagcuccaggcccaggagaccguccacgaggucgcccucaaggacaaggagcccgacacccaggacgccgacgaggucaagaaggcccucgagcuccagauggagucccaccgcgaggcccaccaccgccagcucgcccgccuccgcgacgagaucaacgagaagcagaagaccaucgacgagcucaaggaccucaaccagaagcuccagcucgagcucgagaagcuccaggccgacuacgagaagcucaaguccgaggagcacgagaaguccaccaagcuccaggagcucaccuuccucuacgagcgccacgagcaguccaagcaggaccucaagggccucgaggagaccgucgcccgcgagcuccagacccuccacaaccuccgcaagcucuucguccaggacgucaccacccgcgucaagaaguccgccgagauggagcccgaggacuccggcggcauccacucccagaagcagaagaucuccuuccucgagaacaaccucgagcagcucaccaagguccacaagcagcucguccgcgacaacgccgaccuccgcugcgagcuccccaagcucgagaagcgccuccgcgccaccgccgagcgcgucaaggcccucgagggcgcccucaaggaggccaaggagggcgccaugaaggacaagcgccgcuaccagcaggaggucgaccgcaucaaggaggccguccgcuacaaguccuccggcaagcgcggccacuccgcccagaucgccaagcccguccgccccggccacuaccccgccuccucccccaccaaccccuacggcacccgcucccccgagugcaucuccuacaccaacucccucuuccagaacuaccagaaccucuaccuccaggccacccccuccuccaccuccgacauguacuucgccaacuccugcaccuccuccggcgccaccuccuccggcggcccccucgccuccuaccagaaggccaacauggacaacggcaacgccaccgacaucaacgacaaccgcuccgaccuccccugcggcuacgaggccgaggaccaggccaagcucuucccccuccaccaggagaccgccgccuccuga

SEQ ID NO: 45067 - RNA, 2892 nt, Artificial Sequence
  derived and/or modified sequence opt2 from KIF5B__Homo_sapiens__NP_004512
auggccgaccucgccgagugcaacaucaaggucaugugccgcuuccgcccccucaacgaguccgaggucaaccgcggcgacaaguacaucgccaaguuccagggcgaggacaccgucgucaucgccuccaagcccuacgccuucgaccgcgucuuccaguccuccaccucccaggagcaggucuacaacgacugcgccaagaagaucgucaaggacguccucgagggcuacaacggcaccaucuucgccuacggccagaccuccuccggcaagacccacaccauggagggcaagcuccacgaccccgagggcaugggcaucaucccccgcaucguccaggacaucuucaacuacaucuacuccauggacgagaaccucgaguuccacaucaaggucuccuacuucgagaucuaccucgacaagauccgcgaccuccucgacgucuccaagaccaaccucuccguccacgaggacaagaaccgcguccccuacgucaagggcugcaccgagcgcuucgucugcucccccgacgaggucauggacaccaucgacgagggcaaguccaaccgccacgucgccgucaccaacaugaacgagcacuccucccgcucccacuccaucuuccucaucaacgucaagcaggagaacacccagaccgagcagaagcucuccggcaagcucuaccucgucgaccucgccggcuccgagaaggucuccaagaccggcgccgagggcgccguccucgacgaggccaagaacaucaacaagucccucuccgcccucggcaacgucaucuccgcccucgccgagggcuccaccuacguccccuaccgcgacuccaagaugacccgcauccuccaggacucccucggcggcaacugccgcaccaccaucgucaucugcugcucccccuccuccuacaacgaguccgagaccaaguccacccuccucuucggccagcgcgccaagaccaucaagaacaccgucugcgucaacgucgagcucaccgccgagcaguggaagaagaaguacgagaaggagaaggagaagaacaagauccuccgcaacaccauccaguggcucgagaacgagcucaaccgcuggcgcaacggcgagaccguccccaucgacgagcaguucgacaaggagaaggccaaccucgaggccuucaccgucgacaaggacaucacccucaccaacgacaagcccgccaccgccaucggcgucaucggcaacuucaccgacgccgagcgccgcaagugcgaggaggagaucgccaagcucuacaagcagcucgacgacaaggacgaggagaucaaccagcagucccagcucgucgagaagcucaagacccagaugcucgaccaggaggagcuccucgccuccacccgccgcgaccaggacaacaugcaggccgagcucaaccgccuccaggccgagaacgacgccuccaaggaggaggucaaggagguccuccaggcccucgaggagcucgccgucaacuacgaccagaagucccaggaggucgaggacaagaccaaggaguacgagcuccucuccgacgagcucaaccagaaguccgccacccucgccuccaucgacgccgagcuccagaagcucaaggagaugaccaaccaccagaagaagcgcgccgccgagaugauggccucccuccucaaggaccucgccgagaucggcaucgccgucggcaacaacgacgucaagcagcccgagggcaccggcaugaucgacgaggaguucaccgucgcccgccucuacaucuccaagaugaaguccgaggucaagaccauggucaagcgcugcaagcagcucgaguccacccagaccgaguccaacaagaagauggaggagaacgagaaggagcucgccgccugccagcuccgcaucucccagcacgaggccaagaucaagucccucaccgaguaccuccagaacgucgagcagaagaagcgccagcucgaggaguccgucgacgcccucuccgaggagcucguccagcuccgcgcccaggagaagguccacgagauggagaaggagcaccucaacaagguccagaccgccaacgaggucaagcaggccgucgagcagcagauccagucccaccgcgagacccaccagaagcagaucuccucccuccgcgacgaggucgaggccaaggccaagcucaucaccgaccuccaggaccagaaccagaagaugaugcucgagcaggagcgccuccgcgucgagcacgagaagcucaaggccaccgaccaggagaagucccgcaagcuccacgagcucaccgucaugcaggaccgccgcgagcaggcccgccaggaccucaagggccucgaggagaccgucgccaaggagcuccagacccuccacaaccuccgcaagcucuucguccaggaccucgccacccgcgucaagaaguccgccgagaucgacuccgacgacaccggcggcuccgccgcccagaagcagaagaucuccuuccucgagaacaaccucgagcagcucaccaagguccacaagcagcucguccgcgacaacgccgaccuccgcugcgagcuccccaagcucgagaagcgccuccgcgccaccgccgagcgcgucaaggcccucgaguccgcccucaaggaggccaaggagaacgccucccgcgaccgcaagcgcuaccagcaggaggucgaccgcaucaaggaggccguccgcuccaagaacauggcccgccgcggccacuccgcccagaucgccaagcccauccgccccggccagcaccccgccgccucccccacccaccccuccgccauccgcggcggcggcgccuucguccagaacucccagcccgucgccguccgcggcggcggcggcaagcaggucuga

SEQ ID NO: 45068 - RNA, 2874 nt, Artificial Sequence
  derived and/or modified sequence opt2 from KIF5C__Homo_sapiens__NP_004513
auggccgaccccgccgagugcuccaucaaggucaugugccgcuuccgcccccucaacgaggccgagauccuccgcggcgacaaguucauccccaaguucaagggcgacgagaccgucgucaucggccagggcaagcccuacgucuucgaccgcguccucccccccaacaccacccaggagcaggucuacaacgccugcgccaagcagaucgucaaggacguccucgagggcuacaacggcaccaucuucgccuacggccagaccuccuccggcaagacccacaccauggagggcaagcuccacgacccccagcucaugggcaucaucccccgcaucgcccacgacaucuucgaccacaucuacuccauggacgagaaccucgaguuccacaucaaggucuccuacuucgagaucuaccucgacaagauccgcgaccuccucgacgucuccaagaccaaccucgccguccacgaggacaagaaccgcguccccuacgucaagggcugcaccgagcgcuucgucuccucccccgaggaggucauggacgucaucgacgagggcaaggccaaccgccacgucgccgucaccaacaugaacgagcacuccucccgcucccacuccaucuuccucaucaacaucaagcaggagaacgucgagaccgagaagaagcucuccggcaagcucuaccucgucgaccucgccggcuccgagaaggucuccaagaccggcgccgagggcgccguccucgacgaggccaagaacaucaacaagucccucuccgcccucggcaacgucaucuccgcccucgccgagggcaccaagacccacguccccuaccgcgacuccaagaugacccgcauccuccaggacucccucggcggcaacugccgcaccaccaucgucaucugcugcucccccuccgucuucaacgaggccgagaccaaguccacccucauguucggccagcgcgccaagaccaucaagaacaccgucuccgucaaccucgagcucaccgccgaggaguggaagaagaaguacgagaaggagaaggagaagaacaagacccucaagaacgucauccagcaccucgagauggagcucaaccgcuggcgcaacggcgaggccguccccgaggacgagcagaucuccgccaaggaccagaagaaccucgagcccugcgacaacacccccaucaucgacaacaucgcccccgucgucgccggcaucuccaccgaggagaaggagaaguacgacgaggagaucuccucccucuaccgccagcucgacgacaaggacgacgagaucaaccagcagucccagcucgccgagaagcucaagcagcagaugcucgaccaggacgagcuccucgccuccacccgccgcgacuacgagaagauccaggaggagcucacccgccuccagaucgagaacgaggccgccaaggacgaggucaaggagguccuccaggcccucgaggagcucgccgucaacuacgaccagaagucccaggaggucgaggacaagacccgcgccaacgagcagcucaccgacgagcucgcccagaagaccaccacccucaccaccacccagcgcgagcucucccagcuccaggagcucuccaaccaccagaagaagcgcgccaccgagauccucaaccuccuccucaaggaccucggcgagaucggcggcaucaucggcaccaacgacgucaagacccucgccgacgucaacggcgucaucgaggaggaguucaccauggcccgccucuacaucuccaagaugaaguccgaggucaagucccucgucaaccgcuccaagcagcucgaguccgcccagauggacuccaaccgcaagaugaacgccuccgagcgcgagcucgccgccugccagcuccucaucucccagcacgaggccaagaucaagucccucaccgacuacaugcagaacauggagcagaagcgccgccagcucgaggagucccaggacucccucuccgaggagcucgccaagcuccgcgcccaggagaagaugcacgaggucuccuuccaggacaaggagaaggagcaccucacccgccuccaggacgccgaggagaugaagaaggcccucgagcagcagauggagucccaccgcgaggcccaccagaagcagcucucccgccuccgcgacgagaucgaggagaagcagaagaucaucgacgagauccgcgaccucaaccagaagcuccagcucgagcaggagaagcucuccuccgacuacaacaagcucaagaucgaggaccaggagcgcgagaugaagcucgagaagcuccuccuccucaacgacaagcgcgagcaggcccgcgaggaccucaagggccucgaggagaccgucucccgcgagcuccagacccuccacaaccuccgcaagcucuucguccaggaccucaccacccgcgucaagaaguccgucgagcucgacaacgacgacggcggcggcuccgccgcccagaagcagaagaucuccuuccucgagaacaaccucgagcagcucaccaagguccacaagcagcucguccgcgacaacgccgaccuccgcugcgagcuccccaagcucgagaagcgccuccgcgccaccgccgagcgcgucaaggcccucgaguccgcccucaaggaggccaaggagaacgccaugcgcgaccgcaagcgcuaccagcaggaggucgaccgcaucaaggaggccguccgcgccaagaacauggcccgccgcgcccacuccgcccagaucgccaagcccauccgccccggccacuaccccgccuccucccccaccgccguccacgccauccgcggcggcggcggcuccuccuccaacuccacccacuaccagaaguga

SEQ ID NO: 45069 - RNA, 2394 nt, Artificial Sequence
  derived and/or modified sequence opt2 from KIF6__Homo_sapiens__NP_001275949
auggucaagcagaccauccagaucuucgcccgcgucaagccccccguccgcaagcaccagcagggcaucuacuccaucgacgaggacgagaagcucauccccucccucgagaucauccucccccgcgaccucgccgacggcuucgucaacaacaagcgcgaguccuacaaguucaaguuccagcgcaucuucgaccaggacgccaaccaggagaccgucuucgagaacaucgccaagcccgucgccggcuccguccucgccggcuacaacggcaccaucuucgccuacggccagaccggcuccggcaagaccuucaccaucaccggcggcgccgagcgcuacuccgaccgcggcaucaucccccgcacccucuccuacaucuucgagcagcuccagaaggacuccuccaagaucuacaccacccacaucuccuaccucgagaucuacaacgagugcggcuacgaccuccucgacccccgccacgaggccuccucccucgaggaccuccccaaggucaccauccucgaggaccccgaccagaacauccaccucaagaaccucacccuccaccaggccaccaccgaggaggaggcccucaaccuccucuuccucggcgacaccaaccgcaugaucgccgagacccccaugaaccaggccuccacccgcucccacugcaucuucaccauccaccucuccuccaaggagcccggcuccgccaccguccgccacgccaagcuccaccucgucgaccucgccggcuccgagcgcgucgccaagaccggcgucggcggccaccuccucaccgaggccaaguacaucaaccucucccuccacuaccucgagcaggucaucaucgcccucuccgagaagcaccgcucccacauccccuaccgcaacuccaugaugaccuccguccuccgcgacucccucggcggcaacugcaugaccaccaugaucgccacccucucccucgagaagcgcaaccucgacgaguccaucuccaccugccgcuucgcccagcgcgucgcccucaucaagaacgaggccguccucaacgaggagaucaacccccgccucgucaucaagcgccuccagaaggagauccaggagcucaaggacgagcucgccauggucaccggcgagcagcgcaccgaggcccucaccgaggccgagcuccuccagcucgagaagcucaucaccuccuuccucgaggaccaggacuccgacucccgccucgaggucggcgccgacaugcgcaagguccaccacugcuuccaccaccucaagaagcuccucaacgacaagaagauccucgagaacaacaccgucuccuccgaguccaaggaccaggacugccaggagccccucaaggaggaggaguaccgcaagcuccgcgacauccucaagcagcgcgacaacgagaucaacauccucgucaacaugcucaagaaggagaagaagaaggcccaggaggcccuccaccucgccggcauggaccgccgcgaguuccgccagucccaguccccccccuuccgccucggcaaccccgaggagggccagcgcaugcgccucuccuccgcccccucccaggcccaggacuucuccauccucggcaagcgcuccucccuccuccacaagaagaucggcaugcgcgaggagaugucccucggcugccaggaggccuucgagaucuucaagcgcgaccacgccgacuccgucaccaucgacgacaacaagcagauccucaagcagcgcuucuccgaggccaaggcccucggcgaguccaucaacgaggcccgcuccaagaucggcaucuccgagaacauggccgucccccucaugcccgaccagcaggaggagaagcuccgcucccagcucgaggaggagaagcgccgcuacaagaccauguucacccgccucaaggcccucaaggucgagaucgagcaccuccagcuccucauggacaaggccaaggucaagcuccagaaggaguucgaggucuggugggccgaggaggccaccaaccuccaggucaacucccccgccgucaacucccucgaccacaccaagcccuuccuccagaccuccgacucccagcacgaguggucccagcuccucuccaacaaguccuccggcggcugggagguccaggaccagggcaccggccgcuucgacgucugcgacgucaacgcccgcaagauccuccccucccccugccccuccccccacucccagaagcaguccuccaccuccaccccccucgaggacuccauccccaagcgccccgucuccuccaucccccucaccggcgacucccagaccgacuccgacaucaucgccuucaucaaggcccgccaguccauccuccagaagcagugccucggcuccaacuga

SEQ ID NO: 45070 - RNA, 4032 nt, Artificial Sequence
  derived and/or modified sequence opt2 from KIF7__Homo_sapiens__XP_005254959
augggccucgaggcccagcgccuccccggcgccgaggaggcccccguccgcgucgcccuccgcguccgcccccuccuccccaaggagcuccuccacggccaccaguccugccuccaggucgagcccggccucggccgcgucacccucggccgcgaccgccacuucggcuuccacgucguccucgccgaggacgccggccaggaggccgucuaccaggccugcguccagccccuccucgaggccuucuucgagggcuucaacgccaccgucuucgccuacggccagaccggcuccggcaagaccuacaccaugggcgaggccuccgucgccucccuccucgaggacgagcagggcaucgucccccgcgccauggccgaggccuucaagcucaucgacgagaacgaccuccucgacugccucguccacgucuccuaccucgaggucuacaaggaggaguuccgcgaccuccucgaggucggcaccgccucccgcgacauccagcuccgcgaggacgagcgcggcaacgucguccucugcggcgucaaggaggucgacgucgagggccucgacgagguccucucccuccucgagaugggcaacgccgcccgccacaccggcgccacccaccucaaccaccucuccucccgcucccacaccgucuucaccgucacccucgagcagcgcggccgcgcccccucccgccucccccgccccgcccccggccagcuccucgucuccaaguuccacuucgucgaccucgccggcuccgagcgcguccucaagaccggcuccaccggcgagcgccucaaggaguccauccagaucaacuccucccuccucgcccucggcaacgucaucuccgcccucggcgacccccagcgccgcggcucccacauccccuaccgcgacuccaagaucacccgcauccucaaggacucccucggcggcaacgccaagaccgucaugaucgccugcgucucccccuccuccuccgacuucgacgagacccucaacacccucaacuacgccucccgcgcccagaacauccgcaaccgcgccaccgucaacuggcgccccgaggccgagcgcccccccgaggagaccgccuccggcgcccgcggccccccccgccaccgcuccgagacccgcaucauccaccgcggccgccgcgcccccggccccgccaccgccuccgccgccgccgccaugcgccucggcgccgagugcgcccgcuaccgcgccugcaccgacgccgccuacucccuccuccgcgagcuccaggccgagcccggccuccccggcgccgccgcccgcaagguccgcgacuggcucugcgccgucgagggcgagcgcuccgcccucuccuccgccuccggccccgacuccggcaucgaguccgccuccgucgaggaccaggccgcccagggcgccggcggccgcaaggaggacgagggcgcccagcagcuccucacccuccagaaccaggucgcccgccucgaggaggagaaccgcgacuuccucgccgcccucgaggacgccauggagcaguacaagcuccaguccgaccgccuccgcgagcagcaggaggagauggucgagcuccgccuccgccucgagcucguccgccccggcuggggcggcccccgccuccucaacggccucccccccggcuccuucgucccccgcccccacaccgccccccucggcggcgcccacgcccacguccucggcauggucccccccgccugccuccccggcgacgaggucggcuccgagcagcgcggcgagcaggucaccaacggccgcgaggccggcgccgagcuccucaccgaggucaaccgccucggcuccggcuccuccgccgccuccgaggaggaggaggaggaggaggagcccccccgccgcacccuccaccuccgccgcaaccgcaucuccaacugcucccagcgcgccggcgcccgccccggcucccuccccgagcgcaagggccccgagcucugccucgaggagcucgacgccgccauccccggcucccgcgccgucggcggcuccaaggcccgcguccaggcccgccaggucccccccgccaccgccuccgaguggcgccucgcccaggcccagcagaagauccgcgagcucgccaucaacauccgcaugaaggaggagcucaucggcgagcucguccgcaccggcaaggccgcccaggcccucaaccgccagcacucccagcgcauccgcgagcucgagcaggaggccgagcagguccgcgccgagcucuccgagggccagcgccagcuccgcgagcucgagggcaaggagcuccaggacgccggcgagcgcucccgccuccaggaguuccgccgccgcgucgccgccgcccagucccagguccagguccucaaggagaagaagcaggccaccgagcgccucgucucccucuccgcccaguccgagaagcgccuccaggagcucgagcgcaacguccagcucaugcgccagcagcagggccagcuccagcgccgccuccgcgaggagaccgagcagaagcgccgccucgaggccgagauguccaagcgccagcaccgcgucaaggagcucgagcucaagcacgagcagcagcagaagauccucaagaucaagaccgaggagaucgccgccuuccagcgcaagcgccgcuccggcuccaacggcuccgucgucucccucgagcagcagcagaagaucgaggagcagaagaaguggcucgaccaggagauggagaagguccuccagcagcgccgcgcccucgaggagcucggcgaggagcuccacaagcgcgaggccauccucgccaagaaggaggcccucaugcaggagaagaccggccucgaguccaagcgccuccgcuccucccaggcccucaacgaggacaucguccgcgucuccucccgccucgagcaccucgagaaggagcucuccgagaaguccggccagcuccgccagggcuccgcccagucccagcagcagauccgcggcgagaucgacucccuccgccaggagaaggacucccuccucaagcagcgccucgagaucgacggcaagcuccgccagggcucccuccucucccccgaggaggagcgcacccucuuccagcucgacgaggccaucgaggcccucgacgccgccaucgaguacaagaacgaggccaucaccugccgccagcgcguccuccgcgccuccgccucccuccucucccagugcgagaugaaccucauggccaagcucuccuaccucuccuccuccgagacccgcgcccuccucugcaaguacuucgacaaggucgucacccuccgcgaggagcagcaccagcagcagaucgccuucuccgagcucgagaugcagcucgaggagcagcagcgccucgucuacuggcucgaggucgcccucgagcgccagcgccucgagauggaccgccagcucacccuccagcagaaggagcacgagcagaacaugcagcuccuccuccagcagucccgcgaccaccucggcgagggccucgccgacucccgccgccaguacgaggcccgcauccaggcccucgagaaggagcucggccgcuacauguggaucaaccaggagcucaagcagaagcucggcggcgucaacgccgucggccacucccgcggcggcgagaagcgcucccucugcuccgagggccgccaggcccccggcaacgaggacgagcuccaccucgcccccgagcuccucuggcucuccccccucaccgagggcgccccccgcacccgcgaggagacccgcgaccucguccacgccccccucccccucaccuggaagcgcuccucccucugcggcgaggagcagggcucccccgaggagcuccgccagcgcgaggccgccgagccccucgucggccgcguccuccccgucggcgaggccggccuccccuggaacuucggcccccucuccaagccccgccgcgagcuccgccgcgccucccccggcaugaucgacguccgcaagaacccccucuga

SEQ ID NO: 45071 - RNA, 2373 nt, Artificial Sequence
  derived and/or modified sequence opt2 from KIF9__Homo_sapiens__NP_001128350
augggcacccgcaagaagguccacgccuucguccgcgucaagcccaccgacgacuucgcccacgagaugauccgcuacggcgacgacaagcgcuccaucgacauccaccucaagaaggacauccgccgcggcgucgucaacaaccagcagaccgacugguccuucaagcucgacggcguccuccacgacgccucccaggaccucgucuacgagaccgucgccaaggacgucgucucccaggcccucgacggcuacaacggcaccaucaugugcuacggccagaccggcgccggcaagaccuacaccaugaugggcgccaccgagaacuacaagcaccgcggcauccucccccgcgcccuccagcaggucuuccgcaugaucgaggagcgccccacccacgccaucaccguccgcgucuccuaccucgagaucuacaacgagucccucuucgaccuccucuccacccuccccuacgucggccccuccgucacccccaugaccaucgucgagaacccccagggcgucuucaucaagggccucuccguccaccucaccucccaggaggaggacgccuucucccuccucuucgagggcgagaccaaccgcaucaucgccucccacaccaugaacaagaacuccucccgcucccacugcaucuucaccaucuaccucgaggcccacucccgcacccucuccgaggagaaguacaucaccuccaagaucaaccucgucgaccucgccggcuccgagcgccucggcaaguccggcuccgagggccagguccucaaggaggccaccuacaucaacaagucccucuccuuccucgagcaggccaucaucgcccucggcgaccagaagcgcgaccacauccccuuccgccagugcaagcucacccacgcccucaaggacucccucggcggcaacugcaacaugguccucgucaccaacaucuacggcgaggccgcccagcucgaggagacccucuccucccuccgcuucgccucccgcaugaagcucgucaccaccgagcccgccaucaacgagaaguacgacgccgagcgcauggucaagaaccucgagaaggagcucgcccuccucaagcaggagcucgccauccacgacucccucaccaaccgcaccuucgucaccuacgaccccauggacgagauccagaucgccgagaucaacucccagguccgccgcuaccucgagggcacccucgacgagaucgacaucaucucccuccgccagaucaaggaggucuucaaccaguuccgcgucguccucucccagcaggagcaggaggucgaguccacccuccgccgcaaguacacccucaucgaccgcaacgacuucgccgccaucuccgccauccagaaggccggccucgucgacgucgacggccaccucgucggcgagcccgagggccagaacuucggccucggcgucgcccccuucuccaccaagcccggcaagaaggccaaguccaagaagaccuucaaggagccccucuccucccucgcccgcaaggagggcgccuccucccccgucaacggcaaggaccucgacuacgucuccaccuccaagacccagcucguccccuccuccaaggacggcgacgucaaggacaugcucucccgcgaccgcgagaccuccuccaucgagccccuccccuccgacucccccaaggaggagcuccgccccauccgccccgacaccccccccuccaagcccgucgccuucgaggaguucaagaacgagcagggcuccgagaucaaccgcaucuucaaggagaacaaguccauccucaacgagcgccgcaagcgcgccuccgagaccacccagcacaucaacgccaucaagcgcgagaucgacgucaccaaggaggcccucaacuuccagaagucccuccgcgagaagcagggcaaguacgagaacaagggccucaugaucaucgacgaggaggaguuccuccucauccucaagcucaaggaccucaagaagcaguaccgcuccgaguaccaggaccuccgcgaccuccgcgccgagauccaguacugccagcaccucgucgaccagugccgccaccgccuccucauggaguucgacaucugguacaacgaguccuucgucauccccgaggacaugcagauggcccucaagcccggcggcuccauccgccccggcaugguccccgucaaccgcaucgucucccucggcgaggacgaccaggacaaguucucccagcuccagcagcgcguccuccccgagggccccgacuccaucuccuucuacaacgccaaggucaagaucgagcagaagcacaacuaccucaagaccaugaugggccuccagcaggcccaccgcaaguga

SEQ ID NO: 45072 - RNA, 2145 nt, Artificial Sequence
  derived and/or modified sequence opt2 from KIFAP3__Homo_sapiens__NP_001191443
auguccaucgcccucggcaacaccuaccgccgcucccucuccgacuccgagaccgucuccguccuccaggccucccucugcgaggagaagaaggagaaguccuccaagcccaaggaccccccccccuucgagggcauggagaucgacgaggucgccaacaucaacgacauggacgaguacaucgagcuccucuacgaggacauccccgacaagguccgcggcuccgcccucauccuccagcucgcccgcaaccccgacaaccucgaggagcuccuccucaacgagaccgcccucggcgcccucgcccgcguccuccgcgaggacuggaagcaguccgucgagcucgccaccaacaucaucuacaucuucuucugcuucuccuccuucucccaguuccacggccucaucacccacuacaagaucggcgcccucugcaugaacaucaucgaccacgagcucaagcgccacgagcucuggcaggaggagcucuccaagaagaagaaggccgucgacgaggaccccgagaaccagacccuccgcaaggacuacgagaagaccuucaagaaguaccagggccucgucgucaagcaggagcagcuccuccgcgucgcccucuaccuccuccucaaccucgccgaggacacccgcaccgagcucaagaugcgcaacaagaacaucguccacaugcucgucaaggcccucgaccgcgacaacuucgagcuccucauccucgucgucuccuuccucaagaagcucuccaucuucauggagaacaagaacgacauggucgagauggacaucgucgagaagcucgucaagaugauccccugcgagcacgaggaccuccucaacaucacccuccgccuccuccucaaccucuccuucgacaccggccuccgcaacaagaugguccaggucggccuccuccccaagcucaccgcccuccucggcaacgacaacuacaagcagaucgccaugugcguccucuaccacaucuccauggacgaccgcuucaaguccauguucgccuacaccgacugcaucccccagcucaugaagaugcucuucgagugcuccgacgagcgcaucgaccucgagcucaucuccuucugcaucaaccucgccgccaacaagcgcaacguccagcucaucugcgagggcaacggccucaagaugcucaugaagcgcgcccucaaguucaaggacccccuccucaugaagaugauccgcaacaucucccagcacgacggccccaccaagaaccucuucaucgacuacgucggcgaccucgccgcccagaucuccaacgacgaggaggaggaguucgucaucgagugccucggcacccucgccaaccucaccauccccgaccucgacugggagcucguccucaaggaguacaagcucguccccuaccucaaggacaagcucaagcccggcgccgccgaggacgaccucguccucgaggucgucaucaugaucggcaccgucuccauggacgacuccugcgccgcccuccucgccaaguccggcaucauccccgcccucaucgagcuccucaacgcccagcaggaggacgacgaguucgucugccagaucaucuacgucuucuaccagauggucuuccaccaggccacccgcgacgucaucaucaaggagacccaggcccccgccuaccucaucgaccucaugcacgacaagaacaacgagauccgcaaggucugcgacaacacccucgacaucaucgccgaguacgacgaggagugggccaagaagauccaguccgagaaguuccgcuggcacaacucccaguggcucgagauggucgagucccgccagauggacgaguccgagcaguaccucuacggcgacgaccgcaucgagcccuacauccacgagggcgacauccucgagcgccccgaccucuucuacaacuccgacggccucaucgccuccgagggcgccaucucccccgacuucuucaacgacuaccaccuccagaacggcgacgucgucggccagcacuccuuccccggcucccucggcauggacggcuucggccagcccgucggcauccucggccgccccgccaccgccuacggcuuccgccccgacgagcccuacuacuacggcuacggcuccuga

SEQ ID NO: 45073 - RNA, 2022 nt, Artificial Sequence
  derived and/or modified sequence opt2 from KIFC1__Homo_sapiens__NP_002254
auggacccccagcgcuccccccuccucgaggucaagggcaacaucgagcucaagcgcccccucaucaaggcccccucccagcucccccucuccggcucccgccucaagcgccgccccgaccagauggaggacggccucgagcccgagaagaagcgcacccgcggccucggcgccaccaccaagaucaccaccucccacccccgcguccccucccucaccaccgucccccagacccagggccagaccaccgcccagaaggucuccaagaagaccggcccccgcugcuccaccgccaucgccaccggccucaagaaccagaagcccguccccgccguccccguccagaaguccggcaccuccggcgucccccccauggccggcggcaagaagcccuccaagcgccccgccugggaccucaagggccagcucugcgaccucaacgccgagcucaagcgcugccgcgagcgcacccagacccucgaccaggagaaccagcagcuccaggaccagcuccgcgacgcccagcagcaggucaaggcccucggcaccgagcgcaccacccucgagggccaccucgccaagguccaggcccaggccgagcagggccagcaggagcucaagaaccuccgcgccugcguccucgagcucgaggagcgccucuccacccaggagggccucguccaggagcuccagaagaagcaggucgagcuccaggaggagcgccgcggccucaugucccagcucgaggagaaggagcgccgccuccagaccuccgaggccgcccucuccuccucccaggccgaggucgccucccuccgccaggagaccgucgcccaggccgcccuccucaccgagcgcgaggagcgccuccacggccucgagauggagcgccgccgccuccacaaccagcuccaggagcucaagggcaacauccgcgucuucugccgcguccgccccguccuccccggcgagcccacccccccccccggccuccuccucuuccccuccggccccggcggccccuccgacccccccacccgccucucccucucccgcuccgacgagcgccgcggcacccucuccggcgcccccgccccccccacccgccacgacuucuccuucgaccgcgucuucccccccggcuccggccaggacgaggucuucgaggagaucgccaugcucguccaguccgcccucgacggcuaccccgucugcaucuucgccuacggccagaccggcuccggcaagaccuucaccauggagggcggccccggcggcgacccccagcucgagggccucaucccccgcgcccuccgccaccucuucuccgucgcccaggagcucuccggccagggcuggaccuacuccuucgucgccuccuacgucgagaucuacaacgagaccguccgcgaccuccucgccaccggcacccgcaagggccagggcggcgagugcgagauccgccgcgccggccccggcuccgaggagcucaccgucaccaacgcccgcuacguccccgucuccugcgagaaggaggucgacgcccuccuccaccucgcccgccagaaccgcgccgucgcccgcaccgcccagaacgagcgcuccucccgcucccacuccgucuuccagcuccagaucuccggcgagcacuccucccgcggccuccagugcggcgccccccucucccucgucgaccucgccggcuccgagcgccucgaccccggccucgcccucggccccggcgagcgcgagcgccuccgcgagacccaggccaucaacuccucccucuccacccucggccucgucaucauggcccucuccaacaaggagucccacguccccuaccgcaacuccaagcucaccuaccuccuccagaacucccucggcggcuccgccaagaugcucauguucgucaacaucuccccccucgaggagaacgucuccgagucccucaacucccuccgcuucgccuccaaggucaaccagugcgucaucggcaccgcccaggccaaccgcaaguga

SEQ ID NO: 45074 - RNA, 2481 nt, Artificial Sequence
  derived and/or modified sequence opt2 from KIFC3__Homo_sapiens__NP_001123572
augguccccucccgccgcaccuggaaccucggcgccacccccucccuccgcggccucuggcgcgucggccgcgcccccgagcccgagcccggcauggcccgccccgcccccgcccccgccucccccgccgcccgccccuucccccacaccggccccggccgccuccgcaccggccgcggcaaggacacccccgucugcggcgacgaggacuccuccgcccgcuccgccgcccgccccgcccucgcccagugccgcgcccucuccgucgacugggccggccccggcuccccccacggccucuaccucacccuccaggucgagcaccucaaggagaagcucaucucccaggcccaggaggucucccgccuccgcuccgagcucggcggcaccgaccucgagaagcaccgcgaccuccucauggucgagaacgagcgccuccgccaggagaugcgccgcugcgaggccgagcuccaggagcuccgcaccaagcccgccggccccugccccggcugcgagcacucccaggaguccgcccagcuccgcgacaagcucucccagcuccagcucgagauggccgaguccaagggcaugcucuccgagcucaaccucgagguccagcagaagaccgaccgccucgccgaggucgagcuccgccucaaggacugccucgccgagaaggcccaggaggaggagcgccucucccgccgccuccgcgacucccacgagaccaucgccucccuccgcgcccaguccccccccgucaaguacgucaucaagaccgucgaggucgaguccuccaagaccaagcaggcccucuccgagucccaggcccgcaaccagcaccuccaggagcaggucgccaugcagcgccagguccucaaggagauggagcagcagcuccaguccucccaccagcucaccgcccgccuccgcgcccagaucgccauguacgaguccgagcucgagcgcgcccacggccagaugcucgaggagaugcagucccucgaggaggacaagaaccgcgccaucgaggaggccuucgcccgcgcccaggucgagaugaaggccguccacgagaaccucgccggcguccgcaccaaccuccucacccuccagcccgcccuccgcacccucaccaacgacuacaacggccucaagcgccagguccgcggcuucccccuccuccuccaggaggcccuccgcuccgucaaggccgagaucggccaggccaucgaggaggucaacuccaacaaccaggagcuccuccgcaaguaccgccgcgagcuccagcuccgcaagaagugccacaacgagcucguccgccucaagggcaacauccgcgucaucgcccgcguccgccccgucaccaaggaggacggcgagggccccgaggccaccaacgccgucaccuucgacgccgacgacgacuccaucauccaccuccuccacaagggcaagcccgucuccuucgagcucgacaaggucuucuccccccaggccucccagcaggacgucuuccaggagguccaggcccucgucaccuccugcaucgacggcuucaacgucugcaucuucgccuacggccagaccggcgccggcaagaccuacaccauggagggcaccgccgagaaccccggcaucaaccagcgcgcccuccagcuccucuucuccgagguccaggagaaggccuccgacugggaguacaccaucaccgucuccgccgccgagaucuacaacgagguccuccgcgaccuccucggcaaggagccccaggagaagcucgagauccgccucugccccgacggcuccggccagcucuacguccccggccucaccgaguuccagguccaguccgucgacgacaucaacaaggucuucgaguucggccacaccaaccgcaccaccgaguucaccaaccucaacgagcacuccucccgcucccacgcccuccucaucgucaccguccgcggcgucgacugcuccaccggccuccgcaccaccggcaagcucaaccucgucgaccucgccggcuccgagcgcgucggcaaguccggcgccgagggcucccgccuccgcgaggcccagcacaucaacaagucccucuccgcccucggcgacgucaucgccgcccuccgcucccgccagggccacguccccuuccgcaacuccaagcucaccuaccuccuccaggacucccucuccggcgacuccaagacccucauggucguccaggucucccccgucgagaagaacaccuccgagacccucuacucccucaaguucgccgagcgcguccgcuccgucgagcucggccccggccuccgccgcgccgagcucggcuccugguccucccaggagcaccucgagugggagcccgccugccagaccccccagcccuccgcccgcgcccacuccgcccccuccuccggcaccuccucccgccccggcuccauccgccgcaagcuccagcccuccgccuga

SEQ ID NO: 45075 - RNA, 1182 nt, Artificial Sequence
  derived and/or modified sequence opt2 from KIN__Homo_sapiens__NP_036443
augggcaaguccgacuuccucacccccaaggccaucgccaaccgcaucaaguccaagggccuccagaagcuccgcugguacugccagaugugccagaagcagugccgcgacgagaacggcuucaagugccacugcauguccgagucccaccagcgccagcuccuccucgccuccgagaacccccagcaguucauggacuacuucuccgaggaguuccgcaacgacuuccucgagcuccuccgccgccgcuucggcaccaagcgcguccacaacaacaucgucuacaacgaguacaucucccaccgcgagcacauccacaugaacgccacccagugggagacccucaccgacuucaccaaguggcucggccgcgagggccucugcaaggucgacgagacccccaagggcugguacauccaguacaucgaccgcgaccccgagaccauccgccgccagcucgagcucgagaagaagaagaagcaggaccucgacgacgaggagaagaccgccaaguucaucgaggagcagguccgccgcggccucgagggcaaggagcaggagguccccaccuucaccgagcucucccgcgagaacgacgaggagaaggucaccuucaaccucuccaagggcgccugcuccuccuccggcgccaccuccuccaaguccuccacccucggccccuccgcccucaagaccaucggcuccuccgccuccgucaagcgcaaggaguccucccaguccuccacccaguccaaggagaagaagaagaagaaguccgcccucgacgagaucauggagaucgaggaggagaagaagcgcaccgcccgcaccgacuacuggcuccagcccgagaucaucgucaagaucaucaccaagaagcucggcgagaaguaccacaagaagaaggccaucgucaaggaggucaucgacaaguacaccgccgucgucaagaugaucgacuccggcgacaagcucaagcucgaccagacccaccucgagaccgucauccccgcccccggcaagcgcauccucguccucaacggcggcuaccgcggcaacgagggcacccucgaguccaucaacgagaagaccuucuccgccaccaucgucaucgagaccggcccccucaagggccgccgcgucgagggcauccaguacgaggacaucuccaagcucgccuga

SEQ ID NO: 45076 - RNA, 1047 nt, Artificial Sequence
  derived and/or modified sequence opt2 from KIR2DL1__Homo_sapiens__NP_055033
augucccuccucgucgucuccauggccugcgucggcuucuuccuccuccagggcgccuggccccacgagggcguccaccgcaagcccucccuccucgcccaccccggccgccucgucaaguccgaggagaccgucauccuccagugcugguccgacgucauguucgagcacuuccuccuccaccgcgagggcauguucaacgacacccuccgccucaucggcgagcaccacgacggcgucuccaaggccaacuucuccaucucccgcaugacccaggaccucgccggcaccuaccgcugcuacggcuccgucacccacucccccuaccaggucuccgcccccuccgacccccucgacaucgucaucaucggccucuacgagaagcccucccucuccgcccagcucggccccaccguccucgccggcgagaacgucacccucuccugcuccucccgcuccuccuacgacauguaccaccucucccgcgagggcgaggcccacgagcgccgccuccccgccggccccaaggucaacggcaccuuccaggccgacuucccccucggccccgccacccacggcggcaccuaccgcugcuucggcuccuuccacgacucccccuacgagugguccaaguccuccgacccccuccucgucuccgucaccggcaaccccuccaacuccuggcccucccccaccgagcccuccuccaagaccggcaacccccgccaccuccacauccucaucggcaccuccgucgucaucauccucuucauccuccucuucuuccuccuccaccgcuggugcuccaacaagaagaacgccgccgucauggaccaggaguccgccggcaaccgcaccgccaacuccgaggacuccgacgagcaggacccccaggaggucaccuacacccagcucaaccacugcgucuucacccagcgcaagaucacccgccccucccagcgccccaagaccccccccaccgacaucaucgucuacaccgagcuccccaacgccgagucccgcuccaaggucgucuccugccccuga

SEQ ID NO: 45077 - RNA, 1047 nt, Artificial Sequence
  derived and/or modified sequence opt2 from KIR2DL2__Homo_sapiens__NP_055034
augucccucauggucgucuccauggccugcgucggcuucuuccuccuccagggcgccuggccccacgagggcguccaccgcaagcccucccuccucgcccaccccggccgccucgucaaguccgaggagaccgucauccuccagugcugguccgacguccgcuucgagcacuuccuccuccaccgcgagggcaaguucaaggacacccuccaccucaucggcgagcaccacgacggcgucuccaaggccaacuucuccaucggccccaugaugcaggaccucgccggcaccuaccgcugcuacggcuccgucacccacucccccuaccagcucuccgcccccuccgacccccucgacaucgucaucaccggccucuacgagaagcccucccucuccgcccagcccggccccaccguccucgccggcgaguccgucacccucuccugcuccucccgcuccuccuacgacauguaccaccucucccgcgagggcgaggcccacgagugccgcuucuccgccggccccaaggucaacggcaccuuccaggccgacuucccccucggccccgccacccacggcggcaccuaccgcugcuucggcuccuuccgcgacucccccuacgagugguccaacuccuccgacccccuccucgucuccgucaccggcaaccccuccaacuccuggcccucccccaccgagcccuccuccaagaccggcaacccccgccaccuccacauccucaucggcaccuccgucgucaucauccucuucauccuccucuucuuccuccuccaccgcuggugcuccaacaagaagaacgccgccgucauggaccaggaguccgccggcaaccgcaccgccaacuccgaggacuccgacgagcaggacccccaggaggucaccuacacccagcucaaccacugcgucuucacccagcgcaagaucacccgccccucccagcgccccaagaccccccccaccgacaucaucgucuacaccgagcuccccaacgccgagucccgcuccaaggucgucuccugccccuga

SEQ ID NO: 45078 - RNA, 1026 nt, Artificial Sequence
  derived and/or modified sequence opt2 from KIR2DL3__Homo_sapiens__NP_056952
augucccucauggucgucuccauggucugcgucggcuucuuccuccuccagggcgccuggccccacgagggcguccaccgcaagcccucccuccucgcccaccccggcccccucgucaaguccgaggagaccgucauccuccagugcugguccgacguccgcuuccagcacuuccuccuccaccgcgagggcaaguucaaggacacccuccaccucaucggcgagcaccacgacggcgucuccaaggccaacuucuccaucggccccaugaugcaggaccucgccggcaccuaccgcugcuacggcuccgucacccacucccccuaccagcucuccgcccccuccgacccccucgacaucgucaucaccggccucuacgagaagcccucccucuccgcccagcccggccccaccguccucgccggcgaguccgucacccucuccugcuccucccgcuccuccuacgacauguaccaccucucccgcgagggcgaggcccacgagcgccgcuucuccgccggccccaaggucaacggcaccuuccaggccgacuucccccucggccccgccacccacggcggcaccuaccgcugcuucggcuccuuccgcgacucccccuacgagugguccaacuccuccgacccccuccucgucuccgucaccggcaaccccuccaacuccuggcccucccccaccgagcccuccuccgagaccggcaacccccgccaccuccacguccucaucggcaccuccgucgucaucauccucuucauccuccuccucuucuuccuccuccaccgcuggugcugcaacaagaagaacgccgucgucauggaccaggagcccgccggcaaccgcaccgucaaccgcgaggacuccgacgagcaggacccccaggaggucaccuacgcccagcucaaccacugcgucuucacccagcgcaagaucacccgccccucccagcgccccaagaccccccccaccgacaucaucgucuacaccgagcuccccaacgccgagcccuga

SEQ ID NO: 45079 - RNA, 1029 nt, Artificial Sequence
  derived and/or modified sequence opt2 from KIR2DL4__Homo_sapiens__NP_001074239
auguccaugucccccaccgucaucauccucgccugccucggcuucuuccucgaccaguccgucugggcccacgucggcggccaggacaagcccuucugcuccgccuggcccuccgccgucgucccccagggcggccacgucacccuccgcugccacuaccgccgcggcuucaacaucuucacccucuacaagaaggacggcguccccguccccgagcucuacaaccgcaucuucuggaacuccuuccucaucucccccgucacccccgcccacgccggcaccuaccgcugccgcggcuuccacccccacucccccaccgagugguccgcccccuccaacccccucgucaucauggucaccggccucuacgagaagcccucccucaccgcccgccccggccccaccguccgcgccggcgagaacgucacccucuccugcuccucccaguccuccuucgacaucuaccaccucucccgcgagggcgaggcccacgagcuccgccuccccgccguccccuccaucaacggcaccuuccaggccgacuucccccucggccccgccacccacggcgagaccuaccgcugcuucggcuccuuccacggcucccccuacgagugguccgaccccuccgacccccuccccgucuccgucaccggcaaccccuccuccuccuggcccucccccaccgagcccuccuucaagaccgacgccgccgucaugaaccaggagcccgccggccaccgcaccgucaaccgcgaggacuccgacgagcaggacccccaggaggucaccuacgcccagcucgaccacugcaucuucacccagcgcaagaucaccggccccucccagcgcuccaagcgccccuccaccgacaccuccgucugcaucgagcuccccaacgccgagccccgcgcccucucccccgcccacgagcaccacucccaggcccucaugggcuccucccgcgagaccaccgcccucucccagacccagcucgccuccuccaacguccccgccgccggcaucuga

SEQ ID NO: 45080 - RNA, 1128 nt, Artificial Sequence
  derived and/or modified sequence opt2 from KIR2DL5A__Homo_sapiens__NP_065396
augucccucauggucaucuccauggccugcgucggcuucuuccuccuccagggcgccuggacccacgagggcggccaggacaagccccuccucuccgccuggcccuccgccgucgucccccgcggcggccacgucacccuccucugccgcucccgccucggcuucaccaucuucucccucuacaaggaggacggcguccccguccccgagcucuacaacaagaucuucuggaaguccauccucaugggccccgucacccccgcccacgccggcaccuaccgcugccgcggcucccacccccgcucccccaucgagugguccgcccccuccaacccccucgucaucgucgucaccggccucuucggcaagcccucccucuccgcccagcccggccccaccguccgcaccggcgagaacgucacccucuccugcuccucccgcuccuccuucgacauguaccaccucucccgcgagggccgcgcccacgagccccgccuccccgccguccccuccgucaacggcaccuuccaggccgacuucccccucggccccgccacccacggcggcaccuacaccugcuucggcucccuccacgacucccccuacgagugguccgaccccuccgacccccuccucgucuccgucaccggcaacuccuccuccuccuccuccucccccaccgagcccuccuccaagaccggcauccgccgccaccuccacauccucaucggcaccuccgucgccaucauccucuucaucauccucuucuucuuccuccuccacugcugcugcuccaacaagaagaacgccgccgucauggaccaggagcccgccggcgaccgcaccgucaaccgcgaggacuccgacgaccaggacccccaggaggucaccuacgcccagcucgaccacugcgucuucacccagaccaagaucaccucccccucccagcgccccaagaccccccccaccgacaccaccauguacauggagcuccccaacgccaagccccgcucccucucccccgcccacaagcaccacucccaggcccuccgcggcuccucccgcgagaccaccgcccucucccagaaccgcgucgccuccucccacguccccgccgccggcaucuga

SEQ ID NO: 45081 - RNA, 1128 nt, Artificial Sequence
  derived and/or modified sequence opt2 from KIR2DL5B__Homo_sapiens__NP_001018091
augucccucauggucaucuccauggccugcgucggcuucuuccuccuccagggcgccuggacccacgagggcggccaggacaagccccuccucuccgccuggcccuccgccgucgucccccgcggcggccacgucacccuccucugccgcucccgccucggcuucaccaucuucucccucuacaaggaggacggcguccccguccccgagcucuacaacaagaucuucuggaaguccauccucaugggccccgucacccccgcccacgccggcaccuaccgcugccgcggcucccacccccgcucccccaucgagugguccgcccccuccaacccccucgucaucgucgucaccggccucuucggcaagcccucccucuccgcccagcccggccccaccguccgcaccggcgagaacgucgcccucuccugcuccucccgcuccuccuucgacauguaccaccucucccgcgagggccgcgcccacgagccccgccuccccgccguccccuccgucgacggcaccuuccaggccgacuucccccucggccccgccacccacggcggcaccuacaccugcuucuccucccuccacgacucccccuacgagugguccgaccccuccgacccccuccucgucuccgucaccggcaacuccuccuccuccuccuccucccccaccgagcccuccuccaagaccggcauccgccgccaccuccacauccucaucggcaccuccgucgccaucauccucuucaucauccucuucuucuuccuccuccacugcugcugcuccaacaagaagaacgccgccgucauggaccagggccccgccggcgaccgcaccgucaaccgcgaggacuccgacgaccaggacccccaggaggucaccuacgcccagcucgaccacugcgucuucacccagaccaagaucaccucccccucccagcgccccaaggccccccccaccgacaccaccauguacauggagcuccccaacgccaagccccgcucccucucccccgcccacaagcaccacucccaggcccuccgcggcuccucccgcgagaccaccgcccucucccagaaccgcgucgccuccucccacguccccgccgccggcaucuga

SEQ ID NO: 45082 - RNA, 915 nt, Artificial Sequence
  derived and/or modified sequence opt2 from KIR2DS1__Homo_sapiens__NP_055327
augucccucaccgucgucuccauggccugcgucggcuucuuccuccuccagggcgccuggccccacgagggcguccaccgcaagcccucccuccucgcccaccccggccgccucgucaaguccgaggagaccgucauccuccagugcugguccgacgucauguucgagcacuuccuccuccaccgcgagggcauguucaacgacacccuccgccucaucggcgagcaccacgacggcgucuccaaggccaacuucuccaucucccgcaugaagcaggaccucgccggcaccuaccgcugcuacggcuccgucacccacucccccuaccagcucuccgcccccuccgacccccucgacaucgucaucaucggccucuacgagaagcccucccucuccgcccagcccggccccaccguccucgccggcgagaacgucacccucuccugcuccucccgcuccuccuacgacauguaccaccucucccgcgagggcgaggcccacgagcgccgccuccccgccggcaccaaggucaacggcaccuuccaggccaacuucccccucggccccgccacccacggcggcaccuaccgcugcuucggcuccuuccgcgacucccccuacgagugguccaaguccuccgacccccuccucgucuccgucaccggcaaccccuccaacuccuggcccucccccaccgagcccuccuccgagaccggcaacccccgccaccuccacguccucaucggcaccuccgucgucaagauccccuucaccauccuccucuucuuccuccuccaccgcuggugcuccgacaagaagaacgccgccgucauggaccaggagcccgccggcaaccgcaccgucaacuccgaggacuccgacgagcaggaccaccaggaggucuccuacgccuga

SEQ ID NO: 45083 - RNA, 1017 nt, Artificial Sequence
  derived and/or modified sequence opt2 from KIR2DS2__Homo_sapiens__NP_001278624
augucccucauggucgucuccauggccugcgucggcuucuuccuccuccagggcgccuggccccacgagggcguccaccgcaagcccucccuccucgcccaccccggcccccucgucaaguccgaggagaccgucauccuccagugcugguccgacguccgcuucgagcacuuccuccuccaccgcgagggcaaguacaaggacacccuccaccucaucggcgagcaccacgacggcgucuccaaggccaacuucuccaucggccccaugaugcaggaccucgccggcaccuaccgcugcuacggcuccgucacccacucccccuaccagcucuccgcccccuccgacccccucgacaucgucaucaccggccucuacgagaagcccucccucuccgcccagcccggccccaccguccucgccggcgaguccgucacccucuccugcuccucccgcuccuccuacgacauguaccaccucucccgcgagggcgaggcccacgagcgccgcuucuccgccggccccaaggucaacggcaccuuccaggccgacuucccccucggccccgccacccacggcggcaccuaccgcugcuucggcuccuuccgcgacucccccuacgagugguccaacuccuccgacccccuccucgucuccgucaccggcaaccccuccaacuccuggcccucccccaccgagcccuccuccaagaccggcaacccccgccaccuccacguccucaucggcaccuccgucgucaagauccccuucaccauccuccucuucuuccuccuccaccgcuggugcuccaacaagaagaacgccgccgucauggaccaggagcccgccggcaaccgcaccgucaacuccgagcgcgagaucacccgccccuccgagcgccccaagaccccccccaccgacaccuccauguacaucgagcuccccaacgccgagccccgcuccaaggucgucuucugcccccgcgccccccaguccggccucgagggcaucuucuga

SEQ ID NO: 45084 - RNA, 915 nt, Artificial Sequence
  derived and/or modified sequence opt2 from KIR2DS3__Homo_sapiens__NP_036445
augucccucauggucaucuccauggccugcgucggcuucuucuggcuccagggcgccuggccccacgagggcuuccgccgcaagcccucccuccucgcccaccccggccgccucgucaaguccgaggagaccgucauccuccagugcugguccgacgucauguucgagcacuuccuccuccaccgcgagggcaccuucaacgacacccuccgccucaucggcgagcacaucgacggcgucuccaaggccaacuucuccaucggccgcaugcgccaggaccucgccggcaccuaccgcugcuacggcuccgucccccacucccccuaccaguucuccgcccccuccgacccccucgacaucgucaucaccggccucuacgagaagcccucccucuccgcccagcccggccccaccguccucgccggcgaguccgucacccucuccugcuccuccugguccuccuacgacauguaccaccucuccaccgagggcgaggcccacgagcgccgcuucuccgccggccccaaggucaacggcaccuuccaggccgacuucccccucggccccgccacccagggcggcaccuaccgcugcuucggcuccuuccacgacucccccuacgagugguccaaguccuccgacccccuccucgucuccgucaccggcaaccccuccaacuccuggcccucccccaccgagcccuccuccaagaccggcaacccccgccaccuccacguccucaucggcaccuccgucgucaagcuccccuucaccauccuccucuucuuccuccuccaccgcuggugcuccgacaagaagaacgccuccgucauggaccagggccccgccggcaaccgcaccgucaaccgcgaggacuccgacgagcaggaccaccaggaggucuccuacgccuga

SEQ ID NO: 45085 - RNA, 915 nt, Artificial Sequence
  derived and/or modified sequence opt2 from KIR2DS4__Homo_sapiens__NP_036446
augucccucauggucaucaucauggccugcgucggcuucuuccuccuccagggcgccuggccccaggagggcguccaccgcaagcccuccuuccucgcccuccccggccaccucgucaaguccgaggagaccgucauccuccagugcugguccgacgucauguucgagcacuuccuccuccaccgcgagggcaaguucaacaacacccuccaccucaucggcgagcaccacgacggcgucuccaaggccaacuucuccaucggccccaugaugcccguccucgccggcaccuaccgcugcuacggcuccgucccccacucccccuaccagcucuccgcccccuccgacccccucgacauggucaucaucggccucuacgagaagcccucccucuccgcccagcccggccccaccguccaggccggcgagaacgucacccucuccugcuccucccgcuccuccuacgacauguaccaccucucccgcgagggcgaggcccacgagcgccgccuccccgccguccgcuccaucaacggcaccuuccaggccgacuucccccucggccccgccacccacggcggcaccuaccgcugcuucggcuccuuccgcgacgcccccuacgagugguccaacuccuccgacccccuccucgucuccgucaccggcaaccccuccaacuccuggcccucccccaccgagcccuccuccaagaccggcaacccccgccaccuccacguccucaucggcaccuccgucgucaagauccccuucaccauccuccucuucuuccuccuccaccgcuggugcuccgacaagaagaacgccgccgucauggaccaggagcccgccggcaaccgcaccgucaacuccgaggacuccgacgagcaggaccaccaggaggucuccuacgccuga

SEQ ID NO: 45086 - RNA, 1335 nt, Artificial Sequence
  derived and/or modified sequence opt2 from KIR3DL1__Homo_sapiens__NP_037421
augucccucauggucgucuccauggccugcgucggccucuuccucguccagcgcgccggcccccacaugggcggccaggacaagcccuuccucuccgccuggcccuccgccgucgucccccgcggcggccacgucacccuccgcugccacuaccgccaccgcuucaacaacuucaugcucuacaaggaggaccgcauccacauccccaucuuccacggccgcaucuuccaggaguccuucaacaugucccccgucaccaccgcccacgccggcaacuacaccugccgcggcucccacccccacucccccaccggcugguccgcccccuccaaccccgucgucaucauggucaccggcaaccaccgcaagcccucccuccucgcccaccccggcccccucgucaaguccggcgagcgcgucauccuccagugcugguccgacaucauguucgagcacuucuuccuccacaaggagggcaucuccaaggaccccucccgccucgucggccagauccacgacggcgucuccaaggccaacuucuccaucggccccaugaugcucgcccucgccggcaccuaccgcugcuacggcuccgucacccacacccccuaccagcucuccgcccccuccgacccccucgacaucgucgucaccggccccuacgagaagcccucccucuccgcccagcccggccccaagguccaggccggcgaguccgucacccucuccugcuccucccgcuccuccuacgacauguaccaccucucccgcgagggcggcgcccacgagcgccgccuccccgccguccgcaaggucaaccgcaccuuccaggccgacuucccccucggccccgccacccacggcggcaccuaccgcugcuucggcuccuuccgccacucccccuacgagugguccgaccccuccgacccccuccucgucuccgucaccggcaaccccuccuccuccuggcccucccccaccgagcccuccuccaaguccggcaacccccgccaccuccacauccucaucggcaccuccgucgucaucauccucuucauccuccuccucuucuuccuccuccaccucuggugcuccaacaagaagaacgccgccgucauggaccaggagcccgccggcaaccgcaccgccaacuccgaggacuccgacgagcaggaccccgaggaggucaccuacgcccagcucgaccacugcgucuucacccagcgcaagaucacccgccccucccagcgccccaagaccccccccaccgacaccauccucuacaccgagcuccccaacgccaagccccgcuccaaggucgucuccugccccuga

SEQ ID NO: 45087 - RNA, 1317 nt, Artificial Sequence
  derived and/or modified sequence opt2 from KIR3DL2__Homo_sapiens__NP_001229796
augucccucaccgucgucuccauggccugcgucggcuucuuccuccuccagggcgccuggccccucaugggcggccaggacaagcccuuccucuccgcccgccccuccaccgucgucccccgcggcggccacgucgcccuccagugccacuaccgccgcggcuucaacaacuucaugcucuacaaggaggaccgcucccacguccccaucuuccacggccgcaucuuccaggaguccuucaucaugggccccgucacccccgcccacgccggcaccuaccgcugccgcggcucccgcccccacucccucaccggcugguccgcccccuccaacccccucgucaucauggucaccggcaaccaccgcaagcccucccuccucgcccaccccggcccccuccucaaguccggcgagaccgucauccuccagugcugguccgacgucauguucgagcacuucuuccuccaccgcgagggcaucuccgaggaccccucccgccucgucggccagauccacgacggcgucuccaaggccaacuucuccaucggcccccucaugcccguccucgccggcaccuaccgcugcuacggcuccgucccccacucccccuaccagcucuccgcccccuccgacccccucgacaucgucaucaccggccucuacgagaagcccucccucuccgcccagcccggccccaccguccaggccggcgagaacgucacccucuccugcuccuccugguccuccuacgacaucuaccaccucucccgcgagggcgaggcccacgagcgccgccuccgcgccguccccaaggucaaccgcaccuuccaggccgacuucccccucggccccgccacccacggcggcaccuaccgcugcuucggcuccuuccgcgcccuccccugcgucugguccaacuccuccgacccccuccucgucuccgucaccggcaucugccgccaccuccacguccucaucggcaccuccgucgucaucuuccucuucauccuccuccucuucuuccuccucuaccgcuggugcuccaacaagaagaacgccgccgucauggaccaggagcccgccggcgaccgcaccgucaaccgccaggacuccgacgagcaggacccccaggaggucaccuacgcccagcucgaccacugcgucuucauccagcgcaagaucucccgccccucccagcgccccaagaccccccucaccgacaccuccgucuacaccgagcuccccaacgccgagccccgcuccaaggucgucuccugcccccgcgccccccaguccggccucgagggcgucuucuga

SEQ ID NO: 45088 - RNA, 1233 nt, Artificial Sequence
  derived and/or modified sequence opt2 from KIR3DL3__Homo_sapiens__NP_703144
augucccucauggucgucuccauggccugcgucggcuucuuccuccucgagggccccuggccccacgucggcggccaggacaagcccuuccucuccgccuggcccggcaccgucgucuccgagggccagcacgucacccuccagugccgcucccgccucggcuucaacgaguucucccucuccaaggaggacggcaugcccguccccgagcucuacaaccgcaucuuccgcaacuccuuccucaugggccccgucacccccgcccacgccggcaccuaccgcugcugcuccucccacccccacucccccaccggcugguccgcccccuccaaccccgucgucaucauggucaccggcguccaccgcaagcccucccuccucgcccaccccggcccccucgucaaguccggcgagaccgucauccuccagugcugguccgacguccgcuucgagcgcuuccuccuccaccgcgagggcaucaccgaggacccccuccgccucgucggccagcuccacgacgccggcucccaggucaacuacuccaugggccccaugacccccgcccucgccggcaccuaccgcugcuucggcuccgucacccaccuccccuacgagcucuccgcccccuccgacccccucgacaucgucgucgucggccucuacggcaagcccucccucuccgcccagcccggccccaccguccaggccggcgagaacgucacccucuccugcuccucccgcucccucuucgacaucuaccaccucucccgcgaggccgaggccggcgagcuccgccucaccgccguccuccgcgucaacggcaccuuccaggccaacuucccccucggccccgucacccacggcggcaacuaccgcugcuucggcuccuuccgcgcccucccccacgccugguccgaccccuccgacccccuccccgucuccgucaccggcaacucccgcaaccuccacguccucaucggcaccuccgucgucaucauccccuucgccauccuccucuucuuccuccuccaccgcuggugcgccaacaagaagaacgccgucgucauggaccaggagcccgccggcaaccgcaccgucaaccgcgaggacuccgacgagcaggacccccaggaggucaccuacgcccagcucaaccacugcgucuucacccagcgcaagaucacccgccccucccagcgccccaagaccccccccaccgacaccuccgucuga

SEQ ID NO: 45089 - RNA, 1902 nt, Artificial Sequence
  derived and/or modified sequence opt2 from KIRREL2__Homo_sapiens__NP_115499
augcuccgcaugcgcguccccgcccuccucguccuccucuucugcuuccgcggccgcgccggccccuccccccacuuccuccagcagcccgaggaccucgucguccuccucggcgaggaggcccgccuccccugcgcccucggcgccuacuggggccucguccaguggaccaaguccggccucgcccucggcggccagcgcgaccuccccggcuggucccgcuacuggaucuccggcaacgccgccaacggccagcacgaccuccacauccgccccgucgagcucgaggacgaggccuccuacgagugccaggccacccaggccggccuccgcucccgccccgcccagcuccacguccucgucccccccgaggccccccagguccucggcggccccuccgucucccucgucgccggcguccccgccaaccucaccugccgcucccgcggcgacgcccgccccacccccgagcuccucugguuccgcgacggcguccuccucgacggcgccaccuuccaccagacccuccucaaggagggcacccccggcuccgucgaguccacccucacccucacccccuucucccacgacgacggcgccaccuucgucugccgcgcccgcucccaggcccuccccaccggccgcgacaccgccaucacccucucccuccaguacccccccgaggucacccucuccgccuccccccacaccguccaggagggcgagaaggucaucuuccucugccaggccaccgcccagccccccgucaccggcuaccgcugggccaagggcggcucccccguccucggcgcccgcggcccccgccucgaggucgucgccgacgccuccuuccucaccgagcccgucuccugcgaggucuccaacgccgucggcuccgccaaccgcuccaccgcccucgacguccucuucggccccauccuccaggccaagcccgagcccgucuccgucgacgucggcgaggacgccuccuucuccugcgccuggcgcggcaacccccucccccgcgucaccuggacccgccgcggcggcgcccagguccucggcuccggcgccacccuccgccuccccuccgucggccccgaggacgccggcgacuacgucugccgcgccgaggccggccucuccggccuccgcggcggcgccgccgaggcccgccucaccgucaacgccccccccgucgucaccgcccuccacuccgcccccgccuuccuccgcggccccgcccgccuccagugccucgucuucgccucccccgcccccgacgccgucgucugguccugggacgagggcuuccucgaggccggcucccagggccgcuuccucgucgagaccuuccccgcccccgagucccgcggcggccucggccccggccucaucuccguccuccacaucuccggcacccaggaguccgacuucucccgcuccuucaacugcuccgcccgcaaccgccucggcgagggcggcgcccaggccucccucggccgccgcgaccuccuccccaccguccgcaucgucgccggcgucgccgccgccaccaccacccuccucauggucaucaccggcgucgcccucugcugcuggcgccacuccaaggccuccgccuccuucuccgagcagaagaaccucaugcgcauccccggcuccuccgacggcuccuccucccgcggccccgaggaggaggagaccggcucccgcgaggaccgcggccccaucguccacaccgaccacuccgaccucguccucgaggaggagggcacccucgagaccaaggaccccaccaacggcuacuacaagguccgcggcgucuccccccccgccucccccgacucccgcgucaccuccuuccaguggaagucccccggcaucuccaaccuccccuga

SEQ ID NO: 45090 - RNA, 1803 nt, Artificial Sequence
  derived and/or modified sequence opt2 from KIRREL3__Homo_sapiens__NP_001155179
augaagcccuuccagcucgaccuccucuucgucugcuucuuccucuucucccaggagcucggccuccagaagcgcggcugcugccucguccucggcuacauggccaaggacaaguuccgccgcaugaacgagggccaggucuacuccuucucccagcagccccaggaccaggucgucgucuccggccagcccgucacccuccucugcgccauccccgaguacgacggcuucguccucuggaucaaggacggccucgcccucggcgucggccgcgaccucuccuccuacccccaguaccucgucgucggcaaccaccucuccggcgagcaccaccucaagauccuccgcgccgagcuccaggacgacgccgucuacgagugccaggccauccaggccgccauccgcucccgccccgcccgccucaccguccucgucccccccgacgaccccgucauccucggcggccccgucaucucccuccgcgccggcgacccccucaaccucaccugccacgccgacaacgccaagcccgccgccuccaucaucuggcuccgcaagggcgaggucaucaacggcgccaccuacuccaagacccuccuccgcgacggcaagcgcgaguccaucgucuccacccucuucaucucccccggcgacgucgagaacggccaguccaucgucugccgcgccaccaacaaggccauccccggcggcaaggagaccuccgucaccaucgacauccagcaccccccccucgucaaccucuccgucgagccccagcccguccucgaggacaacgucgucaccuuccacugcuccgccaaggccaaccccgccgucacccaguaccgcugggccaagcgcggccagaucaucaaggaggccuccggcgaggucuaccgcaccaccgucgacuacaccuacuucuccgagcccgucuccugcgaggucaccaacgcccucggcuccaccaaccucucccgcaccgucgacgucuacuucggcccccgcaugaccaccgagccccagucccuccucgucgaccucggcuccgacgccaucuucuccugcgccuggaccggcaaccccucccucaccaucgucuggaugaagcgcggcuccggcgucguccucuccaacgagaagacccucacccucaaguccguccgccaggaggacgccggcaaguacgucugccgcgccgucgucccccgcgucggcgccggcgagcgcgaggucacccucaccgucaacggcccccccaucaucuccuccacccagacccagcacgcccuccacggcgagaagggccagaucaagugcuucauccgcuccacccccccccccgaccgcaucgccugguccuggaaggagaacguccucgaguccggcaccuccggccgcuacaccgucgagaccaucuccaccgaggagggcgucaucuccacccucaccaucuccaacaucguccgcgccgacuuccagaccaucuacaacugcaccgccuggaacuccuucggcuccgacaccgagaucauccgccucaaggagcagggcuccgagaugaaguccggcgccggccucgaggccgaguccguccccauggccgucaucaucggcgucgccgucggcgccggcgucgccuuccucguccucauggccaccaucgucgccuucugcugcgcccgcucccagcgcuccaccggcggccgcuccggcaucuccggccgcggcaccgagaagaaggcccgccuccgccucccccgccgcgccuccaagcaggagugcaacgagcagggcuccuga

SEQ ID NO: 45091 - RNA, 1974 nt, Artificial Sequence
  derived and/or modified sequence opt2 from KIRREL__Homo_sapiens__NP_001273278
augcucucccuccucgucuggauccucacccucuccgacaccuucucccaggucccccccgaggacacccgcaucgacggcggccccgucauccuccuccaggccggcaccccccacaaccucaccugccgcgccuucaacgccaagcccgccgccaccaucaucugguuccgcgacggcacccagcaggagggcgccgucgccuccaccgagcuccucaaggacggcaagcgcgagaccaccgucucccagcuccucaucaaccccaccgaccucgacaucggccgcgucuucaccugccgcuccaugaacgaggccauccccuccggcaaggagaccuccaucgagcucgacguccaccacccccccaccgucacccucuccaucgagccccagaccguccaggagggcgagcgcgucgucuucaccugccaggccaccgccaaccccgagauccucggcuaccgcugggccaagggcggcuuccucaucgaggacgcccacgagucccgcuacgagaccaacgucgacuacuccuucuucaccgagcccgucuccugcgagguccacaacaaggucggcuccaccaacgucuccacccucgucaacguccacuucgccccccgcaucgucgucgaccccaagcccaccaccaccgacaucggcuccgacgucacccucaccugcgucugggucggcaaccccccccucacccucaccuggaccaagaaggacuccaacaugguccucuccaacuccaaccagcuccuccucaaguccgucacccaggccgacgccggcaccuacaccugccgcgccaucgucccccgcaucggcgucgccgagcgcgaggucccccucuacgucaacggcccccccaucaucuccuccgaggccguccaguacgccguccgcggcgacggcggcaaggucgagugcuucaucggcuccacccccccccccgaccgcaucgccugggccuggaaggagaacuuccucgaggucggcacccucgagcgcuacaccgucgagcgcaccaacuccggcuccggcguccucuccacccucaccaucaacaacgucauggaggccgacuuccagacccacuacaacugcaccgccuggaacuccuucggccccggcaccgccaucauccagcucgaggagcgcgagguccuccccgucggcaucaucgccggcgccaccaucggcgccuccauccuccucaucuucuucuucaucgcccucgucuucuuccucuaccgccgccgcaagggcucccgcaaggacgucacccuccgcaagcucgacaucaaggucgagaccgucaaccgcgagccccucaccaugcacuccgaccgcgaggacgacaccgccuccgucuccaccgccacccgcgucaugaaggccaucuacuccuccuucaaggacgacgucgaccucaagcaggaccuccgcugcgacaccaucgacacccgcgaggaguacgagaugaaggaccccaccaacggcuacuacaacguccgcgcccacgaggaccgccccuccucccgcgccguccucuacgccgacuaccgcgcccccggccccgcccgcuucgacggccgccccuccucccgccucucccacuccuccggcuacgcccagcucaacaccuacucccgcggccccgccuccgacuacggccccgagcccaccccccccggccccgccgcccccgccggcaccgacaccaccucccagcucuccuacgagaacuacgagaaguucaacucccaccccuuccccggcgccgccggcuaccccaccuaccgccucggcuacccccaggccccccccuccggccucgagcgcacccccuacgaggccuacgaccccaucggcaaguacgccaccgccacccgcuucuccuacaccucccagcacuccgacuacggccagcgcuuccagcagcgcaugcagacccacgucuga

SEQ ID NO: 45092 - RNA, 417 nt, Artificial Sequence
  derived and/or modified sequence opt2 from KISS1__Homo_sapiens__XP_011507827
augaacucccucgucuccuggcagcuccuccucuuccucugcgccacccacuucggcgagccccucgagaaggucgccuccgucggcaacucccgccccaccggccagcagcucgagucccucggccuccucgcccccggcgagcagucccuccccugcaccgagcgcaagcccgccgccaccgcccgccucucccgccgcggcaccucccucucccccccccccgaguccuccggcuccccccagcagcccggccucuccgccccccacucccgccagauccccgccccccagggcgccguccucguccagcgcgagaaggaccuccccaacuacaacuggaacuccuucggccuccgcuucggcaagcgcgaggccgcccccggcaaccacggccgcuccgccggccgcggcuga

SEQ ID NO: 45093 - RNA, 1197 nt, Artificial Sequence
  derived and/or modified sequence opt2 from KISS1R__Homo_sapiens__NP_115940
augcacaccgucgccaccuccggccccaacgccuccuggggcgcccccgccaacgccuccggcugccccggcugcggcgccaacgccuccgacggccccguccccuccccccgcgccgucgacgccuggcucgucccccucuucuucgccgcccucaugcuccucggccucgucggcaacucccucgucaucuacgucaucugccgccacaagcccaugcgcaccgucaccaacuucuacaucgccaaccucgccgccaccgacgucaccuuccuccucugcugcguccccuucaccgcccuccucuacccccuccccggcuggguccucggcgacuucaugugcaaguucgucaacuacauccagcaggucuccguccaggccaccugcgccacccucaccgccauguccgucgaccgcugguacgucaccgucuucccccuccgcgcccuccaccgccgcaccccccgccucgcccucgccgucucccucuccaucugggucggcuccgccgccgucuccgcccccguccucgcccuccaccgccucucccccggcccccgcgccuacugcuccgaggccuuccccucccgcgcccucgagcgcgccuucgcccucuacaaccuccucgcccucuaccuccucccccuccucgccaccugcgccugcuacgccgccaugcuccgccaccucggccgcgucgccguccgccccgcccccgccgacuccgcccuccagggccagguccucgccgagcgcgccggcgccguccgcgccaaggucucccgccucgucgccgccgucguccuccucuucgccgccugcuggggccccauccagcucuuccucguccuccaggcccucggccccgccggcuccuggcacccccgcuccuacgccgccuacgcccucaagaccugggcccacugcauguccuacuccaacuccgcccucaacccccuccucuacgccuuccucggcucccacuuccgccaggccuuccgccgcgucugccccugcgccccccgccgcccccgccgcccccgccgccccggccccuccgaccccgccgccccccacgccgagcuccuccgccucggcucccaccccgcccccgcccgcgcccagaagcccggcuccuccggccucgccgcccgcggccucugcguccucggcgaggacaacgccccccucuga

SEQ ID NO: 45094 - RNA, 2931 nt, Artificial Sequence
  derived and/or modified sequence opt2 from KIT__Homo_sapiens__NP_000213
augcgcggcgcccgcggcgccugggacuuccucugcguccuccuccuccuccuccgcguccagaccggcuccucccagcccuccgucucccccggcgagcccuccccccccuccauccaccccggcaaguccgaccucaucguccgcgucggcgacgagauccgccuccucugcaccgaccccggcuucgucaaguggaccuucgagauccucgacgagaccaacgagaacaagcagaacgaguggaucaccgagaaggccgaggccaccaacaccggcaaguacaccugcaccaacaagcacggccucuccaacuccaucuacgucuucguccgcgaccccgccaagcucuuccucgucgaccgcucccucuacggcaaggaggacaacgacacccucguccgcugcccccucaccgaccccgaggucaccaacuacucccucaagggcugccagggcaagccccuccccaaggaccuccgcuucauccccgaccccaaggccggcaucaugaucaaguccgucaagcgcgccuaccaccgccucugccuccacugcuccgucgaccaggagggcaaguccguccucuccgagaaguucauccucaagguccgccccgccuucaaggccguccccgucgucuccgucuccaaggccuccuaccuccuccgcgagggcgaggaguucaccgucaccugcaccaucaaggacgucuccuccuccgucuacuccaccuggaagcgcgagaacucccagaccaagcuccaggagaaguacaacuccuggcaccacggcgacuucaacuacgagcgccaggccacccucaccaucuccuccgcccgcgucaacgacuccggcgucuucaugugcuacgccaacaacaccuucggcuccgccaacgucaccaccacccucgaggucgucgacaagggcuucaucaacaucuuccccaugaucaacaccaccgucuucgucaacgacggcgagaacgucgaccucaucgucgaguacgaggccuuccccaagcccgagcaccagcaguggaucuacaugaaccgcaccuucaccgacaagugggaggacuaccccaaguccgagaacgaguccaacauccgcuacgucuccgagcuccaccucacccgccucaagggcaccgagggcggcaccuacaccuuccucgucuccaacuccgacgucaacgccgccaucgccuucaacgucuacgucaacaccaagcccgagauccucaccuacgaccgccucgucaacggcaugcuccagugcgucgccgccggcuuccccgagcccaccaucgacugguacuucugccccggcaccgagcagcgcugcuccgccuccguccuccccgucgacguccagacccucaacuccuccggcccccccuucggcaagcucgucguccaguccuccaucgacuccuccgccuucaagcacaacggcaccgucgagugcaaggccuacaacgacgucggcaagaccuccgccuacuucaacuucgccuucaagggcaacaacaaggagcagauccacccccacacccucuucaccccccuccucaucggcuucgucaucgucgccggcaugaugugcaucaucgucaugauccucaccuacaaguaccuccagaagcccauguacgagguccaguggaaggucgucgaggagaucaacggcaacaacuacgucuacaucgaccccacccagcuccccuacgaccacaagugggaguucccccgcaaccgccucuccuucggcaagacccucggcgccggcgccuucggcaaggucgucgaggccaccgccuacggccucaucaaguccgacgccgccaugaccgucgccgucaagaugcucaagcccuccgcccaccucaccgagcgcgaggcccucauguccgagcucaagguccucuccuaccucggcaaccacaugaacaucgucaaccuccucggcgccugcaccaucggcggccccacccucgucaucaccgaguacugcugcuacggcgaccuccucaacuuccuccgccgcaagcgcgacuccuucaucugcuccaagcaggaggaccacgccgaggccgcccucuacaagaaccuccuccacuccaaggaguccuccugcuccgacuccaccaacgaguacauggacaugaagcccggcgucuccuacgucguccccaccaaggccgacaagcgccgcuccguccgcaucggcuccuacaucgagcgcgacgucacccccgccaucauggaggacgacgagcucgcccucgaccucgaggaccuccucuccuucuccuaccaggucgccaagggcauggccuuccucgccuccaagaacugcauccaccgcgaccucgccgcccgcaacauccuccucacccacggccgcaucaccaagaucugcgacuucggccucgcccgcgacaucaagaacgacuccaacuacgucgucaagggcaacgcccgccuccccgucaaguggauggcccccgaguccaucuucaacugcgucuacaccuucgaguccgacgucugguccuacggcaucuuccucugggagcucuucucccucggcuccucccccuaccccggcaugcccgucgacuccaaguucuacaagaugaucaaggagggcuuccgcaugcucucccccgagcacgcccccgccgagauguacgacaucaugaagaccugcugggacgccgacccccucaagcgccccaccuucaagcagaucguccagcucaucgagaagcagaucuccgaguccaccaaccacaucuacuccaaccucgccaacugcucccccaaccgccagaagcccgucgucgaccacuccguccgcaucaacuccgucggcuccaccgccuccuccucccagccccuccucguccacgacgacgucuga

SEQ ID NO: 45095 - RNA, 822 nt, Artificial Sequence
  derived and/or modified sequence opt2 from KITLG__Homo_sapiens__NP_000890
augaagaagacccagaccuggauccucaccugcaucuaccuccagcuccuccucuucaacccccucgucaagaccgagggcaucugccgcaaccgcgucaccaacaacgucaaggacgucaccaagcucgucgccaaccuccccaaggacuacaugaucacccucaaguacguccccggcauggacguccuccccucccacugcuggaucuccgagauggucguccagcucuccgacucccucaccgaccuccucgacaaguucuccaacaucuccgagggccucuccaacuacuccaucaucgacaagcucgucaacaucgucgacgaccucgucgagugcgucaaggagaacuccuccaaggaccucaagaaguccuucaagucccccgagccccgccucuucacccccgaggaguucuuccgcaucuucaaccgcuccaucgacgccuucaaggacuucgucgucgccuccgagaccuccgacugcgucgucuccuccacccucucccccgagaaggacucccgcgucuccgucaccaagcccuucaugcucccccccgucgccgccuccucccuccgcaacgacuccuccuccuccaaccgcaaggccaagaacccccccggcgacuccucccuccacugggccgccauggcccuccccgcccucuucucccucaucaucggcuucgccuucggcgcccucuacuggaagaagcgccagcccucccucacccgcgccgucgagaacauccagaucaacgaggaggacaacgagaucuccaugcuccaggagaaggagcgcgaguuccaggaggucuga

SEQ ID NO: 45096 - RNA, 3135 nt, Artificial Sequence
  derived and/or modified sequence opt2 from KLB__Homo_sapiens__NP_783864
augaagcccggcugcgccgccggcucccccggcaacgaguggaucuucuucuccaccgacgagaucaccacccgcuaccgcaacaccauguccaacggcggccuccagcgcuccgucauccucuccgcccucauccuccuccgcgccgucaccggcuucuccggcgacggccgcgccaucugguccaagaaccccaacuucacccccgucaacgagucccagcucuuccucuacgacaccuuccccaagaacuucuucuggggcaucggcaccggcgcccuccaggucgagggcuccuggaagaaggacggcaagggccccuccaucugggaccacuucauccacacccaccucaagaacgucuccuccaccaacggcuccuccgacuccuacaucuuccucgagaaggaccucuccgcccucgacuucaucggcgucuccuucuaccaguucuccaucuccuggccccgccucuuccccgacggcaucgucaccgucgccaacgccaagggccuccaguacuacuccacccuccucgacgcccucguccuccgcaacaucgagcccaucgucacccucuaccacugggaccucccccucgcccuccaggagaaguacggcggcuggaagaacgacaccaucaucgacaucuucaacgacuacgccaccuacugcuuccagauguucggcgaccgcgucaaguacuggaucaccauccacaaccccuaccucgucgccuggcacggcuacggcaccggcaugcacgcccccggcgagaagggcaaccucgccgccgucuacaccgucggccacaaccucaucaaggcccacuccaaggucuggcacaacuacaacacccacuuccgcccccaccagaagggcuggcucuccaucacccucggcucccacuggaucgagcccaaccgcuccgagaacaccauggacaucuucaagugccagcaguccauggucuccguccucggcugguucgccaaccccauccacggcgacggcgacuaccccgagggcaugcgcaagaagcucuucuccguccuccccaucuucuccgaggccgagaagcacgagaugcgcggcaccgccgacuucuucgccuucuccuucggccccaacaacuucaagccccucaacaccauggccaagaugggccagaacgucucccucaaccuccgcgaggcccucaacuggaucaagcucgaguacaacaacccccgcauccucaucgccgagaacggcugguucaccgacucccgcgucaagaccgaggacaccaccgccaucuacaugaugaagaacuuccucucccagguccuccaggccauccgccucgacgagauccgcgucuucggcuacaccgccuggucccuccucgacggcuucgaguggcaggacgccuacaccauccgccgcggccucuucuacgucgacuucaacuccaagcagaaggagcgcaagcccaaguccuccgcccacuacuacaagcagaucauccgcgagaacggcuucucccucaaggaguccacccccgacguccagggccaguuccccugcgacuucuccuggggcgucaccgaguccguccucaagcccgaguccgucgccuccuccccccaguucuccgacccccaccucuacgucuggaacgccaccggcaaccgccuccuccaccgcgucgagggcguccgccucaagacccgccccgcccagugcaccgacuucgucaacaucaagaagcagcucgagaugcucgcccgcaugaaggucacccacuaccgcuucgcccucgacugggccuccguccuccccaccggcaaccucuccgccgucaaccgccaggcccuccgcuacuaccgcugcgucgucuccgagggccucaagcucggcaucuccgccauggucacccucuacuaccccacccacgcccaccucggccuccccgagccccuccuccacgccgacggcuggcucaaccccuccaccgccgaggccuuccaggccuacgccggccucugcuuccaggagcucggcgaccucgucaagcucuggaucaccaucaacgagcccaaccgccucuccgacaucuacaaccgcuccggcaacgacaccuacggcgccgcccacaaccuccucgucgcccacgcccucgccuggcgccucuacgaccgccaguuccgccccucccagcgcggcgccgucucccucucccuccacgccgacugggccgagcccgccaaccccuacgccgacucccacuggcgcgccgccgagcgcuuccuccaguucgagaucgccugguucgccgagccccucuucaagaccggcgacuaccccgccgccaugcgcgaguacaucgccuccaagcaccgccgcggccucuccuccuccgcccucccccgccucaccgaggccgagcgccgccuccucaagggcaccgucgacuucugcgcccucaaccacuucaccacccgcuucgucaugcacgagcagcucgccggcucccgcuacgacuccgaccgcgacauccaguuccuccaggacaucacccgccucuccucccccacccgccucgccgucauccccuggggcguccgcaagcuccuccgcuggguccgccgcaacuacggcgacauggacaucuacaucaccgccuccggcaucgacgaccaggcccucgaggacgaccgccuccgcaaguacuaccucggcaaguaccuccaggagguccucaaggccuaccucaucgacaagguccgcaucaagggcuacuacgccuucaagcucgccgaggagaaguccaagccccgcuucggcuucuucaccuccgacuucaaggccaaguccuccauccaguucuacaacaaggucaucuccucccgcggcuuccccuucgagaacuccuccucccgcugcucccagacccaggagaacaccgagugcaccgucugccucuuccucguccagaagaagccccucaucuuccucggcugcugcuucuucuccacccucguccuccuccucuccaucgccaucuuccagcgccagaagcgccgcaaguucuggaaggccaagaaccuccagcacaucccccucaagaagggcaagcgcgucgucuccuga

SEQ ID NO: 45097 - RNA, 1857 nt, Artificial Sequence
  derived and/or modified sequence opt2 from KLC1__Homo_sapiens__NP_001123579
auguacgacaacauguccaccauggucuacaucaaggaggacaagcucgagaagcucacccaggacgagaucaucuccaagaccaagcaggucauccagggccucgaggcccucaagaacgagcacaacuccauccuccagucccuccucgagacccucaagugccucaagaaggacgacgaguccaaccucgucgaggagaaguccaacaugauccgcaagucccucgagaugcucgagcucggccucuccgaggcccaggucaugauggcccucuccaaccaccucaacgccgucgaguccgagaagcagaagcuccgcgcccagguccgccgccucugccaggagaaccaguggcuccgcgacgagcucgccaacacccagcagaagcuccagaaguccgagcaguccgucgcccagcucgaggaggagaagaagcaccucgaguucaugaaccagcucaagaaguacgacgacgacaucucccccuccgaggacaaggacaccgacuccaccaaggagccccucgacgaccucuuccccaacgacgaggacgaccccggccagggcauccagcagcagcacuccuccgccgccgccgccgcccagcagggcggcuacgagauccccgcccgccuccgcacccuccacaaccucgucauccaguacgccucccagggccgcuacgaggucgccgucccccucugcaagcaggcccucgaggaccucgagaagaccuccggccacgaccaccccgacgucgccaccaugcucaacauccucgcccucgucuaccgcgaccagaacaaguacaaggacgccgccaaccuccucaacgacgcccucgccauccgcgagaagacccucggcaaggaccaccccgccgucgccgccacccucaacaaccucgccguccucuacggcaagcgcggcaaguacaaggaggccgagccccucugcaagcgcgcccucgagauccgcgagaagguccucggcaaggaccaccccgacgucgccaagcagcucaacaaccucgcccuccucugccagaaccagggcaaguacgaggaggucgaguacuacuaccagcgcgcccucgagaucuaccagaccaagcucggccccgacgaccccaacgucgccaagaccaagaacaaccucgccuccugcuaccucaagcagggcaaguucaagcaggccgagacccucuacaaggagauccucacccgcgcccacgagcgcgaguucggcuccgucgacgacgagaacaagcccaucuggaugcacgccgaggagcgcgaggagugcaagggcaagcagaaggacggcaccuccuucggcgaguacggcggcugguacaaggccugcaaggucgacucccccaccgucaccaccacccucaagaaccucggcgcccucuaccgccgccagggcaaguucgaggccgccgagacccucgaggaggccgccaugcgcucccgcaagcagggccucgacaacguccacaagcagcgcgucgccgagguccucaacgaccccgagaacauggagaagcgccgcucccgcgagucccucaacgucgacgucgucaaguacgaguccggccccgacggcggcgaggaggucuccauguccgucgaguggaacggcgacggcaccggcucccucaagcgcuccggcuccuucuccaagcuccgcgccuccauccgccgcuccuccgagaagcucguccgcaagcucaagggcggcuccucccgcgaguccgagcccaagaaccccggcgccucccucgccgagccccucuucgucgagaacgacuccuccuccuccggccucgaggacgccaccgccaacuga

SEQ ID NO: 45098 - RNA, 1410 nt, Artificial Sequence
  derived and/or modified sequence opt2 from KLF10__Homo_sapiens__NP_001027453
auggaggagcgcauggagaugaucuccgagcgccccaaggaguccauguacuccuggaacaagaccgccgagaaguccgacuucgaggccgucgaggcccucauguccauguccugcuccuggaaguccgacuucaagaaguacgucgagaaccgccccgucacccccgucuccgaccucuccgaggaggagaaccuccuccccggcacccccgacuuccacaccauccccgccuucugccucaccccccccuacucccccuccgacuucgagcccucccaggucuccaaccucauggcccccgcccccuccaccguccacuucaagucccucuccgacaccgccaagccccacaucgccgcccccuucaaggaggaggagaagucccccgucuccgcccccaagcuccccaaggcccaggccaccuccgucauccgccacaccgccgacgcccagcucugcaaccaccagaccugccccaugaaggccgccuccauccucaacuaccagaacaacuccuuccgccgccgcacccaccucaacgucgaggccgcccgcaagaacauccccugcgccgccgucucccccaaccgcuccaagugcgagcgcaacaccgucgccgacgucgacgagaaggccuccgccgcccucuacgacuucuccguccccuccuccgagaccgucaucugccgcucccagcccgcccccgucuccccccagcagaaguccguccucgucuccccccccgccgucuccgccggcggcgucccccccaugcccgucaucugccagauggucccccuccccgccaacaaccccgucgucaccaccgucguccccuccaccccccccucccagccccccgccgucugcccccccgucgucuucaugggcacccagguccccaagggcgccgucauguucgucgucccccagcccgucguccaguccuccaagccccccgucgucucccccaacggcacccgccucucccccaucgcccccgcccccggcuucucccccuccgccgccaaggucaccccccagaucgacuccucccgcauccgcucccacaucugcucccaccccggcugcggcaagaccuacuucaaguccucccaccucaaggcccacacccgcacccacaccggcgagaagcccuucuccugcuccuggaagggcugcgagcgccgcuucgcccgcuccgacgagcucucccgccaccgccgcacccacaccggcgagaagaaguucgccugccccaugugcgaccgccgcuucaugcgcuccgaccaccucaccaagcacgcccgccgccaccucuccgccaagaagcuccccaacuggcagauggaggucuccaagcucaacgacaucgcccucccccccacccccgcccccacccaguga

SEQ ID NO: 45099 - RNA, 1539 nt, Artificial Sequence
  derived and/or modified sequence opt2 from KLF11__Homo_sapiens__NP_003588
augcacacccccgacuucgccggccccgacgacgcccgcgccgucgacaucauggacaucugcgaguccauccucgagcgcaagcgccacgacuccgagcgcuccaccugcuccauccucgagcagaccgacauggaggccgucgaggcccucgucugcauguccuccuggggccagcgcucccagaagggcgaccuccuccgcauccgcccccucacccccgucuccgacuccggcgacgucaccaccaccguccacauggacgccgccacccccgagcuccccaaggacuuccacucccucuccacccucugcaucacccccccccagucccccgaccucgucgagcccuccacccgcacccccgucuccccccaggucaccgacuccaaggccugcaccgccaccgacguccuccaguccuccgccgucgucgcccgcgcccucuccggcggcgccgagcgcggccuccucggccucgagcccguccccuccucccccugccgcgccaagggcaccuccgucauccgccacaccggcgagucccccgccgccugcuuccccaccauccagacccccgacugccgccucuccgacucccgcgagggcgaggagcagcuccucggccacuucgagacccuccaggacacccaccucaccgacucccuccucuccaccaaccucgucuccugccagcccugccuccacaaguccggcggccuccuccucaccgacaagggccagcaggccggcuggcccggcgccguccagaccugcucccccaagaacuacgagaacgaccucccccgcaagaccaccccccucaucuccgucuccguccccgccccccccguccucugccagaugauccccgucaccggccaguccuccaugcuccccgccuuccucaagccccccccccagcucuccgucggcaccguccgccccauccucgcccaggccgcccccgccccccagcccgucuucgucggccccgccgucccccagggcgccgucaugcucguccucccccagggcgcccuccccccccccgcccccugcgccgccaacgucauggccgccggcaacaccaagcuccucccccucgcccccgcccccgucuucaucaccuccucccagaacugcgucccccaggucgacuucucccgccgccgcaacuacgucugcuccuuccccggcugccgcaagaccuacuucaaguccucccaccucaaggcccaccuccgcacccacaccggcgagaagcccuucaacugcuccugggacggcugcgacaagaaguucgcccgcuccgacgagcucucccgccaccgccgcacccacaccggcgagaagaaguucgucugccccgucugcgaccgccgcuucaugcgcuccgaccaccucaccaagcacgcccgccgccacaugaccaccaagaagauccccggcuggcaggccgaggucggcaagcucaaccgcaucgccuccgccgagucccccggcuccccccucgucuccaugcccgccuccgccuga

SEQ ID NO: 45100 - RNA, 1209 nt, Artificial Sequence
  derived and/or modified sequence opt2 from KLF12__Homo_sapiens__XP_011533211
augaacauccacaugaagcgcaagaccaucaagaacaucaacaccuucgagaaccgcaugcucaugcucgacggcaugcccgccguccgcgucaagaccgagcuccucgaguccgagcagggcucccccaacguccacaacuaccccgacauggaggccgucccccuccuccucaacaacgucaagggcgagccccccgaggacucccucuccgucgaccacuuccagacccagaccgagcccgucgaccucuccaucaacaaggcccgcaccucccccaccgccgucuccuccucccccgucuccaugaccgccuccgccuccucccccuccuccaccuccaccuccuccuccuccuccucccgccucgccuccucccccaccgucaucaccuccgucuccuccgccuccuccuccuccaccguccucacccccggcccccucgucgccuccgccuccggcgucggcggccagcaguuccuccacaucauccaccccgucccccccuccucccccaugaaccuccaguccaacaagcucucccacguccaccgcauccccgucgucguccaguccguccccgucgucuacaccgccguccgcucccccggcaacgucaacaacaccaucgucgucccccuccucgaggacggccgcggccacggcaaggcccagauggacccccgcggccucuccccccgccaguccaaguccgacuccgacgacgacgaccuccccaacgucacccucgacuccgucaacgagaccggcuccaccgcccucuccaucgcccgcgccguccaggagguccaccccucccccgucucccgcguccgcggcaaccgcaugaacaaccagaaguuccccugcuccaucucccccuucuccaucgaguccacccgccgccagcgccgcuccgagucccccgacucccgcaagcgccgcauccaccgcugcgacuucgagggcugcaacaaggucuacaccaaguccucccaccucaaggcccaccgccgcacccacaccggcgagaagcccuacaagugcaccugggagggcugcaccuggaaguucgcccgcuccgacgagcucacccgccacuaccgcaagcacaccggcgucaagcccuucaagugcgccgacugcgaccgcuccuucucccgcuccgaccaccucgcccuccaccgccgccgccacaugcucgucuga

SEQ ID NO: 45101 - RNA, 867 nt, Artificial Sequence
  derived and/or modified sequence opt2 from KLF13__Homo_sapiens__NP_057079
auggccgccgccgccuacgucgaccacuucgccgccgagugccucgucuccauguccucccgcgccgucguccacggcccccgcgagggccccgagucccgccccgagggcgccgccgucgccgccacccccacccucccccgcgucgaggagcgccgcgacggcaaggacuccgccucccucuucgucgucgcccgcauccucgccgaccucaaccagcaggcccccgcccccgcccccgccgagcgccgcgagggcgccgccgcccgcaaggcccgcacccccugccgccuccccccccccgcccccgagcccaccucccccggcgccgagggcgccgccgccgccccccccucccccgccugguccgagcccgagcccgaggccggccucgagcccgagcgcgagcccggccccgccggcuccggcgagcccggccuccgccagcgcguccgccgcggccgcucccgcgccgaccucgaguccccccagcgcaagcacaagugccacuacgccggcugcgagaaggucuacggcaaguccucccaccucaaggcccaccuccgcacccacaccggcgagcgccccuucgccugcuccuggcaggacugcaacaagaaguucgcccgcuccgacgagcucgcccgccacuaccgcacccacaccggcgagaagaaguucuccugccccaucugcgagaagcgcuucaugcgcuccgaccaccucaccaagcacgcccgccgccacgccaacuuccaccccggcaugcuccagcgccgcggcggcggcucccgcaccggcucccucuccgacuacucccgcuccgacgccuccucccccaccaucucccccgccuccucccccuga

SEQ ID NO: 45102 - RNA, 972 nt, Artificial Sequence
  derived and/or modified sequence opt2 from KLF14__Homo_sapiens__NP_619638
auguccgccgccgucgccugccucgacuacuucgccgccgagugccucgucuccauguccgccggcgccgucguccaccgccgcccccccgaccccgagggcgccggcggcgccgccggcuccgaggucggcgccgccccccccgaguccgcccuccccggccccggcccccccggccccgccuccgucccccagcucccccagguccccgcccccucccccggcgccggcggcgccgccccccaccuccucgccgccuccgucugggccgaccuccgcggcuccuccggcgagggcuccugggagaacuccggcgaggccccccgcgccuccuccggcuucuccgaccccauccccugcuccguccagacccccugcuccgagcucgcccccgccuccggcgccgccgccgucugcgcccccgaguccuccuccgacgcccccgccguccccuccgcccccgccgcccccggcgcccccgccgccuccggcggcuucuccggcggcgcccucggcgccggccccgcccccgccgccgaccaggccccccgccgccgcuccgucacccccgccgccaagcgccaccagugccccuuccccggcugcaccaaggccuacuacaaguccucccaccucaagucccaccagcgcacccacaccggcgagcgccccuucuccugcgacuggcucgacugcgacaagaaguucacccgcuccgacgagcucgcccgccacuaccgcacccacaccggcgagaagcgcuucuccugcccccucugccccaagcaguucucccgcuccgaccaccucaccaagcacgcccgccgccaccccaccuaccaccccgacaugaucgaguaccgcggccgccgccgcaccccccgcaucgaccccccccucaccuccgaggucgaguccuccgccuccggcuccggccccggccccgcccccuccuucaccaccugccucuga

SEQ ID NO: 45103 - RNA, 1251 nt, Artificial Sequence
  derived and/or modified sequence opt2 from KLF15__Homo_sapiens__NP_054798
auggucgaccaccuccuccccgucgacgagaacuucuccucccccaagugccccgucggcuaccucggcgaccgccucgucggccgccgcgccuaccacaugcuccccucccccgucuccgaggacgacuccgacgccuccucccccugcuccugcuccucccccgacucccaggcccucugcuccugcuacggcggcggccucggcaccgagucccaggacuccauccucgacuuccuccucucccaggccacccucggcuccggcggcggcuccggcuccuccaucggcgccuccuccggccccgucgccuggggccccuggcgccgcgccgccgcccccgucaagggcgagcacuucugccuccccgaguucccccucggcgaccccgacgacgucccccgccccuuccagcccacccucgaggagaucgaggaguuccucgaggagaacauggagcccggcgucaaggagguccccgagggcaacuccaaggaccucgacgccugcucccagcucuccgccggcccccacaagucccaccuccaccccggcuccuccggccgcgagcgcugcucccccccccccggcggcgccuccgccggcggcgcccagggccccggcggcggccccacccccgacggccccauccccguccuccuccagauccagcccguccccgucaagcaggaguccggcaccggccccgccucccccggccaggcccccgagaacgucaaggucgcccagcuccucgucaacauccagggccagaccuucgcccucgucccccaggucguccccuccuccaaccucaaccuccccuccaaguucguccgcaucgcccccguccccaucgccgccaagcccgucggcuccggcccccucggccccggccccgccggccuccucaugggccagaaguuccccaagaaccccgccgccgagcucaucaagaugcacaagugcaccuuccccggcugcuccaagauguacaccaaguccucccaccucaaggcccaccuccgccgccacaccggcgagaagcccuucgccugcaccuggcccggcugcggcuggcgcuucucccgcuccgacgagcucucccgccaccgccgcucccacuccggcgucaagcccuaccagugccccgucugcgagaagaaguucgcccgcuccgaccaccucuccaagcacaucaagguccaccgcuucccccgcuccucccgcuccguccgcuccgucaacuga

SEQ ID NO: 45104 - RNA, 759 nt, Artificial Sequence
  derived and/or modified sequence opt2 from KLF16__Homo_sapiens__NP_114124
auguccgccgccgucgccugcgucgacuacuucgccgccgacguccucauggccaucuccuccggcgccgucguccaccgcggccgccccggccccgagggcgccggccccgccgccggccucgacguccgcgccgcccgccgcgaggccgccucccccggcacccccggcccccccccccccccccccgccgccuccggccccggccccggcgccgccgccgccccccaccuccucgccgccuccauccucgccgaccuccgcggcggccccggcgccgcccccggcggcgccucccccgccuccuccuccuccgccgccuccucccccuccuccggccgcgcccccggcgccgcccccuccgccgccgccaagucccaccgcugccccuuccccgacugcgccaaggccuacuacaaguccucccaccucaagucccaccuccgcacccacaccggcgagcgccccuucgccugcgacuggcagggcugcgacaagaaguucgcccgcuccgacgagcucgcccgccaccaccgcacccacaccggcgagaagcgcuucuccugcccccucugcuccaagcgcuucacccgcuccgaccaccucgccaagcacgcccgccgccaccccggcuuccaccccgaccuccuccgccgccccggcgcccgcuccaccucccccuccgacucccuccccugcucccucgccggcucccccgcccccucccccgcccccucccccgcccccgccggccucuga

SEQ ID NO: 45105 - RNA, 1089 nt, Artificial Sequence
  derived and/or modified sequence opt2 from KLF1__Homo_sapiens__NP_006554
auggccaccgccgagaccgcccuccccuccaucuccacccucaccgcccucggccccuuccccgacacccaggacgacuuccucaagugguggcgcuccgaggaggcccaggacaugggccccggcccccccgaccccaccgagcccccccuccacgucaaguccgaggaccagcccggcgaggaggaggacgacgagcgcggcgccgacgccaccugggaccucgaccuccuccucaccaacuucuccggccccgagcccggcggcgccccccagaccugcgcccucgcccccuccgaggccuccggcgcccaguacccccccccccccgagacccucggcgccuacgccggcggccccggccucgucgccggccuccucggcuccgaggaccacuccggcuggguccgccccgcccuccgcgcccgcgcccccgacgccuucgucggccccgcccucgcccccgcccccgcccccgagcccaaggcccucgcccuccagcccgucuaccccggccccggcgccggcuccuccggcggcuacuucccccgcaccggccucuccguccccgccgccuccggcgcccccuacggccuccucuccggcuaccccgccauguaccccgccccccaguaccagggccacuuccagcucuuccgcggccuccagggccccgcccccggccccgccaccucccccuccuuccucuccugccucggccccggcaccgucggcaccggccucggcggcaccgccgaggaccccggcgucaucgccgagaccgcccccuccaagcgcggccgccgcuccugggcccgcaagcgccaggccgcccacaccugcgcccaccccggcugcggcaaguccuacaccaaguccucccaccucaaggcccaccuccgcacccacaccggcgagaagcccuacgccugcaccugggagggcugcggcuggcgcuucgcccgcuccgacgagcucacccgccacuaccgcaagcacaccggccagcgccccuuccgcugccagcucugcccccgcgccuucucccgcuccgaccaccucgcccuccacaugaagcgccaccucuga

SEQ ID NO: 45106 - RNA, 1068 nt, Artificial Sequence
  derived and/or modified sequence opt2 from KLF2__Homo_sapiens__NP_057354
auggcccucuccgagcccauccuccccuccuucuccaccuucgccucccccugccgcgagcgcggccuccaggagcgcuggccccgcgccgagcccgaguccggcggcaccgacgacgaccucaacuccguccucgacuucauccucuccaugggccucgacggccucggcgccgaggccgcccccgagccccccccccccccccccccccccgccuucuacuaccccgagcccggcgcccccccccccuacuccgcccccgccggcggccucgucuccgagcuccuccgccccgagcucgacgccccccucggccccgcccuccacggccgcuuccuccucgccccccccggccgccucgucaaggccgagccccccgaggccgacggcggcggcggcuacggcugcgcccccggccucacccgcggcccccgcggccucaagcgcgagggcgcccccggccccgccgccuccugcaugcgcggccccggcggccgccccccccccccccccgacacccccccccucucccccgacggccccgcccgccuccccgcccccggcccccgcgccuccuuccccccccccuucggcggccccggcuucggcgcccccggccccggccuccacuacgccccccccgccccccccgccuucggccucuucgacgacgccgccgccgccgccgccgcccucggccucgccccccccgccgcccgcggccuccucaccccccccgccuccccccucgagcuccucgaggccaagcccaagcgcggccgccgcuccuggccccgcaagcgcaccgccacccacaccugcuccuacgccggcugcggcaagaccuacaccaaguccucccaccucaaggcccaccuccgcacccacaccggcgagaagcccuaccacugcaacugggacggcugcggcuggaaguucgcccgcuccgacgagcucacccgccacuaccgcaagcacaccggccaccgccccuuccagugccaccucugcgaccgcgccuucucccgcuccgaccaccucgcccuccacaugaagcgccacauguga

SEQ ID NO: 45107 - RNA, 1038 nt, Artificial Sequence
  derived and/or modified sequence opt2 from KLF3__Homo_sapiens__NP_057615
augcucauguucgaccccguccccgucaagcaggaggccauggaccccgucuccgucuccuaccccuccaacuacauggaguccaugaagcccaacaaguacggcgucaucuacuccaccccccuccccgagaaguucuuccagacccccgagggccucucccacggcauccagauggagcccgucgaccucaccgucaacaagcgcuccuccccccccuccgccggcaacucccccuccucccucaaguuccccuccucccaccgccgcgccucccccggccucuccaugcccuccuccuccccccccaucaagaaguacuccccccccucccccggcguccagcccuucggcgucccccucuccaugccccccgucauggccgccgcccucucccgccacggcauccgcucccccggcauccuccccgucauccagcccgucgucguccagcccguccccuucauguacaccucccaccuccagcagccccucauggucucccucuccgaggagauggagaacuccuccuccuccaugcagguccccgucaucgaguccuacgagaagcccaucucccagaagaagaucaagaucgagcccggcaucgagccccagcgcaccgacuacuaccccgaggagaugucccccccccucaugaacuccgucucccccccccaggcccuccuccaggagaaccaccccuccgucaucguccagcccggcaagcgcccccuccccgucgagucccccgacacccagcgcaagcgccgcauccaccgcugcgacuacgacggcugcaacaaggucuacaccaaguccucccaccucaaggcccaccgccgcacccacaccggcgagaagcccuacaagugcaccugggagggcugcaccuggaaguucgcccgcuccgacgagcucacccgccacuuccgcaagcacaccggcaucaagcccuuccagugccccgacugcgaccgcuccuucucccgcuccgaccaccucgcccuccaccgcaagcgccacaugcucgucuga

SEQ ID NO: 45108 - RNA, 1440 nt, Artificial Sequence
  derived and/or modified sequence opt2 from KLF4__Homo_sapiens__NP_004226
augcgccagccccccggcgaguccgacauggccgucuccgacgcccuccuccccuccuucuccaccuucgccuccggccccgccggccgcgagaagacccuccgccaggccggcgcccccaacaaccgcuggcgcgaggagcucucccacaugaagcgccucccccccguccuccccggccgccccuacgaccucgccgccgccaccgucgccaccgaccucgaguccggcggcgccggcgccgccugcggcggcuccaaccucgccccccucccccgccgcgagaccgaggaguucaacgaccuccucgaccucgacuucauccucuccaacucccucacccacccccccgaguccgucgccgccaccgucuccuccuccgccuccgccuccuccuccuccucccccuccuccuccggccccgccuccgcccccuccaccugcuccuucaccuaccccauccgcgccggcaacgaccccggcgucgcccccggcggcaccggcggcggccuccucuacggccgcgaguccgcccccccccccaccgcccccuucaaccucgccgacaucaacgacgucucccccuccggcggcuucgucgccgagcuccuccgccccgagcucgaccccgucuacauccccccccagcagccccagccccccggcggcggccucaugggcaaguucguccucaaggccucccucuccgcccccggcuccgaguacggcucccccuccgucaucuccgucuccaagggcucccccgacggcucccaccccgucgucgucgcccccuacaacggcggccccccccgcaccugccccaagaucaagcaggaggccgucuccuccugcacccaccucggcgccggccccccccucuccaacggccaccgccccgccgcccacgacuucccccucggccgccagcuccccucccgcaccacccccacccucggccucgaggagguccucuccucccgcgacugccaccccgcccucccccucccccccggcuuccacccccaccccggccccaacuaccccuccuuccuccccgaccagaugcagccccagguccccccccuccacuaccaggagcucaugccccccggcuccugcaugcccgaggagcccaagcccaagcgcggccgccgcuccuggccccgcaagcgcaccgccacccacaccugcgacuacgccggcugcggcaagaccuacaccaaguccucccaccucaaggcccaccuccgcacccacaccggcgagaagcccuaccacugcgacugggacggcugcggcuggaaguucgcccgcuccgacgagcucacccgccacuaccgcaagcacaccggccaccgccccuuccagugccagaagugcgaccgcgccuucucccgcuccgaccaccucgcccuccacaugaagcgccacuucuga

SEQ ID NO: 45109 - RNA, 1101 nt, Artificial Sequence
  derived and/or modified sequence opt2 from KLF5__Homo_sapiens__NP_001273747
auggagaaguaccucaccccccagcucccccccguccccaucauccccgagcacaagaaguaccgccgcgacuccgccuccgucgucgaccaguucuucaccgacaccgagggccuccccuacuccaucaacaugaacgucuuccuccccgacaucacccaccuccgcaccggccucuacaagucccagcgccccugcgucacccacaucaagaccgagcccgucgccaucuucucccaccaguccgagaccaccgcccccccccccgcccccacccaggcccuccccgaguucaccuccaucuucuccucccaccagaccgccgcccccgaggucaacaacaucuucaucaagcaggagcuccccacccccgaccuccaccucuccguccccacccagcagggccaccucuaccagcuccucaacacccccgaccucgacaugcccuccuccaccaaccagaccgccgccauggacacccucaacgucuccauguccgccgccauggccggccucaacacccacaccuccgccgucccccagaccgccgucaagcaguuccagggcaugccccccugcaccuacaccaugcccucccaguuccucccccagcaggccaccuacuucccccccuccccccccuccuccgagcccggcucccccgaccgccaggccgagaugcuccagaaccucacccccccccccuccuacgccgccaccaucgccuccaagcucgccauccacaaccccaaccuccccaccacccuccccgucaacucccagaacauccagcccguccgcuacaaccgccgcuccaaccccgaccucgagaagcgccgcauccacuacugcgacuaccccggcugcaccaaggucuacaccaaguccucccaccucaaggcccaccuccgcacccacaccggcgagaagcccuacaagugcaccugggagggcugcgacuggcgcuucgcccgcuccgacgagcucacccgccacuaccgcaagcacaccggcgccaagcccuuccagugcggcgucugcaaccgcuccuucucccgcuccgaccaccucgcccuccacaugaagcgccaccagaacuga

SEQ ID NO: 45110 - RNA, 714 nt, Artificial Sequence
  derived and/or modified sequence opt2 from KLF6__Homo_sapiens__NP_001153597
auggacguccuccccaugugcuccaucuuccaggagcuccagaucguccacgagaccggcuacuucuccgcccuccccucccucgaggaguacuggcagcagaccugccucgagcucgagcgcuaccuccaguccgagcccugcuacgucuccgccuccgagaucaaguucgacucccaggaggaccucuggaccaagaucauccucgcccgcgagaagaaggaggaguccgagcucaagaucuccuccuccccccccgaggacacccucaucucccccuccuucugcuacaaccucgagaccaacucccucaacuccgacgucuccuccgaguccuccgacuccuccgaggagcucucccccaccgccaaguucaccuccgaccccaucggcgagguccucgucuccuccggcaagcucuccuccuccgucaccuccaccccccccuccucccccgagcucucccgcgagcccucccagcucuggggcugcguccccggcgagcuccccucccccggcaagguccgcuccggcaccuccggcaagcccggcgacaagggcaacggcgacgccucccccgacggccgccgccgcguccaccgcugccacuucaacggcugccgcaaggucuacaccaaguccucccaccucaaggcccaccagcgcacccacaccggcgucuuccccggccucaccaccuggcccugcaccuga

SEQ ID NO: 45111 - RNA, 693 nt, Artificial Sequence
  derived and/or modified sequence opt2 from KLF7__Homo_sapiens__NP_001257871
auggacguccucgccuccuacuccaucuuccaggagcuccagcucguccacgacaccggcuacuucuccgcccuccccucccucgaggagaccuggcagcagaccugccucgagcucgagcgcuaccuccagaccgagccccgccgcaucuccgagaccuucggcgaggaccucgacugcuuccuccacgccucccccccccccugcaucgaggaguccuuccgccgccucgacccccuccuccuccccgucgaggccgccaucugcgagaaguccuccgccgucgacauccuccucucccgcgacaagcuccucuccgagaccugccucucccuccagcccgccuccuccucccucgacuccuacaccgccgucaaccaggcccagcucaacgccgucaccucccucaccccccccuccucccccgagcucucccgccaccucgucaagaccucccagacccucuccgccgucgacggcaccgucacccucaagcucgucgccaagaaggccgcccucuccuccgucaagguccgcucccucaucuccgcccacggccgcgacgucuccggcguccuccacgaggccauguccucccgcggcaccaccggcaacacccagguccagucccccuccaacgccaccaccgccaccggcgucuuccccggccucaccauccuccccuccaccuga

SEQ ID NO: 45112 - RNA, 1080 nt, Artificial Sequence
  derived and/or modified sequence opt2 from KLF8__Homo_sapiens__XP_005262036
auggucgacauggacaagcucaucaacaaccucgagguccagcucaacuccgagggcggcuccaugcaggucuucaagcaggucaccgccuccguccgcaaccgcgacccccccgagaucgaguaccgcuccaacaugaccucccccacccuccucgacgccaaccccauggagaaccccgcccucuucaacgacaucaagaucgagccccccgaggagcuccucgccuccgacuucucccucccccaggucgagcccgucgaccucuccuuccacaagcccaaggccccccuccagcccgccuccaugcuccaggcccccauccgcccccccaagccccaguccuccccccagacccucgucgucuccaccuccaccuccgacauguccaccuccgccaacauccccaccguccucacccccggcuccguccucaccuccucccaguccaccggcucccagcagauccuccacgucauccacaccauccccuccgucucccuccccaacaagaugggcggccucaagaccauccccgucgucguccagucccuccccauggucuacaccacccuccccgccgacggcggccccgccgccaucaccgucccccucaucggcggcgacggcaagaacgccggcuccgucaaggucgaccccaccuccauguccccccucgagauccccuccgacuccgaggaguccaccaucgaguccggcuccuccgcccuccagucccuccagggccuccagcaggagcccgccgccauggcccagaugcagggcgaggagucccucgaccucaagcgccgccgcauccaccagugcgacuucgccggcugcuccaaggucuacaccaaguccucccaccucaaggcccaccgccgcauccacaccggcgagaagcccuacaagugcaccugggacggcugcuccuggaaguucgcccgcuccgacgagcucacccgccacuuccgcaagcacaccggcaucaagcccuuccgcugcaccgacugcaaccgcuccuucucccgcuccgaccaccucucccuccaccgccgccgccacgacaccauguga

SEQ ID NO: 45113 - RNA, 735 nt, Artificial Sequence
  derived and/or modified sequence opt2 from KLF9__Homo_sapiens__NP_001197
auguccgccgccgccuacauggacuucgucgccgcccagugccucgucuccaucuccaaccgcgccgccguccccgagcacggcgucgcccccgacgccgagcgccuccgccuccccgagcgcgaggucaccaaggagcacggcgaccccggcgacaccuggaaggacuacugcacccucgucaccaucgccaagucccuccucgaccucaacaaguaccgccccauccagacccccuccgucugcuccgacucccucgagucccccgacgaggacaugggcuccgacuccgacgucaccaccgaguccggcuccucccccucccacucccccgaggagcgccaggaccccggcuccgcccccuccccccucucccuccuccaccccggcgucgccgccaagggcaagcacgccuccgagaagcgccacaagugccccuacuccggcugcggcaaggucuacggcaaguccucccaccucaaggcccacuaccgcguccacaccggcgagcgccccuuccccugcaccuggcccgacugccucaagaaguucucccgcuccgacgagcucacccgccacuaccgcacccacaccggcgagaagcaguuccgcugcccccucugcgagaagcgcuucaugcgcuccgaccaccucaccaagcacgcccgccgccacaccgaguuccaccccuccaugaucaagcgcuccaagaaggcccucgccaacgcccucuga

SEQ ID NO: 45114 - RNA, 1221 nt, Artificial Sequence
  derived and/or modified sequence opt2 from KLHDC1__Homo_sapiens__NP_751943
auggccgacucccagcucuucugcgucgccgaggagcgcuccggccacugcgccgucgucgacggcaacuuccucuacgucuggggcggcuacgucuccaucgaggacaacgaggucuaccuccccaacgacgagaucuggaccuacgacaucgacuccggccucuggcgcaugcaccucauggagggcgagcuccccgccuccauguccggcuccugcggcgccugcaucaacggcaagcucuacaucuucggcggcuacgacgacaagggcuacuccaaccgccucuacuucgucaaccuccgcacccgcgacgagaccuacaucugggagaagaucaccgacuucgagggccagccccccaccccccgcgacaagcucuccugcugggucuacaaggaccgccucaucuacuucggcggcuacggcugccgccgccacuccgagcuccaggacugcuucgacguccacgacgccuccugggaggagcagaucuucuggggcuggcacaacgacguccacaucuucgacaccaagacccagaccugguuccagcccgagaucaagggcggcguccccccccagccccgcgccgcccacaccugcgccguccucggcaacaagggcuacaucuucggcggccgcguccuccagacccgcaugaacgaccuccacuaccucaaccucgacaccuggaccugguccggccgcaucaccaucaacggcgagucccccaagcaccgcuccuggcacacccucacccccaucgccgacgacaagcucuuccucugcggcggccucuccgccgacaacaucccccucuccgacggcuggauccacaacgucaccaccaacugcuggaagcagcucacccaccuccccaagacccgcccccgccucuggcacaccgccugccucggcaaggagaacgagaucauggucuucggcggcuccaaggacgaccuccucgcccucgacaccggccacugcaacgaccuccucaucuuccagacccagcccuacucccuccuccgcuccugccucgacugcaucggcaagaacuccaucaugcucgagucccagaucucccuccucccccccaagcuccuccagcagguccucaagaagaucaccuucugggccgccgccaaccaccgcgaggagcagcgcguccagaaggaggagaccgagaacaaguaccaguggaucuccuccaacuga

SEQ ID NO: 45115 - RNA, 1221 nt, Artificial Sequence
  derived and/or modified sequence opt2 from KLHDC2__Homo_sapiens__NP_055130
auggccgacggcaacgaggaccuccgcgccgacgaccuccccggccccgccuucgaguccuacgaguccauggagcucgccugccccgccgagcgcuccggccacgucgccgucuccgacggccgccacauguucgucuggggcggcuacaaguccaaccagguccgcggccucuacgacuucuaccucccccgcgaggagcucuggaucuacaacauggagaccggccgcuggaagaagaucaacaccgagggcgacgucccccccuccauguccggcuccugcgccgucugcgucgaccgcguccucuaccucuucggcggccaccacucccgcggcaacaccaacaaguucuacaugcucgacucccgcuccaccgaccgcguccuccagugggagcgcaucgacugccagggcaucccccccuccuccaaggacaagcucggcgucugggucuacaagaacaagcucaucuucuucggcggcuacggcuaccuccccgaggacaagguccucggcaccuucgaguucgacgagaccuccuucuggaacuccucccacccccgcggcuggaacgaccacguccacauccucgacaccgagaccuucaccuggucccagcccaucaccaccggcaaggcccccuccccccgcgccgcccacgccugcgccaccgucggcaaccgcggcuucgucuucggcggccgcuaccgcgacgcccgcaugaacgaccuccacuaccucaaccucgacaccugggaguggaacgagcucaucccccagggcaucugccccgucggccgcuccuggcacucccucacccccgucuccuccgaccaccucuuccucuucggcggcuucaccaccgacaagcagccccucuccgacgccuggaccuacugcaucuccaagaacgaguggauccaguucaaccaccccuacaccgagaagccccgccucuggcacaccgccugcgccuccgacgagggcgaggucaucgucuucggcggcugcgccaacaaccuccucguccaccaccgcgccgcccacuccaacgagauccucaucuucuccguccagcccaagucccucguccgccucucccucgaggccgucaucugcuucaaggagaugcucgccaacuccuggaacugccuccccaagcaccuccuccacuccgucaaccagcgcuucggcuccaacaacaccuccggcuccuga

SEQ ID NO: 45116 - RNA, 1053 nt, Artificial Sequence
  derived and/or modified sequence opt2 from KLHDC8A__Homo_sapiens__XP_006711492
auggagguccccaacgucaaggacuuccaguggaagcgccucgccccccuccccucccgccgcgucuacugcucccuccucgagaccggcggccaggucuacgccaucggcggcugcgacgacaacggcguccccauggacugcuucgaggucuacucccccgaggccgaccaguggaccgcccucccccgccuccccaccgcccgcgccggcgucgccgucaccgcccucggcaagcgcaucauggucaucggcggcgucggcaccaaccagcucccccucaaggucgucgagauguacaacaucgacgagggcaaguggaagaagcgcuccaugcuccgcgaggccgccaugggcaucuccgucaccgccaaggacuaccgcgucuacgccgccggcggcaugggccucgaccuccgcccccacaaccaccuccagcacuacgacaugcucaaggacaugugggucucccucgcccccaugcccaccccccgcuacgccgccaccuccuuccuccgcggcuccaagaucuacguccucggcggccgccaguccaaguacgccgucaacgccuucgaggucuucgacaucgagacccgcuccuggaccaaguuccccaacauccccuacaagcgcgccuucuccuccuucgucacccucgacaaccaccucuacucccucggcggccuccgccagggccgccucuaccgccagcccaaguuccuccgcaccauggacgucuucgacauggagcagggcggcuggcucaagauggagcgcuccuucuuccucaagaagcgccgcgccgacuucgucgccggcucccucuccggccgcgucaucgucgccggcggccucggcaaccagcccaccguccucgagaccgccgaggccuuccaccccggcaagaacaagugggagauccuccccgccaugcccaccccccgcugcgccugcuccuccaucgucgucaagaacugccuccucgccgucggcggcgucaaccagggccucuccgacgccgucgaggcccucugcgucuccgacuccuga

SEQ ID NO: 45117 - RNA, 1065 nt, Artificial Sequence
  derived and/or modified sequence opt2 from KLHDC8B__Homo_sapiens__NP_775817
auguccgccggcggcggccgcgccuucgccuggcaggucuucccccccaugcccaccugccgcgucuacggcaccgucgcccaccaggacggccaccuccucguccucggcggcugcggccgcgccggccucccccucgacaccgccgagacccucgacauggccucccacaccuggcucgcccucgccccccuccccaccgcccgcgccggcgccgccgccgucguccucggcaagcagguccucgucgucggcggcgucgacgagguccagucccccgucgccgccgucgaggccuuccucauggacgagggccgcugggagcgccgcgccacccucccccaggccgccaugggcgucgccaccgucgagcgcgacggcauggucuacgcccucggcggcaugggccccgacaccgccccccaggcccagguccgcgucuacgagccccgccgcgacugcuggcucucccuccccuccaugcccacccccugcuacggcgccuccaccuuccuccacggcaacaagaucuacguccucggcggccgccagggcaagcuccccgucaccgccuucgaggccuucgaccucgaggcccgcaccuggacccgccaccccucccuccccucccgccgcgccuucgccggcugcgccauggccgagggcuccgucuucucccucggcggccuccagcagcccggcccccacaacuucuacucccgcccccacuucgucaacaccgucgagauguucgaccucgagcacggcuccuggaccaagcucccccgcucccuccgcaugcgcgacaagcgcgccgacuucgucgucggcucccucggcggccacaucgucgccaucggcggccucggcaaccagcccugcccccucggcuccgucgaguccuucucccucgcccgccgccgcugggaggcccuccccgccaugcccaccgcccgcugcuccugcuccucccuccaggccggcccccgccucuucgucaucggcggcgucgcccagggccccucccaggccgucgaggcccucugccuccgcgacggcgucuga

SEQ ID NO: 45118 - RNA, 1827 nt, Artificial Sequence
  derived and/or modified sequence opt2 from KLHL10__Homo_sapiens__NP_689680
auggagauggaguccgccgccgccuccacccgcuuccaccagccccacauggagcgcaagauguccgccauggccugcgagaucuucaacgagcuccgccucgagggcaagcucugcgacgucgucaucaaggucaacggcuucgaguucuccgcccacaagaacauccucugcuccugcuccuccuacuuccgcgcccucuucaccuccggcuggaacaacaccgagaagaaggucuacaacauccccggcaucucccccgacaugaugaagcucaucaucgaguacgccuacacccgcaccguccccaucacccccgacaacgucgagaagcuccucgccgccgccgaccaguucaacaucaugggcaucguccgcggcugcugcgaguuccucaaguccgagcucugccucgacaacugcaucggcaucugcaaguucaccgacuacuacuacugccccgagcuccgccagaaggccuacauguucauccuccacaacuucgaggagauggucaaggucuccgccgaguuccucgagcucuccgucaccgagcucaaggacaucaucgagaaggacgagcucaacgucaagcaggaggacgccgucuucgaggccauccucaaguggaucucccacgacccccagaaccgcaagcagcacaucuccauccuccuccccaagguccgccucgcccucaugcacgccgaguacuucaugaacaacgucaagaugaacgacuacgucaaggacuccgaggagugcaagcccgucaucaucaacgcccucaaggccauguacgaccucaacaugaacggccccuccaacuccgacuucaccaacccccucacccgcccccgccuccccuacgccauccucuucgccaucggcggcugguccggcggcucccccaccaacgccaucgaggccuacgacgcccgcgccgaccgcugggucaacgucaccugcgaggaggaguccccccgcgccuaccacggcgccgccuaccucaagggcuacgucuacaucaucggcggcuucgacuccgucgacuacuucaacuccgucaagcgcuucgaccccgucaagaagaccuggcaccaggucgcccccaugcacucccgccgcugcuacgucuccgucaccguccucggcaacuucaucuacgccaugggcggcuucgacggcuacguccgccucaacaccgccgagcgcuacgagcccgagaccaaccaguggacccucaucgcccccaugcacgagcagcgcuccgacgccuccgccaccacccucuacggcaaggucuacaucugcggcggcuucaacggcaacgagugccucuucaccgccgaggucuacaacaccgaguccaaccaguggaccgucaucgcccccaugcgcucccgccgcuccggcaucggcgucaucgccuacggcgagcacgucuacgccgucggcggcuucgacggcgccaaccgccuccgcuccgccgaggccuacucccccgucgccaacaccuggcgcaccauccccaccauguucaacccccgcuccaacuucggcaucgaggucgucgacgaccuccucuucgucgucggcggcuucaacggcuucaccaccaccuucaacgucgagugcuacgacgagaagaccgacgagugguacgacgcccacgacauguccaucuaccgcuccgcccucuccugcugcgucguccccggccucgccaacgucgaggaguacgccgcccgccgcgacaacuuccccggccucgcccuccgcgacgaggucaaguacuccgccuccaccuccacccuccccgucuga

SEQ ID NO: 45119 - RNA, 1821 nt, Artificial Sequence
  derived and/or modified sequence opt2 from KLHL12__Homo_sapiens__NP_001289980
auggacgucaacaaguucgaggccuccgucggcuuccucgacgucaagaaguuccucuccaccuggaagcuccagaacccccgcacccacuucguccucuccccccacugcuucaugggcggcaucauggcccccaaggacaucaugaccaacacccacgccaaguccauccucaacuccaugaacucccuccgcaaguccaacacccucugcgacgucacccuccgcgucgagcagaaggacuuccccgcccaccgcaucguccucgccgccugcuccgacuacuucugcgccauguucaccuccgagcucuccgagaagggcaagcccuacgucgacauccagggccucaccgccuccaccauggagauccuccucgacuucgucuacaccgagaccguccacgucaccgucgagaacguccaggagcuccuccccgccgccugccuccuccagcucaagggcgucaagcaggccugcugcgaguuccucgagucccagcucgaccccuccaacugccucggcauccgcgacuucgccgagacccacaacugcgucgaccucaugcaggccgccgaggucuucucccagaagcacuuccccgaggucguccagcacgaggaguucauccuccucucccagggcgaggucgagaagcucaucaagugcgacgagauccaggucgacuccgaggagcccgucuucgaggccgucaucaacugggucaagcacgccaagaaggagcgcgaggagucccuccccaaccuccuccaguacguccgcaugccccuccucaccccccgcuacaucaccgacgucaucgacgccgagcccuucauccgcugcucccuccagugccgcgaccucgucgacgaggccaagaaguuccaccuccgccccgagcuccgcucccagaugcagggcccccgcacccgcgcccgccucggcgccaacgagguccuccucgucgucggcggcuucggcucccagcagucccccaucgacgucgucgagaaguacgaccccaagacccaggagugguccuuccuccccuccaucacccgcaagcgccgcuacgucgccuccgucucccuccacgaccgcaucuacgucaucggcggcuacgacggccgcucccgccucuccuccgucgagugccucgacuacaccgccgacgaggacggcgucugguacuccgucgcccccaugaacguccgccgcggccucgccggcgccaccacccucggcgacaugaucuacgucuccggcggcuucgacggcucccgccgccacaccuccauggagcgcuacgaccccaacaucgaccagugguccaugcucggcgacaugcagaccgcccgcgagggcgccggccucgucgucgccuccggcgucaucuacugccucggcggcuacgacggccucaacauccucaacuccgucgagaaguacgacccccacaccggccacuggaccaacgucacccccauggccaccaagcgcuccggcgccggcgucgcccuccucaacgaccacaucuacgucgucggcggcuucgacggcaccgcccaccucuccuccgucgaggccuacaacauccgcaccgacuccuggaccaccgucaccuccaugaccaccccccgcugcuacgucggcgccaccguccuccgcggccgccucuacgccaucgccggcuacgacggcaacucccuccucuccuccaucgagugcuacgaccccaucaucgacuccugggaggucgucaccuccaugggcacccagcgcugcgacgccggcgucugcguccuccgcgagaaguga

SEQ ID NO: 45120 - RNA, 2064 nt, Artificial Sequence
  derived and/or modified sequence opt2 from KLHL1__Homo_sapiens__NP_001273654
auguccggcuccggccgcaaggacuucgacgucaagcacauccuccgccuccgcuggaagcucuucucccaccccucccccuccaccggcggccccgccggcggcggcugccuccagcaggacggcuccggcuccuucgagcacuggggccccucccagucccgccuccucaagucccaggagcgcuccggcgucuccaccuucuggaagaagcccuccuccuccuccuccuccuccuccucccccuccuccuccuccuccuccuucaacccccucaacggcacccuccuccccgucgccacccgccuccagcagggcgcccccggccagggcacccagcagcccgcccgcacccucuucuacgucgagucccucgaggaggaggucguccccggcauggacuuccccggcccccacgagaagggccucguccuccaggagcucaaggucgagcccgacaacuccucccaggccaccggcgagggcugcggccaccgccucguccucuccuccgucuccgacuacuucgccgccauguucaccuccgacgucugcgaggccaagcaggaggagaucaagauggagggcaucgaccccaacgcccucugggaccucguccaguucgccuacaccggcugccucgagcucaaggaggacaccaucgagaaccuccucgccgccgccugccuccuccagcucccccaggucgucgaggucugcugccacuuccucaugaagcuccuccaccccuccaacugccucggcauccgcgccuucgccgacgcccagggcugcaucgagcucaugaaggucgcccacuccuacaccauggagaacaucauggaggucauccgcaaccaggaguuccuccuccuccccgccgaggagcuccacaagcuccucgccuccgacgacgucaacguccccgacgaggagaccaucuuccacgcccucaugaugugggucaaguacgacaugcagucccgcugcaacgaccucuccaugcuccucgccuucauccgccucccccuccuccccccccagauccucgccgaccucgagaaccacgcccucuucaagaacgaccucgagugccagaagcucauccucgaggccaugaaguaccaccuccuccccgagcgccgcacccucaugcaguccccccgcaccaagccccgcaaguccaccgucggcacccucuacgccgucggcggcauggacaacaacaagggcgccaccaccaucgagaaguacgaccuccgcaccaaccucuggauccaggccggcaugaugaacggccgccgccuccaguucggcgucgccgucaucgacgacaagcucuucgucaucggcggccgcgacggccucaagacccucaacaccgucgagugcuacaaccccaagaccaagaccuggaccguccucccccccauguccacccaccgccacggccucggcgucaccguccucgagggccccaucuacgccgucggcggccacgacggcugguccuaccucaacaccgucgagcgcugggacccccagucccagcaguggaccuucgucgccuccauguccaucgcccgcuccaccgucggcgucgccgcccucaacggcaagcucuacuccgucggcggccgcgacggcuccuccugccucuccuccauggaguacuacgacccccacaccaacaaguggaacaugugcgcccccaugugcaagcgccgcggcggcgucggcgucgccaccugcgacggcuuccucuacgccgucggcggccacgacgcccccgccuccaaccacugcucccgccuccucgacuacgucgagcgcuacgaccccaagaccgacaccuggaccauggucgccccccucuccaugccccgcgacgccgucggcgucugccuccucggcgaccgccucuacgccgucggcggcuacgacggccagaccuaccucaacaccauggaguccuacgacccccagaccaacgaguggacccagauggccucccucaacaucggccgcgccggcgccugcgucgucgucaucaagcagcccuga

SEQ ID NO: 45121 - RNA, 1830 nt, Artificial Sequence
  derived and/or modified sequence opt2 from KLHL20__Homo_sapiens__NP_055273
auggagggcaagcccaugcgccgcugcaccaacauccgccccggcgagaccggcauggacgucaccucccgcugcacccucggcgaccccaacaagcuccccgagggcgucccccagcccgcccgcaugcccuacaucuccgacaagcacccccgccagacccucgaggucaucaaccuccuccgcaagcaccgcgagcucugcgacgucguccucgucgucggcgccaagaagaucuacgcccaccgcgucauccucuccgccugcucccccuacuuccgcgccauguucaccggcgagcucgccgagucccgccagaccgaggucgucauccgcgacaucgacgagcgcgccauggagcuccucaucgacuucgccuacaccucccagaucaccgucgaggagggcaacguccagacccuccuccccgccgccugccuccuccagcucgccgagauccaggaggccugcugcgaguuccucaagcgccagcucgaccccuccaacugccucggcauccgcgccuucgccgacacccacuccugccgcgagcuccuccgcaucgccgacaaguucacccagcacaacuuccaggaggucauggaguccgaggaguucaugcuccuccccgccaaccagcucaucgacaucaucuccuccgacgagcucaacguccgcuccgaggagcaggucuucaacgccgucauggccugggucaaguacuccauccaggagcgccgcccccagcucccccagguccuccagcacguccgccucccccuccucucccccaaguuccucgucggcaccgucggcuccgacccccucaucaaguccgacgaggagugccgcgaccucgucgacgaggccaagaacuaccuccuccucccccaggagcgcccccucaugcagggcccccgcacccgcccccgcaagcccauccgcugcggcgagguccucuucgccgucggcggcuggugcuccggcgacgccaucuccuccgucgagcgcuacgacccccagaccaacgaguggcgcauggucgccuccauguccaagcgccgcugcggcgucggcgucuccguccucgacgaccuccucuacgccgucggcggccacgacggcuccuccuaccucaacuccgucgagcgcuacgaccccaagaccaaccagugguccuccgacgucgcccccaccuccaccugccgcaccuccgucggcgucgccguccucggcggcuuccucuacgccgucggcggccaggacggcgucuccugccucaacaucgucgagcgcuacgaccccaaggagaacaaguggacccgcgucgccuccauguccacccgccgccucggcgucgccgucgccguccucggcggcuuccucuacgccgucggcggcuccgacggcaccuccccccucaacaccgucgagcgcuacaacccccaggagaaccgcuggcacaccaucgcccccaugggcacccgccgcaagcaccucggcugcgccgucuaccaggacaugaucuacgccgucggcggccgcgacgacaccaccgagcucuccuccgccgagcgcuacaacccccgcaccaaccaguggucccccgucgucgccaugaccucccgccgcuccggcgucggccucgccgucgucaacggccagcucauggccgucggcggcuucgacggcaccaccuaccucaagaccaucgaggucuucgaccccgacgccaacaccuggcgccucuacggcggcaugaacuaccgccgccucggcggcggcgucggcgucaucaagaugacccacugcgagucccacaucugguga

SEQ ID NO: 45122 - RNA, 1770 nt, Artificial Sequence
  derived and/or modified sequence opt2 from KLHL25__Homo_sapiens__NP_071925
auguccgucuccguccacgagacccgcaagucccgcuccuccaccggcuccaugaacgucacccucuuccacaaggccucccaccccgacugcguccucgcccaccucaacacccuccgcaagcacugcauguucaccgacgucacccucugggccggcgaccgcgccuuccccugccaccgcgccguccucgccgccuccucccgcuacuucgaggccauguucucccacggccuccgcgagucccgcgacgacaccgucaacuuccaggacaaccuccaccccgagguccucgagcuccuccucgacuucgccuacuccucccgcaucgccaucaacgaggagaacgccgagucccuccucgaggccggcgacaugcuccaguuccacgacguccgcgacgccgccgccgaguuccucgagaagaaccucuuccccuccaacugccucggcaugaugcuccucuccgacgcccaccagugccgccgccucuacgaguucuccuggcgcaugugccucguccacuucgagaccguccgccaguccgaggacuucaacucccucuccaaggacacccuccucgaccucaucuccuccgacgagcucgagaccgaggacgagcgcgucgucuucgaggccauccuccagugggucaagcacgaccucgagccccgcaagguccaccuccccgagcuccuccgcuccguccgccucgcccuccuccccuccgacugccuccaggaggccgucuccuccgaggcccuccucauggccgacgagcgcaccaagcucaucauggacgaggcccuccgcugcaagacccgcauccuccagaacgacggcgucgucaccucccccugcgcccgcccccgcaaggccggccacacccuccucauccucggcggccagaccuucaugugcgacaagaucuaccaggucgaccacaaggccaaggagaucauccccaaggccgaccuccccuccccccgcaaggaguucuccgccuccgccaucggcugcaaggucuacgucaccggcggccgcggcuccgagaacggcgucuccaaggacgucugggucuacgacaccguccacgaggagugguccaaggccgcccccaugcucaucgcccgcuucggccacggcuccgccgagcucgagaacugccucuacgucgucggcggccacaccucccucgccggcgucuuccccgccucccccuccgucucccucaagcaggucgagaaguacgaccccggcgccaacaaguggaugauggucgccccccuccgcgacggcgucuccaacgccgccgucgucuccgccaagcucaagcucuucgucuucggcggcaccuccauccaccgcgacauggucuccaagguccagugcuacgaccccuccgagaaccgcuggaccaucaaggccgagugcccccagcccuggcgcuacaccgccgccgccguccucggcucccagaucuucaucaugggcggcgacaccgaguucaccgccgccuccgccuaccgcuucgacugcgagaccaaccaguggacccgcaucggcgacaugaccgccaagcgcauguccugccacgcccucgccuccggcaacaagcucuacgucgucggcggcuacuucggcacccagcgcugcaagacccucgacugcuacgaccccaccuccgacaccuggaacugcaucaccaccguccccuacucccucauccccaccgccuucgucuccaccuggaagcaccuccccgccuga

SEQ ID NO: 45123 - RNA, 1848 nt, Artificial Sequence
  derived and/or modified sequence opt2 from KLHL26__Homo_sapiens__NP_060786
auggccgaguccggcggcuccuccggcggcgccggcggcggcggcgccuucggcgccggccccggccccgagcgccccaacuccaccgccgacaagaacggcgcccucaagugcaccuucuccgcccccucccacuccaccucccuccuccagggccucgccacccuccgcgcccagggccagcuccucgacgucguccucaccaucaaccgcgaggccuuccccgcccacaaggucguccucgccgccugcuccgacuacuuccgcgccauguucaccggcggcaugcgcgaggccucccaggacgucaucgagcucaagggcgucuccgcccgcggccuccgccacaucaucgacuucgccuacuccgccgaggucacccucgaccucgacugcguccaggacguccucggcgccgccgucuuccuccagaugcuccccgucgucgagcucugcgaggaguuccucaaggccgccauguccgucgagaccugccucaacaucggccagauggccaccaccuucucccucgccucccuccgcgaguccgucgacgccuucaccuuccgccacuuccuccagaucgccgaggaggaggacuuccuccgccucccccucgagcgccucgucuucuuccuccaguccaaccgccuccaguccugcgccgagaucgaccucuuccgcgccgccguccgcuggcuccagcacgaccccgcccgccgcccccgcgccucccacguccucugccacauccgcuucccccucaugcaguccuccgagcucgucgacuccguccagacccucgacaucauggucgaggacguccucugccgccaguaccuccucgaggccuucaacuaccagguccuccccuuccgccagcacgagaugcaguccccccgcaccgccguccgcuccgacguccccucccucgucaccuucggcggcacccccuacaccgacuccgaccgcuccgucuccuccaaggucuaccagcuccccgagcccggcgcccgccacuuccgcgagcucaccgagauggaggucggcugcucccacaccugcgucgccguccucgacaacuucgucuacgucgccggcggccagcaccuccaguaccgcuccggcgagggcgccgucgacgccugcuaccgcuacgacccccaccucaaccgcuggcuccgccuccaggccaugcaggagucccgcauccaguuccagcucaacguccucugcggcauggucuacgccaccggcggccgcaaccgcgccggcucccucgccuccgucgagcgcuacugcccccgccgcaacgaguggggcuacgccugcucccucaagcgccgcaccuggggccacgccggcgccgccuccggcggccgccucuacaucuccggcggcuacggcaucuccgucgaggacaagaaggcccuccacugcuacgaccccgucgccgaccagugggaguucaaggcccccauguccgagccccgcguccuccacgccauggucggcgccggcggccgcaucuacgcccucggcggccgcauggaccacgucgaccgcugcuucgacguccucgccgucgaguacuacguccccgagaccgaccaguggaccuccgucucccccaugcgcgccggccaguccgaggccggcugcugccuccucgagcgcaagaucuacaucgucggcggcuacaacuggcgccucaacaacgucaccggcaucguccaggucuacaacaccgacaccgacgagugggagcgcgaccuccacuuccccgaguccuucgccggcaucgccugcgcccccguccuccucccccgcgccggcacccgccgcuga

SEQ ID NO: 45124 - RNA, 2628 nt, Artificial Sequence
  derived and/or modified sequence opt2 from KLHL29__Homo_sapiens__NP_443152
augucccgccaccacucccgcuucgagcgcgacuaccgcgucggcugggaccgccgcgagugguccgucaacggcacccacggcaccaccuccaucugcuccgucaccuccggcgccggcggcggcaccgccuccucccucuccguccgccccggccuccucccccuccccgucguccccucccgccuccccacccccgccaccgcccccgcccccugcaccaccggcuccuccgaggccaucaccucccucgucgccuccuccgccuccgccgucaccaccaaggcccccggcaucuccaagggcgacucccagucccagggccucgccaccuccauccgcuggggccagacccccaucaaccaguccacccccugggacaccgacgagccccccuccaagcagaugcgcgaguccgacaaccccggcaccggccccugggucaccaccgucgccgccggcaaccagcccacccucaucgcccacuccuacggcgucgcccagccccccaccuucucccccgccgucaacguccaggcccccgucaucggcgucacccccucccuccccccccacgucggcccccagcucccccucaugcccggccacuacucccucccccagccccccucccagccccucuccuccgucgucgucaacaugcccgcccaggcccucuacgccuccccccagccccucgccgucuccacccuccccggcgucggccaggucgcccgccccggccccaccgccgucggcaacggccacauggccggcccccuccuccccccccccccccccgcccagcccuccgccacccuccccuccggcgcccccgccaccaacggcccccccaccaccgacuccgcccacggccuccagaugcuccgcaccaucggcgucggcaaguacgaguucaccgaccccggccacccccgcgagaugcucaaggagcucaaccagcagcgccgcgccaaggccuucaccgaccucaagaucgucgucgagggccgcgaguucgagguccaccagaacguccucgccuccugcucccucuacuucaaggaccucauccagcgcuccguccaggacuccggccagggcggccgcgagaagcucgagcucguccucuccaaccuccaggccgacguccucgagcuccuccucgaguucgucuacaccggcucccucgucaucgacuccgccaacgccaagacccuccucgaggccgccuccaaguuccaguuccacaccuucugcaaggucugcgucuccuuccucgagaagcagcucaccgccuccaacugccucggcguccucgccauggccgaggccaugcagugcuccgagcucuaccacauggccaaggccuucgcccuccagaucuuccccgaggucgccgcccaggaggagauccucuccaucuccaaggacgacuucaucgccuacgucuccaacgacucccucaacaccaaggccgaggagcucgucuacgagaccgucaucaaguggaucaagaaggaccccgccacccgcacccaguacgccgccgagcuccucgccgucguccgccuccccuucauccaccccuccuaccuccucaacgucgucgacaacgaggagcucaucaaguccuccgaggccugccgcgaccucgucaacgaggccaagcgcuaccacaugcucccccacgcccgccaggagaugcagaccccccgcacccgcccccgccucuccgccggcgucgccgaggucaucguccucgucggcggccgccagauggucggcaugacccagcgcucccucgucgccgucaccugcuggaacccccagaacaacaagugguacccccucgccucccuccccuucuacgaccgcgaguucuucuccgucgucuccgccggcgacaacaucuaccucuccggcggcauggaguccggcgucacccucgccgacgucuggugcuacaugucccuccucgacaacuggaaccucgucucccgcaugaccgucccccgcugccgccacaacucccucgucuacgacggcaagaucuacacccucggcggccucggcgucgccggcaacgucgaccacgucgagcgcuacgacaccaucaccaaccagugggaggccgucgccccccuccccaaggccguccacuccgccgccgccaccgucugcggcggcaagaucuacgucuucggcggcgucaacgaggccggccgcgccgccggcguccuccaguccuacgucccccagaccaacaccugguccuucaucgagucccccaugaucgacaacaaguacgcccccgccgucacccucaacggcuucgucuucauccucggcggcgccuacgcccgcgccaccaccaucuacgaccccgagaagggcaacaucaaggccggccccaacaugaaccacucccgccaguucugcuccgccgucguccucgacggcaagaucuacgccaccggcggcaucgucuccuccgagggccccgcccucggcaacauggaggccuacgagcccaccaccaacaccuggacccuccucccccacaugcccugccccgucuuccgccacggcugcgucgucaucaagaaguacauccaguccggcuga

SEQ ID NO: 45125 - RNA, 1794 nt, Artificial Sequence
  derived and/or modified sequence opt2 from KLHL2__Homo_sapiens__NP_001154993
auggucuggcucgaggcccgcccccagauccucuucgucugcaccaagcagggccaccagaagccccucgacuccaaggacgacaacaccgagaagcacugccccgucaccgucaaccccuggcacaugaagaaggccuucaaggucaugaacgagcuccgcucccagaaccuccucugcgacgucaccaucgucgccgaggacauggagaucuccgcccaccgcgucguccucgccgccugcucccccuacuuccacgccauguucaccggcgagauguccgagucccgcgccaagcgcguccgcaucaaggaggucgacggcuggacccuccgcaugcucaucgacuacgucuacaccgccgagauccaggucaccgaggagaacguccagguccuccuccccgccgccggccuccuccagcuccaggacgucaagaagaccugcugcgaguuccucgagucccagcuccaccccgucaacugccucggcauccgcgccuucgccgacaugcacgccugcaccgaccuccucaacaaggccaacaccuacgccgagcagcacuucgccgacgucguccucuccgaggaguuccucaaccucggcaucgagcaggucugcucccucaucuccuccgacaagcucaccaucuccuccgaggagaaggucuucgaggccgucaucgccugggucaaccacgacaaggacguccgccaggaguucauggcccgccucauggagcacguccgccucccccuccucccccgcgaguaccucguccagcgcgucgaggaggaggcccucgucaagaacuccuccgccugcaaggacuaccucaucgaggccaugaaguaccaccuccuccccaccgagcagcgcauccucaugaaguccguccgcacccgccuccgcacccccaugaaccuccccaagcucauggucgucgucggcggccaggcccccaaggccauccgcuccgucgagugcuacgacuucaaggaggagcgcuggcaccaggucgccgagcuccccucccgccgcugccgcgccggcauggucuacauggccggccucgucuucgccgucggcggcuucaacggcucccuccgcguccgcaccgucgacuccuacgaccccgucaaggaccaguggaccuccgucgccaacaugcgcgaccgccgcuccacccucggcgccgccguccucaacggccuccucuacgccgucggcggcuucgacggcuccaccggccucuccuccgucgaggccuacaacaucaaguccaacgagugguuccacgucgcccccaugaacacccgccgcuccuccgucggcgucggcgucgucggcggccuccucuacgccgucggcggcuacgacggcgccucccgccagugccucuccaccgucgagugcuacaacgccaccaccaacgaguggaccuacaucgccgagauguccacccgccgcuccggcgccggcgucggcguccucaacaaccuccucuacgccgucggcggccacgacggcccccucguccgcaaguccgucgaggucuacgaccccaccaccaacgccuggcgccaggucgccgacaugaacaugugccgccgcaacgccggcgucugcgccgucaacggccuccucuacgucgucggcggcgacgacggcuccugcaaccucgccuccgucgaguacuacaaccccaccaccgacaaguggaccgucgucuccuccugcauguccaccggccgcuccuacgccggcgucaccgucaucgacaagccccucuga

SEQ ID NO: 45126 - RNA, 1905 nt, Artificial Sequence
  derived and/or modified sequence opt2 from KLHL31__Homo_sapiens__NP_001003760
auggcccccaagaagaagaucgucaagaagaacaagggcgacaucaacgagaugaccaucaucgucgaggacuccccccucaacaagcucaacgcccucaacggccuccucgagggcggcaacggccucuccugcaucuccuccgagcucaccgacgccuccuacggccccaaccuccucgagggccucuccaagaugcgccaggagaacuuccucugcgaccucgucaucggcaccaagaccaaguccuucgacguccacaaguccgucauggccuccugcuccgaguacuucuacaacauccucaagaaggaccccuccauccagcgcgucgaccucaacgacaucuccccccucggccucgccaccgucaucgccuacgccuacaccggcaagcucacccucucccucuacaccaucggcuccaucaucuccgccgccgucuaccuccagauccacacccucgucaagaugugcuccgacuuccucauccgcgagauguccgucgagaacugcauguacgucgucaacaucgccgagaccuacucccucaagaacgccaaggccgccgcccagaaguucauccgcgacaacuuccucgaguucgccgaguccgaccaguucaugaagcucaccuucgagcagaucaacgagcuccucaucgacgacgaccuccagcuccccuccgagaucgucgccuuccagaucgccaugaaguggcucgaguucgaccagaagcgcgucaaguacgccgccgaccuccucuccaacauccgcuucggcaccaucuccgcccaggaccucgucaacuacguccaguccgucccccgcaugaugcaggacgccgacugccaccgccuccucgucgacgccaugaacuaccaccuccuccccuaccaccagaacacccuccagucccgccgcacccgcauccgcggcggcugccgcguccucgucaccgucggcggccgccccggccucaccgagaagucccucucccgcgacauccucuaccgcgaccccgagaacggcugguccaagcucaccgagaugcccgccaaguccuucaaccagugcgucgccgucauggacggcuuccucuacgucgccggcggcgaggaccagaacgacgcccgcaaccaggccaagcacgccgucuccaacuucugccgcuacgacccccgcuucaacaccuggauccaccucgccuccaugaaccagaagcgcacccacuucucccucuccgucuucaacggccucgucuacgccgccggcggccgcaacgccgagggcucccucgccucccucgagugcuacguccccuccaccaaccaguggcagcccaagaccccccucgaggucgcccgcugcugccacgccuccgccgucgccgacggccgcguccucgucaccggcggcuacaucgccaacgccuacucccgcuccgucugcgccuacgaccccgccuccgacuccuggcaggagcuccccaaccucuccaccccccgcggcuggcacugcgccgucacccucuccgaccgcgucuacgucaugggcggcucccagcucggcccccgcggcgagcgcgucgacguccucaccgucgagugcuacucccccgccaccggccagugguccuacgccgccccccuccaggucggcgucuccaccgccggcgucuccgcccuccacggccgcgccuaccucgucggcggcuggaacgagggcgagaagaaguacaagaagugcauccagugcuucucccccgagcucaacgaguggaccgaggacgacgagcuccccgaggccaccgucggcgucuccugcugcacccucuccaugcccaacaacgucacccgcgagucccgcgccuccuccgucuccuccguccccgucuccaucuga

SEQ ID NO: 45127 - RNA, 1752 nt, Artificial Sequence
  derived and/or modified sequence opt2 from KLHL35__Homo_sapiens__NP_001034637
augcgccagggccacgcccccgaggaguccgagcccggcugcgaggcccccugcgccggccccugccacgcccagcgcguccuccaggcccucaacgccuaccgccgcuccggcacccucaccgacgucguccuccgcgccggcggccgcgacuuccccugccaccgcgccgcccucuccgccggcuccgccuacuuccgcucccucuucgccgccggccgccccgagcgcggccccgccgucguccccgucguccccgucgcccccgaggcccccggcaccucccccgccggcgccgccgccgcccucgccgucguccucgacuacgucuacggcgccggcguccgccuccgcgccgaggacgaggccgccgccguccucgcccucgccgagcgccucggcgucgccggccuccgcgaggccugcguccgcuuccucgagggccgccuccgcgccgccaacucccucgcccuccgccgcgucgccgccgccuucucccucgccccccucgccgagcgcugcggccgcguccuccgccaggccuucgccgaggucgcccgccacgccgacuuccucgagcucgcccccgacgaggucgucgcccuccucgccgaccccgcccucggcgucgcccgcgaggaggccgucuucgaggccgccaugcgcuggguccgccacgacgcccccgcccgccgcggccagcuccgccgccuccucgagcacguccgccucccccuccucgcccccgccuacuuccucgagaaggucgaggccgacgagcuccuccaggccugcggcgagugccgcccccuccuccucgaggcccgcgccugcuucauccucggccgcgaggccggcgcccuccgcacccgcccccgccgcuucauggaccucgccgaggucaucgucgucaucggcggcugcgaccgcaagggccuccucaagcuccccuucgccgacgccuaccaccccgagucccagcgcuggaccccccuccccucccuccccggcuacacccgcuccgaguucgccgccugcgcccuccgcaacgacgucuacgucuccggcggccacaucaacucccacgacgucuggauguucuccucccaccuccacaccuggaucaaggucgccucccuccacaagggccgcuggcgccacaagauggccgucguccagggccagcucuucgccgucggcggcuucgacggccuccgccgccuccacuccgucgagcgcuacgaccccuucuccaacaccugggccgccgccgccccccuccccgaggccgucuccuccgccgccgucgccuccugcgccggcaagcucuucgucaucggcggcgcccgccagggcggcgucaacaccgacaagguccagugcuucgaccccaaggaggaccgcuggucccuccgcucccccgcccccuucucccagcgcugccucgaggccgucucccucgaggacaccaucuacgucaugggcggccucauguccaagaucuucaccuacgaccccggcaccgacgucuggggcgaggccgccguccuccccucccccgucgaguccugcggcgucaccgucugcgacggcaagguccacauccucggcggccgcgacgaccgcggcgaguccaccgacaaggucuucaccuucgaccccuccuccggccaggucgagguccagcccucccuccagcgcugcaccuccucccacggcugcgucaccaucauccagucccucggccgcuga

SEQ ID NO: 45128 - RNA, 1668 nt, Artificial Sequence
  derived and/or modified sequence opt2 from KLHL3__Homo_sapiens__NP_001244123
augggcaaggccuucaaggucaugaacgagcuccgcuccaagcagcuccucugcgacgucaugaucgucgccgaggacgucgagaucgaggcccaccgcgucguccucgccgccugcucccccuacuucugcgccauguucaccggcgacauguccgaguccaaggccaagaagaucgagaucaaggacgucgacggccagacccucuccaagcucaucgacuacaucuacaccgccgagaucgaggucaccgaggagaacguccagguccuccuccccgccgccucccuccuccagcucauggacguccgccagaacugcugcgacuuccuccagucccagcuccaccccaccaacugccucggcauccgcgccuucgccgacguccacaccugcaccgaccuccuccagcaggccaacgccuacgccgagcagcacuuccccgaggucaugcucggcgaggaguuccucucccucucccucgaccaggucugcucccucaucuccuccgacaagcucaccgucuccuccgaggagaaggucuucgaggccgucaucuccuggaucaacuacgagaaggagacccgccucgagcacauggccaagcucauggagcacguccgccucccccuccucccccgcgacuaccucguccagaccgucgaggaggaggcccucaucaagaacaacaacaccugcaaggacuuccucaucgaggccaugaaguaccaccuccucccccucgaccagcgccuccucaucaagaacccccgcaccaagccccgcacccccgucucccuccccaaggucaugaucgucgucggcggccaggcccccaaggccauccgcuccgucgagugcuacgacuucgaggaggaccgcugggaccagaucgccgagcuccccucccgccgcugccgcgccggcgucgucuucauggccggccacgucuacgccgucggcggcuucaacggcucccuccgcguccgcaccgucgacgucuacgacggcgucaaggaccaguggaccuccaucgccuccaugcaggagcgccgcuccacccucggcgccgccguccucaacgaccuccucuacgccgucggcggcuucgacggcuccaccggccucgccuccgucgaggccuacuccuacaagaccaacgagugguucuucgucgcccccaugaacacccgccgcuccuccgucggcgucggcgucgucgagggcaagcucuacgccgucggcggcuacgacggcgccucccgccagugccucuccaccgucgagcaguacaaccccgccaccaacgaguggaucuacgucgccgacauguccacccgccgcuccggcgccggcgucggcguccucuccggccagcucuacgccaccggcggccacgacggcccccucguccgcaaguccgucgaggucuacgaccccggcaccaacaccuggaagcaggucgccgacaugaacaugugccgccgcaacgccggcgucugcgccgucaacggccuccucuacgucgucggcggcgacgacggcuccugcaaccucgccuccgucgaguacuacaaccccgucaccgacaaguggacccuccuccccaccaacauguccaccggccgcuccuacgccggcgucgccgucauccacaagucccucuga

SEQ ID NO: 45129 - RNA, 1866 nt, Artificial Sequence
  derived and/or modified sequence opt2 from KLHL40__Homo_sapiens__NP_689606
auggcccucggccucgagcaggccgaggagcagcgccucuaccagcagacccuccuccaggacggccucaaggacaugcucgaccacggcaaguuccucgacugcgucguccgcgccggcgagcgcgaguuccccugccaccgccucguccucgccgccugcucccccuacuuccgcgcccgcuuccucgccgagcccgagcgcgccggcgagcuccaccucgaggaggucucccccgacgucgucgcccagguccuccacuaccucuacaccuccgagaucgcccucgacgaggccuccguccaggaccucuucgccgccgcccaccgcuuccagauccccuccaucuucaccaucugcgucuccuuccuccagaagcgccucugccucuccaacugccucgccgucuuccgccucggccuccuccucgacugcgcccgccucgccgucgccgcccgcgacuucaucugcgcccacuucacccucgucgcccgcgacgccgacuuccucggccucuccgccgacgagcucaucgccaucaucuccuccgacggccucaacgucgagaaggaggaggccgucuucgaggccgucaugcgcugggccggcuccggcgacgccgaggcccaggccgagcgccagcgcgcccuccccaccgucuucgaguccguccgcugccgccuccucccccgcgccuuccucgagucccgcgucgagcgccacccccucguccgcgcccagcccgagcuccuccgcaagguccagauggucaaggacgcccacgagggccgcaucaccacccuccgcaagaagaagaagggcaaggacggcgccggcgccaaggaggccgacaagggcaccuccaaggccaaggccgaggaggacgaggaggccgagcgcauccuccccggcauccucaacgacacccuccgcuucggcauguuccuccaggaccucaucuucaugaucuccgaggagggcgccgucgccuacgaccccgccgccaacgagugcuacugcgccucccucuccaaccagguccccaagaaccacgucucccucgucaccaaggagaaccaggucuucgucgccggcggccucuucuacaacgaggacaacaaggaggaccccauguccgccuacuuccuccaguucgaccaccucgacuccgaguggcucggcaugcccccccuccccuccccccgcugccucuucggccucggcgaggcccucaacuccaucuacgucgucggcggccgcgagaucaaggacggcgagcgcugccucgacuccgucaugugcuacgaccgccucuccuucaaguggggcgaguccgacccccuccccuacgucgucuacggccacaccguccucucccacauggaccucgucuacgucaucggcggcaagggcuccgaccgcaagugccucaacaagaugugcgucuacgaccccaagaaguucgaguggaaggagcucgcccccaugcagaccgcccgcucccucuucggcgccaccguccacgacggccgcaucaucgucgccgccggcgucaccgacaccggccucaccuccuccgccgaggucuacuccaucaccgacaacaagugggcccccuucgaggccuucccccaggagcgcuccucccucucccucgucucccucgucggcacccucuacgccaucggcggcuucgccacccucgagaccgaguccggcgagcucguccccaccgagcucaacgacaucuggcgcuacaacgaggaggagaagaagugggagggcguccuccgcgagaucgccuacgccgccggcgccaccuuccuccccguccgccucaacguccucugccucaccaagauguga

SEQ ID NO: 45130 - RNA, 1821 nt, Artificial Sequence
  derived and/or modified sequence opt2 from KLHL41__Homo_sapiens__NP_006054
auggacucccagcgcgagcucgccgaggagcuccgccucuaccaguccacccuccuccaggacggccucaaggaccuccucgacgagaagaaguucaucgacugcacccucaaggccggcgacaagucccuccccugccaccgccucauccucuccgccugcucccccuacuuccgcgaguacuuccucuccgagaucgacgaggccaagaagaaggaggucguccucgacaacgucgaccccgccauccucgaccucaucaucaaguaccucuacuccgccuccaucgaccucaacgacggcaacguccaggacaucuucgcccucgccucccgcuuccagauccccuccgucuucaccgucugcgucuccuaccuccagaagcgccucgcccccggcaacugccucgccauccuccgccucggccuccuccucgacugcccccgccucgccaucuccgcccgcgaguucgucuccgaccgcuucguccagaucugcaaggaggaggacuucaugcagcucuccccccaggagcucaucuccgucaucuccaacgacucccucaacgucgagaaggaggaggccgucuucgaggccgucaugaaguggguccgcaccgacaaggagaaccgcgucaagaaccucuccgaggucuucgacugcauccgcuuccgccucaugaccgagaaguacuucaaggaccacgucgagaaggacgacaucaucaaguccaaccccgaccuccagaagaagaucaagguccucaaggacgccuucgccggcaagcuccccgagcccuccaagaacgccgccaagaccggcgccggcgaggucaacggcgacgucggcgacgaggaccuccuccccggcuaccucaacgacaucccccgccacggcauguucgucaaggaccucauccuccucgucaacgacaccgccgccgucgccuacgaccccaccgagaacgagugcuaccucaccgcccucgccgagcagaucccccgcaaccacuccuccaucgucacccagcagaaccagaucuacgucgucggcggccucuacgucgacgaggagaacaaggaccagccccuccaguccuacuucuuccagcucgacuccaucgccuccgagugggucggccuccccccccuccccuccgcccgcugccucuucggccucggcgaggucgacgacaagaucuacgucgucgccggcaaggaccuccagaccgaggccucccucgacuccguccucugcuacgaccccgucgccgccaaguggaacgaggucaagaagcuccccaucaaggucuacggccacaacgucaucucccacaagggcaugaucuacugccucggcggcaagaccgacgacaagaagugcaccaaccgcgucuucaucuucaaccccaagaagggcgacuggaaggaccucgcccccaugaagaucccccgcuccauguucggcgucgccguccacaagggcaagaucgucaucgccggcggcgucaccgaggacggccucuccgccuccgucgaggccuucgaccucaccaccaacaagugggacgucaugaccgaguucccccaggagcgcuccuccaucucccucgucucccucgccggcucccucuacgccaucggcggcuucgccaugauccagcucgaguccaaggaguucgcccccaccgaggucaacgacaucuggaaguacgaggacgacaagaaggagugggccggcaugcucaaggagauccgcuacgccuccggcgccuccugccucgccacccgccucaaccucuucaagcucuccaagcucuga

SEQ ID NO: 45131 - RNA, 1518 nt, Artificial Sequence
  derived and/or modified sequence opt2 from KLHL42__Homo_sapiens__NP_065833
auguccgccgaggagaugguccagauccgccucgaggaccgcugcuaccccgucuccaagcgcaagcucaucgagcaguccgacuacuuccgcgcccucuaccgcuccggcaugcgcgaggcccucucccaggaggccggcggccccgagguccagcagcuccgcggccucuccgcccccggccuccgccucguccucgacuucaucaacgccggcggcgcccgcgagggcuggcuccucggcccccgcggcgagaagggcggcggcgucgacgaggacgaggagauggacgaggucucccuccucuccgagcucgucgaggccgccuccuuccuccaggucaccucccuccuccagcuccuccucucccagguccgccucaacaacugccucgagauguaccgccucgcccaggucuacggccuccccgaccuccaggaggccugccuccgcuucauggucguccacuuccacgagguccucugcaagccccaguuccaccuccucggcucccccccccaggcccccggcgacgucucccucaagcagcgccuccgcgaggcccgcaugaccggcacccccguccucgucgcccucggcgacuuccucggcggcccccucgccccccaccccuaccagggcgagccccccuccaugcuccgcuacgaggagaugaccgagcgcugguucccccucgccaacaaccucccccccgaccucgucaacguccgcggcuacggcuccgccauccucgacaacuaccucuucaucgucggcggcuaccgcaucaccucccaggagaucuccgccgcccacuccuacaaccccuccaccaacgaguggcuccaggucgccuccaugaaccagaagcgcuccaacuucaagcucgucgccgucaacuccaagcucuacgccaucggcggccaggccgucuccaacgucgagugcuacaaccccgagcaggacgccuggaacuucgucgccccccuccccaacccccucgccgaguucuccgccugcgagugcaagggcaagaucuacgucaucggcggcuacaccacccgcgaccgcaacaugaacauccuccaguacugccccuccuccgacauguggacccucuucgagaccugcgacguccacauccgcaagcagcagauggucuccgucgaggagaccaucuacaucgucggcggcugccuccacgagcucggccccaaccgccgcuccucccaguccgaggacaugcucaccguccaguccuacaacaccgucacccgccaguggcucuaccucaaggagaacaccuccaaguccggccucaaccucaccugcgcccuccacaacgacggcaucuacaucaugucccgcgacgucacccucuccaccucccucgagcaccgcgucuuccucaaguacaacaucuucuccgacuccugggaggccuuccgccgcuuccccgccuucggccacaaccuccucgucuccucccucuaccuccccaacaaggccgagaccuga

SEQ ID NO: 45132 - RNA, 2130 nt, Artificial Sequence
  derived and/or modified sequence opt2 from KLHL5__Homo_sapiens__NP_001007076
auguccggcucccgcaaggaguucgacgucaagcagauccucaagauccgcuggcgcugguucggccaccaggccuccucccccaacuccaccgucgacucccagcagggcgaguucuggaaccgcggccagaccggcgccaacggcggccgcaaguuccucgaccccugcucccuccagcucccccucgccuccaucggcuaccgccgcuccucccagcucgacuuccagaacucccccuccuggcccauggccuccaccuccgagguccccgccuucgaguucaccgccgaggacugcggcggcgcccacuggcucgaccgccccgaggucgacgacggcaccuccgaggaggagaacgaguccgacuccuccuccugccgcaccuccaacuccucccagacccucuccuccugccacaccauggagcccugcaccuccgacgaguucuuccaggcccucaaccacgccgagcagaccuucaagaagauggagaacuaccuccgccacaagcagcucugcgacgucauccucgucgccggcgaccgccgcauccccgcccaccgccucguccucuccuccgucuccgacuacuucgccgccauguucaccaacgacguccgcgaggcccgccaggaggagaucaagauggagggcgucgagcccaacucccucuggucccucauccaguacgccuacaccggccgccucgagcucaaggaggacaacaucgagugccuccucuccaccgccugccuccuccagcucucccaggucgucgaggccugcugcaaguuccucaugaagcagcuccaccccuccaacugccucggcauccgcuccuucgccgacgcccagggcugcaccgaccuccacaaggucgcccacaacuacaccauggagcacuucauggaggucauccgcaaccaggaguucguccuccuccccgccuccgagaucgccaagcuccucgccuccgacgacaugaacauccccaacgaggagaccauccucaacgcccuccucaccuggguccgccacgaccucgagcagcgccgcaaggaccucuccaagcuccucgccuacauccgccucccccuccucgccccccaguuccucgccgacauggagaacaacguccucuuccgcgacgacaucgagugccagaagcucaucauggaggccaugaaguaccaccuccuccccgagcgccgccccaugcuccaguccccccgcaccaagccccgcaaguccaccgucggcacccucuucgccgucggcggcauggacuccaccaagggcgccaccuccaucgagaaguacgaccuccgcaccaacauguggacccccgucgccaacaugaacggccgccgccuccaguucggcgucgccguccucgacgacaagcucuacgucgucggcggccgcgacggccucaagacccucaacaccgucgagugcuacaaccccaagaccaagaccugguccgucaugccccccauguccacccaccgccacggccucggcgucgccguccucgagggccccauguacgccgucggcggccacgacggcugguccuaccucaacaccgucgagcgcugggacccccaggcccgccaguggaacuucgucgccaccauguccaccccccgcuccaccgucggcgucgccguccucuccggcaagcucuacgccgucggcggccgcgacggcuccuccugccucaaguccgucgagugcuucgacccccacaccaacaaguggacccucugcgcccagauguccaagcgccgcggcggcgucggcgucaccaccuggaacggccuccucuacgccaucggcggccacgacgcccccgccuccaaccucaccucccgccucuccgacugcgucgagcgcuacgaccccaagaccgacauguggaccgccgucgccuccauguccaucucccgcgacgccgucggcgucugccuccucggcgacaagcucuacgccgucggcggcuacgacggccaggccuaccucaacaccgucgaggccuacgacccccagaccaacgaguggacccaggucgccccccucugccucggccgcgccggcgccugcgucgucaccgucaagcucuga

SEQ ID NO: 45133 - RNA, 1866 nt, Artificial Sequence
  derived and/or modified sequence opt2 from KLHL6__Homo_sapiens__NP_569713
augcucauggccggccagcgcggcgccuggaccaugggcgacgucgucgagaagucccucgagggcccccucgcccccuccaccgacgagcccucccagaagaccggcgaccucgucgagauccucaacggcgagaaggucaaguucgacgacgccggccucucccucauccuccagaacggccucgagacccuccgcauggagaacgcccucaccgacgucauccucugcgucgacauccaggaguucuccugccaccgcgucguccucgccgccgccuccaacuacuuccgcgccauguucugcaacgaccucaaggagaaguacgagaagcgcaucaucaucaagggcgucgacgccgagaccaugcacacccuccucgacuacaccuacaccuccaaggcccucaucaccaagcagaacguccagcgcguccucgaggccgccaaccucuuccaguuccuccgcauggucgacgccugcgccuccuuccucaccgaggcccucaaccccgagaacugcgucggcauccuccgccucgccgacacccacucccucgacucccucaagaagcagguccaguccuacaucauccagaacuucguccagauccucaacuccgaggaguuccucgaccuccccgucgacacccuccaccacauccucaaguccgacgaccucuacgucaccgaggaggcccaggucuucgagaccgucauguccuggguccgccacaagcccuccgagcgccucugccuccuccccuacguccucgagaacguccgccucccccuccucgaccccugguacuucgucgagaccgucgaggccgacccccucauccgccagugccccgaggucuucccccuccuccaggaggcccgcauguaccaccucuccggcaacgagaucaucuccgagcgcaccaagccccgcaugcacgaguuccaguccgaggucuucaugaucaucggcggcugcaccaaggacgagcgcuucgucgccgaggucaccugccucgacccccuccgccgcucccgccucgaggucgccaagcucccccucaccgagcacgagcucgaguccgagaacaagaagugggucgaguucgccugcgucacccucaagaacgaggucuacaucuccggcggcaaggagacccagcacgacgucuggaaguacaacuccuccaucaacaaguggauccagaucgaguaccucaacaucggccgcuggcgccacaagauggucguccucggcggcaaggucuacgucaucggcggcuucgacggccuccagcgcaucaacaacgucgagaccuacgaccccuuccacaacugcugguccgaggccgccccccuccucguccacgucuccuccuucgccgccaccucccacaagaagaagcucuacgucaucggcggcggccccaacggcaagcucgccaccgacaagacccagugcuacgaccccuccaccaacaaguggucccucaaggccgccaugcccgucgaggccaagugcaucaacgccgucuccuuccgcgaccgcaucuacgucgucggcggcgccaugcgcgcccucuacgccuacuccccccucgaggacuccuggugccucgucacccagcucucccacgagcgcgccuccugcggcaucgcccccugcaacaaccgccucuacaucaccggcggccgcgacgagaagaacgaggucaucgccaccguccucugcugggaccccgaggcccagaagcucaccgaggagugcguccucccccgcggcgucucccaccacggcuccgucaccauccgcaaguccuacacccacauccgccgcaucguccccggcgccgucuccgucuga

SEQ ID NO: 45134 - RNA, 1761 nt, Artificial Sequence
  derived and/or modified sequence opt2 from KLHL7__Homo_sapiens__NP_001026880
auggccgccuccggcgucgagaaguccuccaagaagaagaccgagaagaagcucgccgcccgcgaggaggccaagcuccucgccggcuucaugggcgucaugaacaacaugcgcaagcagaagacccucugcgacgucauccucaugguccaggagcgcaagauccccgcccaccgcgucguccucgccgccgccucccacuucuucaaccucauguucaccaccaacaugcucgaguccaaguccuucgaggucgagcucaaggacgccgagcccgacaucaucgagcagcucgucgaguucgccuacaccgcccgcaucuccgucaacuccaacaacguccagucccuccucgacgccgccaaccaguaccagaucgagcccgucaagaagaugugcgucgacuuccucaaggagcaggucgacgccuccaacugccucggcaucuccguccucgccgagugccucgacugccccgagcucaaggccaccgccgacgacuucauccaccagcacuucaccgaggucuacaagaccgacgaguuccuccagcucgacgucaagcgcgucacccaccuccucaaccaggacacccucaccguccgcgccgaggaccaggucuacgacgccgccguccgcuggcucaaguacgacgagcccaaccgccagcccuucauggucgacauccucgccaagguccgcuucccccucaucuccaagaacuuccucuccaagaccguccaggccgagccccucauccaggacaaccccgagugccucaagauggucaucuccggcaugcgcuaccaccuccucucccccgaggaccgcgaggagcucgucgacggcacccgcccccgccgcaagaagcacgacuaccgcaucgcccucuucggcggcucccagccccaguccugccgcuacuucaaccccaaggacuacuccuggaccgacauccgcugccccuucgagaagcgccgcgacgccgccugcgucuucugggacaacgucgucuacauccucggcggcucccagcucuuccccaucaagcgcauggacugcuacaacgucgucaaggacuccugguacuccaagcucggcccccccaccccccgcgacucccucgccgccugcgccgccgagggcaagaucuacaccuccggcggcuccgaggucggcaacuccgcccucuaccucuucgagugcuacgacacccgcaccgaguccuggcacaccaagcccuccaugcucacccagcgcugcucccacggcauggucgaggccaacggccucaucuacgucugcggcggcucccucggcaacaacgucuccggccgcguccucaacuccugcgaggucuacgaccccgccaccgagaccuggaccgagcucugccccaugaucgaggcccgcaagaaccacggccucgucuucgucaaggacaagaucuucgccgucggcggccagaacggccucggcggccucgacaacgucgaguacuacgacaucaagcucaacgaguggaagauggucucccccaugcccuggaagggcgucaccgucaagugcgccgccgucggcuccaucgucuacguccucgccggcuuccagggcgucggccgccucggccacauccucgaguacaacaccgagaccgacaagugggucgccaacuccaagguccgcgccuuccccgucaccuccugccucaucugcgucgucgacaccugcggcgccaacgaggagacccucgagaccuga

SEQ ID NO: 45135 - RNA, 1854 nt, Artificial Sequence
  derived and/or modified sequence opt2 from KLHL9__Homo_sapiens__NP_061335
augaaggucucccucggcaacggcgagaugggcgucuccgcccaccuccagcccugcaaggccggcaccacccgcuucuucaccuccaacacccacuccuccgucguccuccagggcuucgaccagcuccgcaucgagggccuccucugcgacgucacccucguccccggcgacggcgacgagaucuuccccguccaccgcgccaugauggccuccgccuccgacuacuucaaggccauguucaccggcggcaugaaggagcaggaccucaugugcaucaagcuccacggcgucaacaaggucggccucaagaagaucaucgacuucaucuacaccgccaagcucucccucaacauggacaaccuccaggacacccucgaggccgccuccuuccuccagauccuccccguccucgacuucugcaaggucuuccucaucuccggcgucucccucgacaacugcgucgaggucggccgcaucgccaacaccuacaaccucaucgaggucgacaaguacgucaacaacuucauccucaagaacuuccccgcccuccucuccaccggcgaguuccucaagcuccccuucgagcgccucgccuucguccucuccuccaacucccucaagcacugcaccgagcucgagcucuucaaggccgccugccgcuggcuccgccucgaggacccccgcauggacuacgccgccaagcucaugaagaacauccgcuucccccucaugaccccccaggaccucaucaacuacguccagaccgucgacuucaugcgcaccgacaacaccugcgucaaccuccuccucgaggccuccaacuaccagaugaugcccuacaugcagcccgucaugcaguccgaccgcaccgccauccgcuccgacuccacccaccucgucacccucggcggcguccuccgccagcagcucgucgucuccaaggagcuccgcauguacgacgagcgcgcccaggaguggcgcucccucgcccccauggacgccccccgcuaccagcacggcaucgccgucaucggcaacuuccucuacgucgucggcggccaguccaacuacgacaccaagggcaagaccgccgucgacaccgucuuccgcuucgacccccgcuacaacaaguggaugcaggucgccucccucaacgagaagcgcaccuucuuccaccucuccgcccucaagggccaccucuacgccgucggcggccgcuccgccgccggcgagcucgccaccgucgagugcuacaacccccgcaugaacgagugguccuacgucgccaagauguccgagccccacuacggccacgccggcaccgucuacggcggccucauguacaucuccggcggcaucacccacgacaccuuccagaacgagcucaugugcuucgaccccgacaccgacaaguggaugcagaaggcccccaugaccaccguccgcggccuccacugcaugugcaccgucggcgacaagcucuacgucaucggcggcaaccacuuccgcggcaccuccgacuacgacgacguccucuccugcgaguacuacucccccacccucgaccaguggacccccaucgccgccaugcuccgcggccaguccgacgucggcgucgccgucuucgagaacaagaucuacgucgucggcggcuacuccuggaacaaccgcugcauggucgagaucguccagaaguacgaccccgagaaggacgaguggcacaaggucuucgaccuccccgagucccucggcggcauccgcgccugcacccucaccgucuucccccccgaggagaaccccggcucccccucccgcgaguccccccucuccgcccccuccgaccacuccuga

SEQ ID NO: 45136 - RNA, 3039 nt, Artificial Sequence
  derived and/or modified sequence opt2 from KL__Homo_sapiens__NP_004786
augcccgccuccgcccccccccgccgcccccgcccccccccccccucccucucccuccuccucguccuccucggccucggcggccgccgccuccgcgccgagcccggcgacggcgcccagaccugggcccgcuucucccgcccccccgcccccgaggccgccggccucuuccagggcaccuuccccgacggcuuccucugggccgucggcuccgccgccuaccagaccgagggcggcuggcagcagcacggcaagggcgccuccaucugggacaccuucacccaccacccccucgccccccccggcgacucccgcaacgccucccucccccucggcgcccccuccccccuccagcccgccaccggcgacgucgccuccgacuccuacaacaacgucuuccgcgacaccgaggcccuccgcgagcucggcgucacccacuaccgcuucuccaucuccugggcccgcguccuccccaacggcuccgccggcguccccaaccgcgagggccuccgcuacuaccgccgccuccucgagcgccuccgcgagcucggcguccagcccgucgucacccucuaccacugggaccucccccagcgccuccaggacgccuacggcggcugggccaaccgcgcccucgccgaccacuuccgcgacuacgccgagcucugcuuccgccacuucggcggccaggucaaguacuggaucaccaucgacaaccccuacgucgucgccuggcacggcuacgccaccggccgccucgcccccggcauccgcggcuccccccgccucggcuaccucgucgcccacaaccuccuccucgcccacgccaaggucuggcaccucuacaacaccuccuuccgccccacccagggcggccaggucuccaucgcccucuccucccacuggaucaacccccgccgcaugaccgaccacuccaucaaggagugccagaagucccucgacuucguccucggcugguucgccaagcccgucuucaucgacggcgacuaccccgaguccaugaagaacaaccucuccuccauccuccccgacuucaccgaguccgagaagaaguucaucaagggcaccgccgacuucuucgcccucugcuucggccccacccucuccuuccagcuccucgacccccacaugaaguuccgccagcucgagucccccaaccuccgccagcuccucuccuggaucgaccucgaguucaaccacccccagaucuucaucgucgagaacggcugguucgucuccggcaccaccaagcgcgacgacgccaaguacauguacuaccucaagaaguucaucauggagacccucaaggccaucaagcucgacggcgucgacgucaucggcuacaccgccuggucccucauggacggcuucgaguggcaccgcggcuacuccauccgccgcggccucuucuacgucgacuuccucucccaggacaagaugcuccuccccaaguccuccgcccucuucuaccagaagcucaucgagaagaacggcuuccccccccuccccgagaaccagccccucgagggcaccuuccccugcgacuucgccuggggcgucgucgacaacuacauccaggucgacaccacccucucccaguucaccgaccucaacgucuaccucugggacguccaccacuccaagcgccucaucaaggucgacggcgucgucaccaagaagcgcaaguccuacugcgucgacuucgccgccauccagccccagaucgcccuccuccaggagaugcacgucacccacuuccgcuucucccucgacugggcccucauccucccccucggcaaccagucccaggucaaccacaccauccuccaguacuaccgcugcauggccuccgagcucguccgcgucaacaucacccccgucgucgcccucuggcagcccauggcccccaaccagggccucccccgccuccucgcccgccagggcgccugggagaaccccuacaccgcccucgccuucgccgaguacgcccgccucugcuuccaggagcucggccaccacgucaagcucuggaucaccaugaacgagcccuacacccgcaacaugaccuacuccgccggccacaaccuccucaaggcccacgcccucgccuggcacgucuacaacgagaaguuccgccacgcccagaacggcaagaucuccaucgcccuccaggccgacuggaucgagcccgccugccccuucucccagaaggacaaggaggucgccgagcgcguccucgaguucgacaucggcuggcucgccgagcccaucuucggcuccggcgacuaccccugggucaugcgcgacuggcucaaccagcgcaacaacuuccuccuccccuacuucaccgaggacgagaagaagcucauccagggcaccuucgacuuccucgcccucucccacuacaccaccauccucgucgacuccgagaaggaggaccccaucaaguacaacgacuaccucgagguccaggagaugaccgacaucaccuggcucaacucccccucccaggucgccgucguccccuggggccuccgcaagguccucaacuggcucaaguucaaguacggcgaccuccccauguacaucaucuccaacggcaucgacgacggccuccacgccgaggacgaccagcuccgcgucuacuacaugcagaacuacaucaacgaggcccucaaggcccacauccucgacggcaucaaccucugcggcuacuucgccuacuccuucaacgaccgcaccgccccccgcuucggccucuaccgcuacgccgccgaccaguucgagcccaaggccuccaugaagcacuaccgcaagaucaucgacuccaacggcuuccccggccccgagacccucgagcgcuucugccccgaggaguucaccgucugcaccgagugcuccuucuuccacacccgcaagucccuccucgccuucaucgccuuccucuucuucgccuccaucaucucccucucccucaucuucuacuacuccaagaagggccgccgcuccuacaaguga

SEQ ID NO: 45137 - RNA, 831 nt, Artificial Sequence
  derived and/or modified sequence opt2 from KLK10__Homo_sapiens__NP_002767
augcgcgccccccaccuccaccucuccgccgccuccggcgcccgcgcccucgccaagcuccucccccuccucauggcccagcucugggccgccgaggccgcccuccucccccagaacgacacccgccucgaccccgaggccuacggcucccccugcgcccgcggcucccagcccuggcaggucucccucuucaacggccucuccuuccacugcgccggcguccucgucgaccaguccuggguccucaccgccgcccacugcggcaacaagccccucugggcccgcgucggcgacgaccaccuccuccuccuccagggcgagcagcuccgccgcaccacccgcuccgucguccaccccaaguaccaccagggcuccggccccauccucccccgccgcaccgacgagcacgaccucaugcuccucaagcucgcccgccccgucguccucggcccccgcguccgcgcccuccagcuccccuaccgcugcgcccagcccggcgaccagugccaggucgccggcuggggcaccaccgccgcccgccgcgucaaguacaacaagggccucaccugcuccuccaucaccauccucucccccaaggagugcgaggucuucuaccccggcgucgucaccaacaacaugaucugcgccggccucgaccgcggccaggaccccugccaguccgacuccggcggcccccucgucugcgacgagacccuccagggcauccucuccuggggcgucuaccccugcggcuccgcccagcaccccgccgucuacacccagaucugcaaguacauguccuggaucaacaaggucauccgcuccaacuga

SEQ ID NO: 45138 - RNA, 753 nt, Artificial Sequence
  derived and/or modified sequence opt2 from KLK11__Homo_sapiens__NP_001129504
augcgcauccuccagcucauccuccucgcccucgccaccggccucgucggcggcgagacccgcaucaucaagggcuucgagugcaagccccacucccagcccuggcaggccgcccucuucgagaagacccgccuccucugcggcgccacccucaucgccccccgcuggcuccucaccgccgcccacugccucaagccccgcuacaucguccaccucggccagcacaaccuccagaaggaggagggcugcgagcagacccgcaccgccaccgaguccuucccccaccccggcuucaacaacucccuccccaacaaggaccaccgcaacgacaucaugcucgucaagauggccucccccgucuccaucaccugggccguccgcccccucacccucuccucccgcugcgucaccgccggcaccuccugccucaucuccggcuggggcuccaccuccuccccccagcuccgccucccccacacccuccgcugcgccaacaucaccaucaucgagcaccagaagugcgagaacgccuaccccggcaacaucaccgacaccauggucugcgccuccguccaggagggcggcaaggacuccugccagggcgacuccggcggcccccucgucugcaaccagucccuccagggcaucaucuccuggggccaggaccccugcgccaucacccgcaagcccggcgucuacaccaaggucugcaaguacgucgacuggauccaggagaccaugaagaacaacuga

SEQ ID NO: 45139 - RNA, 765 nt, Artificial Sequence
  derived and/or modified sequence opt2 from KLK12__Homo_sapiens__NP_062544
augggccucuccaucuuccuccuccucugcguccucggccucucccaggccgccacccccaagaucuucaacggcaccgagugcggccgcaacucccagcccuggcaggucggccucuucgagggcaccucccuccgcugcggcggcguccucaucgaccaccgcuggguccucaccgccgcccacugcuccggcucccgcuacuggguccgccucggcgagcacucccucucccagcucgacuggaccgagcagauccgccacuccggcuucuccgucacccaccccggcuaccucggcgccuccaccucccacgagcacgaccuccgccuccuccgccuccgccuccccguccgcgucaccuccuccguccagccccucccccuccccaacgacugcgccaccgccggcaccgagugccacgucuccggcuggggcaucaccaaccacccccgcaaccccuuccccgaccuccuccagugccucaaccucuccaucgucucccacgccaccugccacggcgucuaccccggccgcaucaccuccaacauggucugcgccggcggcguccccggccaggacgccugccagggcgacuccggcggcccccucgucugcggcggcguccuccagggccucgucuccuggggcuccgucggccccugcggccaggacggcauccccggcgucuacaccuacaucugcaacuccacccucgucggccucggcaccuccuggaacuucaacuccugccagcccuucuga

SEQ ID NO: 45140 - RNA, 834 nt, Artificial Sequence
  derived and/or modified sequence opt2 from KLK13__Homo_sapiens__NP_056411
auguggccccucgcccucgucaucgccucccucacccucgcccucuccggcggcgucucccaggaguccuccaagguccucaacaccaacggcaccuccggcuuccuccccggcggcuacaccugcuucccccacucccagcccuggcaggccgcccuccucguccagggccgccuccucugcggcggcguccucguccaccccaaguggguccucaccgccgcccacugccucaaggagggccucaaggucuaccucggcaagcacgcccucggccgcgucgaggccggcgagcagguccgcgaggucguccacuccaucccccaccccgaguaccgccgcucccccacccaccucaaccacgaccacgacaucaugcuccucgagcuccagucccccguccagcucaccggcuacauccagacccucccccucucccacaacaaccgccucacccccggcaccaccugccgcgucuccggcuggggcaccaccaccuccccccaggucaacuaccccaagacccuccagugcgccaacauccagcuccgcuccgacgaggagugccgccaggucuaccccggcaagaucaccgacaacaugcucugcgccggcaccaaggagggcggcaaggacuccugcgagggcgacuccggcggcccccucgucugcaaccgcacccucuacggcaucgucuccuggggcgacuuccccugcggccagcccgaccgccccggcgucuacacccgcgucucccgcuacguccucuggauccgcgagaccauccgcaaguacgagacccagcagcagaaguggcucaagggcccccaguga

SEQ ID NO: 45141 - RNA, 804 nt, Artificial Sequence
  derived and/or modified sequence opt2 from KLK14__Homo_sapiens__NP_071329
augucccuccgcguccucggcuccggcaccuggcccuccgcccccaagauguuccuccuccucaccgcccuccagguccucgccaucgccaugacccagucccaggaggacgagaacaagaucaucggcggccacaccugcacccgcuccucccagcccuggcaggccgcccuccucgccggcccccgccgccgcuuccucugcggcggcgcccuccucuccggccagugggucaucaccgccgcccacugcggccgccccauccuccaggucgcccucggcaagcacaaccuccgccgcugggaggccacccagcagguccuccgcgucguccgccaggucacccaccccaacuacaacucccgcacccacgacaacgaccucaugcuccuccagcuccagcagcccgcccgcaucggccgcgccguccgccccaucgaggucacccaggccugcgccucccccggcaccuccugccgcgucuccggcuggggcaccaucuccucccccaucgcccgcuaccccgccucccuccagugcgucaacaucaacaucucccccgacgaggucugccagaaggccuacccccgcaccaucacccccggcauggucugcgccggcgucccccagggcggcaaggacuccugccagggcgacuccggcggcccccucgucugccgcggccagcuccagggccucgucuccuggggcauggagcgcugcgcccuccccggcuaccccggcgucuacaccaaccucugcaaguaccgcuccuggaucgaggagaccaugcgcgacaaguga

SEQ ID NO: 45142 - RNA, 768 nt, Artificial Sequence
  derived and/or modified sequence opt2 from KLK15__Homo_sapiens__NP_001264010
auguggcuccuccucacccucuccuuccuccucgccuccaccgcccaggacggcgacaagcuccucgagggcgacgagugcgccccccacucccagcccuggcaggucgcccucuacgagcgcggccgcuucaacugcggcgccucccucaucuccccccacuggguccucuccgccgcccacugccagucccgcuucaugcgcguccgccucggcgagcacaaccuccgcaagcgcgacggccccgagcagcuccgcaccaccucccgcgucaucccccacccccgcuacgaggcccgcucccaccgcaacgacaucaugcuccuccgccucguccagcccgcccgccucaacccccagguccgccccgccguccuccccacccgcugcccccaccccggcgaggccugcgucgucuccggcuggggccucgucucccacaacgagcccggcaccgccggcuccccccgcucccaggucucccuccccgacacccuccacugcgccaacaucuccaucaucuccgacaccuccugcgacaaguccuaccccggccgccucaccaacaccauggucugcgccggcgccgagggccgcggcgccgaguccugcgagggcgacuccggcggcccccucgucugcggcggcauccuccagggcaucgucuccuggggcgacguccccugcgacaacaccaccaagcccggcgucuacaccaaggucugccacuaccucgaguggauccgcgagaccaugaagcgcaacuga

SEQ ID NO: 45143 - RNA, 789 nt, Artificial Sequence
  derived and/or modified sequence opt2 from KLK1__Homo_sapiens__NP_002248
augugguuccucguccucugccucgcccucucccucggcggcaccggcgccgccccccccauccagucccgcaucgucggcggcugggagugcgagcagcacucccagcccuggcaggccgcccucuaccacuucuccaccuuccagugcggcggcauccucguccaccgccaguggguccucaccgccgcccacugcaucuccgacaacuaccagcucuggcucggccgccacaaccucuucgacgacgagaacaccgcccaguucguccacgucuccgaguccuucccccaccccggcuucaacaugucccuccucgagaaccacacccgccaggccgacgaggacuacucccacgaccucaugcuccuccgccucaccgagcccgccgacaccaucaccgacgccgucaaggucgucgagcuccccaccgaggagcccgaggucggcuccaccugccucgccuccggcuggggcuccaucgagcccgagaacuucuccuuccccgacgaccuccagugcgucgaccucaagauccuccccaacgacgagugcaagaaggcccacguccagaaggucaccgacuucaugcucugcgucggccaccucgagggcggcaaggacaccugcgucggcgacuccggcggcccccucaugugcgacggcguccuccagggcgucaccuccuggggcuacguccccugcggcacccccaacaagcccuccgucgccguccgcguccucuccuacgucaaguggaucgaggacaccaucgccgagaacuccuga

SEQ ID NO: 45144 - RNA, 672 nt, Artificial Sequence
  derived and/or modified sequence opt2 from KLK2__Homo_sapiens__NP_001002231
augugggaccucguccucuccaucgcccucuccgucggcugcaccggcgccgucccccucauccagucccgcaucgucggcggcugggagugcgagaagcacucccagcccuggcaggucgccgucuacucccacggcugggcccacugcggcggcguccucguccacccccaguggguccucaccgccgcccacugccucaagaagaacucccaggucuggcucggccgccacaaccucuucgagcccgaggacaccggccagcgcguccccgucucccacuccuucccccacccccucuacaacaugucccuccucaagcaccagucccuccgccccgacgaggacuccucccacgaccucaugcuccuccgccucuccgagcccgccaagaucaccgacgucgucaagguccucggccuccccacccaggagcccgcccucggcaccaccugcuacgccuccggcuggggcuccaucgagcccgaggaguuccuccgcccccgcucccuccagugcgucucccuccaccuccucuccaacgacaugugcgcccgcgccuacuccgagaaggucaccgaguucaugcucugcgccggccucuggaccggcggcaaggacaccugcggcgucucccaccccuacucccagcaccucgagggcaagggcuga

SEQ ID NO: 45145 - RNA, 717 nt, Artificial Sequence
  derived and/or modified sequence opt2 from KLK3__Homo_sapiens__NP_001025218
auguggguccccgucgucuuccucacccucuccgucaccuggaucggcgccgccccccucauccucucccgcaucgucggcggcugggagugcgagaagcacucccagcccuggcagguccucgucgccucccgcggccgcgccgucugcggcggcguccucguccacccccaguggguccucaccgccgcccacugcauccgcaacaaguccgucauccuccucggccgccacucccucuuccaccccgaggacaccggccaggucuuccaggucucccacuccuucccccacccccucuacgacaugucccuccucaagaaccgcuuccuccgccccggcgacgacuccucccacgaccucaugcuccuccgccucuccgagcccgccgagcucaccgacgccgucaaggucauggaccuccccacccaggagcccgcccucggcaccaccugcuacgccuccggcuggggcuccaucgagcccgaggaguuccucacccccaagaagcuccagugcgucgaccuccacgucaucuccaacgacgucugcgcccagguccacccccagaaggucaccaaguucaugcucugcgccggccgcuggaccggcggcaaguccaccugcuccugggucauccucaucaccgagcucaccaugcccgcccuccccaugguccuccacggcucccucguccccuggcgcggcggcgucuga

SEQ ID NO: 45146 - RNA, 765 nt, Artificial Sequence
  derived and/or modified sequence opt2 from KLK4__Homo_sapiens__NP_004908
auggccaccgccggcaaccccuggggcugguuccucggcuaccucauccucggcgucgccggcucccucgucuccggcuccugcucccagaucaucaacggcgaggacugcuccccccacucccagcccuggcaggccgcccucgucauggagaacgagcucuucugcuccggcguccucguccacccccaguggguccucuccgccgcccacugcuuccagaacuccuacaccaucggccucggccuccacucccucgaggccgaccaggagcccggcucccagauggucgaggccucccucuccguccgccaccccgaguacaaccgcccccuccucgccaacgaccucaugcucaucaagcucgacgaguccgucuccgaguccgacaccauccgcuccaucuccaucgccucccagugccccaccgccggcaacuccugccucgucuccggcuggggccuccucgccaacggccgcaugcccaccguccuccagugcgucaacgucuccgucgucuccgaggaggucugcuccaagcucuacgacccccucuaccaccccuccauguucugcgccggcggcggccaggaccagaaggacuccugcaacggcgacuccggcggcccccucaucugcaacggcuaccuccagggccucgucuccuucggcaaggcccccugcggccaggucggcguccccggcgucuacaccaaccucugcaaguucaccgaguggaucgagaagaccguccaggccuccuga

SEQ ID NO: 45147 - RNA, 882 nt, Artificial Sequence
  derived and/or modified sequence opt2 from KLK5__Homo_sapiens__NP_036559
auggccaccgcccgcccccccuggauguggguccucugcgcccucaucaccgcccuccuccucggcgucaccgagcacguccucgccaacaacgacgucuccugcgaccaccccuccaacaccguccccuccggcuccaaccaggaccucggcgccggcgccggcgaggacgcccgcuccgacgacuccuccucccgcaucaucaacggcuccgacugcgacaugcacacccagcccuggcaggccgcccuccuccuccgccccaaccagcucuacugcggcgccguccucguccacccccaguggcuccucaccgccgcccacugccgcaagaaggucuuccgcguccgccucggccacuacucccucucccccgucuacgaguccggccagcagauguuccagggcgucaaguccaucccccaccccggcuacucccaccccggccacuccaacgaccucaugcucaucaagcucaaccgccgcauccgccccaccaaggacguccgccccaucaacgucuccucccacugccccuccgccggcaccaagugccucgucuccggcuggggcaccaccaaguccccccagguccacuuccccaagguccuccagugccucaacaucuccguccucucccagaagcgcugcgaggacgccuacccccgccagaucgacgacaccauguucugcgccggcgacaaggccggccgcgacuccugccagggcgacuccggcggccccgucgucugcaacggcucccuccagggccucgucuccuggggcgacuaccccugcgcccgccccaaccgccccggcgucuacaccaaccucugcaaguucaccaaguggauccaggagaccauccaggccaacuccuga

SEQ ID NO: 45148 - RNA, 735 nt, Artificial Sequence
  derived and/or modified sequence opt2 from KLK6__Homo_sapiens__NP_001012982
augaagaagcucauggucguccucucccucaucgccgccgccugggccgaggagcagaacaagcucguccacggcggccccugcgacaagaccucccaccccuaccaggccgcccucuacaccuccggccaccuccucugcggcggcguccucauccacccccucuggguccucaccgccgcccacugcaagaagcccaaccuccaggucuuccucggcaagcacaaccuccgccagcgcgaguccucccaggagcaguccuccgucguccgcgccgucauccaccccgacuacgacgccgccucccacgaccaggacaucaugcuccuccgccucgcccgccccgccaagcucuccgagcucauccagccccucccccucgagcgcgacugcuccgccaacaccaccuccugccacauccucggcuggggcaagaccgccgacggcgacuuccccgacaccauccagugcgccuacauccaccucgucucccgcgaggagugcgagcacgccuaccccggccagaucacccagaacaugcucugcgccggcgacgagaaguacggcaaggacuccugccagggcgacuccggcggcccccucgucugcggcgaccaccuccgcggccucgucuccuggggcaacauccccugcggcuccaaggagaagcccggcgucuacaccaacgucugccgcuacaccaacuggauccagaagaccauccaggccaaguga

SEQ ID NO: 45149 - RNA, 546 nt, Artificial Sequence
  derived and/or modified sequence opt2 from KLK7__Homo_sapiens__NP_001193982
augaacgaguacaccguccaccucggcuccgacacccucggcgaccgccgcgcccagcgcaucaaggccuccaaguccuuccgccaccccggcuacuccacccagacccacgucaacgaccucaugcucgucaagcucaacucccaggcccgccucuccuccauggucaagaagguccgccuccccucccgcugcgagccccccggcaccaccugcaccgucuccggcuggggcaccaccaccucccccgacgucaccuuccccuccgaccucaugugcgucgacgucaagcucaucuccccccaggacugcaccaaggucuacaaggaccuccucgagaacuccaugcucugcgccggcauccccgacuccaagaagaacgccugcaacggcgacuccggcggcccccucgucugccgcggcacccuccagggccucgucuccuggggcaccuuccccugcggccagcccaacgaccccggcgucuacacccaggucugcaaguucaccaaguggaucaacgacaccaugaagaagcaccgcuga

SEQ ID NO: 45150 - RNA, 783 nt, Artificial Sequence
  derived and/or modified sequence opt2 from KLK8__Homo_sapiens__NP_009127
augggccgcccccgcccccgcgccgccaagaccuggauguuccuccuccuccucggcggcgccugggccggccacucccgcgcccaggaggacaagguccucggcggccacgagugccagccccacucccagcccuggcaggccgcccucuuccagggccagcagcuccucugcggcggcguccucgucggcggcaacuggguccucaccgccgcccacugcaagaagcccaaguacaccguccgccucggcgaccacucccuccagaacaaggacggccccgagcaggagauccccgucguccaguccaucccccaccccugcuacaacuccuccgacgucgaggaccacaaccacgaccucaugcuccuccagcuccgcgaccaggccucccucggcuccaaggucaagcccaucucccucgccgaccacugcacccagcccggccagaagugcaccgucuccggcuggggcaccgucaccuccccccgcgagaacuuccccgacacccucaacugcgccgaggucaagaucuucccccagaagaagugcgaggacgccuaccccggccagaucaccgacggcauggucugcgccggcuccuccaagggcgccgacaccugccagggcgacuccggcggcccccucgucugcgacggcgcccuccagggcaucaccuccuggggcuccgaccccugcggccgcuccgacaagcccggcgucuacaccaacaucugccgcuaccucgacuggaucaagaagaucaucggcuccaagggcuga

SEQ ID NO: 45151 - RNA, 753 nt, Artificial Sequence
  derived and/or modified sequence opt2 from KLK9__Homo_sapiens__NP_036447
augaagcucggccuccucugcgcccuccucucccuccucgccggccacggcugggccgacacccgcgccaucggcgccgaggagugccgccccaacucccagcccuggcaggccggccucuuccaccucacccgccucuucugcggcgccacccucaucuccgaccgcuggcuccucaccgccgcccacugccgcaagcccuaccucuggguccgccucggcgagcaccaccucuggaagugggagggccccgagcagcucuuccgcgucaccgacuucuucccccaccccggcuucaacaaggaccucuccgccaacgaccacaacgacgacaucaugcucauccgccucccccgccaggcccgccucucccccgccguccagccccucaaccucucccagaccugcgucucccccggcaugcagugccucaucuccggcuggggcgccgucuccucccccaaggcccucuuccccgucacccuccagugcgccaacaucuccauccucgagaacaagcucugccacugggccuaccccggccacaucuccgacuccaugcucugcgccggccucugggagggcggccgcggcuccugccagggcgacuccggcggcccccucgucugcaacggcacccucgccggcgucgucuccggcggcgccgagcccugcucccgcccccgccgccccgccgucuacaccuccgucugccacuaccucgacuggauccaggagaucauggagaacuga

SEQ ID NO: 45152 - RNA, 1917 nt, Artificial Sequence
  derived and/or modified sequence opt2 from KLKB1__Homo_sapiens__NP_000883
augauccucuucaagcaggccaccuacuucaucucccucuucgccaccgucuccugcggcugccucacccagcucuacgagaacgccuucuuccgcggcggcgacgucgccuccauguacacccccaacgcccaguacugccagaugcgcugcaccuuccacccccgcugccuccucuucuccuuccuccccgccuccuccaucaacgacauggagaagcgcuucggcugcuuccucaaggacuccgucaccggcacccuccccaagguccaccgcaccggcgccgucuccggccacucccucaagcagugcggccaccagaucuccgccugccaccgcgacaucuacaagggcgucgacaugcgcggcgucaacuucaacgucuccaaggucuccuccgucgaggagugccagaagcgcugcaccuccaacauccgcugccaguucuucuccuacgccacccagaccuuccacaaggccgaguaccgcaacaacugccuccucaaguacucccccggcggcacccccaccgccaucaagguccucuccaacgucgaguccggcuucucccucaagcccugcgcccucuccgagaucggcugccacaugaacaucuuccagcaccucgccuucuccgacgucgacgucgcccgcguccucacccccgacgccuucgucugccgcaccaucugcaccuaccaccccaacugccucuucuucaccuucuacaccaacgucuggaagaucgagucccagcgcaacgucugccuccucaagaccuccgaguccggcacccccuccuccuccaccccccaggagaacaccaucuccggcuacucccuccucaccugcaagcgcacccuccccgagcccugccacuccaagaucuaccccggcgucgacuucggcggcgaggagcucaacgucaccuucgucaagggcgucaacgucugccaggagaccugcaccaagaugauccgcugccaguucuucaccuacucccuccuccccgaggacugcaaggaggagaagugcaagugcuuccuccgccucuccauggacggcucccccacccgcaucgccuacggcacccagggcuccuccggcuacucccuccgccucugcaacaccggcgacaacuccgucugcaccaccaagaccuccacccgcaucgucggcggcaccaacuccuccuggggcgaguggcccuggcaggucucccuccaggucaagcucaccgcccagcgccaccucugcggcggcucccucaucggccaccaguggguccucaccgccgcccacugcuucgacggccucccccuccaggacgucuggcgcaucuacuccggcauccucaaccucuccgacaucaccaaggacacccccuucucccagaucaaggagaucaucauccaccagaacuacaaggucuccgagggcaaccacgacaucgcccucaucaagcuccaggccccccucaacuacaccgaguuccagaagcccaucugccuccccuccaagggcgacaccuccaccaucuacaccaacugcugggucaccggcuggggcuucuccaaggagaagggcgagauccagaacauccuccagaaggucaacaucccccucgucaccaacgaggagugccagaagcgcuaccaggacuacaagaucacccagcgcauggucugcgccggcuacaaggagggcggcaaggacgccugcaagggcgacuccggcggcccccucgucugcaagcacaacggcauguggcgccucgucggcaucaccuccuggggcgagggcugcgcccgccgcgagcagcccggcgucuacaccaaggucgccgaguacauggacuggauccucgagaagacccaguccuccgacggcaaggcccagaugcagucccccgccuga

SEQ ID NO: 45153 - RNA, 537 nt, Artificial Sequence
  derived and/or modified sequence opt2 from KLLN__Homo_sapiens__NP_001119521
auggaccgccccggccccggcuccgcccgccccggccgcaccguccacgucuggggcuaccgcgucgaguggaagguccgcaacggccgcaagcuccagcccuccgagugggccggccgcggcgaccucggcggcuucaagcgccgcuggaaggacacccgcgccaccgucggcaccaccuuccgccgccgcucccgcgucucccucgucggcgagcucuccaaguucccccuccccuccgacuccuccggcggcaaguccuccuccuccuucgcccgcggcgcccucgccuggugccgccagcgcaaccccaaccccuccugcgccgccgccgagaccggcgcccgcaccucccuccccaaggagcgcugccgcggcuggcgccucggcaacuggcuccacaagcacccccaccccaacaccugcccccgccuccccgccugcuggcucccccccauccucaccgagcgcggcgagcgcguccccaagcucgucccccuccucgccugcuaccccaaguccaagcccaaggacuga

SEQ ID NO: 45154 - RNA, 678 nt, Artificial Sequence
  derived and/or modified sequence opt2 from KLRB1__Homo_sapiens__NP_002249
auggaccagcaggccaucuacgccgagcucaaccuccccaccgacuccggccccgaguccuccucccccuccucccucccccgcgacgucugccagggcucccccuggcaccaguucgcccucaagcucuccugcgccggcaucauccuccucguccucgucgucaccggccucuccgucuccgucaccucccucauccagaaguccuccaucgagaagugcuccgucgacauccagcagucccgcaacaagaccaccgagcgccccggccuccucaacugccccaucuacuggcagcagcuccgcgagaagugccuccucuucucccacaccgucaaccccuggaacaacucccucgccgacugcuccaccaaggaguccucccuccuccucauccgcgacaaggacgagcucauccacacccagaaccucauccgcgacaaggccauccucuucuggaucggccucaacuucucccucuccgagaagaacuggaaguggaucaacggcuccuuccucaacuccaacgaccucgagauccgcggcgacgccaaggagaacuccugcaucuccaucucccagaccuccgucuacuccgaguacugcuccaccgagauccgcuggaucugccagaaggagcucacccccguccgcaacaaggucuaccccgacuccuga

SEQ ID NO: 45155 - RNA, 648 nt, Artificial Sequence
  derived and/or modified sequence opt2 from KLRC1__Homo_sapiens__NP_998822
auggacaaccagggcgucaucuacuccgaccucaaccucccccccaaccccaagcgccagcagcgcaagcccaagggcaacaaguccuccauccucgccaccgagcaggagaucaccuacgccgagcucaaccuccagaaggccucccaggacuuccagggcaacgacaagaccuaccacugcaaggaccuccccuccgcccccgagaagcucaucgucggcauccucggcaucaucugccucauccucauggccuccgucgucaccaucgucgucauccccucccgccacugcggccacugccccgaggaguggaucaccuacuccaacuccugcuacuacaucggcaaggagcgccgcaccugggaggagucccuccucgccugcaccuccaagaacuccucccuccucuccaucgacaacgaggaggagaugaaguuccucuccaucaucucccccuccuccuggaucggcgucuuccgcaacuccucccaccaccccugggucaccaugaacggccucgccuucaagcacgagaucaaggacuccgacaacgccgagcucaacugcgccguccuccaggucaaccgccucaaguccgcccagugcggcuccuccaucaucuaccacugcaagcacaagcucuga

SEQ ID NO: 45156 - RNA, 696 nt, Artificial Sequence
  derived and/or modified sequence opt2 from KLRC2__Homo_sapiens__NP_002251
augaacaagcagcgcggcaccuucuccgaggucucccucgcccaggaccccaagcgccagcagcgcaagcccaagggcaacaaguccuccaucuccggcaccgagcaggagaucuuccaggucgagcucaaccuccagaaccccucccucaaccaccagggcaucgacaagaucuacgacugccagggccuccuccccccccccgagaagcucaccgccgagguccucggcaucaucugcaucguccucauggccaccguccucaagaccaucguccucauccccuuccucgagcagaacaacuucucccccaacacccgcacccagaaggcccgccacugcggccacugccccgaggaguggaucaccuacuccaacuccugcuacuacaucggcaaggagcgccgcaccugggaggagucccuccucgccugcaccuccaagaacuccucccuccucuccaucgacaacgaggaggagaugaaguuccucgccuccauccuccccuccuccuggaucggcgucuuccgcaacuccucccaccaccccugggucaccaucaacggccucgccuucaagcacaagaucaaggacuccgacaacgccgagcucaacugcgccguccuccaggucaaccgccucaaguccgcccagugcggcuccuccaugaucuaccacugcaagcacaagcucuga

SEQ ID NO: 45157 - RNA, 477 nt, Artificial Sequence
  derived and/or modified sequence opt2 from KLRC4__Homo_sapiens__NP_038459
augaacaagcagcgcggcaccuacuccgaggucucccucgcccaggaccccaagcgccagcagcgcaagcucaagggcaacaagaucuccaucuccggcaccaagcaggagaucuuccaggucgagcucaaccuccagaacgccuccuccgaccaccagggcaacgacaagaccuaccacugcaagggccuccuccccccccccgagaagcucaccgccgagguccucggcaucaucugcaucguccucauggccaccguccucaagaccaucguccucauccccugcaucggcguccucgagcagaacaacuucucccucaaccgccgcaugcagaaggcccgccacugcggccacugccccgaggaguggaucaccuacuccaacuccugcuacuacaucggcaaggagcgccgcaccugggaggagcgcgucugcuggcccguccuccgccgcacccucaucugcuuccucuga

SEQ ID NO: 45158 - RNA, 651 nt, Artificial Sequence
  derived and/or modified sequence opt2 from KLRC4-KLRK1__Homo_sapiens__NP_001186734
augggcuggauccgcggccgccgcucccgccacuccugggagauguccgaguuccacaacuacaaccucgaccucaagaaguccgacuucuccacccgcuggcagaagcagcgcugccccgucgucaaguccaagugccgcgagaacgccucccccuucuucuucugcugcuucaucgccgucgccaugggcauccgcuucaucaucauggucaccaucugguccgccgucuuccucaacucccucuucaaccaggagguccagaucccccucaccgaguccuacugcggccccugccccaagaacuggaucugcuacaagaacaacugcuaccaguucuucgacgaguccaagaacugguacgagucccaggccuccugcaugucccagaacgccucccuccucaaggucuacuccaaggaggaccaggaccuccucaagcucgucaaguccuaccacuggaugggccucguccacauccccaccaacggcuccuggcagugggaggacggcuccauccucucccccaaccuccucaccaucaucgagaugcagaagggcgacugcgcccucuacgccuccuccuucaagggcuacaucgagaacugcuccacccccaacaccuacaucugcaugcagcgcaccgucuga

SEQ ID NO: 45159 - RNA, 540 nt, Artificial Sequence
  derived and/or modified sequence opt2 from KLRD1__Homo_sapiens__NP_001107868
auggccgucuucaagaccacccucuggcgccucaucuccggcacccucggcaucaucugccucucccucauggccacccucggcauccuccucaagaacuccuucaccaagcucuccaucgagcccgccuucacccccggccccaacaucgagcuccagaaggacuccgacugcugcuccugccaggagaagugggucggcuaccgcugcaacugcuacuucaucuccuccgagcagaagaccuggaacgagucccgccaccucugcgccucccagaaguccucccuccuccagcuccagaacaccgacgagcucgacuucauguccuccucccagcaguucuacuggaucggccucuccuacuccgaggagcacaccgccuggcucugggagaacggcuccgcccucucccaguaccucuuccccuccuucgagaccuucaacaccaagaacugcaucgccuacaaccccaacggcaacgcccucgacgaguccugcgaggacaagaaccgcuacaucugcaagcagcagcucaucuga

SEQ ID NO: 45160 - RNA, 570 nt, Artificial Sequence
  derived and/or modified sequence opt2 from KLRG1__Homo_sapiens__NP_005801
augaccgacuccgucaucuacuccaugcucgagcuccccaccgccacccaggcccagaacgacuacggcccccagcagaaguccuccuccucccgccccuccugcuccugccucgucgccaucgcccucggccuccucaccgccguccuccucuccguccuccucuaccaguggauccucugccagggcuccaacuacuccaccugcgccuccugccccuccugccccgaccgcuggaugaaguacggcaaccacugcuacuacuucuccgucgaggagaaggacuggaacuccucccucgaguucugccucgcccgcgacucccaccuccucgucaucaccgacaaccaggagaugucccuccuccaggucuuccucuccgaggccuucugcuggaucggccuccgcaacaacuccggcuggcgcugggaggacggcuccccccucaacuucucccgcaucuccuccaacuccuucguccagaccugcggcgccaucaacaagaacggccuccaggccuccuccugcgaggucccccuccacugggucugcaagaagguccgccucuga

SEQ ID NO: 45161 - RNA, 1230 nt, Artificial Sequence
  derived and/or modified sequence opt2 from KLRG2__Homo_sapiens__NP_940910
auggaggaguccugggaggccgcccccggcggccaggccggcgccgagcuccccauggagcccgucggcucccucguccccacccucgagcagccccagguccccgccaagguccgccagcccgagggccccgaguccucccccucccccgccggcgccgucgagaaggccgccggcgccggccucgagcccuccuccaagaagaagccccccuccccccgccccggcuccccccgcguccccccccucucccucggcuacggcgucugccccgagccccccucccccggccccgcccucgucaagcucccccgcaacggcgaggcccccggcgccgagcccgcccccuccgccugggcccccauggagcuccaggucgacguccgcgucaagcccgucggcgccgccggcggcuccuccacccccuccccccgccccuccacccgcuuccucaagguccccguccccgagucccccgccuucucccgccacgccgaccccgcccaccagcuccuccuccgcgcccccucccagggcggcaccuggggccgccgcuccccccucgccgccgcccgcaccgaguccggcugcgacgccgagggccgcgccucccccgccgagggcuccgccggcucccccggcucccccaccugcugccgcugcaaggagcucggccucgagaaggaggacgccgcccuccucccccgcgccggccucgacggcgacgagaagcucccccgcgccgucacccucaccggccuccccauguacgucaagucccucuacugggcccucgccuucauggccguccuccucgccgucuccggcgucgucaucgucguccucgccucccgcgccggcgcccgcugccagcagugcccccccggcuggguccucuccgaggagcacugcuacuacuucuccgccgaggcccaggccugggaggccucccaggccuucugcuccgccuaccacgccacccucccccuccucucccacacccaggacuuccucggccgcuaccccgucucccgccacuccugggucggcgccuggcgcggcccccagggcuggcacuggaucgacgaggccccccuccccccccagcuccuccccgaggacggcgaggacaaccucgacaucaacugcggcgcccucgaggagggcacccucgucgccgccaacugcuccaccccccgccccugggucugcgccaagggcacccaguga

SEQ ID NO: 45162 - RNA, 1461 nt, Artificial Sequence
  derived and/or modified sequence opt2 from KMO__Homo_sapiens__NP_003670
auggacuccuccgucauccagcgcaagaaggucgccgucaucggcggcggccucgucggcucccuccaggccugcuuccucgccaagcgcaacuuccagaucgacgucuacgaggcccgcgaggacacccgcgucgccaccuucacccgcggccgcuccaucaaccucgcccucucccaccgcggccgccaggcccucaaggccgucggccucgaggaccagaucgucucccagggcauccccaugcgcgcccgcaugauccacucccucuccggcaagaaguccgccauccccuacggcaccaagucccaguacauccucuccgucucccgcgagaaccucaacaaggaccuccucaccgccgccgagaaguaccccaacgucaagaugcacuucaaccaccgccuccucaagugcaaccccgaggagggcaugaucaccguccucggcuccgacaagguccccaaggacgucaccugcgaccucaucgucggcugcgacggcgccuacuccaccguccgcucccaccucaugaagaagccccgcuucgacuacucccagcaguacaucccccacggcuacauggagcucaccaucccccccaagaacggcgacuacgccauggagcccaacuaccuccacaucuggccccgcaacaccuucaugaugaucgcccuccccaacaugaacaaguccuucaccugcacccucuucaugcccuucgaggaguucgagaagcuccucaccuccaacgacgucgucgacuucuuccagaaguacuuccccgacgccaucccccucaucggcgagaagcuccucguccaggacuucuuccuccuccccgcccagcccaugaucuccgucaagugcuccuccuuccacuucaagucccacugcguccuccucggcgacgccgcccacgccaucguccccuucuucggccagggcaugaacgccggcuucgaggacugccucgucuucgacgagcucauggacaaguucuccaacgaccucucccucugccuccccgucuucucccgccuccgcauccccgacgaccacgccaucuccgaccucuccauguacaacuacaucgagaugcgcgcccacgucaacuccuccugguucaucuuccagaagaacauggagcgcuuccuccacgccaucaugcccuccaccuucaucccccucuacaccauggucaccuucucccgcauccgcuaccacgaggccguccagcgcuggcacuggcagaagaaggucaucaacaagggccucuucuuccucggcucccucaucgccaucuccuccaccuaccuccucauccacuacauguccccccgcuccuuccuccgccuccgccgccccuggaacuggaucgcccacuuccgcaacaccaccugcuuccccgccaaggccgucgacucccucgagcagaucuccaaccucaucucccgcuga

SEQ ID NO: 45163 - RNA, 11919 nt, Artificial Sequence
  derived and/or modified sequence opt2 from KMT2A__Homo_sapiens__NP_001184033
auggcccacuccugccgcuggcgcuuccccgcccgccccggcaccaccggcggcggcggcggcggcggccgccgcggccucggcggcgccccccgccagcgcguccccgcccuccuccucccccccggcccccccgucggcggcggcggccccggcgccccccccuccccccccgccgucgccgccgccgccgccgccgccggcuccuccggcgccggcguccccggcggcgccgccgccgccuccgccgccuccuccuccuccgccuccuccuccuccuccuccuccuccuccgccuccuccggccccgcccuccuccgcgucggccccggcuucgacgccgcccuccaggucuccgccgccaucggcaccaaccuccgccgcuuccgcgccgucuucggcgaguccggcggcggcggcggcuccggcgaggacgagcaguuccucggcuucggcuccgacgaggagguccgcguccgcucccccacccgcucccccuccgucaagaccuccccccgcaagccccgcggccgcccccgcuccggcuccgaccgcaacuccgccauccucuccgaccccuccgucuucuccccccucaacaaguccgagaccaaguccggcgacaagaucaagaagaaggacuccaaguccaucgagaagaagcgcggccgcccccccaccuuccccggcgucaagaucaagaucacccacggcaaggacaucuccgagcuccccaagggcaacaaggaggacucccucaagaagaucaagcgcacccccuccgccaccuuccagcaggccaccaagaucaagaagcuccgcgccggcaagcucuccccccucaaguccaaguucaagaccggcaagcuccagaucggccgcaagggcguccagaucguccgccgccgcggccgcccccccuccaccgagcgcaucaagacccccuccggccuccucaucaacuccgagcucgagaagccccagaagguccgcaaggacaaggagggcacccccccccucaccaaggaggacaagaccgucguccgccaguccccccgccgcaucaagcccguccgcaucauccccuccuccaagcgcaccgacgccaccaucgccaagcagcuccuccagcgcgccaagaagggcgcccagaagaagaucgagaaggaggccgcccagcuccagggccgcaaggucaagacccaggucaagaacauccgccaguucaucaugcccgucgucuccgccaucuccucccgcaucaucaagaccccccgccgcuucaucgaggacgaggacuacgacccccccaucaagaucgcccgccucgaguccacccccaacucccgcuucuccgcccccuccugcggcuccuccgagaaguccuccgccgccucccagcacuccucccagauguccuccgacuccucccgcuccuccucccccuccgucgacaccuccaccgacucccaggccuccgaggagauccagguccuccccgaggagcgcuccgacacccccgagguccaccccccccuccccaucucccagucccccgagaacgaguccaacgaccgccgcucccgccgcuacuccgucuccgagcgcuccuucggcucccgcaccaccaagaagcucuccacccuccaguccgccccccagcagcagaccuccuccucccccccccccccccuccucacccccccccccccccuccagcccgccuccuccaucuccgaccacacccccuggcucaugccccccaccaucccccucgccucccccuuccuccccgccuccaccgcccccaugcagggcaagcgcaaguccauccuccgcgagcccaccuuccgcuggaccucccucaagcacucccgcuccgagccccaguacuucuccuccgccaaguacgccaaggagggccucauccgcaagcccaucuucgacaacuuccgcccccccccccucacccccgaggacgucggcuucgccuccggcuucuccgccuccggcaccgccgccuccgcccgccucuucuccccccuccacuccggcacccgcuucgacaugcacaagcgcuccccccuccuccgcgccccccgcuucacccccuccgaggcccacucccgcaucuucgaguccgucacccuccccuccaaccgcaccuccgccggcaccuccuccuccggcgucuccaaccgcaagcgcaagcgcaaggucuucucccccauccgcuccgagccccgcucccccucccacuccaugcgcacccgcuccggccgccucuccuccuccgagcucuccccccucaccccccccuccuccgucuccuccucccucuccaucuccgucuccccccucgccaccuccgcccucaaccccaccuucaccuuccccucccacucccucacccaguccggcgaguccgccgagaagaaccagcgcccccgcaagcagaccuccgcccccgccgagcccuucuccuccuccucccccaccccccucuuccccugguucacccccggcucccagaccgagcgcggccgcaacaaggacaaggcccccgaggagcucuccaaggaccgcgacgccgacaaguccgucgagaaggacaagucccgcgagcgcgaccgcgagcgcgagaaggagaacaagcgcgagucccgcaaggagaagcgcaagaagggcuccgagauccaguccuccuccgcccucuaccccgucggccgcgucuccaaggagaaggucgucggcgaggacgucgccaccuccuccuccgccaagaaggccaccggccgcaagaaguccuccucccacgacuccggcaccgacaucaccuccgucacccucggcgacaccaccgccgucaagaccaagauccucaucaagaagggccgcggcaaccucgagaagaccaaccucgaccucggccccaccgcccccucccucgagaaggagaagacccucugccucuccacccccuccuccuccaccgucaagcacuccaccuccuccaucggcuccaugcucgcccaggccgacaagcuccccaugaccgacaagcgcgucgccucccuccucaagaaggccaaggcccagcucugcaagaucgagaaguccaagucccucaagcagaccgaccagcccaaggcccagggccaggaguccgacuccuccgagaccuccguccgcggcccccgcaucaagcacgucugccgccgcgccgccgucgcccucggccgcaagcgcgccgucuuccccgacgacaugcccacccucuccgcccuccccugggaggagcgcgagaagauccucuccuccaugggcaacgacgacaaguccuccaucgccggcuccgaggacgccgagccccucgccccccccaucaagcccaucaagcccgucacccgcaacaaggccccccaggagccccccgucaagaagggccgccgcucccgccgcugcggccagugccccggcugccagguccccgaggacugcggcgucugcaccaacugccucgacaagcccaaguucggcggccgcaacaucaagaagcagugcugcaagaugcgcaagugccagaaccuccaguggaugcccuccaaggccuaccuccagaagcaggccaaggccgucaagaagaaggagaagaaguccaagaccuccgagaagaaggacuccaaggaguccuccgucgucaagaacgucgucgacuccucccagaagcccacccccuccgcccgcgaggaccccgcccccaagaaguccuccuccgagccccccccccgcaagcccgucgaggagaaguccgaggagggcaacgucuccgcccccggccccgaguccaagcaggccaccacccccgccucccgcaaguccuccaagcaggucucccagcccgcccucgucauccccccccagccccccaccaccggccccccccgcaaggagguccccaagaccacccccuccgagcccaagaagaagcagccccccccccccgaguccggccccgagcaguccaagcagaagaaggucgccccccgccccuccauccccgucaagcagaagcccaaggagaaggagaagcccccccccgucaacaagcaggagaacgccggcacccucaacauccucuccacccucuccaacggcaacuccuccaagcagaagauccccgccgacggcguccaccgcauccgcgucgacuucaaggaggacugcgaggccgagaacgucugggagaugggcggccucggcauccucaccuccguccccaucaccccccgcgucgucugcuuccucugcgccuccuccggccacgucgaguucgucuacugccaggucugcugcgagcccuuccacaaguucugccucgaggagaacgagcgcccccucgaggaccagcucgagaacuggugcugccgccgcugcaaguucugccacgucugcggccgccagcaccaggccaccaagcagcuccucgagugcaacaagugccgcaacuccuaccaccccgagugccucggccccaacuaccccaccaagcccaccaagaagaagaaggucuggaucugcaccaagugcguccgcugcaaguccugcggcuccaccacccccggcaagggcugggacgcccaguggucccacgacuucucccucugccacgacugcgccaagcucuucgccaagggcaacuucugcccccucugcgacaagugcuacgacgacgacgacuacgaguccaagaugaugcagugcggcaagugcgaccgcuggguccacuccaagugcgagaaccucuccggcaccgaggacgagauguacgagauccucuccaaccuccccgaguccgucgccuacaccugcgucaacugcaccgagcgccaccccgccgaguggcgccucgcccucgagaaggagcuccagaucucccucaagcagguccucaccgcccuccucaacucccgcaccaccucccaccuccuccgcuaccgccaggccgccaagccccccgaccucaaccccgagaccgaggaguccauccccucccgcuccucccccgagggccccgacccccccguccucaccgaggucuccaagcaggacgaccagcagccccucgaccucgagggcgucaagcgcaagauggaccagggcaacuacaccuccguccucgaguucuccgacgacaucgucaagaucauccaggccgccaucaacuccgacggcggccagcccgagaucaagaaggccaacuccauggucaaguccuucuucauccgccagauggagcgcgucuuccccugguucuccgucaagaagucccgcuucugggagcccaacaaggucuccuccaacuccggcaugcuccccaacgccguccucccccccucccucgaccacaacuacgcccaguggcaggagcgcgaggagaacucccacaccgagcagcccccccucaugaagaagaucauccccgcccccaagcccaagggccccggcgagcccgacucccccaccccccuccacccccccaccccccccauccucuccaccgaccgcucccgcgaggacucccccgagcucaaccccccccccggcaucgaggacaaccgccagugcgcccucugccucaccuacggcgacgacuccgccaacgacgccggccgccuccucuacaucggccagaacgaguggacccacgucaacugcgcccucugguccgccgaggucuucgaggacgacgacggcucccucaagaacguccacauggccgucauccgcggcaagcagcuccgcugcgaguucugccagaagcccggcgccaccgucggcugcugccucaccuccugcaccuccaacuaccacuucaugugcucccgcgccaagaacugcgucuuccucgacgacaagaaggucuacugccagcgccaccgcgaccucaucaagggcgaggucguccccgagaacggcuucgaggucuuccgccgcgucuucgucgacuucgagggcaucucccuccgccgcaaguuccucaacggccucgagcccgagaacauccacaugaugaucggcuccaugaccaucgacugccucggcauccucaacgaccucuccgacugcgaggacaagcucuuccccaucggcuaccagugcucccgcgucuacugguccaccaccgacgcccgcaagcgcugcgucuacaccugcaagaucgucgagugccgcccccccgucgucgagcccgacaucaacuccaccgucgagcacgacgagaaccgcaccaucgcccacucccccaccuccuucaccgaguccuccuccaaggagucccagaacaccgccgagaucaucuccccccccucccccgaccgccccccccacucccagaccuccggcuccugcuacuaccacgucaucuccaaggucccccgcauccgcacccccuccuacucccccacccagcgcucccccggcugccgcccccuccccuccgccggcucccccacccccaccacccacgagaucgucaccgucggcgacccccuccucuccuccggccuccgcuccaucggcucccgccgccacuccaccuccucccucuccccccagcgcuccaagcuccgcaucaugucccccaugcgcaccggcaacaccuacucccgcaacaacgucuccuccgucuccaccaccggcaccgccaccgaccucgaguccuccgccaaggucgucgaccacguccucggcccccucaacuccuccaccucccucggccagaacaccuccaccuccuccaaccuccagcgcaccgucgucaccgucggcaacaagaacucccaccucgacggcuccuccuccuccgagaugaagcaguccuccgccuccgaccucgucuccaaguccuccucccucaagggcgagaagaccaagguccucuccuccaaguccuccgagggcuccgcccacaacgucgccuaccccggcauccccaagcucgccccccagguccacaacaccaccucccgcgagcucaacgucuccaagaucggcuccuucgccgagcccuccuccgucuccuucuccuccaaggaggcccucuccuucccccaccuccaccuccgcggccagcgcaacgaccgcgaccagcacaccgacuccacccaguccgccaacuccucccccgacgaggacaccgaggucaagacccucaagcucuccggcauguccaaccgcuccuccaucaucaacgagcacaugggcuccuccucccgcgaccgccgccagaagggcaagaaguccugcaaggagaccuucaaggagaagcacuccuccaaguccuuccucgagcccggccaggucaccaccggcgaggagggcaaccucaagcccgaguucauggacgagguccucacccccgaguacaugggccagcgccccugcaacaacgucuccuccgacaagaucggcgacaagggccucuccaugcccggcguccccaaggccccccccaugcaggucgagggcuccgccaaggagcuccaggccccccgcaagcgcaccgucaaggucacccucaccccccucaagauggagaacgagucccaguccaagaacgcccucaaggaguccucccccgccuccccccuccagaucgaguccaccucccccaccgagcccaucuccgccuccgagaaccccggcgacggccccgucgcccagcccucccccaacaacaccuccugccaggacucccaguccaacaacuaccagaaccuccccguccaggaccgcaaccucaugcuccccgacggccccaagccccaggaggacggcuccuucaagcgccgcuacccccgccgcuccgcccgcgcccgcuccaacauguucuucggccucaccccccucuacggcguccgcuccuacggcgaggaggacauccccuucuacuccuccuccaccggcaagaagcgcggcaagcgcuccgccgagggccaggucgacggcgccgacgaccucuccaccuccgacgaggacgaccucuacuacuacaacuucacccgcaccgucaucuccuccggcggcgaggagcgccucgccucccacaaccucuuccgcgaggaggagcagugcgaccuccccaagaucucccagcucgacggcgucgacgacggcaccgaguccgacaccuccgucaccgccaccacccgcaaguccucccagauccccaagcgcaacggcaaggagaacggcaccgagaaccucaagaucgaccgccccgaggacgccggcgagaaggagcacgucaccaaguccuccgucggccacaagaacgagcccaagauggacaacugccacuccgucucccgcgucaagacccagggccaggacucccucgaggcccagcucuccucccucgaguccucccgccgcguccacaccuccacccccuccgacaagaaccuccucgacaccuacaacaccgagcuccucaaguccgacuccgacaacaacaacuccgacgacugcggcaacauccuccccuccgacaucauggacuucguccucaagaacacccccuccaugcaggcccucggcgagucccccgaguccuccuccuccgagcuccucaaccucggcgagggccucggccucgacuccaaccgcgagaaggacaugggccucuucgaggucuucucccagcagcuccccaccaccgagcccgucgacuccuccgucuccuccuccaucuccgccgaggagcaguucgagcucccccucgagcuccccuccgaccucuccguccucaccacccgcucccccaccguccccucccagaaccccucccgccucgccgucaucuccgacuccggcgagaagcgcgucaccaucaccgagaaguccgucgccuccuccgaguccgaccccgcccuccucucccccggcgucgaccccacccccgagggccacaugacccccgaccacuucauccagggccacauggacgccgaccacaucuccuccccccccugcggcuccgucgagcagggccacggcaacaaccaggaccucacccgcaacuccuccacccccggccuccagguccccgucucccccaccguccccauccagaaccagaaguacguccccaacuccaccgacucccccggccccucccagaucuccaacgccgccguccagaccacccccccccaccucaagcccgccaccgagaagcucaucgucgucaaccagaacaugcagccccucuacguccuccagacccuccccaacggcgucacccagaagauccagcucaccuccuccgucuccuccacccccuccgucauggagaccaacaccuccguccucggccccaugggcggcggccucacccucaccaccggccucaaccccucccuccccaccucccagucccucuuccccuccgccuccaagggccuccuccccaugucccaccaccagcaccuccacuccuuccccgccgccacccaguccuccuucccccccaacaucuccaacccccccuccggccuccucaucggcguccagcccccccccgacccccagcuccucgucuccgaguccucccagcgcaccgaccucuccaccaccgucgccacccccuccuccggccucaagaagcgccccaucucccgccuccagacccgcaagaacaagaagcucgcccccuccuccacccccuccaacaucgcccccuccgacgucgucuccaacaugacccucaucaacuucacccccucccagcuccccaaccaccccucccuccucgaccucggcucccucaacaccuccucccaccgcaccguccccaacaucaucaagcgcuccaaguccuccaucauguacuucgagcccgccccccuccucccccaguccgucggcggcaccgccgccaccgccgccggcaccuccaccaucucccaggacaccucccaccucaccuccggcuccgucuccggccucgccuccuccuccuccguccucaacgucgucuccaugcagaccaccaccacccccaccuccuccgccuccguccccggccacgucacccucaccaacccccgccuccucggcacccccgacaucggcuccaucuccaaccuccucaucaaggccucccagcagucccucggcauccaggaccagcccgucgcccucccccccuccuccggcauguucccccagcucggcaccucccagacccccuccaccgccgccaucaccgccgccuccuccaucugcguccuccccuccacccagaccaccggcaucaccgccgccucccccuccggcgaggccgacgagcacuaccagcuccagcacgucaaccagcuccucgccuccaagaccggcauccacuccucccagcgcgaccucgacuccgccuccggcccccaggucuccaacuucacccagaccgucgacgcccccaacuccaugggccucgagcagaacaaggcccucuccuccgccguccaggccucccccaccucccccggcggcucccccuccucccccuccuccggccagcgcuccgccucccccuccguccccggccccaccaagcccaagcccaagaccaagcgcuuccagcucccccucgacaagggcaacggcaagaagcacaaggucucccaccuccgcaccuccuccuccgaggcccacauccccgaccaggagaccaccucccucaccuccggcaccggcacccccggcgccgaggccgagcagcaggacaccgccuccgucgagcaguccucccagaaggagugcggccagcccgccggccaggucgccguccuccccgagguccaggucacccagaaccccgccaacgagcaggaguccgccgagcccaagaccgucgaggaggaggaguccaacuucuccuccccccucaugcucuggcuccagcaggagcagaagcgcaaggaguccaucaccgagaagaagcccaagaagggccucgucuucgagaucuccuccgacgacggcuuccagaucugcgccgaguccaucgaggacgccuggaagucccucaccgacaagguccaggaggcccgcuccaacgcccgccucaagcagcucuccuucgccggcgucaacggccuccgcaugcucggcauccuccacgacgccgucgucuuccucaucgagcagcucuccggcgccaagcacugccgcaacuacaaguuccgcuuccacaagcccgaggaggccaacgagcccccccucaacccccacggcuccgcccgcgccgagguccaccuccgcaaguccgccuucgacauguucaacuuccucgccuccaagcaccgccagccccccgaguacaaccccaacgacgaggaggaggaggagguccagcucaaguccgcccgccgcgccaccuccauggaccuccccaugcccaugcgcuuccgccaccucaagaagaccuccaaggaggccgucggcgucuaccgcucccccauccacggccgcggccucuucugcaagcgcaacaucgacgccggcgagauggucaucgaguacgccggcaacgucauccgcuccauccagaccgacaagcgcgagaaguacuacgacuccaagggcaucggcugcuacauguuccgcaucgacgacuccgaggucgucgacgccaccaugcacggcaacgccgcccgcuucaucaaccacuccugcgagcccaacugcuacucccgcgucaucaacaucgacggccagaagcacaucgucaucuucgccaugcgcaagaucuaccgcggcgaggagcucaccuacgacuacaaguuccccaucgaggacgccuccaacaagcuccccugcaacugcggcgccaagaagugccgcaaguuccucaacuga

SEQ ID NO: 45164 - RNA, 8148 nt, Artificial Sequence
  derived and/or modified sequence opt2 from KMT2B__Homo_sapiens__NP_055542
auggccgccgccgccggcggcggcuccugccccggccccggcuccgcccgcggccgcuuccccggccgcccccgcggcgccggcggcggcggcggccgcggcggccgcggcaacggcgccgagcgcguccgcgucgcccuccgccgcggcggcggcgccaccggccccggcggcgccgagcccggcgaggacaccgcccuccuccgccuccucggccuccgccgcggccuccgccgccuccgccgccucugggccggcccccgcguccagcgcggccgcggccgcggccgcggccgcggcuggggccccucccgcggcugcguccccgaggaggaguccuccgacggcgaguccgacgaggaggaguuccagggcuuccacuccgacgaggacgucgcccccuccucccuccgcuccgcccuccgcucccagcgcggccgcgccccccgcggccgcggccgcaagcacaagaccaccccccucccccccccccgccucgccgacgucgcccccaccccccccaagacccccgcccgcaagcgcggcgaggagggcaccgagcgcaugguccaggcccucaccgagcuccuccgccgcgcccaggccccccaggccccccgcucccgcgccugcgagcccuccaccccccgccgcucccgcggccgcccccccggccgccccgccggccccugccgccgcaagcagcaggccgucgucgucgccgaggccgccgucaccauccccaagcccgagccccccccccccgucguccccgucaagcaccagaccggcuccuggaagugcaaggagggccccggccccggccccggcaccccccgccgcggcggccaguccucccgcggcggccgcggcggccgcggccgcggccgcggcggcggccuccccuucgucaucaaguucgucucccgcgccaagaaggucaagaugggccagcucucccucggccucgaguccggccagggccagggccagcacgaggaguccuggcaggacgucccccagcgccgcgucggcuccggccagggcggcucccccugcuggaagaagcaggagcagaagcucgacgacgaggaggaggagaagaaggaggaggaggagaaggacaaggagggcgaggagaaggaggagcgcgccgucgccgaggagaugaugcccgccgccgagaaggaggaggccaagcuccccccccccccccucaccccccccgcccccucccccccccccccccuccccccccccuccaccucccccccccccccccucugcccccccccccccccccccgucuccccccccccccuccccucccccccccccccccccgcccaggaggagcaggaggagucccccccccccgucguccccgccaccugcucccgcaagcgcggccgccccccccucacccccucccagcgcgccgagcgcgaggccgcccgcgccggccccgagggcaccuccccccccacccccacccccuccaccgccaccggcggcccccccgaggacucccccaccgucgcccccaaguccaccaccuuccucaagaacauccgccaguucaucaugcccgucgucuccgcccgcuccucccgcgucaucaagaccccccgccgcuucauggacgaggacccccccaagccccccaaggucgaggucucccccguccuccgcccccccaucaccaccuccccccccgucccccaggagcccgcccccguccccucccccccccgcgcccccaccccccccuccacccccgucccccuccccgagaagcgccgcuccauccuccgcgagcccaccuuccgcuggaccucccucacccgcgagcuccccccccccccccccgcccccccccccccccccgcccccucccccccccccgcccccgccaccuccucccgccgcccccuccuccuccgcgccccccaguucacccccuccgaggcccaccucaagaucuacgaguccguccucaccccccccccccucggcgcccccgaggcccccgagcccgagcccccccccgccgacgacucccccgccgagcccgagccccgcgccgucggccgcaccaaccaccucucccucccccgcuucgcccccgucgucaccacccccgucaaggccgaggucuccccccacggcgcccccgcccucuccaacggcccccagacccaggcccagcuccuccagccccuccaggcccuccagacccagcuccucccccaggcccucccccccccccagccccagcuccagcccccccccuccccccagcagaugcccccccucgagaaggcccgcaucgccggcgucggcucccucccccucuccggcgucgaggagaagauguucucccuccucaagcgcgccaagguccagcucuucaagaucgaccagcagcagcagcagaaggucgccgccuccaugccccucucccccggcggccagauggaggaggucgccggcgccgucaagcagaucuccgaccgcggccccguccgcuccgaggacgaguccgucgaggccaagcgcgagcgccccuccggccccgagucccccguccagggcccccgcaucaagcacgucugccgccacgccgccgucgcccucggccaggcccgcgccaugguccccgaggacgucccccgccucuccgcccucccccuccgcgaccgccaggaccucgccaccgaggacaccuccuccgccuccgagaccgaguccguccccucccgcucccgccgcggcaaggucgaggccgccggccccggcggcgaguccgagcccaccggcuccggcggcacccucgcccacaccccccgccgcucccuccccucccaccacggcaagaagaugcgcauggcccgcugcggccacugccgcggcugccuccgcguccaggacugcggcuccugcgucaacugccucgacaagcccaaguucggcggccccaacaccaagaagcagugcugcgucuaccgcaagugcgacaagaucgaggcccgcaagauggagcgccucgccaagaagggccgcaccaucgucaagacccuccuccccugggacuccgacgagucccccgaggccucccccggcccccccggcccccgccgcggcgccggcgccggcggcccccgcgaggaggucgucgcccaccccggccccgaggagcaggacucccuccuccagcgcaaguccgcccgccgcugcgucaagcagcgccccuccuacgacaucuucgaggacuccgacgacuccgagcccggcggcccccccgccccccgccgccgcaccccccgcgagaacgagcucccccuccccgagcccgaggagcagucccgcccccgcaagcccacccuccagcccguccuccagcucaaggcccgccgccgccucgacaaggacgcccucgcccccggccccuucgccuccuuccccaacggcuggaccggcaagcagaagucccccgacggcguccaccgcguccgcgucgacuucaaggaggacugcgaccucgagaacgucuggcucaugggcggccucuccguccucaccuccguccccggcggcccccccauggucugccuccucugcgccuccaagggccuccacgagcucgucuucugccaggucugcugcgaccccuuccaccccuucugccucgaggaggccgagcgcccccucccccagcaccacgacaccuggugcugccgccgcugcaaguucugccacgucugcggccgcaagggccgcggcuccaagcaccuccucgagugcgagcgcugccgccacgccuaccaccccgccugccucggccccuccuaccccacccgcgccacccgcaagcgccgccacuggaucugcuccgccugcguccgcugcaaguccugcggcgccacccccggcaagaacugggacgucgagugguccggcgacuacucccucugcccccgcugcacccagcucuacgagaagggcaacuacugccccaucugcacccgcugcuacgaggacaacgacuacgaguccaagaugaugcagugcgcccagugcgaccacuggguccacgccaagugcgagggccucuccgacgaggacuacgagauccucuccggccuccccgacuccguccucuacaccugcggccccugcgccggcgccgcccagccccgcuggcgcgaggcccucuccggcgcccuccagggcggccuccgccagguccuccagggccuccucuccuccaaggucgucggcccccuccuccucugcacccagugcggccccgacggcaagcagcuccaccccggccccugcggccuccaggccgucucccagcgcuucgaggacggccacuacaaguccguccacuccuucauggaggacauggucggcauccucaugcgccacuccgaggagggcgagacccccgaccgccgcgccggcggccagaugaagggccuccuccucaagcuccucgaguccgccuucggcugguucgacgcccacgaccccaaguacuggcgccgcuccacccgccuccccaacggcguccuccccaacgccguccucccccccucccucgaccacgucuacgcccaguggcgccagcaggagcccgagacccccgaguccggccagccccccggcgaccccuccgccgccuuccagggcaaggaccccgccgccuucucccaccucgaggacccccgccagugcgcccucugccucaaguacggcgacgccgacuccaaggaggccggccgccuccucuacaucggccagaacgaguggacccacgucaacugcgccaucugguccgccgaggucuucgaggagaacgacggcucccucaagaacguccacgccgccgucgcccgcggccgccagaugcgcugcgagcucugccucaagcccggcgccaccgucggcugcugccucuccuccugccucuccaacuuccacuucaugugcgcccgcgccuccuacugcaucuuccaggacgacaagaaggucuucugccagaagcacaccgaccuccucgacggcaaggagaucgucaaccccgacggcuucgacguccuccgccgcgucuacgucgacuucgagggcaucaacuucaagcgcaaguuccucaccggccucgagcccgacgccaucaacguccucaucggcuccauccgcaucgacucccucggcacccucuccgaccucuccgacugcgagggccgccucuuccccaucggcuaccagugcucccgccucuacugguccaccgucgacgcccgccgccgcugcugguaccgcugccgcauccucgaguaccgccccuggggcccccgcgaggagcccgcccaccucgaggccgccgaggagaaccagaccaucguccacucccccgcccccuccuccgagccccccggcggcgaggaccccccccucgacaccgacguccucguccccggcgcccccgagcgccacucccccauccagaaccucgaccccccccuccgccccgacuccggcuccgcccccccccccgccccccgcuccuucuccggcgcccgcaucaagguccccaacuacucccccucccgccgcccccucggcggcgucuccuucggcccccuccccucccccggcucccccuccucccucacccaccacauccccaccgucggcgaccccgacuuccccgcccccccccgccgcucccgccgccccuccccccucgccccccgccccccccccucccgcugggccucccccccccucaagaccuccccccagcuccgcguccccccccccaccuccgucgucaccgcccucacccccaccuccggcgagcucgccccccccggccccgcccccuccccccccccccccgaggaccucggccccgacuucgaggacauggaggucgucuccggccucuccgccgccgaccucgacuucgccgccucccuccucggcaccgagcccuuccaggaggagaucgucgccgccggcgccaugggcuccucccacggcggccccggcgacuccuccgaggaggaguccucccccaccucccgcuacauccacuuccccgucaccgucgucuccgcccccggccucgcccccuccgccacccccggcgccccccgcaucgagcagcucgacggcgucgacgacggcaccgacuccgaggccgaggccguccagcagccccgcggccagggcaccccccccuccggccccggcgucguccgcgccggcguccucggcgccgccggcgaccgcgcccgcccccccgaggaccuccccuccgagaucgucgacuucguccucaagaaccucggcggccccggcgacggcggcgccggcccccgcgaggagucccucccccccgcccccccccucgccaacggcucccagcccucccagggccucaccgccucccccgccgaccccacccgcaccuucgccuggcuccccggcgcccccggcguccgcguccucucccucggccccgcccccgagccccccaagcccgccaccuccaagaucauccucgucaacaagcucggccaggucuucgucaagauggccggcgagggcgagcccguccccccccccgucaagcagcccccccucccccccaccaucucccccaccgcccccaccuccuggacccucccccccggcccccuccucggcguccuccccgucgucggcgucguccgccccgccccccccccccccccccccccccucacccucguccucuccuccggccccgccucccccccccgccaggccauccgcgucaagcgcgucuccaccuucuccggccgcuccccccccgcccccccccccuacaaggccccccgccucgacgaggacggcgaggccuccgaggacaccccccagguccccggccucggcuccggcggcuucucccgcguccgcaugaagacccccaccguccgcggcguccucgaccucgaccgccccggcgagcccgccggcgaggagucccccggcccccuccaggagcgcuccccccuccucccccuccccgaggacggccccccccagguccccgacggcccccccgaccuccuccucgagucccaguggcaccacuacuccggcgaggccuccuccuccgaggaggagccccccucccccgacgacaaggagaaccaggcccccaagcgcaccggcccccaccuccgcuucgagaucuccuccgaggacggcuucuccgucgaggccgagucccucgagggcgccuggcgcacccucaucgagaagguccaggaggcccgcggccacgcccgccuccgccaccucuccuucuccggcauguccggcgcccgccuccucggcauccaccacgacgccgucaucuuccucgccgagcagcuccccggcgcccagcgcugccagcacuacaaguuccgcuaccaccagcagggcgagggccaggaggagcccccccucaacccccacggcgccgcccgcgccgaggucuaccuccgcaagugcaccuucgacauguucaacuuccucgccucccagcaccgcguccuccccgagggcgccaccugcgacgaggaggaggacgagguccagcuccgcuccacccgccgcgccaccucccucgagcuccccauggccaugcgcuuccgccaccucaagaagaccuccaaggaggccgucggcgucuaccgcuccgccauccacggccgcggccucuucugcaagcgcaacaucgacgccggcgagauggucaucgaguacuccggcaucgucauccgcuccguccucaccgacaagcgcgagaaguucuacgacggcaagggcaucggcugcuacauguuccgcauggacgacuucgacgucgucgacgccaccaugcacggcaacgccgcccgcuucaucaaccacuccugcgagcccaacugcuucucccgcgucauccacgucgagggccagaagcacaucgucaucuucgcccuccgccgcauccuccgcggcgaggagcucaccuacgacuacaaguuccccaucgaggacgccuccaacaagcuccccugcaacugcggcgccaagcgcugccgccgcuuccucaacuga

SEQ ID NO: 45165 - RNA, 14736 nt, Artificial Sequence
  derived and/or modified sequence opt2 from KMT2C__Homo_sapiens__NP_733751
auguccuccgaggaggacaaguccgucgagcagccccagccccccccccccccccccgaggagcccggcgcccccgcccccucccccgccgccgccgacaagcgcccccgcggccgcccccgcaaggacggcgccucccccuuccagcgcgcccgcaagaagccccgcucccgcggcaagaccgccgucgaggacgaggacuccauggacggccucgagaccaccgagaccgagaccaucgucgagaccgagaucaaggagcaguccgccgaggaggacgccgaggccgaggucgacaacuccaagcagcucauccccacccuccagcgcuccgucuccgaggaguccgccaacucccucgucuccgucggcgucgaggccaagaucuccgagcagcucugcgccuucugcuacugcggcgagaaguccucccucggccagggcgaccucaagcaguuccgcaucacccccggcuucauccuccccuggcgcaaccagcccuccaacaagaaggacaucgacgacaacuccaacggcaccuacgagaagaugcagaacuccgccccccgcaagcagcgcggccagcgcaaggagcgcuccccccagcagaacaucgucuccugcgucuccgucuccacccagaccgccuccgacgaccaggccggcaagcucugggacgagcucucccucgucggccuccccgacgccaucgacauccaggcccucuucgacuccaccggcaccugcugggcccaccaccgcugcgucgaguggucccucggcgucugccagauggaggagccccuccucgucaacgucgacaaggccgucgucuccggcuccaccgagcgcugcgccuucugcaagcaccucggcgccaccaucaagugcugcgaggagaagugcacccagauguaccacuaccccugcgccgccggcgccggcaccuuccaggacuucucccacaucuuccuccucugccccgagcacaucgaccaggcccccgagcgcuccaaggaggacgccaacugcgccgucugcgacucccccggcgaccuccucgaccaguucuucugcaccaccugcggccagcacuaccacggcaugugccucgacaucgccgucaccccccucaagcgcgccggcuggcagugccccgagugcaaggucugccagaacugcaagcaguccggcgaggacuccaagaugcucgucugcgacaccugcgacaagggcuaccacaccuucugccuccagcccgucaugaaguccguccccaccaacggcuggaagugcaagaacugccgcaucugcaucgagugcggcacccgcuccuccucccaguggcaccacaacugccucaucugcgacaacugcuaccagcagcaggacaaccucugccccuucugcggcaagugcuaccaccccgagcuccagaaggacaugcuccacugcaacaugugcaagcgcuggguccaccucgagugcgacaagcccaccgaccacgagcucgacacccagcucaaggaggaguacaucugcauguacugcaagcaccucggcgccgagauggaccgccuccagcccggcgaggaggucgagaucgccgagcucaccaccgacuacaacaacgagauggaggucgagggccccgaggaccagauggucuucuccgagcaggccgccaacaaggacgucaacggccaggaguccacccccggcaucguccccgacgccguccagguccacaccgaggagcagcagaagucccaccccuccgagucccucgacaccgacucccuccucaucgccgucuccucccagcacaccgucaacaccgagcucgagaagcagaucuccaacgaggucgacuccgaggaccucaagauguccuccgaggucaagcacaucugcggcgaggaccagaucgaggacaagauggaggucaccgagaacaucgaggucgucacccaccagaucaccguccagcaggagcagcuccagcuccucgaggagcccgagaccgucgucucccgcgaggagucccgcccccccaagcucgucauggaguccgucacccucccccucgagacccucgucuccccccacgaggaguccaucucccucugccccgaggagcagcucgucaucgagcgccuccagggcgagaaggagcagaaggagaacuccgagcucuccaccggccucauggacuccgagaugacccccaccaucgagggcugcgucaaggacgucuccuaccagggcggcaaguccaucaagcucuccuccgagaccgaguccuccuucuccuccuccgccgacaucuccaaggccgacgucuccuccucccccacccccuccuccgaccuccccucccacgacaugcuccacaacuaccccuccgcccucuccuccuccgccggcaacaucaugcccaccaccuacaucuccgucacccccaagaucggcaugggcaagcccgccaucaccaagcgcaaguucucccccggccgcccccgcuccaagcagggcgccugguccacccacaacaccgucuccccccccuccuggucccccgacaucuccgagggccgcgagaucuucaagccccgccagcuccccggcuccgccaucugguccaucaaggucggccgcggcuccggcuuccccggcaagcgccgcccccgcggcgccggccucuccggccgcggcggccgcggccgcuccaagcucaaguccggcaucggcgccgucguccuccccggcgucuccaccgccgacaucuccuccaacaaggacgacgaggagaacuccaugcacaacaccgucguccucuucuccuccuccgacaaguucacccucaaccaggacaugugcgucgucugcggcuccuucggccagggcgccgagggccgccuccucgccugcucccagugcggccagugcuaccaccccuacugcgucuccaucaagaucaccaaggucguccucuccaagggcuggcgcugccucgagugcaccgucugcgaggccugcggcaaggccaccgaccccggccgccuccuccucugcgacgacugcgacaucuccuaccacaccuacugccucgaccccccccuccagaccguccccaagggcggcuggaagugcaaguggugcgucuggugccgccacugcggcgccaccuccgccggccuccgcugcgaguggcagaacaacuacacccagugcgcccccugcgccucccucuccuccugccccgucugcuaccgcaacuaccgcgaggaggaccucauccuccagugccgccagugcgaccgcuggaugcacgccgucugccagaaccucaacaccgaggaggaggucgagaacgucgccgacaucggcuucgacugcuccaugugccgccccuacaugcccgccuccaacguccccuccuccgacugcugcgaguccucccucgucgcccagaucgucaccaaggucaaggagcucgacccccccaagaccuacacccaggacggcgucugccucaccgaguccggcaugacccagcuccagucccucaccgucaccgucccccgccgcaagcgcuccaagcccaagcucaagcucaagaucaucaaccagaacuccgucgccguccuccagaccccccccgacauccaguccgagcacucccgcgacggcgagauggacgacucccgcgagggcgagcucauggacugcgacggcaaguccgaguccucccccgagcgcgaggccgucgacgacgagaccaagggcgucgagggcaccgacggcgucaagaagcgcaagcgcaagcccuaccgccccggcaucggcggcuucaugguccgccagcgcucccgcaccggccagggcaagaccaagcgcuccgucauccgcaaggacuccuccggcuccaucuccgagcagcuccccugccgcgacgacggcugguccgagcagcuccccgacacccucgucgacgaguccgucuccgucaccgaguccaccgagaagaucaagaagcgcuaccgcaagcgcaagaacaagcucgaggagaccuuccccgccuaccuccaggaggccuucuucggcaaggaccuccucgacaccucccgccaguccaagaucucccucgacaaccucuccgaggacggcgcccagcuccucuacaagaccaacaugaacaccggcuuccucgaccccucccucgacccccuccucuccuccuccuccgcccccaccaaguccggcacccacggccccgccgacgacccccucgccgacaucuccgagguccucaacaccgacgacgacauccucggcaucaucuccgacgaccucgccaaguccgucgaccacuccgacaucggccccgucaccgacgaccccuccucccucccccagcccaacgucaaccaguccucccgcccccucuccgaggagcagcucgacggcauccucucccccgagcucgacaagauggucaccgacggcgccauccucggcaagcucuacaagauccccgagcucggcggcaaggacgucgaggaccucuucaccgccguccucucccccgccaacacccagcccaccccccucccccagccccccccccccacccagcuccuccccauccacaaccaggacgccuucucccgcaugccccucaugaacggccucaucggcuccuccccccaccucccccacaacucccucccccccggcuccggccucggcaccuucuccgccaucgcccaguccuccuaccccgacgcccgcgacaagaacuccgccuucaaccccauggccuccgaccccaacaacuccuggaccuccuccgcccccaccgucgagggcgagaacgacaccauguccaacgcccagcgcuccacccucaagugggagaaggaggaggcccucggcgagauggccaccgucgcccccguccucuacaccaacaucaacuuccccaaccucaaggaggaguuccccgacuggaccacccgcgucaagcagaucgccaagcucuggcgcaaggccuccucccaggagcgcgcccccuacguccagaaggcccgcgacaaccgcgccgcccuccgcaucaacaagguccagauguccaacgacuccaugaagcgccagcagcagcaggacuccaucgaccccuccucccgcaucgacuccgagcucuucaaggacccccucaagcagcgcgaguccgagcacgagcaggaguggaaguuccgccagcagaugcgccagaaguccaagcagcaggccaagaucgaggccacccagaagcucgagcaggucaagaacgagcagcagcagcagcagcagcagcaguucggcucccagcaccuccucguccaguccggcuccgacacccccuccuccggcauccaguccccccucaccccccagcccggcaacggcaacaugucccccgcccaguccuuccacaaggagcucuucaccaagcagccccccuccacccccaccuccaccuccuccgacgacgucuucgucaagccccaggcccccccccccccccccgcccccucccgcauccccauccaggacucccucucccaggcccagaccucccagccccccuccccccaggucuucucccccggcuccuccaacucccgcccccccucccccauggaccccuacgccaagauggucggcaccccccgccccccccccgucggccacuccuucucccgccgcaacuccgccgcccccgucgagaacugcaccccccucuccuccgucucccgcccccuccagaugaacgagaccaccgccaaccgccccucccccguccgcgaccucugcuccuccuccaccaccaacaacgaccccuacgccaagccccccgacaccccccgccccgucaugaccgaccaguuccccaagucccucggccucucccgcucccccgucgucuccgagcagaccgccaagggccccaucgccgccggcaccuccgaccacuucaccaagcccuccccccgcgccgacgucuuccagcgccagcgcauccccgacuccuacgcccgcccccuccucacccccgccccccucgacuccggccccggccccuucaagacccccaugcagcccccccccuccucccaggaccccuacggcuccgucucccaggccucccgccgccucuccgucgaccccuacgagcgccccgcccucaccccccgccccaucgacaacuucucccacaaccaguccaacgaccccuacucccagcccccccucaccccccaccccgccgucaacgaguccuucgcccaccccucccgcgccuucucccagcccggcaccaucucccgccccaccucccaggaccccuacucccagccccccggcaccccccgccccgucgucgacuccuacucccaguccuccggcaccgcccgcuccaacaccgaccccuacucccagccccccggcaccccccgccccaccaccgucgaccccuacucccagcagccccagaccccccgccccuccacccagaccgaccucuucgucacccccgucaccaaccagcgccacuccgaccccuacgcccacccccccggcaccccccgccccggcaucuccguccccuacucccagccccccgccaccccccgcccccgcaucuccgagggcuucacccgcuccuccaugacccgccccguccucaugcccaaccaggaccccuuccuccaggccgcccagaaccgcggccccgcccuccccggcccccucguccgcccccccgacaccugcucccagaccccccgcccccccggccccggccucuccgacaccuucucccgcgucucccccuccgccgcccgcgaccccuacgaccagucccccaugaccccccgcucccaguccgacuccuucggcaccucccagaccgcccacgacgucgccgaccagccccgccccggcuccgagggcuccuucugcgccuccuccaacucccccaugcacucccagggccagcaguucuccggcgucucccagcuccccggccccguccccaccuccggcgucaccgacacccagaacaccgucaacauggcccaggccgacaccgagaagcuccgccagcgccagaagcuccgcgagaucauccuccagcagcagcagcagaagaagaucgccggccgccaggagaagggcucccaggacucccccgccgucccccaccccggcccccuccagcacuggcagcccgagaacgucaaccaggccuucacccgcccccccccccccuaccccggcaacauccgcucccccgucgcccccccccucggcccccgcuacgccgucuuccccaaggaccagcgcggccccuacccccccgacgucgccuccaugggcaugcgcccccacggcuuccgcuucggcuuccccggcggcucccacggcaccaugcccucccaggagcgcuuccucguccccccccagcagauccagggcuccggcgucuccccccagcuccgccgcuccgucuccgucgacaugccccgcccccucaacaacucccagaugaacaaccccgucggccucccccagcacuucuccccccagucccuccccguccagcagcacaacauccucggccaggccuacaucgagcuccgccaccgcgcccccgacggccgccagcgccuccccuucuccgccccccccggcuccgucgucgaggccuccuccaaccuccgccacggcaacuucaucccccgccccgacuuccccggcccccgccacaccgaccccaugcgccgccccccccagggccuccccaaccagcuccccguccaccccgaccucgagcaggucccccccucccagcaggagcagggccacuccguccacuccuccuccauggucaugcgcacccucaaccacccccucggcggcgaguucuccgaggccccccucuccaccuccguccccuccgagaccaccuccgacaaccuccagaucaccacccagcccuccgacggccucgaggagaagcucgacuccgacgaccccuccgucaaggagcucgacgucaaggaccucgagggcgucgaggucaaggaccucgacgacgaggaccucgagaaccucaaccucgacaccgaggacggcaaggucgucgagcucgacacccucgacaaccucgagaccaacgaccccaaccucgacgaccuccuccgcuccggcgaguucgacaucaucgccuacaccgaccccgagcucgacaugggcgacaagaaguccauguucaacgaggagcucgaccuccccaucgacgacaagcucgacaaccagugcgucuccgucgagcccaagaagaaggagcaggagaacaagacccucguccucuccgacaagcacuccccccagaagaaguccaccgucaccaacgaggucaagaccgagguccucucccccaacuccaaggucgaguccaagugcgagaccgagaagaacgacgagaacaaggacaacgucgacacccccugcucccaggccuccgcccacuccgaccucaacgacggcgagaagaccucccuccaccccugcgaccccgaccucuucgagaagcgcaccaaccgcgagaccgccggccccuccgccaacgucauccaggccuccacccagcuccccgcccaggacgucaucaacuccugcggcaucaccggcuccacccccguccucuccucccuccucgccaacgagaaguccgacaacuccgacauccgccccuccggcuccccccccccccccacccuccccgccucccccuccaaccacgucuccucccucccccccuucaucgccccccccggccgcguccucgacaacgccaugaacuccaacgucaccgucgucucccgcgucaaccacgucuucucccagggcguccaggucaaccccggccucauccccggccaguccaccgucaaccacucccucggcaccggcaagcccgccacccagaccggcccccagaccucccaguccggcaccuccuccauguccggcccccagcagcucaugaucccccagacccucgcccagcagaaccgcgagcgcccccuccuccucgaggagcagccccuccuccuccaggaccuccucgaccaggagcgccaggagcagcagcagcagcgccagaugcaggccaugauccgccagcgcuccgagcccuucuuccccaacaucgacuucgacgccaucaccgaccccaucaugaaggccaagauggucgcccucaagggcaucaacaaggucauggcccagaacaaccucggcaugccccccauggucaugucccgcuuccccuucaugggccaggucgucaccggcacccagaacuccgagggccagaaccucggcccccaggccaucccccaggacggcuccaucacccaccagaucucccgccccaacccccccaacuucggccccggcuucgucaacgacucccagcgcaagcaguacgaggaguggcuccaggagacccagcagcuccuccagaugcagcagaaguaccucgaggagcagaucggcgcccaccgcaaguccaagaaggcccucuccgccaagcagcgcaccgccaagaaggccggccgcgaguuccccgaggaggacgccgagcagcucaagcacgucaccgagcagcaguccaugguccagaagcagcucgagcagauccgcaagcagcagaaggagcacgccgagcucaucgaggacuaccgcaucaagcagcagcagcagugcgccauggccccccccaccaugaugcccuccguccagccccagcccccccucauccccggcgccaccccccccaccaugucccagcccaccuuccccauggucccccagcagcuccagcaccagcagcacaccaccgucaucuccggccacaccucccccguccgcaugcccucccuccccggcuggcagcccaacuccgcccccgcccaccucccccucaaccccccccgcauccagccccccaucgcccagcuccccaucaagaccugcacccccgcccccggcaccgucuccaacgccaacccccaguccggcccccccccccgcgucgaguucgacgacaacaaccccuucuccgaguccuuccaggagcgcgagcgcaaggagcgccuccgcgagcagcaggagcgccagcgcauccagcucaugcaggaggucgaccgccagcgcgcccuccagcagcgcauggagauggagcagcacggcauggucggcuccgagaucuccuccucccgcaccuccgucucccagauccccuucuacuccuccgaccuccccugcgacuucaugcagccccucggcccccuccagcaguccccccagcaccagcagcagaugggccagguccuccagcagcagaacauccagcagggcuccaucaacucccccuccacccagaccuucaugcagaccaacgagcgccgccaggucggcccccccuccuucguccccgacucccccuccauccccgucggcucccccaacuucuccuccgucaagcagggccacggcaaccucuccggcaccuccuuccagcagucccccguccgccccuccuucacccccgcccuccccgccgccccccccgucgccaacuccucccuccccugcggccaggacuccaccaucacccacggccacuccuaccccggcuccacccagucccucauccagcucuacuccgacaucauccccgaggagaagggcaagaagaagcgcacccgcaagaagaagcgcgacgacgacgccgaguccaccaaggcccccuccaccccccacuccgacaucaccgccccccccacccccggcaucuccgagaccaccuccacccccgccgucuccacccccuccgagcucccccagcaggccgaccaggaguccgucgagcccgucggccccuccacccccaacauggccgccggccagcucugcaccgagcucgagaacaagcuccccaacuccgacuucucccaggccacccccaaccagcagaccuacgccaacuccgaggucgacaagcucuccauggagacccccgccaagaccgaggagaucaagcucgagaaggccgagaccgaguccugccccggccaggaggagcccaagcucgaggagcagaacggcuccaaggucgagggcaacgccgucgccugccccgucuccuccgcccagucccccccccacuccgccggcgcccccgccgccaagggcgacuccggcaacgagcuccucaagcaccuccucaagaacaagaaguccuccucccuccucaaccagaagcccgagggcuccaucugcuccgaggacgacugcaccaaggacaacaagcucgucgagaagcagaaccccgccgagggccuccagacccucggcgcccagaugcagggcggcuucggcugcggcaaccagcuccccaagaccgacggcggcuccgagaccaagaagcagcgcuccaagcgcacccagcgcaccggcgagaaggccgccccccgcuccaagaagcgcaagaaggacgaggaggagaagcaggccauguacuccuccaccgacaccuucacccaccucaagcagcagaacaaccucuccaacccccccaccccccccgccucccucccccccacccccccccccauggccugccagaagauggccaacggcuucgccaccaccgaggagcucgccggcaaggccggcguccucgucucccacgaggucaccaagacccucggccccaagcccuuccagcuccccuuccgcccccaggacgaccuccucgcccgcgcccucgcccagggccccaagaccgucgacguccccgccucccuccccacccccccccacaacaaccaggaggagcuccgcauccaggaccacugcggcgaccgcgacacccccgacuccuucguccccuccuccucccccgaguccgucgucggcgucgaggucucccgcuaccccgaccucucccucgucaaggaggagccccccgagcccguccccucccccaucauccccauccuccccuccaccgccggcaaguccuccgagucccgccgcaacgacaucaagaccgagcccggcacccucuacuucgccucccccuucggccccucccccaacggcccccgcuccggccucaucuccgucgccaucacccuccaccccaccgccgccgagaacaucuccuccgucgucgccgccuucuccgaccuccuccacguccgcauccccaacuccuacgaggucuccuccgcccccgacguccccuccaugggccucgucuccucccaccgcaucaaccccggccucgaguaccgccagcaccuccuccuccgcggccccccccccggcuccgccaaccccccccgccucgucuccuccuaccgccucaagcagcccaacguccccuucccccccaccuccaacggccucuccggcuacaaggacuccucccacggcaucgccgaguccgccgcccuccgcccccaguggugcugccacugcaaggucgucauccucggcuccggcguccgcaaguccuucaaggaccucacccuccucaacaaggacucccgcgaguccaccaagcgcgucgagaaggacaucgucuucugcuccaacaacugcuucauccucuacuccuccaccgcccaggccaagaacuccgagaacaaggaguccauccccucccucccccagucccccaugcgcgagacccccuccaaggccuuccaccaguacuccaacaacaucuccacccucgacguccacugccucccccagcuccccgagaaggccuccccccccgccuccccccccaucgccuucccccccgccuucgaggccgcccaggucgaggccaagcccgacgagcucaaggucaccgucaagcucaagccccgccuccgcgccguccacggcggcuucgaggacugccgcccccucaacaagaaguggcgcggcaugaaguggaagaagugguccauccacaucgucauccccaagggcaccuucaagccccccugcgaggacgagaucgacgaguuccucaagaagcucggcaccucccucaagcccgaccccguccccaaggacuaccgcaagugcugcuucugccacgaggagggcgacggccucaccgacggccccgcccgccuccucaaccucgaccucgaccucuggguccaccucaacugcgcccucugguccaccgaggucuacgagacccaggccggcgcccucaucaacgucgagcucgcccuccgccgcggccuccagaugaagugcgucuucugccacaagaccggcgccaccuccggcugccaccgcuuccgcugcaccaacaucuaccacuucaccugcgccaucaaggcccagugcauguucuucaaggacaagaccaugcucugccccaugcacaagcccaagggcauccacgagcaggagcucuccuacuucgccgucuuccgccgcgucuacguccagcgcgacgagguccgccagaucgccuccaucguccagcgcggcgagcgcgaccacaccuuccgcgucggcucccucaucuuccacaccaucggccagcuccucccccagcagaugcaggccuuccacucccccaaggcccucuuccccgucggcuacgaggccucccgccucuacugguccacccgcuacgccaaccgccgcugccgcuaccucugcuccaucgaggagaaggacggccgccccgucuucgucauccgcaucgucgagcagggccacgaggaccucguccucuccgacaucucccccaagggcgucugggacaagauccucgagcccgucgccugcguccgcaagaaguccgagaugcuccagcucuuccccgccuaccucaagggcgaggaccucuucggccucaccgucuccgccgucgcccgcaucgccgagucccuccccggcgucgaggccugcgagaacuacaccuuccgcuacggccgcaacccccucauggagcucccccucgccgucaaccccaccggcugcgcccgcuccgagcccaagauguccgcccacgucaagcgcuucguccuccgcccccacacccucaacuccaccuccaccuccaaguccuuccaguccaccgucaccggcgagcucaacgcccccuacuccaagcaguucguccacuccaaguccucccaguaccgcaagaugaagaccgaguggaaguccaacgucuaccucgcccgcucccgcauccagggccucggccucuacgccgcccgcgacaucgagaagcacaccauggucaucgaguacaucggcaccaucauccgcaacgaggucgccaaccgcaaggagaagcucuacgagucccagaaccgcggcgucuacauguuccgcauggacaacgaccacgucaucgacgccacccucaccggcggccccgcccgcuacaucaaccacuccugcgcccccaacugcgucgccgaggucgucaccuucgagcgcggccacaagaucaucaucuccuccucccgccgcauccagaagggcgaggagcucugcuacgacuacaaguucgacuucgaggacgaccagcacaagauccccugccacugcggcgccgucaacugccgcaaguggaugaacuga

SEQ ID NO: 45166 - RNA, 16614 nt, Artificial Sequence
  derived and/or modified sequence opt2 from KMT2D__Homo_sapiens__XP_005269219
auggacucccagaagcucgccggcgaggacaaggacuccgagcccgccgccgacggccccgccgccuccgaggaccccuccgccaccgaguccgaccuccccaacccccacgucggcgaggucuccguccucuccuccggcuccccccgccuccaggagaccccccaggacugcuccggcggccccguccgccgcugcgcccucugcaacugcggcgagcccucccuccacggccagcgcgagcuccgccgcuucgagcuccccuucgacuggccccgcugccccgucgucucccccggcggcucccccggccccaacgaggccguccuccccuccgaggaccucucccagaucggcuuccccgagggccucacccccgcccaccucggcgagcccggcggcuccugcugggcccaccacuggugcgccgccugguccgccggcgucuggggccaggagggccccgagcucugcggcgucgacaaggccaucuucuccggcaucucccagcgcugcucccacugcacccgccucggcgccuccauccccugccgcucccccggcugcccccgccucuaccacuuccccugcgccaccgccuccggcuccuuccucuccaugaagacccuccagcuccucugccccgagcacuccgagggcgccgccuaccucgaggaggcccgcugcgccgucugcgagggccccggcgagcucugcgaccucuucuucugcaccuccugcggccaccacuaccacggcgccugccucgacaccgcccucaccgcccgcaagcgcgccggcuggcagugccccgagugcaaggucugccaggccugccgcaagcccggcaacgacuccaagaugcucgucugcgagaccugcgacaagggcuaccacaccuucugccucaagccccccauggaggagcuccccgcccacuccuggaagugcaaggccugccgcgucugccgcgccugcggcgccggcuccgccgagcucaaccccaacuccgagugguucgagaacuacucccucugccaccgcugccacaaggcccagggcggccagaccauccgcuccgucgccgagcagcacacccccgucugcucccgcuucuccccccccgagcccggcgacacccccaccgacgagcccgacgcccucuacgucgccugccagggccagcccaagggcggccacgucaccuccaugcagcccaaggagcccggcccccuccagugcgaggccaagccccucggcaaggccggcguccagcucgagccccagcucgaggccccccucaacgaggagaugccccuccuccccccccccgaggaguccccccucucccccccccccgaggagucccccaccucccccccccccgaggccucccgccucucccccccccccgaggagcuccccgccuccccccuccccgaggcccuccaccucucccgcccccucgaggaguccccccucucccccccccccgaggaguccccccucucccccccccccgaguccucccccuucuccccccucgaggaguccccccucuccccccccgaggaguccccccccucccccgcccucgagaccccccucucccccccccccgaggccuccccccucuccccccccuucgaggaguccccccucucccccccccccgaggagcuccccaccucccccccccccgaggccucccgccucucccccccccccgaggagucccccaugucccccccccccgaggagucccccaugucccccccccccgaggccucccgccucuucccccccuucgaggaguccccccucucccccccccccgaggaguccccccucucccccccccccgaggccucccgccucucccccccccccgaggacucccccaugucccccccccccgaggagucccccaugucccccccccccgaggucucccgccucuccccccuccccgucgucucccgccucucccccccccccgaggaguccccccucucccccccccccgaggagucccccaccucccccccccccgaggccucccgccucucccccccccccgaggacucccccaccucccccccccccgaggacucccccgccucccccccccccgaggacucccucaugucccucccccucgaggaguccccccuccucccccuccccgaggagccccagcucugcccccgcuccgagggcccccaccucuccccccgccccgaggagccccaccucuccccccgccccgaggagccccaccucuccccccaggccgaggagccccaccucuccccccagcccgaggagcccugccucugcgccguccccgaggagccccaccucuccccccaggccgagggcccccaccucuccccccagcccgaggagcuccaccucuccccccagaccgaggagccccaccucucccccguccccgaggagcccugccucuccccccagcccgaggagucccaccucuccccccaguccgaggagcccugccucuccccccgccccgaggagucccaccucucccccgagcucgagaagcccccccucuccccccgccccgagaagccccccgaggagcccggccagugccccgcccccgaggagcucccccucuuccccccccccggcgagcccucccucuccccccuccucggcgagcccgcccucuccgagcccggcgagcccccccucuccccccuccccgaggagcucccccucucccccuccggcgagcccucccucuccccccagcucaugccccccgacccccucccccccccccucucccccaucaucaccgccgccgccccccccgcccucuccccccucggcgagcucgaguaccccuucggcgccaagggcgacuccgaccccgaguccccccucgccgcccccauccucgagacccccaucucccccccccccgaggccaacugcaccgaccccgagcccgucccccccaugauccucccccccucccccggcucccccgucggccccgccucccccauccucauggagccccuccccccccagugcuccccccuccuccagcacucccucgucccccagaacuccccccccucccagugcuccccccccgcccucccccucuccguccccuccccccucucccccaucggcaaggucgucggcgucuccgacgaggccgagcuccacgagauggagaccgagaaggucuccgagcccgagugccccgcccucgagcccuccgccaccuccccccuccccucccccaugggcgaccucuccugccccgcccccucccccgcccccgcccucgacgacuucuccggccucggcgaggacaccgccccccucgacggcaucgacgcccccggcucccagcccgagcccggccagacccccggcucccucgccuccgagcucaagggcucccccguccuccucgaccccgaggagcucgcccccgucacccccauggaggucuaccccgagugcaagcagaccgccggccagggcucccccugcgaggagcaggaggagccccgcgcccccgucgcccccaccccccccacccucaucaaguccgacaucgucaacgagaucuccaaccucucccagggcgacgccuccgccuccuuccccggcuccgagccccuccucggcucccccgaccccgagggcggcggcucccucuccauggagcucggcgucuccaccgacgucucccccgcccgcgacgagggcucccuccgccucugcaccgacucccuccccgagaccgacgacucccuccucugcgacgccggcaccgccaucuccggcggcaaggccgagggcgagaagggccgccgccgcuccucccccgcccgcucccgcaucaagcagggccgcuccuccuccuuccccggccgccgccgcccccgcggcggcgcccacggcggccgcggccgcggccgcgcccgccucaaguccaccgccuccuccaucgagacccucgucgucgccgacaucgacuccucccccuccaaggaggaggaggaggaggacgacgacaccaugcagaacaccgucguccucuucuccaacaccgacaaguucguccucaugcaggacaugugcgucgucugcggcuccuucggccgcggcgccgagggccaccuccucgccugcucccagugcucccagugcuaccaccccuacugcgucaacuccaagaucaccaaggucaugcuccucaagggcuggcgcugcgucgagugcaucgucugcgaggucugcggccaggccuccgaccccucccgccuccuccucugcgacgacugcgacaucuccuaccacaccuacugccucgaccccccccuccucaccguccccaagggcggcuggaagugcaaguggugcgucuccugcaugcagugcggcgccgccucccccggcuuccacugcgaguggcagaacuccuacacccacugcggccccugcgccucccucgucaccugccccaucugccacgcccccuacgucgaggaggaccuccucauccagugccgccacugcgagcgcuggaugcacgccggcugcgagucccucuucaccgaggacgacgucgagcaggccgccgacgagggcuucgacugcgucuccugccagcccuacgucgucaagcccgucgcccccgucgccccccccgagcucguccccaugaaggucaaggagcccgagccccaguacuuccgcuucgagggcgucuggcucaccgagaccggcauggcccuccuccgcaaccucaccauguccccccuccacaagcgccgccagcgccgcggccgccucggccuccccggcgaggccggccucgagggcuccgagcccuccgacgcccucggccccgacgacaagaaggacggcgaccucgacaccgacgagcuccucaagggcgagggcggcgucgagcacauggagugcgagaucaagcucgagggccccgucucccccgacgucgagcccggcaaggaggagaccgaggaguccaagaagcgcaagcgcaagcccuaccgccccggcaucggcggcuucaugguccgccagcgcaagucccacacccgcaccaagaagggccccgccgcccaggccgagguccucuccggcgacggccagcccgacgaggucauccccgccgaccuccccgccgagggcgccgucgagcagucccucgccgagggcgacgagaagaagaagcagcagcgccgcggccgcaagaaguccaagcucgaggacauguuccccgccuaccuccaggaggccuucuucggcaaggagcuccucgaccucucccgcaaggcccucuucgccgucggcgucggccgccccuccuucggccucggcacccccaaggccaagggcgacggcggcuccgagcgcaaggagcuccccaccucccagaagggcgacgacggccccgacaucgccgacgaggagucccgcggccucgagggcaaggccgacacccccggccccgaggacggcggcgucaaggccucccccguccccuccgaccccgagaagcccggcacccccggcgagggcaugcucuccuccgaccucgaccgcaucuccaccgaggagcuccccaagauggaguccaaggaccuccagcagcucuucaaggacguccucggcuccgagcgcgagcagcaccucggcugcggcacccccggccucgagggcucccgcaccccccuccagcgccccuuccuccagggcggccucccccucggcaaccuccccuccuccucccccauggacuccuaccccggccucugccagucccccuuccucgacucccgcgagcgcggcggcuucuucucccccgagcccggcgagcccgacucccccuggaccggcuccggcggcaccacccccuccacccccaccacccccaccaccgagggcgagggcgacggccucuccuacaaccagcgcucccuccagcgcugggagaaggacgaggagcucggccagcucuccaccaucucccccguccucuacgccaacaucaacuuccccaaccucaagcaggacuaccccgacugguccucccgcugcaagcagaucaugaagcucuggcgcaagguccccgccgccgacaaggcccccuaccuccagaaggccaaggacaaccgcgccgcccaccgcaucaacaagguccagaagcaggccgagucccagaucaacaagcagaccaaggucggcgacaucgcccgcaagaccgaccgccccgcccuccaccuccgcauccccccccagcccggcgcccucggcucccccccccccgccgccgcccccaccaucuucaucggcucccccaccacccccgccggccucuccaccuccgccgacggcuuccucaagccccccgccggcuccguccccggccccgacucccccggcgagcucuuccucaagcuccccccccagguccccgcccagguccccucccaggaccccuucggccucgcccccgccuacccccucgagccccgcuuccccaccgccccccccaccuacccccccuaccccucccccaccggcgcccccgcccagccccccaugcucggcgccuccucccgccccggcgccggccagcccggcgaguuccacaccaccccccccggcaccccccgccaccagcccuccacccccgaccccuuccucaagccccgcugccccucccucgacaaccucgccguccccgagucccccggcgucggcggcggcaaggccuccgagccccuccucucccccccccccuucggcgagucccgcaaggcccucgaggucaagaaggaggagcucggcgccuccucccccuccuacggcccccccaaccucggcuucgucgacucccccuccuccggcacccaccucggcggccucgagcucaagacccccgacgucuucaaggccccccucaccccccgcgccucccaggucgagccccagucccccggccucggccuccgcccccaggagcccccccccgcccaggcccucgcccccuccccccccucccaccccgacaucuuccgccccggcuccuacaccgaccccuacgcccagcccccccucaccccccgcccccagccccccccccccgaguccugcugcgcccuccccccccgcucccuccccuccgaccccuucucccgcguccccgccuccccccagucccaguccuccucccaguccccccucaccccccgcccccucuccgccgaggccuucugccccucccccgucaccccccgcuuccagucccccgaccccuacucccgcccccccucccgcccccagucccgcgaccccuucgccccccuccacaagcccccccgcccccagccccccgaggucgccuucaaggccggcucccucgcccacaccucccucggcgccggcggcuuccccgccgcccuccccgccggccccgccggcgagcuccacgccaagguccccuccggccagccccccaacuucguccgcucccccggcaccggcgccuucgucggcacccccucccccaugcgcuucaccuucccccaggccgucggcgagcccucccucaagccccccgucccccagcccggccucccccccccccacggcaucaacucccacuucggccccggccccacccucggcaagccccaguccaccaacuacaccgucgccaccggcaacuuccaccccuccggcuccccccucggccccuccuccggcuccaccggcgaguccuacggccucuccccccuccgcccccccuccguccuccccccccccgcccccgacggcucccuccccuaccucucccacggcgccucccagcgcuccggcaucaccucccccgucgagaagcgcgaggaccccggcaccggcaugggcuccucccucgccaccgccgagcuccccggcacccaggaccccggcauguccggccucucccagaccgagcucgagaagcagcgccagcgccagcgccuccgcgagcuccucauccgccagcagauccagcgcaacacccuccgccaggagaaggagaccgccgccgccgccgccggcgccgucggcccccccggcuccuggggcgccgagcccuccucccccgccuucgagcagcucucccgcggccagacccccuucgccggcacccaggacaaguccucccucgucggccucccccccuccaagcucuccggccccauccucggccccggcuccuuccccuccgacgaccgccucucccgcccccccccccccgccacccccuccuccauggacgucaacucccgccagcucgucggcggcucccaggccuucuaccagcgcgcccccuaccccggcucccucccccuccagcagcagcagcagcagcucuggcagcagcagcaggccaccgccgccaccuccaugcgcuucgccauguccgcccgcuuccccuccacccccggccccgagcucggccgccaggcccucggcuccccccucgccggcaucuccacccgccuccccggccccggcgagcccguccccggccccgccggccccgcccaguucaucgagcuccgccacaacguccagaagggccucggccccggcggcacccccuuccccggccagggccccccccagcgcccccgcuucuaccccgucuccgaggacccccaccgccucgcccccgagggccuccgcggccucgccgucuccggccuccccccccagaagcccuccgccccccccgcccccgagcucaacaacucccuccaccccaccccccacaccaagggccccacccuccccaccggccucgagcucgucaaccgcccccccuccuccaccgagcucggccgccccaacccccucgcccucgaggccggcaagcuccccugcgaggaccccgagcucgacgacgacuucgacgcccacaaggcccucgaggacgacgaggagcucgcccaccucggccucggcgucgacgucgccaagggcgacgacgagcucggcacccucgagaaccucgagaccaacgacccccaccucgacgaccuccucaacggcgacgaguucgaccuccucgccuacaccgaccccgagcucgacaccggcgacaagaaggacaucuucaacgagcaccuccgccucgucgaguccgccaacgagaaggccgagcgcgaggcccuccuccgcggcgucgagcccggcccccucggccccgaggagcgccccccccccgccgccgacgccuccgagccccgccucgccuccguccuccccgaggucaagcccaaggucgaggagggcggccgccaccccucccccugccaguucaccaucgccacccccaaggucgagcccgcccccgccgccaacucccucggccucggccucaagcccggccaguccaugaugggcucccgcgacacccgcaugggcaccggccccuucuccuccuccggccacaccgccgagaaggccuccuucggcgccaccggcggcccccccgcccaccuccucacccccuccccccucuccggccccggcggcuccucccuccucgagaaguucgagcucgaguccggcgcccucacccuccccggcggccccgccgccuccggcgacgagcucgacaagauggaguccucccucgucgccuccgagcucccccuccucaucgaggaccuccucgagcacgagaagaaggagcuccagaagaagcagcagcucuccgcccagcuccagcccgcccagcagcagcagcagcagcagcagcagcacucccuccucuccgcccccggccccgcccaggccaugucccucccccacgagggcuccucccccucccucgccggcucccagcagcagcucucccucggccucgccggcgcccgccagcccggccucccccagccccucaugcccacccagccccccgcccacgcccuccagcagcgccucgcccccuccauggccauggucuccaaccagggccacaugcucuccggccagcacggcggccaggccggccucgucccccagcaguccucccagcccguccucucccagaagcccaugggcaccaugccccccuccaugugcaugaagccccagcagcucgccaugcagcagcagcucgccaacuccuucuuccccgacaccgaccucgacaaguucgccgccgaggacaucaucgaccccaucgccaaggccaagauggucgcccucaagggcaucaagaaggucauggcccagggcuccaucggcgucgcccccggcaugaaccgccagcaggucucccuccucgcccagcgccucuccggcggccccuccuccgaccuccagaaccacgucgccgccggcuccggccaggagcgcuccgccggcgaccccucccagccccgccccaacccccccaccuucgcccagggcgucaucaacgaggccgaccagcgccaguacgaggaguggcucuuccacacccagcagcuccuccagaugcagcucaagguccucgaggagcagaucggcguccaccgcaagucccgcaaggcccucugcgccaagcagcgcaccgccaagaaggccggccgcgaguuccccgaggccgacgccgagaagcucaagcucgucaccgagcagcaguccaagauccagaagcagcucgaccagguccgcaagcagcagaaggagcacaccaaccucauggccgaguaccgcaacaagcagcagcagcagcagcagcagcagcagcagcagcagcagcagcacuccgccguccucgcccucucccccucccaguccccccgccuccucaccaagcuccccggccagcuccuccccggccacggccuccagcccccccagggcccccccggcggccaggccggcggccuccgccucacccccggcggcauggcccuccccggccagcccggcggccccuuccucaacaccgcccucgcccagcagcagcagcagcagcacuccggcggcgccggcucccucgccggccccuccggcggcuucuuccccggcaaccucgcccuccgcucccucggccccgacucccgccuccuccaggagcgccagcuccagcuccagcagcagcgcaugcagcucgcccagaagcuccagcagcagcagcagcagcagcagcagcagcagcaccuccucggccaggucgccauccagcagcagcagcagcagggccccggcguccagaccaaccaggcccucggccccaagccccagggccucaugccccccuccucccaccagggccuccucguccagcagcucuccccccagcccccccagggcccccagggcaugcucggccccgcccaggucgccguccuccagcagcagcaccccggcgcccucggcccccagggcccccaccgccagguccucaugacccagucccgcguccucuccuccccccagcucgcccagcagggccagggccucaugggccaccgccucgucaccgcccagcagcagcagcagcagcagcagcaccagcagcagggcuccauggccggccucucccaccuccagcagucccucaugucccacuccggccagcccaagcucuccgcccagcccaugggcucccuccagcagcuccagcagcagcagcagcuccagcagcagcagcagcuccagcagcagcagcagcagcagcuccagcagcagcagcagcuccagcagcagcagcuccagcagcagcagcagcagcagcagcuccagcagcagcagcagcagcagcuccagcagcagcagcagcagcuccagcagcagcagcagcagcagcagcagcaguuccagcagcagcagcagcagcagcagaugggccuccucaaccagucccgcacccuccucuccccccagcagcagcagcagcagcaggucgcccucggccccggcaugcccgccaagccccuccagcacuucuccucccccggcgcccucggccccacccuccuccucaccggcaaggagcagaacaccgucgaccccgccgucuccuccgaggccaccgagggccccuccacccaccagggcggcccccucgccaucggcaccacccccgaguccauggccaccgagcccggcgaggucaagcccucccucuccggcgacucccagcuccuccucguccagccccagccccagccccagcccuccucccuccagcuccagcccccccuccgccuccccggccagcagcagcagcaggucucccuccuccacaccgccggcggcggcucccacggccagcucggcuccggcuccuccuccgaggccuccuccgucccccaccuccucgcccagcccuccgucucccucggcgaccagcccggcuccaugacccagaaccuccucggcccccagcagcccaugcucgagcgccccaugcagaacaacaccggcccccagccccccaagcccggccccguccuccaguccggccagggccuccccggcgucggcaucaugcccaccgucggccagcuccgcgcccagcuccagggcguccucgccaagaacccccagcuccgccaccucuccccccagcagcagcagcagcuccaggcccuccucaugcagcgccagcuccagcagucccaggccguccgccagaccccccccuaccaggagcccggcacccagaccuccccccuccagggccuccucggcugccagccccagcucggcggcuuccccggcccccagaccggcccccuccaggagcucggcgccggcccccgcccccagggccccccccgccuccccgccccccccggcgcccucuccaccggccccguccucggccccguccaccccacccccccccccuccuccccccaggagcccaagcgccccucccagcuccccucccccuccucccagcuccccaccgaggcccagcucccccccacccaccccggcacccccaagccccagggccccacccucgagcccccccccggccgcgucucccccgccgccgcccagcucgccgacacccucuucuccaagggccucggccccugggacccccccgacaaccucgccgagacccagaagcccgagcaguccucccucguccccggccaccucgaccaggucaacggccaggucguccccgaggccucccagcucuccaucaagcaggagccccgcgaggagcccugcgcccucggcgcccaguccgucaagcgcgaggccaacggcgagcccaucggcgcccccggcaccuccaaccaccuccuccucgccggcccccgcuccgaggccggccaccuccuccuccagaagcuccuccgcgccaagaacguccagcucuccaccggccgcggcuccgagggccuccgcgccgagaucaacggccacaucgacuccaagcucgccggccucgagcagaagcuccagggcacccccuccaacaaggaggacgccgccgcccgcaagccccucacccccaagcccaagcgcguccagaaggccuccgaccgccucgucuccucccgcaagaagcuccgcaaggaggacggcguccgcgccuccgaggcccuccucaagcagcucaagcaggagcucucccuccucccccucaccgagcccgccaucaccgccaacuucucccucuucgcccccuucggcuccggcugccccgucaacggccagucccagcuccgcggcgccuucggcuccggcgcccuccccaccggccccgacuacuacucccagcuccucaccaagaacaaccucuccaacccccccaccccccccuccucccucccccccacccccccccccuccguccagcagaagauggucaacggcgucacccccuccgaggagcucggcgagcaccccaaggacgccgccuccgcccgcgacuccgagcgcgcccuccgcgacaccuccgaggucaagucccucgaccuccucgccgcccuccccacccccccccacaaccagaccgaggacguccgcauggaguccgacgaggacuccgacucccccgacuccaucguccccgccuccucccccgaguccauccucggcgaggaggccccccgcuucccccaccucggcuccggccgcugggagcaggaggaccgcgcccucucccccgucaucccccucaucccccgcgccuccauccccgucuuccccgacaccaagcccuacggcgcccucggccucgagguccccggcaagcuccccgucaccaccugggagaagggcaagggcuccgaggucuccgucaugcucaccgucuccgccgccgccgccaagaaccucaacggcgucauggucgccgucgccgagcuccucuccaugaagauccccaacuccuacgagguccucuuccccgagucccccgcccgcgccggcaccgagcccaagaagggcgaggccgagggccccggcggcaaggagaagggccucgagggcaagucccccgacaccggccccgacuggcucaagcaguucgacgccguccuccccggcuacacccucaagucccagcucgacauccucucccuccucaagcaggagucccccgcccccgagccccccacccagcacuccuacaccuacaacgucuccaaccucgacguccgccagcucuccgcccccccccccgaggagcccucccccccccccuccccccucgcccccucccccgccuccccccccaccgagccccucgucgagcuccccaccgagccccucgccgagccccccguccccuccccccucccccucgccuccucccccgaguccgcccgccccaagccccgcgcccgcccccccgaggagggcgaggacucccgccccccccgccucaagaaguggaagggcguccgcuggaagcgccuccgccuccuccucaccauccagaagggcuccggccgccaggaggacgagcgcgaggucgccgaguucauggagcagcucggcaccgcccuccgccccgacaaggucccccgcgacaugcgccgcugcugcuucugccacgaggagggcgacggcgccaccgacggccccgcccgccuccucaaccucgaccucgaccucuggguccaccucaacugcgcccucugguccaccgaggucuacgagacccagggcggcgcccucaugaacgucgaggucgcccuccaccgcggccuccucaccaagugcucccucugccagcgcaccggcgccaccuccuccugcaaccgcaugcgcugccccaacgucuaccacuucgccugcgccauccgcgccaagugcauguucuucaaggacaagaccaugcucugccccaugcacaagaucaagggccccugcgagcaggagcucuccuccuucgccgucuuccgccgcgucuacaucgagcgcgacgaggucaagcagaucgccuccaucauccagcgcggcgagcgccuccacauguuccgcgucggcggccucgucuuccacgccaucggccagcuccucccccaccagauggccgacuuccacuccgccaccgcccucuaccccgucggcuacgaggccacccgcaucuacuggucccuccgcaccaacaaccgccgcugcugcuaccgcugcuccaucggcgagaacaacggccgccccgaguucgucaucaaggucaucgagcagggccucgaggaccucgucuucaccgacgccuccccccaggccgucuggaaccgcaucaucgagcccgucgccgccaugcgcaaggaggccgacaugcuccgccucuuccccgaguaccucaagggcgaggagcucuucggccucaccguccacgccguccuccgcaucgccgagucccuccccggcgucgaguccugccagaacuaccucuuccgcuacggccgccacccccucauggagcucccccucaugaucaaccccaccggcugcgcccgcuccgagcccaagauccucacccacuacaagcgcccccacacccucaacuccaccuccauguccaaggccuaccaguccaccuucaccggcgagaccaacacccccuacuccaagcaguucguccacuccaaguccucccaguaccgccgccuccgcaccgaguggaagaacaacgucuaccucgcccgcucccgcauccagggccucggccucuacgccgccaaggaccucgagaagcacaccauggucaucgaguacaucggcaccaucauccgcaacgaggucgccaaccgccgcgagaagaucuacgaggagcagaaccgcggcaucuacauguuccgcaucaacaacgagcacgucaucgacgccacccucaccggcggccccgcccgcuacaucaaccacuccugcgcccccaacugcgucgccgaggucgucaccuucgacaaggaggacaagaucaucaucaucuccucccgccgcauccccaagggcgaggagcucaccuacgacuaccaguucgacuucgaggacgaccagcacaagauccccugccacugcggcgccuggaacugccgcaaguggaugaacuga

SEQ ID NO: 45167 - RNA, 5577 nt, Artificial Sequence
  derived and/or modified sequence opt2 from KMT2E__Homo_sapiens__NP_061152
auguccaucgucaucccccucggcgucgacaccgccgagaccuccuaccucgagauggccgccggcuccgagcccgaguccgucgaggccucccccgucgucgucgagaaguccaacuccuacccccaccagcucuacaccuccuccucccaccacucccacuccuacaucggccuccccuacgccgaccacaacuacggcgcccgccccccccccaccccccccgccucccccccccccuccguccucaucuccaagaacgaggucggcaucuucaccacccccaacuucgacgagaccuccuccgccaccaccaucuccaccuccgaggacggcuccuacggcaccgacgucacccgcugcaucugcggcuucacccacgacgacggcuacaugaucugcugcgacaagugcuccgucuggcagcacaucgacugcaugggcaucgaccgccagcacauccccgacaccuaccucugcgagcgcugccagccccgcaaccucgacaaggagcgcgccguccuccuccagcgccgcaagcgcgagaacauguccgacggcgacaccuccgccaccgaguccggcgacgagguccccgucgagcucuacaccgccuuccagcacacccccaccuccaucacccucaccgccucccgcgucuccaaggucaacgacaagcgccgcaagaaguccggcgagaaggagcagcacaucuccaagugcaagaaggccuuccgcgagggcucccgcaaguccucccgcgucaagggcuccgcccccgagaucgaccccuccuccgacggcuccaacuucggcugggagaccaagaucaaggccuggauggaccgcuacgaggaggccaacaacaaccaguacuccgagggcguccagcgcgaggcccagcgcaucgcccuccgccucggcaacggcaacgacaagaaggagaugaacaaguccgaccucaacaccaacaaccuccucuucaagccccccgucgagucccacauccagaagaacaagaagauccucaaguccgccaaggaccucccccccgacgcccucaucaucgaguaccgcggcaaguucaugcuccgcgagcaguucgaggccaacggcuacuucuucaagcgccccuaccccuucguccucuucuacuccaaguuccacggccucgagaugugcgucgacgcccgcaccuucggcaacgaggcccgcuucauccgccgcuccugcacccccaacgccgagguccgccacgagauccaggacggcaccauccaccucuacaucuacuccauccacuccauccccaagggcaccgagaucaccaucgccuucgacuucgacuacggcaacugcaaguacaaggucgacugcgccugccucaaggagaaccccgagugccccguccucaagcgcuccuccgaguccauggagaacaucaacuccggcuacgagacccgccgcaagaagggcaagaaggacaaggacaucuccaaggagaaggacacccagaaccagaacaucacccucgacugcgagggcaccaccaacaagaugaagucccccgagaccaagcagcgcaagcucuccccccuccgccucuccgucuccaacaaccaggagcccgacuucaucgacgacaucgaggagaagacccccaucuccaacgaggucgagauggaguccgaggagcagaucgccgagcgcaagcgcaagaugacccgcgaggagcgcaagauggaggccauccuccaggccuucgcccgccucgagaagcgcgagaagcgccgcgagcaggcccucgagcgcaucuccaccgccaagaccgaggucaagaccgagugcaaggacacccagaucgucuccgacgccgaggucauccaggagcaggccaaggaggagaacgccuccaagcccacccccgccaaggucaaccgcaccaagcagcgcaaguccuucucccgcucccgcacccacaucggccagcagcgccgccgccaccgcaccgucuccaugugcuccgacauccagcccuccucccccgacaucgaggucaccucccagcagaacgacaucgagaacaccguccucaccaucgagcccgagaccgagaccgcccucgccgagaucaucaccgagaccgagguccccgcccucaacaagugccccaccaaguaccccaagaccaagaagcaccucgucaacgaguggcucuccgagaagaacgagaagaccggcaagcccuccgacggccucuccgagcgcccccuccgcaucaccaccgaccccgagguccucgccacccagcucaacucccuccccggccucaccuacuccccccacgucuacuccacccccaagcacuacauccgcuucaccucccccuuccucuccgagaagcgccgccgcaaggagcccaccgagaacaucuccggcuccugcaagaagcgcuggcucaagcaggcccucgaggaggagaacuccgccauccuccaccgcuucaacucccccugccaggagcgcucccgcucccccgccgucaacggcgagaacaaguccccccuccuccucaacgacuccugcucccuccccgaccucaccaccccccucaagaagcgccgcuucuaccagcuccucgacuccgucuacuccgagaccuccacccccacccccucccccuacgccacccccacccacaccgacaucacccccauggaccccuccuucgccacccccccccgcaucaaguccgacgacgagaccugccgcaacggcuacaagcccaucuacucccccgucacccccgucacccccggcacccccggcaacaccaugcacuucgagaacaucuccucccccgaguccucccccgagaucaagcgccgcaccuacucccaggagggcuacgaccgcuccuccaccaugcucacccucggccccuuccgcaacuccaaccucaccgagcucggccuccaggagaucaagaccaucggcuacaccuccccccgcucccgcaccgaggucaaccgccagugccccggcgagaaggagcccgucuccgaccuccagcucggccucgacgccgucgagcccaccgcccuccacaagacccucgagacccccgcccacgaccgcgccgagcccaacucccagcucgacuccacccacuccggccgcggcaccauguacuccuccugggucaagucccccgaccgcaccggcgucaacuucuccgucaacuccaaccuccgcgaccucacccccucccaccagcucgaggucggcggcggcuuccgcaucuccgaguccaagugccucaugcaggacgacacccgcggcauguucauggagaccaccgucuucugcaccuccgaggacggccucgucuccggcuucggccgcaccgucaacgacaaccucaucgacggcaacugcaccccccagaaccccccccagaagaagaaggucucccuccucgaguaccgcaagcgccagcgcgaggcccgcaaguccggcuccaagaccgagaacuucccccucaucuccgucuccccccacgccuccggcucccucuccaacaacggcgacggcugcgccuccuccaacgacaacggcgagcaggucgaccacaccgccucccucccccuccccacccccgccaccgucuacaacgccaccuccgaggagaccuccaacaacugccccgucaaggacgccaccgccuccgagaagaacgagcccgagguccaguggaccgccuccaccuccgucgagcagguccgcgagcgcuccuaccagcgcgcccuccuccucuccgaccaccgcaaggacaaggacuccggcggcgagucccccugcgucuccugcucccccucccacguccaguccucccccuccucccacuccaaccacaucccccagcuccaggccaagggccccguccccuccuucuccgagcucauggaggaccccgaccccgagaaccccgagcccaccaccaccaacgagugccccucccccgacaccucccagaacaccugcaaguccccccccaagauguccaagcccggcucccccggcuccgucauccccgcccaggcccacggcaagaucuucaccaagcccgacccccagugggacuccaccgucuccgccuccgaggccgagaacggcguccaccucaagaccgagcuccagcagaagcagcucuccaacaacaaccaggcccucuccaagaaccaccccccccagacccacguccgcaacuccuccgagcagcucucccagaagcuccccuccguccccaccaagcuccacugcccccccuccccccaccucgagaacccccccaaguccuccaccccccacacccccguccagcacggcuaccucucccccaagccccccucccagcagcucggcucccccuaccgcccccaccacucccaguccccccaggucggcaccccccagcgcgagccccagcgcaacuucuaccccgccgcccagaaccuccccgccaacacccagcaggccaccuccggcacccucuucacccagacccccuccggccaguccuccgccaccuacucccaguucaaccagcagucccucaacuccaccgcccccccccccccccccccccccccccccuccuccuccuacuaccagaaccagcagcccuccgccaacuuccagaacuacaaccagcucaagggcucccucucccagcagaccgucuucaccuccggccccaaccaggcccuccccggcaccaccucccagcagaccguccccggccaccacgucacccccggccacuuccuccccucccagaaccccaccauccaccaccagaccgccgccgccgucgucccccccccccccccccccccccccgcccccggcccccaccucguccagcagcccaacucccaccagcagcacuccgucgcccacgucgucggccccguccacgccgucacccccggcucccacauccacucccagaccgccggccaccaccuccccccccccccccccccccccggccccgccccccaccaccacccccccccccaccccuccaccggccuccagggccuccaggcccagcaccagcacgucgucaacuccgcccccccccccccccccccccccccccccuccuccguccucgccuccggccaccacaccaccuccgcccaggcccuccaccaccccccccaccagggccccccccucuuccccuccuccgcccaccccaccgucccccccuaccccucccaggccacccaccacaccacccucggccccggcccccagcaccagcccuccggcaccggcccccacugcccccuccccgucaccggcccccaccuccagccccagggccccaacuccauccccacccccaccgccuccggcuucugcccccaccccggcuccgucgcccucccccacggcguccagggcccccagcaggccucccccguccccggccagauccccauccaccgcgcccaggucccccccaccuuccagaacaacuaccacggcuccggcuggcacuga

SEQ ID NO: 45168 - RNA, 1284 nt, Artificial Sequence
  derived and/or modified sequence opt2 from KNG1__Homo_sapiens__NP_000884
augaagcucaucaccauccucuuccucugcucccgccuccuccucucccucacccaggagucccaguccgaggagaucgacugcaacgacaaggaccucuucaaggccgucgacgccgcccucaagaaguacaacucccagaaccaguccaacaaccaguucguccucuaccgcaucaccgaggccaccaagaccgucggcuccgacaccuucuacuccuucaaguacgagaucaaggagggcgacugccccguccaguccggcaagaccuggcaggacugcgaguacaaggacgccgccaaggccgccaccggcgagugcaccgccaccgucggcaagcgcuccuccaccaaguucuccgucgccacccagaccugccagaucacccccgccgagggccccgucgucaccgcccaguacgacugccucggcugcguccaccccaucuccacccagucccccgaccucgagcccauccuccgccacggcauccaguacuucaacaacaacacccagcacuccucccucuucaugcucaacgaggucaagcgcgcccagcgccaggucgucgccggccucaacuuccgcaucaccuacuccaucguccagaccaacugcuccaaggagaacuuccucuuccucacccccgacugcaagucccucuggaacggcgacaccggcgagugcaccgacaacgccuacaucgacauccagcuccgcaucgccuccuucucccagaacugcgacaucuaccccggcaaggacuucguccagccccccaccaagaucugcgucggcugcccccgcgacauccccaccaacucccccgagcucgaggagacccucacccacaccaucaccaagcucaacgccgagaacaacgccaccuucuacuucaagaucgacaacgucaagaaggcccgcguccaggucgucgccggcaagaaguacuucaucgacuucgucgcccgcgagaccaccugcuccaaggaguccaacgaggagcucaccgaguccugcgagaccaagaagcucggccagucccucgacugcaacgccgaggucuacgucguccccugggagaagaagaucuaccccaccgucaacugccagccccucggcaugaucucccucaugaagcgcccccccggcuucucccccuuccgcuccucccgcaucggcgagaucaaggaggagaccaccucccaccuccgcuccugcgaguacaagggccgcccccccaaggccggcgccgagcccgccuccgagcgcgaggucuccuga

SEQ ID NO: 45169 - RNA, 861 nt, Artificial Sequence
  derived and/or modified sequence opt2 from KNSTRN__Homo_sapiens__NP_001136233
auggccgcccccgaggcccccccccucgaccgcgucuuccgcaccaccuggcucuccaccgagugcgacucccacccccucccccccuccuaccgcaaguuccucuucgagacccaggccgccgaccucgccggcggcaccaccgucgccgccggcaaccuccucaacgaguccgagaaggacugcggccaggaccgccgcgcccccggcguccagcccugccgccucgucaccaugaccuccgucgucaagaccgucuacucccuccagccccccuccgcccucuccggcggccagcccgccgacacccagacccgcgccaccuccaagucccuccuccccguccgcuccaaggaggucgacgucuccaagcagcuccacuccggcggccccgagaacgacgucaccaagaucaccaagcuccgccgcgagaacggccagaugaaggccaccgacaccgccacccgccgcaacguccgcaagggcuacaagccccucuccaagcagaaguccgaggaggagcucaaggacaagaaccagcuccucgaggccgucaacaagcagcuccaccagaagcucaccgagacccagggcgagcucaaggaccucacccagaaggucgagcuccucgagaaguuccgcgacaacugccucgccauccucgaguccaagggccucgaccccgcccucggcuccgagacccucgccucccgccaggaguccaccaccgaccacauggacuccaugcuccuccucgagacccuccaggaggagcucaagcucuucaacgagaccgccaagaagcagauggaggagcuccagaucgccuggaugaaccacggcauccuccaccagauguga

SEQ ID NO: 45170 - RNA, 6630 nt, Artificial Sequence
  derived and/or modified sequence opt2 from KNTC1__Homo_sapiens__NP_055523
auguggaacgacaucgagcuccucaccaacgacgacaccggcuccggcuaccucuccgucggcucccgcaaggagcacggcaccgcccucuaccaggucgaccuccucgucaagaucuccuccgagaaggccucccucaaccccaagauccaggccugcucccucuccgacggcuucaucaucgucgccgaccaguccgucauccuccucgacuccaucugccgcucccuccagcuccaccucgucuucgacaccgaggucgacgucgucggccucugccaggagggcaaguuccuccucgucggcgagcgcuccggcaaccuccaccucauccacgucaccuccaagcagacccuccucaccaacgccuucguccagaaggccaacgacgagaaccgccgcaccuaccagaaccucgucaucgagaaggacggcuccaacgagggcaccuacuacaugcuccuccucaccuacuccggcuucuucugcaucaccaaccuccagcuccucaagauccagcaggccaucgagaacgucgacuucuccaccgccaagaagcuccagggccagaucaaguccuccuucaucuccaccgagaacuaccacacccucggcugccucucccucgucgccggcgaccucgccuccgagguccccgucaucaucggcggcaccggcaacugcgccuucuccaagugggagcccgacuccuccaagaagggcaugaccgucaagaaccucaucgacgccgagaucaucaagggcgccaagaaguuccagcucaucgacaaccuccucuucguccucgacaccgacaacguccucucccucugggacaucuacacccucacccccgucuggaacuggcccucccuccacgucgaggaguuccuccucaccaccgaggccgacucccccuccuccgucaccuggcagggcaucaccaaccucaagcucaucgcccucaccgccuccgccaacaagaagaugaagaaccucauggucuacucccuccccaccauggagauccucuacucccucgaggucuccuccgucuccucccucguccagaccggcaucuccaccgacaccaucuaccuccucgagggcgucugcaagaacgaccccaagcucuccgaggacuccgucuccguccucguccuccgcugccucaccgaggcccuccccgagaaccgccucucccgccuccuccacaagcaccgcuucgccgaggccgaguccuucgccauccaguucggccucgacgucgagcucgucuacaaggucaaguccaaccacauccucgagaagcucgcccucuccuccgucgacgccuccgagcagaccgaguggcagcagcucgucgacgacgccaaggagaaccuccacaagauccaggacgacgaguucgucgucaacuacugccucaaggcccaguggaucaccuacgagaccacccaggagaugcucaacuacgccaagacccgccuccucaagaaggaggacaagaccgcccucaucuacuccgacggccucaaggagguccuccgcgcccacgccaagcucaccaccuucuacggcgccuucggccccgagaaguucuccggcuccuccuggaucgaguuccucaacaacgaggacgaccucaaggacaucuuccuccagcucaaggagggcaaccucgucugcgcccaguaccucuggcuccgccaccgcgccaacuucgagucccgcuucgacgucaagaugcucgagucccuccucaacuccauguccgccuccgucucccuccagaagcucugccccugguucaagaacgacgucauccccuucguccgccgcaccguccccgagggccagaucauccucgccaaguggcucgagcaggccgcccgcaaccucgagcucaccgacaaggccaacuggcccgagaacggccuccagcucgccgagaucuucuucaccgccgagaagaccgacgagcucggccucgccuccuccuggcacuggaucucccucaaggacuaccagaacaccgaggaggucugccagcuccgcacccucgucaacaaccuccgcgagcucaucacccuccaccgcaaguacaacugcaagcucgcccucuccgacuucgagaaggagaacaccaccaccaucgucuuccgcauguucgacaagguccucgcccccgagcucauccccuccauccucgagaaguucauccgcgucuacaugcgcgagcacgaccuccaggaggaggagcuccuccuccucuacaucgaggaccuccucaaccgcugcuccuccaaguccaccucccucuucgagaccgccugggaggccaaggccauggccgucaucgccugccucuccgacaccgaccucaucuucgacgccguccucaagaucauguacgccgccgucguccccugguccgccgccgucgagcagcucgucaagcagcaccucgagauggaccaccccaaggucaagcuccuccaggaguccuacaagcucauggagaugaagaagcuccuccgcggcuacggcauccgcgaggucaaccuccucaacaaggagaucaugcgcgucguccgcuacauccucaagcaggacguccccuccucccucgaggacgcccucaaggucgcccaggccuucaugcucuccgacgacgagaucuacucccuccgcaucaucgaccucaucgaccgcgagcagggcgaggacugccuccuccuccucaagucccucccccccgccgaggccgagaagaccgccgagcgcgucaucaucugggcccgccucgcccuccaggaggagcccgaccacuccaaggagggcaaggccuggcgcauguccgucgccaagaccuccgucgacauccucaagauccucugcgacauccagaaggacaaccuccagaagaaggacgagugcgaggagaugcucaagcucuucaaggaggucgccucccuccaggagaacuucgaggucuuccucuccuucgaggacuacuccaacuccucccucgucgccgaccuccgcgagcagcacaucaaggcccacgaggucgcccaggccaagcacaagcccggcuccacccccgagcccaucgccgccgagguccgcucccccuccauggaguccaagcuccaccgccaggcccucgcccuccagauguccaagcaggagcucgaggccgagcucacccuccgcgcccucaaggacggcaacaucaagaccgcccucaagaagugcuccgaccucuucaaguaccacugcaacgccgacaccggcaagcuccucuuccucaccugccagaagcucugccagaugcucgccgacaacguccccgucaccguccccgucggccucaaccuccccuccaugauccacgaccucgccucccaggccgccaccaucugcucccccgacuuccuccucgacgcccucgagcucugcaagcacacccucauggccgucgagcucucccgccagugccagauggacgacugcggcauccucaugaaggccuccuucggcacccacaaggaccccuacgaggagugguccuacuccgacuucuucuccgaggacggcaucguccucgagucccagaugguccuccccgucaucuacgagcucaucuccucccucgucccccucgccgaguccaagcgcuacccccucgaguccaccucccuccccuacugcucccucaacgagggcgacggccucguccuccccgucaucaacuccaucuccgcccuccuccagaaccuccaggaguccucccagugggagcucgcccuccgcuucgucgucggcuccuucggcaccugccuccagcacuccgucuccaacuucaugaacgccacccucuccgagaagcucuucggcgagaccacccucgucaagucccgccacgucgucauggagcucaaggagaaggccgucaucuucauccgcgagaacgccaccacccuccuccacaaggucuucaacugccgccucgucgaccucgaccucgcccucggcuacugcacccuccucccccagaaggacgucuucgagaaccucuggaagcucaucgacaaggccuggcagaacuacgacaagauccucgccaucucccucgucggcuccgagcucgccucccucuaccaggagaucgagaugggccucaaguuccgcgagcucuccaccgacgcccaguggggcauccgccucggcaagcucggcaucuccuuccagcccgucuuccgccagcacuuccucaccaagaaggaccucaucaaggcccucgucgagaacaucgacauggacaccucccucauccucgaguacugcuccaccuuccagcucgacugcgacgccguccuccagcucuucaucgagacccuccuccacaacaccaacgccggccagggccagggcgacgccuccauggacuccgccaagcgccgccaccccaagcuccucgccaaggcccucgagauggucccccuccucaccuccaccaaggaccucgucaucucccucuccggcauccuccacaagcucgaccccuacgacuacgagaugaucgaggucguccucaaggucaucgagcgcgccgacgagaagaucaccaacaucaacaucaaccaggcccucuccauccucaagcaccucaaguccuaccgccgcaucuccccccccgucgaccucgaguaccaguacaugcucgagcacgucaucacccuccccuccgccgcccagacccgccuccccuuccaccucaucuucuucggcaccgcccagaacuucuggaagauccucuccaccgagcucuccgaggaguccuuccccacccuccuccucaucuccaagcucaugaaguucucccucgacacccucuacgucuccaccgccaagcacgucuucgagaagaagcucaagcccaagcuccucaagcucacccaggccaaguccuccacccucaucaacaaggagaucaccaagaucacccagaccaucgaguccugccuccucuccaucgucaaccccgagugggccgucgccaucgccaucucccucgcccaggacauccccgagggcuccuucaagaucuccgcccucaaguucugccucuaccucgccgagcgcuggcuccagaacauccccucccaggacgagaagcgcgagaaggccgaggcccuccucaagaagcuccacauccaguaccgccgcuccggcaccgaggccguccucaucgcccacaagcucaacaccgaggaguaccuccgcgucaucggcaagcccgcccaccucaucgucucccucuacgagcaccccuccaucaaccagcgcauccagaacuccuccggcaccgacuaccccgacauccacgccgccgccaaggagaucgccgaggucaacgagaucaaccucgagaaggucugggacaugcuccucgagaaguggcucugccccuccaccaagcccggcgagaagcccuccgagcucuucgagcuccaggaggacgaggcccuccgccgcguccaguaccuccuccucucccgccccaucgacuacuccucccgcaugcucuucgucuucgccaccuccaccaccaccacccucggcaugcaccagcucaccuucgcccaccgcacccgcgcccuccagugccucuucuaccucgccgacaaggagaccaucgagucccucuucaagaagcccaucgaggaggucaaguccuaccuccgcugcaucaccuuccucgccuccuucgagacccucaacauccccaucaccuacgagcucuucugcuccucccccaaggagggcaugaucaagggccucuggaagaaccacucccacgaguccauggccguccgccucgucaccgagcucugccucgaguacaagaucuacgaccuccagcucuggaacggccuccuccagaagcuccucggcuucaacaugauccccuaccuccgcaagguccucaaggccaucuccuccauccacucccucuggcagguccccuacuucuccaaggccuggcagcgcgucauccagaucccccuccucuccgccuccugcccccucucccccgaccagcucuccgacugcuccgagucccucaucgccguccucgagugccccgucuccggcgaccucgaccucaucggcgucgcccgccaguacauccagcucgagcuccccgccuucgcccucgccugccucaugcucaugccccacuccgagaagcgccaccagcagaucaagaacuuccucggcuccugcgacccccaggucauccucaagcagcucgaggagcacaugaacaccggccagcucgccggcuucucccaccagauccgcucccucauccucaacaacaucaucaacaagaaggaguucggcauccucgccaagaccaaguacuuccagaugcucaagaugcacgccaugaacaccaacaacaucaccgagcucgucaacuaccucgccaacgaccucucccucgacgaggccuccguccucaucaccgaguacuccaagcacugcggcaagcccgucccccccgacaccgcccccugcgagauccucaagauguuccucuccggccucuccuga

SEQ ID NO: 45171 - RNA, 1617 nt, Artificial Sequence
  derived and/or modified sequence opt2 from KPNA1__Homo_sapiens__NP_002255
augaccacccccggcaaggagaacuuccgccucaaguccuacaagaacaagucccucaaccccgacgagaugcgccgccgccgcgaggaggagggccuccagcuccgcaagcagaagcgcgaggagcagcucuucaagcgccgcaacgucgccaccgccgaggaggagaccgaggaggaggucauguccgacggcggcuuccacgaggcccagaucuccaacauggagauggcccccggcggcgucaucaccuccgacaugaucgagaugaucuucuccaagucccccgagcagcagcucuccgccacccagaaguuccgcaagcuccucuccaaggagcccaacccccccaucgacgaggucaucuccacccccggcgucgucgcccgcuucgucgaguuccucaagcgcaaggagaacugcacccuccaguucgaguccgccuggguccucaccaacaucgccuccggcaacucccuccagacccgcaucgucauccaggccggcgccguccccaucuucaucgagcuccucuccuccgaguucgaggacguccaggagcaggccgucugggcccucggcaacaucgccggcgacuccaccaugugccgcgacuacguccucgacugcaacauccuccccccccuccuccagcucuucuccaagcagaaccgccucaccaugacccgcaacgccgucugggcccucuccaaccucugccgcggcaagucccccccccccgaguucgccaaggucucccccugccucaacguccucuccuggcuccucuucgucuccgacaccgacguccucgccgacgccugcugggcccucuccuaccucuccgacggccccaacgacaagauccaggccgucaucgacgccggcgucugccgccgccucgucgagcuccucaugcacaacgacuacaaggucgucucccccgcccuccgcgccgucggcaacaucgucaccggcgacgacauccagacccaggucauccucaacugcuccgcccuccagucccuccuccaccuccucuccucccccaaggaguccaucaagaaggaggccugcuggaccaucuccaacaucaccgccggcaaccgcgcccagauccagaccgucaucgacgccaacaucuuccccgcccucaucuccauccuccagaccgccgaguuccgcacccgcaaggaggccgccugggccaucaccaacgccaccuccggcggcuccgccgagcagaucaaguaccucgucgagcucggcugcaucaagccccucugcgaccuccucaccgucauggacuccaagaucguccaggucgcccucaacggccucgagaacauccuccgccucggcgagcaggaggccaagcgcaacggcaccggcaucaaccccuacugcgcccucaucgaggaggccuacggccucgacaagaucgaguuccuccagucccacgagaaccaggagaucuaccagaaggccuucgaccucaucgagcacuacuucggcaccgaggacgaggacuccuccaucgccccccaggucgaccucaaccagcagcaguacaucuuccagcagugcgaggcccccauggagggcuuccagcucuga

SEQ ID NO: 45172 - RNA, 1590 nt, Artificial Sequence
  derived and/or modified sequence opt2 from KPNA2__Homo_sapiens__NP_001307540
auguccaccaacgagaacgccaacacccccgccgcccgccuccaccgcuucaagaacaagggcaaggacuccaccgagaugcgccgccgccgcaucgaggucaacgucgagcuccgcaaggccaagaaggacgaccagaugcucaagcgccgcaacgucuccuccuuccccgacgacgccaccuccccccuccaggagaaccgcaacaaccagggcaccgucaacugguccgucgacgacaucgucaagggcaucaacuccuccaacgucgagaaccagcuccaggccacccaggccgcccgcaagcuccucucccgcgagaagcagccccccaucgacaacaucauccgcgccggccucauccccaaguucgucuccuuccucggccgcaccgacugcucccccauccaguucgaguccgccugggcccucaccaacaucgccuccggcaccuccgagcagaccaaggccgucgucgacggcggcgccauccccgccuucaucucccuccucgccuccccccacgcccacaucuccgagcaggccgucugggcccucggcaacaucgccggcgacggcuccgucuuccgcgaccucgucaucaaguacggcgccgucgacccccuccucgcccuccucgccguccccgacauguccucccucgccugcggcuaccuccgcaaccucaccuggacccucuccaaccucugccgcaacaagaaccccgccccccccaucgacgccgucgagcagauccuccccacccucguccgccuccuccaccacgacgaccccgagguccucgccgacaccugcugggccaucuccuaccucaccgacggccccaacgagcgcaucggcauggucgucaagaccggcgucgucccccagcucgucaagcuccucggcgccuccgagcuccccaucgucacccccgcccuccgcgccaucggcaacaucgucaccggcaccgacgagcagacccaggucgucaucgacgccggcgcccucgccgucuuccccucccuccucaccaaccccaagaccaacauccagaaggaggccaccuggaccauguccaacaucaccgccggccgccaggaccagauccagcaggucgucaaccacggccucguccccuuccucgucuccguccucuccaaggccgacuucaagacccagaaggaggccgucugggccgucaccaacuacaccuccggcggcaccgucgagcagaucgucuaccucguccacugcggcaucaucgagccccucaugaaccuccucaccgccaaggacaccaagaucauccucgucauccucgacgccaucuccaacaucuuccaggccgccgagaagcucggcgagaccgagaagcucuccaucaugaucgaggagugcggcggccucgacaagaucgaggcccuccagaaccacgagaacgaguccgucuacaaggccucccucucccucaucgagaaguacuucuccgucgaggaggaggaggaccagaacgucguccccgagaccaccuccgagggcuacaccuuccagguccaggacggcgcccccggcaccuucaacuucuga

SEQ ID NO: 45173 - RNA, 1566 nt, Artificial Sequence
  derived and/or modified sequence opt2 from KPNA3__Homo_sapiens__NP_002258
auggccgagaaccccucccucgagaaccaccgcaucaaguccuucaagaacaagggccgcgacgucgagaccaugcgccgccaccgcaacgaggucaccgucgagcuccgcaagaacaagcgcgacgagcaccuccucaagaagcgcaacgucccccaggaggagucccucgaggacuccgacgucgacgccgacuucaaggcccagaacgucacccucgaggccauccuccagaacgccaccuccgacaaccccgucguccagcucuccgccguccaggccgcccgcaagcuccucuccuccgaccgcaacccccccaucgacgaccucaucaaguccggcauccuccccauccucgucaagugccucgagcgcgacgacaaccccucccuccaguucgaggccgccugggcccucaccaacaucgccuccggcaccuccgcccagacccaggccgucguccaguccaacgccgucccccucuuccuccgccuccuccgcuccccccaccagaacgucugcgagcaggccgucugggcccucggcaacaucaucggcgacggcccccagugccgcgacuacgucaucucccucggcgucgucaagccccuccucuccuucaucucccccuccauccccaucaccuuccuccgcaacgucaccugggucaucgucaaccucugccgcaacaaggacccccccccccccauggagaccguccaggagauccuccccgcccucugcguccucaucuaccacaccgacaucaacauccucgucgacaccgucugggcccucuccuaccucaccgacggcggcaacgagcagauccagauggucaucgacuccggcgucguccccuuccucgucccccuccucucccaccaggaggucaagguccagaccgccgcccuccgcgccgucggcaacaucgucaccggcaccgacgagcagacccaggucguccucaacugcgacguccucucccacuuccccaaccuccucucccaccccaaggagaagaucaacaaggaggccgucugguuccucuccaacaucaccgccggcaaccagcagcagguccaggccgucaucgacgccggccucauccccaugaucauccaccagcucgccaagggcgacuucggcacccagaaggaggccgccugggccaucuccaaccucaccaucuccggccgcaaggaccaggucgaguaccucguccagcagaacgucaucccccccuucugcaaccuccucuccgucaaggacucccaggucguccaggucguccucgacggccucaagaacauccucaucauggccggcgacgaggccuccaccaucgccgagaucaucgaggagugcggcggccucgagaagaucgagguccuccagcagcacgagaacgaggacaucuacaagcucgccuucgagaucaucgaccaguacuucuccggcgacgacaucgacgaggaccccugccucauccccgaggccacccagggcggcaccuacaacuucgaccccaccgccaaccuccagaccaaggaguucaacuucuga

SEQ ID NO: 45174 - RNA, 1566 nt, Artificial Sequence
  derived and/or modified sequence opt2 from KPNA4__Homo_sapiens__NP_002259
auggccgacaacgagaagcucgacaaccagcgccucaagaacuucaagaacaagggccgcgaccucgagaccaugcgccgccagcgcaacgaggucgucgucgagcuccgcaagaacaagcgcgacgagcaccuccucaagcgccgcaacgucccccacgaggacaucugcgaggacuccgacaucgacggcgacuaccgcguccagaacaccucccucgaggccaucguccagaacgccuccuccgacaaccagggcauccagcucuccgccguccaggccgcccgcaagcuccucuccuccgaccgcaacccccccaucgacgaccucaucaaguccggcauccuccccauccucguccacugccucgagcgcgacgacaaccccucccuccaguucgaggccgccugggcccucaccaacaucgccuccggcaccuccgagcagacccaggccgucguccaguccaacgccgucccccucuuccuccgccuccuccacuccccccaccagaacgucugcgagcaggccgucugggcccucggcaacaucaucggcgacggcccccagugccgcgacuacgucaucucccucggcgucgucaagccccuccucuccuucaucucccccuccauccccaucaccuuccuccgcaacgucaccugggucauggucaaccucugccgccacaaggacccccccccccccauggagaccauccaggagauccuccccgcccucugcguccucauccaccacaccgacgucaacauccucgucgacaccgucugggcccucuccuaccucaccgacgccggcaacgagcagauccagauggucaucgacuccggcaucgucccccaccucgucccccuccucucccaccaggaggucaagguccagaccgccgcccuccgcgccgucggcaacaucgucaccggcaccgacgagcagacccaggucguccucaacugcgacgcccucucccacuuccccgcccuccucacccaccccaaggagaagaucaacaaggaggccgucugguuccucuccaacaucaccgccggcaaccagcagcagguccaggccgucaucgacgccaaccucguccccaugaucauccaccuccucgacaagggcgacuucggcacccagaaggaggccgccugggccaucuccaaccucaccaucuccggccgcaaggaccaggucgccuaccucauccagcagaacgucaucccccccuucugcaaccuccucaccgucaaggacgcccaggucguccaggucguccucgacggccucuccaacauccucaagauggccgaggacgaggccgagaccaucggcaaccucaucgaggagugcggcggccucgagaagaucgagcagcuccagaaccacgagaacgaggacaucuacaagcucgccuacgagaucaucgaccaguucuucuccuccgacgacaucgacgaggaccccucccucguccccgaggccauccagggcggcaccuucggcuucaacuccuccgccaacguccccaccgagggcuuccaguucuga

SEQ ID NO: 45175 - RNA, 1608 nt, Artificial Sequence
  derived and/or modified sequence opt2 from KPNA6__Homo_sapiens__XP_011539462
augaccauggccucccccggcaaggacaacuaccgcaugaaguccuacaagaacaacgcccucaaccccgaggagaugcgccgccgccgcgaggaggagggcauccagcuccgcaagcagaagcgcgagcagcagcucuucaagcgccgcaacgucgagcucaucaacgaggaggccgccauguucgacucccuccucauggacuccuacgucuccuccaccaccggcgaguccgucaucacccgcgagauggucgagaugcucuucuccgacgacuccgaccuccagcucgccaccacccagaaguuccgcaagcuccucuccaaggagcccuccccccccaucgacgaggucaucaacaccccccgcgucgucgaccgcuucgucgaguuccucaagcgcaacgagaacugcacccuccaguucgaggccgccugggcccucaccaacaucgccuccggcaccucccagcagaccaagaucgucaucgaggccggcgccguccccaucuucaucgagcuccucaacuccgacuucgaggacguccaggagcaggccgucugggcccucggcaacaucgccggcgacuccuccgucugccgcgacuacguccucaacugcuccauccucaacccccuccucacccuccucaccaaguccacccgccucaccaugacccgcaacgccgucugggcccucuccaaccucugccgcggcaagaaccccccccccgaguucgccaaggucucccccugccuccccguccucucccgccuccucuucuccuccgacuccgaccuccucgccgacgccugcugggcccucuccuaccucuccgacggccccaacgagaagauccaggccgucaucgacuccggcgucugccgccgccucgucgagcuccucaugcacaacgacuacaaggucgccucccccgcccuccgcgccgucggcaacaucgucaccggcgacgacauccagacccaggucauccucaacugcuccgcccuccccugccuccuccaccuccucuccucccccaaggaguccauccgcaaggaggccugcuggaccaucuccaacaucaccgccggcaaccgcgcccagauccaggccgucaucgacgccaacaucuuccccguccucaucgagauccuccagaaggccgaguuccgcacccgcaaggaggccgccugggccaucaccaacgccaccuccggcggcacccccgagcagauccgcuaccucgucucccucggcugcaucaagccccucugcgaccuccucaccgucauggacuccaagaucguccaggucgcccucaacggccucgagaacauccuccgccucggcgagcaggagggcaagcgcuccggcuccggcgucaaccccuacugcggccucaucgaggaggccuacggccucgacaagaucgaguuccuccagucccacgagaaccaggagaucuaccagaaggccuucgaccucaucgagcacuacuucggcgucgaggacgacgacuccucccucgccccccaggucgacgagacccagcagcaguucaucuuccagcagcccgaggcccccauggagggcuuccagcucuga

SEQ ID NO: 45176 - RNA, 1551 nt, Artificial Sequence
  derived and/or modified sequence opt2 from KPNA7__Homo_sapiens__NP_001139187
augcccacccucgacgcccccgaggagcgccgccgcaaguucaaguaccgcggcaaggacgucucccuccgccgccagcagcgcauggccgucucccucgagcuccgcaaggccaagaaggacgagcagacccucaagcgccgcaacaucaccuccuucugccccgacacccccuccgagaagaccgccaagggcgucgccgucucccucacccucggcgagaucaucaagggcgucaacuccuccgaccccguccucugcuuccaggccacccagaccgcccgcaagaugcucucccaggagaagaaccccccccucaagcucgucaucgaggccggccucaucccccgcauggucgaguuccucaaguccucccucuaccccugccuccaguucgaggccgccugggcccucaccaacaucgccuccggcaccuccgagcagacccgcgccgucgucgagggcggcgccauccagccccucaucgagcuccucuccuccuccaacgucgccgucugcgagcaggccgucugggcccucggcaacaucgccggcgacggccccgaguuccgcgacaacgucaucaccuccaacgccaucccccaccuccucgcccucaucucccccacccuccccaucaccuuccuccgcaacaucaccuggacccucuccaaccucugccgcaacaagaaccccuaccccugcgacaccgccgucaagcagauccuccccgcccuccuccaccuccuccagcaccaggacuccgagguccucuccgacgccugcugggcccucuccuaccucaccgacggcuccaacaagcgcaucggccaggucgucaacaccggcguccucccccgccucgucguccucaugaccuccuccgagcucaacguccucacccccucccuccgcaccgucggcaacaucgucaccggcaccgacgagcagacccagauggccaucgacgccggcaugcucaacguccucccccagcuccuccagcacaacaagcccuccauccagaaggaggccgccugggcccucuccaacgucgccgccggccccugccaccacauccagcagcuccucgccuacgacguccuccccccccucgucgcccuccucaagaacggcgaguucaagguccagaaggaggccgucuggauggucgccaacuucgccaccggcgccaccauggaccagcucauccagcucguccacuccggcguccucgagccccucgucaaccuccucaccgcccccgacgucaagaucguccucaucauccucgacgucaucuccugcauccuccaggccgccgagaagcgcuccgagaaggagaaccucugccuccucaucgaggagcucggcggcaucgaccgcaucgaggcccuccagcuccacgagaaccgccagaucggccaguccgcccucaacaucaucgagaagcacuucggcgaggaggaggacgagucccagacccuccucucccaggucaucgaccaggacuacgaguucaucgacuacgagugccucgccaagaaguga

SEQ ID NO: 45177 - RNA, 2196 nt, Artificial Sequence
  derived and/or modified sequence opt2 from KPNB1__Homo_sapiens__NP_001263382
augaaggaguccacccucgaggccaucggcuacaucugccaggacaucgaccccgagcagcuccaggacaaguccaacgagauccucaccgccaucauccagggcaugcgcaaggaggagcccuccaacaacgucaagcucgccgccaccaacgcccuccucaacucccucgaguucaccaaggccaacuucgacaaggaguccgagcgccacuucaucaugcaggucgucugcgaggccacccagugccccgacacccgcguccgcgucgccgcccuccagaaccucgucaagaucaugucccucuacuaccaguacauggagaccuacaugggccccgcccucuucgccaucaccaucgaggccaugaaguccgacaucgacgaggucgcccuccagggcaucgaguucugguccaacgucugcgacgaggagauggaccucgccaucgaggccuccgaggccgccgagcagggccgcccccccgagcacaccuccaaguucuacgccaagggcgcccuccaguaccucguccccauccucacccagacccucaccaagcaggacgagaacgacgacgacgacgacuggaaccccugcaaggccgccggcgucugccucaugcuccucgccaccugcugcgaggacgacaucgucccccacguccuccccuucaucaaggagcacaucaagaaccccgacuggcgcuaccgcgacgccgccgucauggccuucggcugcauccucgagggccccgagcccucccagcucaagccccucgucauccaggccaugcccacccucaucgagcucaugaaggaccccuccgucgucguccgcgacaccgccgccuggaccgucggccgcaucugcgagcuccuccccgaggccgccaucaacgacgucuaccucgccccccuccuccagugccucaucgagggccucuccgccgagccccgcgucgccuccaacgucugcugggccuucuccucccucgccgaggccgccuacgaggccgccgacgucgccgacgaccaggaggagcccgccaccuacugccucuccuccuccuucgagcucaucguccagaagcuccucgagaccaccgaccgccccgacggccaccagaacaaccuccgcuccuccgccuacgagucccucauggagaucgucaagaacuccgccaaggacugcuaccccgccguccagaagaccacccucgucaucauggagcgccuccagcagguccuccagauggagucccacauccaguccaccuccgaccgcauccaguucaacgaccuccagucccuccucugcgccacccuccagaacguccuccgcaagguccagcaccaggacgcccuccagaucuccgacgucgucauggccucccuccuccgcauguuccaguccaccgccggcuccggcggcguccaggaggacgcccucauggccgucuccacccucgucgagguccucggcggcgaguuccucaaguacauggaggccuucaagcccuuccucggcaucggccucaagaacuacgccgaguaccaggucugccucgccgccgucggccucgucggcgaccucugccgcgcccuccaguccaacaucauccccuucugcgacgaggucaugcagcuccuccucgagaaccucggcaacgagaacguccaccgcuccgucaagccccagauccucuccgucuucggcgacaucgcccucgccaucggcggcgaguucaagaaguaccucgaggucguccucaacacccuccagcaggccucccaggcccaggucgacaaguccgacuacgacauggucgacuaccucaacgagcuccgcgaguccugccucgaggccuacaccggcaucguccagggccucaagggcgaccaggagaacguccaccccgacgucaugcucguccagccccgcgucgaguucauccucuccuucaucgaccacaucgccggcgacgaggaccacaccgacggcgucgucgccugcgccgccggccucaucggcgaccucugcaccgccuucggcaaggacguccucaagcucgucgaggcccgccccaugauccacgagcuccucaccgagggccgccgcuccaagaccaacaaggccaagacccucgccaccugggccaccaaggagcuccgcaagcucaagaaccaggccuga

SEQ ID NO: 45178 - RNA, 1740 nt, Artificial Sequence
  derived and/or modified sequence opt2 from KPRP__Homo_sapiens__NP_001020402
augugcgaccagcagcagauccagugccgccucccccuccagcagugcugcgucaagggccccuccuucugcuccucccagucccccuucgcccagucccaggucgucguccaggcccccugcgagaugcagaucgucgacugccccgccuccugccccguccaggucugccaggucuccgaccaggcccccugccagucccagaccacccaggucaagugccaguccaagaccaagcaggucaagggccaggcccagugccaguccaagaccacccaggucaagggccaggccgccucccagucccagaccuccuccguccagucccaggcccccugccaguccgaggucuccuacguccagugcgaggccucccagcccguccagaccugcuucgucgagugcgcccccgucugcuacaccgagaccugcuacgucgagugccccguccagaacuacguccccugccccgccccccagcccguccagauguaccgcggccgccccgccgucugccagccccagggccgcuucuccacccagugccaguaccagggcuccuacuccuccugcggcccccaguuccagucccgcgccaccugcaacaacuacaccccccaguuccagcuccgccccuccuacuccuccugcuucccccaguaccgcucccgcaccuccuucucccccugcgucccccagugccagacccagggcuccuacggcuccuucaccgagcagcaccgcucccgcuccaccucccgcugccucccccccccccgccgccuccagcucuucccccgcuccugcucccccccccgccgcuucgagcccugcuccuccuccuaccucccccuccgccccuccgagggcuuccccaacuacugcacccccccccgccgcuccgagcccaucuacaacucccgcugcccccgccgccccaucuccuccugcucccagcgccgcggccccaagugccgcaucgagaucuccucccccugcugcccccgccagguccccccccagcgcugccccgucgagaucccccccauccgccgccgcucccaguccugcggcccccagcccuccuggggcgccuccugccccgagcuccgcccccacgucgagccccgcccccuccccuccuucugccccccccgccgccucgaccagugccccgaguccccccuccagcgcugccccccccccgccccccgcccccgccuccgccccgagcccugcaucucccucgagccccgcccccgcccccucccccgccagcucuccgagcccugccucuaccccgagccccuccccgcccuccgccccaccccccgccccgucccccucccccgccccggccagugcgagauccccgagccccgccccugccuccagcccugcgagcaccccgagcccugcccccgccccgagcccaucccccuccccgcccccugccccucccccgagcccugccgcgagaccuggcgcucccccucccccugcuggggccccaaccccguccccuaccccggcgaccucggcugccacgaguccuccccccaccgccucgacaccgaggcccccuacugcggccccuccuccuacaaccagggccaggaguccggcgccggcugcggccccggcgacgucuuccccgagcgccgcggccaggacggccacggcgaccagggcaacgccuucgccggcgucaagggcgaggccaaguccgccuacuucuga

SEQ ID NO: 45179 - RNA, 1143 nt, Artificial Sequence
  derived and/or modified sequence opt2 from KPTN__Homo_sapiens__NP_001278225
augaugggcgaggccgccgucgccgccggccccugcccccuccgcgaggacuccuucacccgcuucuccucccaguccaacgucuacggccucgccggcggcgccggcggccgcggcgagcuccucgccgccacccucaagggcaagguccucggcuuccgcuaccaggaccuccgccagaagauccgccccgucgccaaggagcuccaguucaacuacauccccgaguccugccucaaccucgagcuccaguucacccccuuccagcucugccacgccgagguccaggucggcgaccagcucgagaccgucuuccuccucuccggcaacgaccccgccauccaccucuacaaggagaacgagggccuccaccaguucgaggagcagcccgucgagaaccucuuccccgagcucaccaaccucaccuccuccguccucuggcucgacguccacaacuuccccggcaccucccgccgccucuccgcccucggcugccaguccggcuacguccgcgucgcccacgucgaccagcgcucccgcgagguccuccagaugugguccguccuccaggacggccccaucucccgcgucaucgucuucucccucuccgccgccaaggagaccaaggaccgcccccuccaggacgaguacuccguccucgucgccuccaugcucgagcccgccgucgucuaccgcgaccuccucaaccgcggccucgaggaccagcuccuccuccccggcuccgaccaguucgacuccguccucugcucccucgucaccgacgucgaccucgacggccgccccgagguccucgucgccaccuacggccaggagcuccucugcuacaaguaccgcggccccgaguccggccuccccgaggcccagcacggcuuccaccuccucuggcagcgcuccuucuccuccccccuccucgccauggcccacgucgaccucaccggcgacggccuccaggagcucgccgucgucucccucaagggcguccacauccuccagcacucccucauccaggccuccgagcucguccucacccgccuccgccaccaggucgagcagcgccgccgccgccuccagggccucgaggacggcgccggcgccggccccgccgagaacgccgccuccuga

SEQ ID NO: 45180 - RNA, 567 nt, Artificial Sequence
  derived and/or modified sequence opt2 from KRAS__Homo_sapiens__NP_004976
augaccgaguacaagcucgucgucgucggcgccggcggcgucggcaaguccgcccucaccauccagcucauccagaaccacuucgucgacgaguacgaccccaccaucgaggacuccuaccgcaagcaggucgucaucgacggcgagaccugccuccucgacauccucgacaccgccggccaggaggaguacuccgccaugcgcgaccaguacaugcgcaccggcgagggcuuccucugcgucuucgccaucaacaacaccaaguccuucgaggacauccaccacuaccgcgagcagaucaagcgcgucaaggacuccgaggacguccccaugguccucgucggcaacaagugcgaccuccccucccgcaccgucgacaccaagcaggcccaggaccucgcccgcuccuacggcauccccuucaucgagaccuccgccaagacccgccagggcgucgacgacgccuucuacacccucguccgcgagauccgcaagcacaaggagaagauguccaaggacggcaagaagaagaagaagaaguccaagaccaagugcgucaucauguga

SEQ ID NO: 45181 - RNA, 516 nt, Artificial Sequence
  derived and/or modified sequence opt2 from KRBOX4__Homo_sapiens__NP_001123370
auggccaugucccaggagucccucaccuucaaggacgucuucgucgacuucacccucgaggaguggcagcagcucgacuccgcccagaagaaccucuaccgcgacgucaugcucgagaacuacucccaccucgucuccgucggcuaccucgucgccaagcccgacgucaucuuccgccucggccccggcgaggaguccuggauggccgacggcggcacccccguccgcaccugcgccggcgaggaccgccccgaggucuggcaggucgacgagcagaucgaccacuacaaggagucccaggacaagcuccccuggcaggccgccuucaucggcaaggagacccucaaggacgaguccggccaggagucccgcaccugccgcaaguccaucuaccucuccaccgaguucgacuccguccgccagcgccuccccaaguacuacuccugggagaaggccuucaagaccuccuucaagcucuccugguccaaguggaagcucugcaagaaggagcgcuga

SEQ ID NO: 45182 - RNA, 1377 nt, Artificial Sequence
  derived and/or modified sequence opt2 from KREMEN1__Homo_sapiens__NP_001034659
auggccccccccgccgcccgccucgcccuccucuccgccgccgcccucacccucgccgcccgccccgcccccucccccggccucggccccggccccgagugcuucaccgccaacggcgccgacuaccgcggcacccagaacuggaccgcccuccagggcggcaagcccugccucuucuggaacgagaccuuccagcaccccuacaacacccucaaguaccccaacggcgagggcggccucggcgagcacaacuacugccgcaaccccgacggcgacgucucccccuggugcuacgucgccgagcacgaggacggcgucuacuggaaguacugcgagauccccgccugccagaugcccggcaaccucggcugcuacaaggaccacggcaacccccccccccucaccggcaccuccaagaccuccaacaagcucaccauccagaccugcaucuccuucugccgcucccagcgcuucaaguucgccggcauggaguccggcuacgccugcuucugcggcaacaaccccgacuacuggaaguacggcgaggccgccuccaccgagugcaacuccgucugcuucggcgaccacacccagcccugcggcggcgacggccgcaucauccucuucgacacccucgucggcgccugcggcggcaacuacuccgccauguccuccgucgucuacucccccgacuuccccgacaccuacgccaccggccgcgucugcuacuggaccauccgcguccccggcgccucccacauccacuucuccuucccccucuucgacauccgcgacuccgccgacauggucgagcuccucgacggcuacacccaccgcguccucgcccgcuuccacggccgcucccgccccccccucuccuucaacgucucccucgacuucgucauccucuacuucuucuccgaccgcaucaaccaggcccagggcuucgccguccucuaccaggccgucaaggaggagcucccccaggagcgccccgccgucaaccagaccgucgccgaggucaucaccgagcaggccaaccucuccgucuccgccgcccgcuccuccaagguccucuacgucaucaccaccucccccucccaccccccccagaccguccccggcuggaccgucuacggccucgccacccuccucauccucaccgucaccgccaucgucgccaagauccuccuccacgucaccuucaagucccaccgcguccccgccuccggcgaccuccgcgacugccaccagcccggcaccuccggcgagaucugguccaucuucuacaagcccuccaccuccaucuccaucuucaagaagaagcucaagggccagucccagcaggacgaccgcaacccccucgucuccgacuga

SEQ ID NO: 45183 - RNA, 2067 nt, Artificial Sequence
  derived and/or modified sequence opt2 from KRIT1__Homo_sapiens__NP_001013424
augggcaaccccgagaacaucgaggacgccuacgucgccgucauccgccccaagaacaccgccucccucaacucccgcgaguaccgcgccaaguccuacgagauccuccuccacgagguccccaucgagggccagaagaagaagcgcaagaagguccuccucgagaccaagcuccagggcaacuccgagaucacccagggcauccucgacuacgucgucgagaccaccaagcccaucucccccgccaaccagggcauccgcggcaagcgcgucguccucaugaagaaguucccccucgacggcgagaagaugggccgcgaggccucccucuucaucguccccuccgucgucaaggacaacaccaaguacaccuacacccccggcugccccaucuucuacugccuccaggacaucaugcgcgucugcuccgaguccuccacccacuucgccacccucaccgcccgcaugcucaucgcccucgacaaguggcucgacgagcgccacgcccagucccacuucauccccgcccucuuccgccccuccccccucgagcgcaucaagaccaacgucaucaaccccgccuacgccaccgaguccggccagaccgagaacucccuccacaugggcuacuccgcccucgagaucaaguccaagaugcucgcccucgagaaggccgacaccugcaucuacaacccccucuucggcuccgaccuccaguacaccaaccgcgucgacaaggucgucaucaaccccuacuucggccucggcgcccccgacuacuccaagauccagauccccaagcaggagaaguggcagcgcuccauguccuccgucaccgaggacaaguacggcaaggucgaggccacccgcauccuccucgagaagggcaagugcaaccccaaccuccucaacggccagcucuccuccccccuccacuucgccgccggcggcggccacgccgagaucguccagauccuccucaaccaccccgagaccgaccgccacaucaccgaccagcagggccgcuccccccucaacaucugcgaggagaacaagcagaacaacugggaggaggccgccaagcuccucaaggaggccaucaacaagcccuacgagaagguccgcaucuaccgcauggacggcuccuaccgcuccgucgagcucaagcacggcaacaacaccaccguccagcagaucauggagggcaugcgccucucccaggagacccagcaguacuucaccaucuggaucugcuccgagaaccucucccuccagcucaagcccuaccacaagccccuccagcacguccgcgacuggcccgagauccucgccgagcucaccaaccucgacccccagcgcgagaccccccagcucuuccuccgccgcgacguccgccucccccucgaggucgagaagcagaucgaggacccccucgccauccucauccucuucgacgaggcccgcuacaaccuccucaagggcuucuacaccgcccccgacgccaagcucaucacccucgccucccuccuccuccagaucgucuacggcaacuacgaguccaagaagcacaagcagggcuuccucaacgaggagaaccucaaguccaucguccccgucaccaagcucaaguccaaggccccccacuggaccaaccgcauccuccacgaguacaagaaccucuccaccuccgagggcgucuccaaggagaugcaccaccuccagcgcauguuccuccagaacugcugggagauccccaccuacggcgccgccuucuucaccggccagaucuucaccaaggccucccccuccaaccacaaggucauccccgucuacgucggcgucaacaucaagggccuccaccuccucaacauggagaccaaggcccuccucaucucccucaaguacggcugcuucauguggcagcucggcgacaccgacaccugcuuccagauccacuccauggagaacaagauguccuucaucguccacaccaagcaggccggccucgucgucaagcuccucaugaagcucaacggccagcucaugcccaccgagcgcaacuccuga

SEQ ID NO: 45184 - RNA, 1755 nt, Artificial Sequence
  derived and/or modified sequence opt2 from KRT10__Homo_sapiens__NP_000412
auguccguccgcuacuccuccuccaagcacuacuccuccucccgcuccggcggcggcggcggcggcggcggcugcggcggcggcggcggcgucuccucccuccgcaucuccuccuccaagggcucccucggcggcggcuucuccuccggcggcuucuccggcggcuccuucucccgcggcuccuccggcggcggcugcuucggcggcuccuccggcggcuacggcggccucggcggcuucggcggcggcuccuuccgcggcuccuacggcuccuccuccuucggcggcuccuacggcggcuccuucggcggcggcuccuucggcggcggcuccuucggcggcggcuccuucggcggcggcggcuucggcggcggcggcuucggcggcggcuucggcggcggcuucggcggcgacggcggccuccucuccggcaacgagaaggucaccaugcagaaccucaacgaccgccucgccuccuaccucgacaagguccgcgcccucgaggaguccaacuacgagcucgagggcaagaucaaggagugguacgagaagcacggcaacucccaccagggcgagccccgcgacuacuccaaguacuacaagaccaucgacgaccucaagaaccagauccucaaccucaccaccgacaacgccaacauccuccuccagaucgacaacgcccgccucgccgccgacgacuuccgccucaaguacgagaacgaggucgcccuccgccaguccgucgaggccgacaucaacggccuccgccgcguccucgacgagcucacccucaccaaggccgaccucgagaugcagaucgagucccucaccgaggagcucgccuaccucaagaagaaccacgaggaggagaugaaggaccuccgcaacgucuccaccggcgacgucaacgucgagaugaacgccgcccccggcgucgaccucacccagcuccucaacaacaugcgcucccaguacgagcagcucgccgagcagaaccgcaaggacgccgaggccugguucaacgagaaguccaaggagcucaccaccgagaucgacaacaacaucgagcagaucuccuccuacaaguccgagaucaccgagcuccgccgcaacguccaggcccucgagaucgagcuccagucccagcucgcccucaagcagucccucgaggccucccucgccgagaccgagggccgcuacugcguccagcucucccagauccaggcccagaucuccgcccucgaggagcagcuccagcagauccgcgccgagaccgagugccagaacaccgaguaccagcagcuccucgacaucaagauccgccucgagaacgagauccagaccuaccgcucccuccucgagggcgagggcuccuccggcggcggcggccgcggcggcggcuccuucggcggcggcuacggcggcggcuccuccggcggcggcuccuccggcggcggccacggcggcggccacggcggcuccuccggcggcggcuacggcggcggcuccuccggcggcggcuccuccggcggcggcuacggcggcggcuccuccuccggcggccacggcggcuccuccuccggcggcuacggcggcggcuccuccggcggcggcggcggcggcuacggcggcggcuccuccggcggcggcuccuccuccggcggcggcuacggcggcggcuccuccuccggcggccacaaguccuccuccuccggcuccgucggcgaguccuccuccaagggcccccgcuacuga

SEQ ID NO: 45185 - RNA, 1485 nt, Artificial Sequence
  derived and/or modified sequence opt2 from KRT12__Homo_sapiens__NP_000214
auggaccucuccaacaacaccaugucccucuccguccgcacccccggccucucccgccgccucuccucccaguccgucaucggccgcccccgcggcauguccgccuccuccgucggcuccggcuacggcggcuccgccuucggcuucggcgccuccugcggcggcggcuucuccgccgccuccauguucggcuccuccuccggcuucggcggcggcuccggcuccuccauggccggcggccucggcgccggcuacggccgcgcccucggcggcggcuccuucggcggccucggcaugggcuucggcggcucccccggcggcggcucccucggcauccucuccggcaacgacggcggccuccucuccggcuccgagaaggagaccaugcagaaccucaacgaccgccucgccuccuaccucgacaagguccgcgcccucgaggaggccaacaccgagcucgagaacaagauccgcgagugguacgagacccgcggcaccggcaccgccgacgccucccaguccgacuacuccaaguacuacccccucaucgaggaccuccgcaacaagaucaucuccgccuccaucggcaacgcccagcuccuccuccagaucgacaacgcccgccucgccgccgaggacuuccgcaugaaguacgagaacgagcucgcccuccgccagggcgucgaggccgacaucaacggccuccgccgcguccucgacgagcucacccucacccgcaccgaccucgagaugcagaucgagucccucaacgaggagcucgccuacaugaagaagaaccacgaggacgagcuccaguccuuccgcgucggcggccccggcgaggucuccgucgagauggacgccgcccccggcgucgaccucacccgccuccucaacgacaugcgcgcccaguacgagaccaucgccgagcagaaccgcaaggacgccgaggccugguucaucgagaaguccggcgagcuccgcaaggagaucuccaccaacaccgagcagcuccaguccuccaaguccgaggucaccgaccuccgccgcgccuuccagaaccucgagaucgagcuccagucccagcucgccaugaagaagucccucgaggacucccucgccgaggccgagggcgacuacugcgcccagcucucccagguccagcagcucaucuccaaccucgaggcccagcuccuccagguccgcgccgacgccgagcgccagaacgucgaccaccagcgccuccucaacgucaaggcccgccucgagcucgagaucgagaccuaccgccgccuccucgacggcgaggcccagggcgacggccucgaggagucccucuucgucaccgacuccaagucccaggcccaguccaccgacuccuccaaggaccccaccaagacccgcaagaucaagaccgucguccaggagauggucaacggcgaggucgucuccucccagguccaggagaucgaggagcucauguga

SEQ ID NO: 45186 - RNA, 1263 nt, Artificial Sequence
  derived and/or modified sequence opt2 from KRT13__Homo_sapiens__NP_002265
augucccuccgccuccaguccuccuccgccuccuacggcggcggcuucggcggcggcuccugccagcucggcggcggccgcggcgucuccaccugcuccacccgcuucgucuccggcggcuccgccggcggcuacggcggcggcgucuccugcggcuucggcggcggcgccggcuccggcuucggcggcggcuacggcggcggccucggcggcggcuacggcggcggccucggcggcggcuucggcggcggcuucgccggcggcuucgucgacuucggcgccugcgacggcggccuccucaccggcaacgagaagaucaccaugcagaaccucaacgaccgccucgccuccuaccucgagaagguccgcgcccucgaggaggccaacgccgaccucgaggucaagauccgcgacuggcaccucaagcagucccccgccucccccgagcgcgacuacucccccuacuacaagaccaucgaggagcuccgcgacaagauccucaccgccaccaucgagaacaaccgcgucauccucgagaucgacaacgcccgccucgccgccgacgacuuccgccucaaguacgagaacgagcucgcccuccgccaguccgucgaggccgacaucaacggccuccgccgcguccucgacgagcucacccucuccaagaccgaccucgagaugcagaucgagucccucaacgaggagcucgccuacaugaagaagaaccacgaggaggagaugaaggaguucuccaaccaggucgucggccaggucaacgucgagauggacgccacccccggcaucgaccucacccgcguccucgccgagaugcgcgagcaguacgaggccauggccgagcgcaaccgccgcgacgccgaggagugguuccacgccaaguccgccgagcucaacaaggaggucuccaccaacaccgccaugauccagaccuccaagaccgagaucaccgagcuccgccgcacccuccagggccucgagaucgagcuccagucccagcucuccaugaaggccggccucgagaacaccgucgccgagaccgagugccgcuacgcccuccagcuccagcagauccagggccucaucuccuccaucgaggcccagcucuccgagcuccgcuccgagauggagugccagaaccaggaguacaagaugcuccucgacaucaagacccgccucgagcaggagaucgccaccuaccgcucccuccucgagggccaggacgccaagaagcgccagccccccuga

SEQ ID NO: 45187 - RNA, 1419 nt, Artificial Sequence
  derived and/or modified sequence opt2 from KRT14__Homo_sapiens__NP_000517
augaccaccugcucccgccaguucaccuccuccuccuccaugaagggcuccugcggcaucggcggcggcaucggcggcggcuccucccgcaucuccuccguccucgccggcggcuccugccgcgcccccuccaccuacggcggcggccucuccgucuccuccucccgcuucuccuccggcggcgccuacggccucggcggcggcuacggcggcggcuucuccuccuccuccuccuccuucggcuccggcuucggcggcggcuacggcggcggccucggcgccggccucggcggcggcuucggcggcggcuucgccggcggcgacggccuccucgucggcuccgagaaggucaccaugcagaaccucaacgaccgccucgccuccuaccucgacaagguccgcgcccucgaggaggccaacgccgaccucgaggucaagauccgcgacugguaccagcgccagcgccccgccgagaucaaggacuacucccccuacuucaagaccaucgaggaccuccgcaacaagauccucaccgccaccgucgacaacgccaacguccuccuccagaucgacaacgcccgccucgccgccgacgacuuccgcaccaaguacgagaccgagcucaaccuccgcauguccgucgaggccgacaucaacggccuccgccgcguccucgacgagcucacccucgcccgcgccgaccucgagaugcagaucgagucccucaaggaggagcucgccuaccucaagaagaaccacgaggaggagaugaacgcccuccgcggccaggucggcggcgacgucaacgucgagauggacgccgcccccggcgucgaccucucccgcauccucaacgagaugcgcgaccaguacgagaagauggccgagaagaaccgcaaggacgccgaggagugguucuucaccaagaccgaggagcucaaccgcgaggucgccaccaacuccgagcucguccaguccggcaaguccgagaucuccgagcuccgccgcaccaugcagaaccucgagaucgagcuccagucccagcucuccaugaaggccucccucgagaacucccucgaggagaccaagggccgcuacugcaugcagcucgcccagauccaggagaugaucggcuccgucgaggagcagcucgcccagcuccgcugcgagauggagcagcagaaccaggaguacaagauccuccucgacgucaagacccgccucgagcaggagaucgccaccuaccgccgccuccucgagggcgaggacgcccaccucuccuccucccaguucuccuccggcucccaguccucccgcgacgucaccuccuccucccgccagauccgcaccaaggucauggacguccacgacggcaaggucgucuccacccacgagcagguccuccgcaccaagaacuga

SEQ ID NO: 45188 - RNA, 1371 nt, Artificial Sequence
  derived and/or modified sequence opt2 from KRT15__Homo_sapiens__NP_002266
augaccaccaccuuccuccagaccuccuccuccaccuucggcggcggcuccacccgcggcggcucccuccucgccggcggcggcggcuucggcggcggcucccucuccggcggcggcggcucccgcuccaucuccgccuccuccgcccgcuucgucuccuccggcuccggcggcggcuacggcggcggcaugcgcgucugcggcuucggcggcggcgccggcuccgucuucggcggcggcuucggcggcggcgucggcggcggcuucggcggcggcuucggcggcggcgacggcggccuccucuccggcaacgagaagaucaccaugcagaaccucaacgaccgccucgccuccuaccucgacaagguccgcgcccucgaggaggccaacgccgaccucgaggucaagauccacgacugguaccagaagcagacccccaccucccccgagugcgacuacucccaguacuucaagaccaucgaggagcuccgcgacaagaucauggccaccaccaucgacaacucccgcgucauccucgagaucgacaacgcccgccucgccgccgacgacuuccgccucaaguacgagaacgagcucgcccuccgccagggcgucgaggccgacaucaacggccuccgccgcguccucgacgagcucacccucgcccgcaccgaccucgagaugcagaucgagggccucaacgaggagcucgccuaccucaagaagaaccacgaggaggagaugaaggaguucuccucccagcucgccggccaggucaacgucgagauggacgccgcccccggcgucgaccucacccgcguccucgccgagaugcgcgagcaguacgaggccauggccgagaagaaccgccgcgacgucgaggccugguucuucuccaagaccgaggagcucaacaaggaggucgccuccaacaccgagaugauccagaccuccaagaccgagaucaccgaccuccgccgcaccaugcaggagcucgagaucgagcuccagucccagcucuccaugaaggccggccucgagaacucccucgccgagaccgagugccgcuacgccacccagcuccagcagauccagggccucaucggcggccucgaggcccagcucuccgagcuccgcugcgagauggaggcccagaaccaggaguacaagaugcuccucgacaucaagacccgccucgagcaggagaucgccaccuaccgcucccuccucgagggccaggacgccaagauggccggcaucggcauccgcgaggccuccuccggcggcggcggcuccuccuccaacuuccacaucaacgucgaggaguccgucgacggccaggucgucuccucccacaagcgcgagaucuga

SEQ ID NO: 45189 - RNA, 1422 nt, Artificial Sequence
  derived and/or modified sequence opt2 from KRT16__Homo_sapiens__NP_005548
augaccaccugcucccgccaguucaccuccuccuccuccaugaagggcuccugcggcaucggcggcggcaucggcggcggcuccucccgcaucuccuccguccucgccggcggcuccugccgcgcccccuccaccuacggcggcggccucuccgucuccucccgcuucuccuccggcggcgccugcggccucggcggcggcuacggcggcggcuucuccuccuccuccuccuucggcuccggcuucggcggcggcuacggcggcggccucggcgccggcuucggcggcggccucggcgccggcuucggcggcggcuucgccggcggcgacggccuccucgucggcuccgagaaggucaccaugcagaaccucaacgaccgccucgccuccuaccucgacaagguccgcgcccucgaggaggccaacgccgaccucgaggucaagauccgcgacugguaccagcgccagcgccccuccgagaucaaggacuacucccccuacuucaagaccaucgaggaccuccgcaacaagaucaucgccgccaccaucgagaacgcccagcccauccuccagaucgacaacgcccgccucgccgccgacgacuuccgcaccaaguacgagcacgagcucgcccuccgccagaccgucgaggccgacgucaacggccuccgccgcguccucgacgagcucacccucgcccgcaccgaccucgagaugcagaucgagggccucaaggaggagcucgccuaccuccgcaagaaccacgaggaggagaugcucgcccuccgcggccagaccggcggcgacgucaacgucgagauggacgccgcccccggcgucgaccucucccgcauccucaacgagaugcgcgaccaguacgagcagauggccgagaagaaccgccgcgacgccgagaccugguuccucuccaagaccgaggagcucaacaaggaggucgccuccaacuccgagcucguccaguccucccgcuccgaggucaccgagcuccgccgcguccuccagggccucgagaucgagcuccagucccagcucuccaugaaggccucccucgagaacucccucgaggagaccaagggccgcuacugcaugcagcucucccagauccagggccucaucggcuccgucgaggagcagcucgcccagcuccgcugcgagauggagcagcagucccaggaguaccagauccuccucgacgucaagacccgccucgagcaggagaucgccaccuaccgccgccuccucgagggcgaggacgcccaccucuccucccagcaggccuccggccaguccuacuccucccgcgaggucuucaccuccuccuccuccuccuccucccgccagacccgccccauccucaaggagcaguccuccuccuccuucucccagggccaguccuccuga

SEQ ID NO: 45190 - RNA, 1299 nt, Artificial Sequence
  derived and/or modified sequence opt2 from KRT17__Homo_sapiens__NP_000413
augaccaccuccauccgccaguucaccuccuccuccuccaucaagggcuccuccggccucggcggcggcuccucccgcaccuccugccgccucuccggcggccucggcgccggcuccugccgccucggcuccgccggcggccucggcuccacccucggcggcuccuccuacuccuccugcuacuccuucggcuccggcggcggcuacggcuccuccuucggcggcgucgacggccuccucgccggcggcgagaaggccaccaugcagaaccucaacgaccgccucgccuccuaccucgacaagguccgcgcccucgaggaggccaacaccgagcucgaggucaagauccgcgacugguaccagcgccaggcccccggccccgcccgcgacuacucccaguacuaccgcaccaucgaggagcuccagaacaagauccucaccgccaccgucgacaacgccaacauccuccuccagaucgacaacgcccgccucgccgccgacgacuuccgcaccaaguucgagaccgagcaggcccuccgccucuccgucgaggccgacaucaacggccuccgccgcguccucgacgagcucacccucgcccgcgccgaccucgagaugcagaucgagaaccucaaggaggagcucgccuaccucaagaagaaccacgaggaggagaugaacgcccuccgcggccaggucggcggcgagaucaacgucgagauggacgccgcccccggcgucgaccucucccgcauccucaacgagaugcgcgaccaguacgagaagauggccgagaagaaccgcaaggacgccgaggacugguucuucuccaagaccgaggagcucaaccgcgaggucgccaccaacuccgagcucguccaguccggcaaguccgagaucuccgagcuccgccgcaccaugcaggcccucgagaucgagcuccagucccagcucuccaugaaggccucccucgagggcaaccucgccgagaccgagaaccgcuacugcguccagcucucccagauccagggccucaucggcuccgucgaggagcagcucgcccagcuccgcugcgagauggagcagcagaaccaggaguacaagauccuccucgacgucaagacccgccucgagcaggagaucgccaccuaccgccgccuccucgagggcgaggacgcccaccucacccaguacaagaaggagcccgucaccacccgccagguccgcaccaucgucgaggagguccaggacggcaaggucaucuccucccgcgagcagguccaccagaccacccgcuga

SEQ ID NO: 45191 - RNA, 1293 nt, Artificial Sequence
  derived and/or modified sequence opt2 from KRT18__Homo_sapiens__NP_000215
auguccuucaccacccgcuccaccuucuccaccaacuaccgcucccucggcuccguccaggcccccuccuacggcgcccgccccgucuccuccgccgccuccgucuacgccggcgccggcggcuccggcucccgcaucuccgucucccgcuccaccuccuuccgcggcggcaugggcuccggcggccucgccaccggcaucgccggcggccucgccggcaugggcggcauccagaacgagaaggagaccaugcagucccucaacgaccgccucgccuccuaccucgaccgcguccgcucccucgagaccgagaaccgccgccucgaguccaagauccgcgagcaccucgagaagaagggcccccagguccgcgacuggucccacuacuucaagaucaucgaggaccuccgcgcccagaucuucgccaacaccgucgacaacgcccgcaucguccuccagaucgacaacgcccgccucgccgccgacgacuuccgcgucaaguacgagaccgagcucgccaugcgccaguccgucgagaacgacauccacggccuccgcaaggucaucgacgacaccaacaucacccgccuccagcucgagaccgagaucgaggcccucaaggaggagcuccucuucaugaagaagaaccacgaggaggaggucaagggccuccaggcccagaucgccuccuccggccucaccgucgaggucgacgcccccaagucccaggaccucgccaagaucauggccgacauccgcgcccaguacgacgagcucgcccgcaagaaccgcgaggagcucgacaaguacuggucccagcagaucgaggaguccaccaccgucgucaccacccaguccgccgaggucggcgccgccgagaccacccucaccgagcuccgccgcaccguccagucccucgagaucgaccucgacuccaugcgcaaccucaaggccucccucgagaacucccuccgcgaggucgaggcccgcuacgcccuccagauggagcagcucaacggcauccuccuccaccucgaguccgagcucgcccagacccgcgccgagggccagcgccaggcccaggaguacgaggcccuccucaacaucaaggucaagcucgaggccgagaucgccaccuaccgccgccuccucgaggacggcgaggacuucaaccucggcgacgcccucgacuccuccaacuccaugcagaccauccagaagaccaccacccgccgcaucgucgacggcaaggucgucuccgagaccaacgacaccaagguccuccgccacuga

SEQ ID NO: 45192 - RNA, 1203 nt, Artificial Sequence
  derived and/or modified sequence opt2 from KRT19__Homo_sapiens__NP_002267
augaccuccuacuccuaccgccaguccuccgccaccuccuccuucggcggccucggcggcggcuccguccgcuucggccccggcgucgccuuccgcgcccccuccauccacggcggcuccggcggccgcggcgucuccgucuccuccgcccgcuucgucuccuccuccuccuccggcgccuacggcggcggcuacggcggcguccucaccgccuccgacggccuccucgccggcaacgagaagcucaccaugcagaaccucaacgaccgccucgccuccuaccucgacaagguccgcgcccucgaggccgccaacggcgagcucgaggucaagauccgcgacugguaccagaagcagggccccggccccucccgcgacuacucccacuacuacaccaccauccaggaccuccgcgacaagauccucggcgccaccaucgagaacucccgcaucguccuccagaucgacaacgcccgccucgccgccgacgacuuccgcaccaaguucgagaccgagcaggcccuccgcauguccgucgaggccgacaucaacggccuccgccgcguccucgacgagcucacccucgcccgcaccgaccucgagaugcagaucgagggccucaaggaggagcucgccuaccucaagaagaaccacgaggaggagaucuccacccuccgcggccaggucggcggccaggucuccgucgaggucgacuccgcccccggcaccgaccucgccaagauccucuccgacaugcgcucccaguacgaggucauggccgagcagaaccgcaaggacgccgaggccugguucaccucccgcaccgaggagcucaaccgcgaggucgccggccacaccgagcagcuccagaugucccgcuccgaggucaccgaccuccgccgcacccuccagggccucgagaucgagcuccagucccagcucuccaugaaggccgcccucgaggacacccucgccgagaccgaggcccgcuucggcgcccagcucgcccacauccaggcccucaucuccggcaucgaggcccagcucggcgacguccgcgccgacuccgagcgccagaaccaggaguaccagcgccucauggacaucaagucccgccucgagcaggagaucgccaccuaccgcucccuccucgagggccaggaggaccacuacaacaaccucuccgccuccaagguccucuga

SEQ ID NO: 45193 - RNA, 1935 nt, Artificial Sequence
  derived and/or modified sequence opt2 from KRT1__Homo_sapiens__NP_006112
augucccgccaguucuccucccgcuccggcuaccgcuccggcggcggcuucuccuccggcuccgccggcaucaucaacuaccagcgccgcaccaccuccuccuccacccgccgcuccggcggcggcggcggccgcuucuccuccugcggcggcggcggcggcuccuucggcgccggcggcggcuucggcucccgcucccucgucaaccucggcggcuccaaguccaucuccaucuccgucgcccgcggcggcggccgcggcuccggcuucggcggcggcuacggcggcggcggcuucggcggcggcggcuucggcggcggcggcuucggcggcggcggcaucggcggcggcggcuucggcggcuucggcuccggcggcggcggcuucggcggcggcggcuucggcggcggcggcuacggcggcggcuacggccccgucugcccccccggcggcauccaggaggucaccaucaaccagucccuccuccagccccucaacgucgagaucgaccccgagauccagaaggucaagucccgcgagcgcgagcagaucaagucccucaacaaccaguucgccuccuucaucgacaagguccgcuuccucgagcagcagaaccagguccuccagaccaagugggagcuccuccagcaggucgacaccuccacccgcacccacaaccucgagcccuacuucgaguccuucaucaacaaccuccgccgccgcgucgaccagcucaaguccgaccagucccgccucgacuccgagcucaagaacaugcaggacauggucgaggacuaccgcaacaaguacgaggacgagaucaacaagcgcaccaacgccgagaacgaguucgucaccaucaagaaggacgucgacggcgccuacaugaccaaggucgaccuccaggccaagcucgacaaccuccagcaggagaucgacuuccucaccgcccucuaccaggccgagcucucccagaugcagacccagaucuccgagaccaacgucauccucuccauggacaacaaccgcucccucgaccucgacuccaucaucgccgaggucaaggcccaguacgaggacaucgcccagaaguccaaggccgaggccgagucccucuaccaguccaaguacgaggagcuccagaucaccgccggccgccacggcgacuccguccgcaacuccaagaucgagaucuccgagcucaaccgcgucauccagcgccuccgcuccgagaucgacaacgucaagaagcagaucuccaaccuccagcaguccaucuccgacgccgagcagcgcggcgagaacgcccucaaggacgccaagaacaagcucaacgaccucgaggacgcccuccagcaggccaaggaggaccucgcccgccuccuccgcgacuaccaggagcucaugaacaccaagcucgcccucgaccucgagaucgccaccuaccgcacccuccucgagggcgaggagucccgcauguccggcgagugcgcccccaacgucuccgucuccgucuccaccucccacaccaccaucuccggcggcggcucccgcggcggcggcggcggcggcuacggcuccggcggcuccuccuacggcuccggcggcggcuccuacggcuccggcggcggcggcggcggcggccgcggcuccuacggcuccggcggcuccuccuacggcuccggcggcggcuccuacggcuccggcggcggcggcggcggccacggcuccuacggcuccggcuccuccuccggcggcuaccgcggcggcuccggcggcggcggcggcggcuccuccggcggccgcggcuccggcggcggcuccuccggcggcuccaucggcggccgcggcuccuccuccggcggcgucaaguccuccggcggcuccuccuccgucaaguucgucuccaccaccuacuccggcgucacccgcuga

SEQ ID NO: 45194 - RNA, 1275 nt, Artificial Sequence
  derived and/or modified sequence opt2 from KRT20__Homo_sapiens__NP_061883
auggacuucucccgccgcuccuuccaccgcucccucuccuccucccuccaggcccccgucgucuccaccgucggcaugcagcgccucggcaccacccccuccgucuacggcggcgccggcggccgcggcauccgcaucuccaacucccgccacaccgucaacuacggcuccgaccucaccggcggcggcgaccucuucgucggcaacgagaagauggccaugcagaaccucaacgaccgccucgccuccuaccucgagaagguccgcacccucgagcaguccaacuccaagcucgagguccagaucaagcagugguacgagaccaacgccccccgcgccggccgcgacuacuccgccuacuaccgccagaucgaggagcuccgcucccagaucaaggacgcccagcuccagaacgcccgcugcguccuccagaucgacaacgccaagcucgccgccgaggacuuccgccucaaguacgagaccgagcgcggcauccgccucaccgucgaggccgaccuccagggccucaacaaggucuucgacgaccucacccuccacaagaccgaccucgagauccagaucgaggagcucaacaaggaccucgcccuccucaagaaggagcaccaggaggaggucgacggccuccacaagcaccucggcaacaccgucaacgucgaggucgacgccgcccccggccucaaccucggcgucaucaugaacgagaugcgccagaaguacgaggucauggcccagaagaaccuccaggaggccaaggagcaguucgagcgccagaccgccguccuccagcagcaggucaccgucaacaccgaggagcucaagggcaccgagguccagcucaccgagcuccgccgcaccucccagucccucgagaucgagcuccagucccaccucuccaugaaggagucccucgagcacacccucgaggagaccaaggcccgcuacuccucccagcucgccaaccuccagucccuccucuccucccucgaggcccagcucaugcagauccgcuccaacauggagcgccagaacaacgaguaccacauccuccucgacaucaagacccgccucgagcaggagaucgccaccuaccgccgccuccucgagggcgaggacgucaagaccaccgaguaccagcucuccacccucgaggagcgcgacaucaagaagacccgcaagaucaagaccgucguccaggaggucgucgacggcaaggucgucuccuccgaggucaaggaggucgaggagaacaucuga

SEQ ID NO: 45195 - RNA, 1269 nt, Artificial Sequence
  derived and/or modified sequence opt2 from KRT23__Homo_sapiens__NP_056330
augaacuccggccacuccuucucccagacccccuccgccuccuuccacggcgccggcggcggcuggggccgcccccgcuccuucccccgcgcccccaccguccacggcggcgccggcggcgcccgcaucucccucuccuucaccacccgcuccugccccccccccggcggcuccuggggcuccggccgcuccuccccccuccucggcggcaacggcaaggccaccaugcagaaccucaacgaccgccucgccuccuaccucgagaagguccgcgcccucgaggaggccaacaugaagcucgagucccgcauccucaaguggcaccagcagcgcgaccccggcuccaagaaggacuacucccaguacgaggagaacaucacccaccuccaggagcagaucgucgacggcaagaugaccaacgcccagaucauccuccucaucgacaacgcccgcauggccgucgacgacuucaaccucaaguacgagaacgagcacuccuucaagaaggaccucgagaucgaggucgagggccuccgccgcacccucgacaaccucaccaucgucaccaccgaccucgagcaggaggucgagggcaugcgcaaggagcucauccucaugaagaagcaccacgagcaggagauggagaagcaccacguccccuccgacuucaacgucaacgucaaggucgacaccggcccccgcgaggaccucaucaagguccucgaggacaugcgccaggaguacgagcucaucaucaagaagaagcaccgcgaccucgacaccugguacaaggagcaguccgccgccaugucccaggaggccgccucccccgccaccguccagucccgccagggcgacauccacgagcucaagcgcaccuuccaggcccucgagaucgaccuccagacccaguacuccaccaaguccgcccucgagaacaugcucuccgagacccagucccgcuacuccugcaagcuccaggacaugcaggagaucaucucccacuacgaggaggagcucacccagcuccgccacgagcucgagcgccagaacaacgaguaccagguccuccucggcaucaagacccaccucgagaaggagaucaccaccuaccgccgccuccucgagggcgaguccgagggcacccgcgaggaguccaaguccuccaugaaggucuccgccacccccaagaucaaggccaucacccaggagaccaucaacggccgccucguccucugccaggucaacgagauccagaagcacgccuga

SEQ ID NO: 45196 - RNA, 1920 nt, Artificial Sequence
  derived and/or modified sequence opt2 from KRT2__Homo_sapiens__NP_000414
auguccugccagaucuccugcaagucccgcggccgcggcggcggcggcggcggcuuccgcggcuucuccuccggcuccgccgucgucuccggcggcucccgccgcuccaccuccuccuucuccugccucucccgccacggcggcggcggcggcggcuucggcggcggcggcuucggcucccgcucccucgucggccucggcggcaccaaguccaucuccaucuccgucgccggcggcggcggcggcuucggcgccgccggcggcuucggcggccgcggcggcggcuucggcggcggcuccuccuucggcggcggcuccggcuucuccggcggcggcuucggcggcggcggcuucggcggcggccgcuucggcggcuucggcggccccggcggcgucggcggccucggcggccccggcggcuucggccccggcggcuaccccggcggcauccacgaggucuccgucaaccagucccuccuccagccccucaacgucaaggucgaccccgagauccagaacgucaaggcccaggagcgcgagcagaucaagacccucaacaacaaguucgccuccuucaucgacaagguccgcuuccucgagcagcagaaccagguccuccagaccaagugggagcuccuccagcagaugaacgucggcacccgccccaucaaccucgagcccaucuuccagggcuacaucgacucccucaagcgcuaccucgacggccucaccgccgagcgcaccucccagaacuccgagcucaacaacaugcaggaccucgucgaggacuacaagaagaaguacgaggacgagaucaacaagcgcaccgccgccgagaacgacuucgucacccucaagaaggacgucgacaacgccuacaugaucaaggucgagcuccaguccaaggucgaccuccucaaccaggagaucgaguuccucaagguccucuacgacgccgagaucucccagauccaccaguccgucaccgacaccaacgucauccucuccauggacaacucccgcaaccucgaccucgacuccaucaucgccgaggucaaggcccaguacgaggagaucgcccagcgcuccaaggaggaggccgaggcccucuaccacuccaaguacgaggagcuccaggucaccgucggccgccacggcgacucccucaaggagaucaagaucgagaucuccgagcucaaccgcgucauccagcgccuccagggcgagaucgcccacgucaagaagcagugcaagaacguccaggacgccaucgccgacgccgagcagcgcggcgagcacgcccucaaggacgcccgcaacaagcucaacgaccucgaggaggcccuccagcaggccaaggaggaccucgcccgccuccuccgcgacuaccaggagcucaugaacgucaagcucgcccucgacgucgagaucgccaccuaccgcaagcuccucgagggcgaggagugccgcauguccggcgaccucuccuccaacgucaccgucuccgucaccuccuccaccaucuccuccaacgucgccuccaaggccgccuucggcggcuccggcggccgcggcuccuccuccggcggcggcuacuccuccggcuccuccuccuacggcuccggcggccgccaguccggcucccgcggcggcuccggcggcggcggcuccaucuccggcggcggcuacggcuccggcggcggcuccggcggccgcuacggcuccggcggcggcuccaagggcggcuccaucuccggcggcggcuacggcuccggcggcggcaagcacuccuccggcggcggcucccgcggcggcuccuccuccggcggcggcuacggcuccggcggcggcggcuccuccuccgucaagggcuccuccggcgaggccuucggcuccuccgucaccuucuccuuccgcuga

SEQ ID NO: 45197 - RNA, 1251 nt, Artificial Sequence
  derived and/or modified sequence opt2 from KRT31__Homo_sapiens__NP_002268
augcccuacaacuucugccuccccucccucuccugccgcaccuccugcuccucccgccccugcgucccccccuccugccacuccugcacccuccccggcgccugcaacauccccgccaacgucuccaacugcaacugguucugcgagggcuccuucaacggcuccgagaaggagaccaugcaguuccucaacgaccgccucgccuccuaccucgagaagguccgccagcucgagcgcgacaacgccgagcucgagaaccucauccgcgagcgcucccagcagcaggagccccuccucugccccuccuaccaguccuacuucaagaccaucgaggagcuccagcagaagauccucugcaccaaguccgagaacgcccgccucgucguccagaucgacaacgccaagcucgccgccgacgacuuccgcaccaaguaccagaccgagcucucccuccgccagcucgucgaguccgacaucaacggccuccgccgcauccucgacgagcucacccucugcaaguccgaccucgaggcccaggucgagucccucaaggaggagcuccucugccucaaguccaaccacgagcaggaggucaacacccuccgcugccagcucggcgaccgccucaacgucgaggucgacgccgcccccaccgucgaccucaaccgcguccucaacgagacccgcucccaguacgaggcccucgucgagaccaaccgccgcgaggucgagcagugguucaccacccagaccgaggagcucaacaagcaggucgucuccuccuccgagcagcuccaguccuaccaggccgagaucaucgagcuccgccgcaccgucaacgcccucgagaucgagcuccaggcccagcacaaccuccgcgacucccucgagaacacccucaccgaguccgaggcccgcuacuccucccagcucucccagguccagucccucaucaccaacgucgagucccagcucgccgagauccgcuccgaccucgagcgccagaaccaggaguaccagguccuccucgacguccgcgcccgccucgagugcgagaucaacaccuaccgcucccuccucgaguccgaggacugcaaccuccccuccaaccccugcgccaccaccaacgccugcuccaagcccaucggccccugccucuccaaccccugcaccuccugcgucccccccgcccccugcacccccugcgccccccgcccccgcugcggccccugcaacuccuucguccgcuga

SEQ ID NO: 45198 - RNA, 1347 nt, Artificial Sequence
  derived and/or modified sequence opt2 from KRT32__Homo_sapiens__NP_002269
augaccuccuccugcugcgucaccaacaaccuccaggccucccucaaguccugcccccgccccgccuccgucugcuccuccggcgucaacugccgccccgagcucugccucggcuacgucugccagcccauggccugccuccccuccgucugccuccccaccaccuuccgccccgccuccugccucuccaagaccuaccucuccuccuccugccaggccgccuccggcaucuccggcuccaugggccccggcuccugguacuccgagggcgccuucaacggcaacgagaaggagaccaugcaguuccucaacgaccgccucgccuccuaccucacccgcguccgccagcucgagcaggagaacgccgagcucgagucccgcauccaggaggccucccacucccagguccucaccaugacccccgacuaccagucccacuuccgcaccaucgaggagcuccagcagaagauccucugcaccaaggccgagaacgcccgcauggucgucaacaucgacaacgccaagcucgccgccgacgacuuccgcgccaaguacgaggccgagcucgccaugcgccagcucgucgaggccgacaucaacggccuccgccgcauccucgacgaccucacccucugcaaggccgaccucgaggcccaggucgagucccucaaggaggagcucaugugccucaagaagaaccacgaggaggaggucggcucccuccgcugccagcucggcgaccgccucaacaucgaggucgacgccgccccccccgucgaccucacccgcguccucgaggagaugcgcugccaguacgaggccauggucgaggccaaccgccgcgacgucgaggagugguucaacaugcagauggaggagcucaaccagcaggucgccaccuccuccgagcagcuccagaacuaccaguccgacaucaucgaccuccgccgcaccgucaacacccucgagaucgagcuccaggcccagcacucccuccgcgacucccucgagaacacccucaccgaguccgaggcccgcuacuccucccagcucgcccagaugcagugcaugaucaccaacgucgaggcccagcucgccgagauccgcgccgaccucgagcgccagaaccaggaguaccagguccuccucgacguccgcgcccgccucgagggcgagaucaacaccuaccgcucccuccucgagaacgaggacugcaagcuccccugcaaccccugcuccacccccuccugcaccaccugcguccccucccccugcgucccccgcaccgucugcgucccccgcaccgucggcaugcccugcucccccugcccccagggccgcuacuga

SEQ ID NO: 45199 - RNA, 1311 nt, Artificial Sequence
  derived and/or modified sequence opt2 from KRT34__Homo_sapiens__NP_066293
augcucuacgccaagcccccccccaccaucaacggcaucaagggccuccagcgcaaggagcgccucaagcccgcccacauccaccuccagcagcucaccugcuucuccaucaccugcuccuccaccauguccuacuccugcugccuccccucccucggcugccgcaccuccugcuccucccgccccugcgucccccccuccugccacggcuacacccuccccggcgccugcaacauccccgccaacgucuccaacugcaacugguucugcgagggcuccuucaacggcuccgagaaggagaccaugcaguuccucaacgaccgccucgccuccuaccucgagaagguccgccagcucgagcgcgacaacgccgagcucgagaagcucauccaggagcgcucccagcagcaggagccccuccucugccccuccuaccaguccuacuucaagaccaucgaggagcuccagcagaagauccucugcgccaaggccgagaacgcccgccucgucgucaacaucgacaacgccaagcucgccuccgacgacuuccgcuccaaguaccagaccgagcagucccuccgccuccucgucgaguccgacaucaacuccauccgccgcauccucgacgagcucacccucugcaaguccgaccucgagucccaggucgagucccuccgcgaggagcucaucugccucaagaagaaccacgaggaggaggucaacacccuccgcucccagcucggcgaccgccucaacgucgaggucgacaccgcccccaccgucgaccucaaccagguccucaacgagacccgcucccaguacgaggcccucgucgagaucaaccgccgcgaggucgagcagugguucgccacccagaccgaggagcucaacaagcaggucgucuccuccuccgagcagcuccaguccugccaggccgagaucaucgagcuccgccgcaccgucaacgcccucgagaucgagcuccaggcccagcacaaccuccgcgacucccucgagaacacccucaccgaguccgaggcccacuacuccucccagcucucccagguccagucccucaucaccaacgucgagucccagcucgccgagauccgcugcgaccucgagcgccagaaccaggaguaccagguccuccucgacguccgcgcccgccucgagugcgagaucaacaccuaccgcucccuccucgaguccgaggacugcaagcuccccugcaaccccugcgccaccaccaacgccuccggcaacuccugcggccccugcggcaccucccagaagggcugcugcaacuga

SEQ ID NO: 45200 - RNA, 1368 nt, Artificial Sequence
  derived and/or modified sequence opt2 from KRT35__Homo_sapiens__NP_002271
auggccuccaagugccucaaggccggcuucuccuccggcucccucaagucccccggcggcgccuccggcggcuccacccgcgucuccgccauguacuccuccuccuccugcaagcuccccucccucucccccgucgcccgcuccuucuccgccugcuccgucggccucggccgcuccuccuaccgcgccaccuccugccuccccgcccucugccuccccgccggcggcuucgccaccuccuacuccggcggcggcggcugguucggcgagggcauccucaccggcaacgagaaggagaccaugcagucccucaacgaccgccucgccggcuaccucgagaagguccgccagcucgagcaggagaacgccucccucgagucccgcauccgcgaguggugcgagcagcagguccccuacaugugccccgacuaccaguccuacuuccgcaccaucgaggagcuccagaagaagacccucugcuccaaggccgagaacgcccgccucgucgucgagaucgacaacgccaagcucgccgccgacgacuuccgcaccaaguacgagaccgaggucucccuccgccagcucgucgaguccgacaucaacggccuccgccgcauccucgacgaccucacccucugcaaguccgaccucgaggcccaggucgagucccucaaggaggagcuccucugccucaagaagaaccacgaggaggaggucaacucccuccgcugccagcucggcgaccgccucaacgucgaggucgacgccgccccccccgucgaccucaaccgcguccucgaggagaugcgcugccaguacgagacccucgucgagaacaaccgccgcgacgccgaggacuggcucgacacccaguccgaggagcucaaccagcaggucgucuccuccuccgagcagcuccaguccugccaggccgagaucaucgagcuccgccgcaccgucaacgcccucgagaucgagcuccaggcccagcacuccaugcgcgacgcccucgaguccacccucgccgagaccgaggcccgcuacuccucccagcucgcccagaugcagugcaugaucaccaacgucgaggcccagcucgccgagauccgcgccgaccucgagcgccagaaccaggaguaccagguccuccucgacguccgcgcccgccucgagugcgagaucaacaccuaccgcggccuccucgaguccgaggacuccaagcuccccugcaaccccugcgcccccgacuacucccccuccaaguccugccuccccugccuccccgccgccuccugcggccccuccgccgcccgcaccaacugcuccccccgccccaucugcguccccugccccggcggccgcuucuga

SEQ ID NO: 45201 - RNA, 1887 nt, Artificial Sequence
  derived and/or modified sequence opt2 from KRT3__Homo_sapiens__NP_476429
augucccgccaggccuccaagaccuccggcggcggcucccagggcuucuccggccgcuccgccgucgucuccggcuccucccgcauguccugcgucgcccacuccggcggcgccggcggcggcgccuacggcuuccgcuccggcgccggcggcuucggcucccgcucccucuacaaccucggcggcaacaaguccaucuccaucuccgucgccgccggcggcucccgcgccggcggcuucggcggcggccgcuccuccugcgccuucgccggcggcuacggcggcggcuucggcuccggcuacggcggcggcuucggcggcggcuucggcggcggccgcggcaugggcggcggcuucggcggcgccggcggcuucggcggcgccggcggcuucggcggcgccggcggcuucggcggccccggcggcuucggcggcuccggcggcuucggcggccccggcucccucggcucccccggcggcuucggccccggcggcuuccccggcggcauccaggaggucaccaucaaccagucccuccuccagccccucaacgucgagaucgacccccagaucggccaggucaaggcccaggagcgcgagcagaucaagacccucaacaacaaguucgccuccuucaucgacaagguccgcuuccucgagcagcagaacaagguccucgagaccaaguggaaccuccuccagcagcagggcaccuccuccaucuccggcaccaacaaccucgagccccucuucgagaaccacaucaacuaccuccgcuccuaccucgacaacauccucggcgagcgcggccgccucgacuccgagcucaagaacauggaggaccucgucgaggacuucaagaagaaguacgaggacgagaucaacaagcgcaccgccgccgagaacgaguucgucacccucaagaaggacgucgacuccgccuacaugaacaaggucgagcuccaggccaaggucgacgcccucaucgacgagaucgacuuccuccgcacccucuacgacgccgagcucucccagaugcagucccacaucuccgacaccuccgucguccucuccauggacaacaaccgcucccucgaccucgacuccaucaucgccgagguccgcgcccaguacgaggacaucgcccagcgcuccaaggccgaggccgaggcccucuaccagaccaagcucggcgagcuccagaccaccgccggccgccacggcgacgaccuccgcaacaccaaguccgagaucaucgagcucaaccgcaugauccagcgccuccgcgccgagaucgagggcgucaagaagcagaacgccaaccuccagaccgccaucgccgaggccgagcagcacggcgagauggcccucaaggacgccaacgccaagcuccaggagcuccaggccgcccuccagcaggccaaggacgaccucgcccgccuccuccgcgacuaccaggagcucaugaacgucaagcucgcccucgacgucgagaucgccaccuaccgcaagcuccucgagggcgaggaguaccgcauguccggcgagugccccuccgccgucuccaucuccgucgucuccuccuccaccaccuccgccuccgccggcggcuacggcggcggcuacggcggcggcaugggcggcggccucggcggcggcuucuccgccggcggcggcuccggcuccggcuucggccgcggcggcggcggcggcaucggcggcggcuucggcggcggcuccuccggcuucuccggcggcuccggcuucggcuccaucuccggcgcccgcuacggcgucuccggcggcggcuucuccuccgccuccaaccgcggcggcuccaucaaguucucccaguccucccaguccucccagcgcuacucccgcuga

SEQ ID NO: 45202 - RNA, 1563 nt, Artificial Sequence
  derived and/or modified sequence opt2 from KRT4__Homo_sapiens__NP_002263
augaucgcccgccagcagugcguccgcggcggcccccgcggcuucuccugcggcuccgccaucgucggcggcggcaagcgcggcgccuucuccuccgucuccauguccggcggcgccggccgcugcuccuccggcggcuucggcucccgcucccucuacaaccuccgcggcaacaaguccaucuccauguccgucgccggcucccgccagggcgccugcuucggcggcgccggcggcuucggcaccggcggcuucggcggcggcuucggcggcuccuucuccggcaagggcggccccggcuuccccgucugccccgccggcggcauccaggaggucaccaucaaccagucccuccucaccccccuccacgucgagaucgaccccgagauccagaagguccgcaccgaggagcgcgagcagaucaagcuccucaacaacaaguucgccuccuucaucgacaagguccaguuccucgagcagcagaacaagguccucgagaccaaguggaaccuccuccagcagcagaccaccaccaccuccuccaagaaccucgagccccucuucgagaccuaccucuccguccuccgcaagcagcucgacacccucggcaacgacaagggccgccuccaguccgagcucaagaccaugcaggacuccgucgaggacuucaagaccaaguacgaggaggagaucaacaagcgcaccgccgccgagaacgacuucgucguccucaagaaggacgucgacgccgccuaccucaacaaggucgagcucgaggccaaggucgacucccucaacgacgagaucaacuuccucaagguccucuacgacgccgagcucucccagaugcagacccacgucuccgacaccuccgucguccucuccauggacaacaaccgcaaccucgaccucgacuccaucaucgccgagguccgcgcccaguacgaggagaucgcccagcgcuccaaggccgaggccgaggcccucuaccagaccaagguccagcagcuccagaucuccgucgaccagcacggcgacaaccucaagaacaccaaguccgagaucgccgagcucaaccgcaugauccagcgccuccgcgccgagaucgagaacaucaagaagcagugccagacccuccaggucuccgucgccgacgccgagcagcgcggcgagaacgcccucaaggacgcccacuccaagcgcgucgagcucgaggccgcccuccagcaggccaaggaggagcucgcccgcaugcuccgcgaguaccaggagcucauguccgucaagcucgcccucgacaucgagaucgccaccuaccgcaagcuccucgagggcgaggaguaccgcauguccggcgagugccaguccgccgucuccaucuccgucgucuccggcuccaccuccaccggcggcaucuccggcggccucggcuccggcuccggcuucggccucuccuccggcuucggcuccggcuccggcuccggcuucggcuucggcggcuccgucuccggcuccuccuccuccaagaucaucuccaccaccacccucaacaagcgccgcuga

SEQ ID NO: 45203 - RNA, 1773 nt, Artificial Sequence
  derived and/or modified sequence opt2 from KRT5__Homo_sapiens__NP_000415
augucccgccaguccuccgucuccuuccgcuccggcggcucccgcuccuucuccaccgccuccgccaucacccccuccgucucccgcaccuccuucaccuccgucucccgcuccggcggcggcggcggcggcggcuucggccgcgucucccucgccggcgccugcggcgucggcggcuacggcucccgcucccucuacaaccucggcggcuccaagcgcaucuccaucuccaccuccggcggcuccuuccgcaaccgcuucggcgccggcgccggcggcggcuacggcuucggcggcggcgccggcuccggcuucggcuucggcggcggcgccggcggcggcuucggccucggcggcggcgccggcuucggcggcggcuucggcggccccggcuuccccgucugcccccccggcggcauccaggaggucaccgucaaccagucccuccucaccccccucaaccuccagaucgaccccuccauccagcgcguccgcaccgaggagcgcgagcagaucaagacccucaacaacaaguucgccuccuucaucgacaagguccgcuuccucgagcagcagaacaagguccucgacaccaaguggacccuccuccaggagcagggcaccaagaccguccgccagaaccucgagccccucuucgagcaguacaucaacaaccuccgccgccagcucgacuccaucgucggcgagcgcggccgccucgacuccgagcuccgcaacaugcaggaccucgucgaggacuucaagaacaaguacgaggacgagaucaacaagcgcaccaccgccgagaacgaguucgucaugcucaagaaggacgucgacgccgccuacaugaacaaggucgagcucgaggccaaggucgacgcccucauggacgagaucaacuucaugaagauguucuucgacgccgagcucucccagaugcagacccacgucuccgacaccuccgucguccucuccauggacaacaaccgcaaccucgaccucgacuccaucaucgccgaggucaaggcccaguacgaggagaucgccaaccgcucccgcaccgaggccgaguccugguaccagaccaaguacgaggagcuccagcagaccgccggccgccacggcgacgaccuccgcaacaccaagcacgagaucuccgagaugaaccgcaugauccagcgccuccgcgccgagaucgacaacgucaagaagcagugcgccaaccuccagaacgccaucgccgacgccgagcagcgcggcgagcucgcccucaaggacgcccgcaacaagcucgccgagcucgaggaggcccuccagaaggccaagcaggacauggcccgccuccuccgcgaguaccaggagcucaugaacaccaagcucgcccucgacgucgagaucgccaccuaccgcaagcuccucgagggcgaggagugccgccucuccggcgagggcgucggccccgucaacaucuccgucgucaccuccuccgucuccuccggcuacggcuccggcuccggcuacggcggcggccucggcggcggccucggcggcggccucggcggcggccucgccggcggcuccuccggcuccuacuacuccuccuccuccggcggcgucggccucggcggcggccucuccgucggcggcuccggcuucuccgccuccuccggccgcggccucggcgucggcuucggcuccggcggcggcuccuccuccuccgucaaguucgucuccaccaccuccuccucccgcaaguccuucaaguccuga

SEQ ID NO: 45204 - RNA, 1695 nt, Artificial Sequence
  derived and/or modified sequence opt2 from KRT6A__Homo_sapiens__NP_005545
auggccuccaccuccaccaccauccgcucccacuccuccucccgccgcggcuucuccgccaacuccgcccgccuccccggcgucucccgcuccggcuucuccuccgucuccgucucccgcucccgcggcuccggcggccucggcggcgccugcggcggcgccggcuucggcucccgcucccucuacggccucggcggcuccaagcgcaucuccaucggcggcggcuccugcgccaucuccggcggcuacggcucccgcgccggcggcuccuacggcuucggcggcgccggcuccggcuucggcuucggcggcggcgccggcaucggcuucggccucggcggcggcgccggccucgccggcggcuucggcggccccggcuuccccgucugcccccccggcggcauccaggaggucaccgucaaccagucccuccucaccccccucaaccuccagaucgaccccaccauccagcgcguccgcgccgaggagcgcgagcagaucaagacccucaacaacaaguucgccuccuucaucgacaagguccgcuuccucgagcagcagaacaagguccucgagaccaaguggacccuccuccaggagcagggcaccaagaccguccgccagaaccucgagccccucuucgagcaguacaucaacaaccuccgccgccagcucgacuccaucgucggcgagcgcggccgccucgacuccgagcuccgcggcaugcaggaccucgucgaggacuucaagaacaaguacgaggacgagaucaacaagcgcaccgccgccgagaacgaguucgucacccucaagaaggacgucgacgccgccuacaugaacaaggucgagcuccaggccaaggccgacacccucaccgacgagaucaacuuccuccgcgcccucuacgacgccgagcucucccagaugcagacccacaucuccgacaccuccgucguccucuccauggacaacaaccgcaaccucgaccucgacuccaucaucgccgaggucaaggcccaguacgaggagaucgcccagcgcucccgcgccgaggccgaguccugguaccagaccaaguacgaggagcuccaggucaccgccggccgccacggcgacgaccuccgcaacaccaagcaggagaucgccgagaucaaccgcaugauccagcgccuccgcuccgagaucgaccacgucaagaagcagugcgccaaccuccaggccgccaucgccgacgccgagcagcgcggcgagauggcccucaaggacgccaagaacaagcucgagggccucgaggacgcccuccagaaggccaagcaggaccucgcccgccuccucaaggaguaccaggagcucaugaacgucaagcucgcccucgacgucgagaucgccaccuaccgcaagcuccucgagggcgaggagugccgccucaacggcgagggcgucggccaggucaacaucuccgucguccaguccaccgucuccuccggcuacggcggcgccuccggcgucggcuccggccucggccucggcggcggcuccuccuacuccuacggcuccggccucggcgucggcggcggcuucuccuccuccuccggccgcgccaucggcggcggccucuccuccgucggcggcggcuccuccaccaucaaguacaccaccaccuccuccuccucccgcaaguccuacaagcacuga

SEQ ID NO: 45205 - RNA, 1695 nt, Artificial Sequence
  derived and/or modified sequence opt2 from KRT6B__Homo_sapiens__NP_005546
auggccuccaccuccaccaccauccgcucccacuccuccucccgccgcggcuucuccgccaacuccgcccgccuccccggcgucucccgcuccggcuucuccuccaucuccgucucccgcucccgcggcuccggcggccucggcggcgccugcggcggcgccggcuucggcucccgcucccucuacggccucggcggcuccaagcgcaucuccaucggcggcggcuccugcgccaucuccggcggcuacggcucccgcgccggcggcuccuacggcuucggcggcgccggcuccggcuucggcuucggcggcggcgccggcaucggcuucggccucggcggcggcgccggccucgccggcggcuucggcggccccggcuuccccgucugcccccccggcggcauccaggaggucaccgucaaccagucccuccucaccccccucaaccuccagaucgaccccgccauccagcgcguccgcgccgaggagcgcgagcagaucaagacccucaacaacaaguucgccuccuucaucgacaagguccgcuuccucgagcagcagaacaagguccucgacaccaaguggacccuccuccaggagcagggcaccaagaccguccgccagaaccucgagccccucuucgagcaguacaucaacaaccuccgccgccagcucgacaacaucgucggcgagcgcggccgccucgacuccgagcuccgcaacaugcaggaccucgucgaggaccucaagaacaaguacgaggacgagaucaacaagcgcaccgccgccgagaacgaguucgucacccucaagaaggacgucgacgccgccuacaugaacaaggucgagcuccaggccaaggccgacacccucaccgacgagaucaacuuccuccgcgcccucuacgacgccgagcucucccagaugcagacccacaucuccgacaccuccgucguccucuccauggacaacaaccgcaaccucgaccucgacuccaucaucgccgaggucaaggcccaguacgaggagaucgcccagcgcucccgcgccgaggccgaguccugguaccagaccaaguacgaggagcuccagaucaccgccggccgccacggcgacgaccuccgcaacaccaagcaggagaucgccgagaucaaccgcaugauccagcgccuccgcuccgagaucgaccacgucaagaagcagugcgccaaccuccaggccgccaucgccgacgccgagcagcgcggcgagauggcccucaaggacgccaagaacaagcucgagggccucgaggacgcccuccagaaggccaagcaggaccucgcccgccuccucaaggaguaccaggagcucaugaacgucaagcucgcccucgacgucgagaucgccaccuaccgcaagcuccucgagggcgaggagugccgccucaacggcgagggcgucggccaggucaacaucuccgucguccaguccaccgucuccuccggcuacggcggcgccuccggcgucggcuccggccucggccucggcggcggcuccuccuacuccuacggcuccggccucggcgucggcggcggcuucuccuccuccuccggccgcgccaccggcggcggccucuccuccgucggcggcggcuccuccaccaucaaguacaccaccaccuccuccuccucccgcaaguccuacaagcacuga

SEQ ID NO: 45206 - RNA, 1695 nt, Artificial Sequence
  derived and/or modified sequence opt2 from KRT6C__Homo_sapiens__NP_775109
auggccuccaccuccaccaccauccgcucccacuccuccucccgccgcggcuucuccgccaacuccgcccgccuccccggcgucucccgcuccggcuucuccuccaucuccgucucccgcucccgcggcuccggcggccucggcggcgccugcggcggcgccggcuucggcucccgcucccucuacggccucggcggcuccaagcgcaucuccaucggcggcggcuccugcgccaucuccggcggcuacggcucccgcgccggcggcuccuacggcuucggcggcgccggcuccggcuucggcuucggcggcggcgccggcaucggcuucggccucggcggcggcgccggccucgccggcggcuucggcggccccggcuuccccgucugcccccccggcggcauccaggaggucaccgucaaccagucccuccucaccccccucaaccuccagaucgaccccgccauccagcgcguccgcgccgaggagcgcgagcagaucaagacccucaacaacaaguucgccuccuucaucgacaagguccgcuuccucgagcagcagaacaagguccucgacaccaaguggacccuccuccaggagcagggcaccaagaccguccgccagaaccucgagccccucuucgagcaguacaucaacaaccuccgccgccagcucgacuccaucgucggcgagcgcggccgccucgacuccgagcuccgcaacaugcaggaccucgucgaggaccucaagaacaaguacgaggacgagaucaacaagcgcaccgccgccgagaacgaguucgucacccucaagaaggacgucgacgccgccuacaugaacaaggucgagcuccaggccaaggccgacacccucaccgacgagaucaacuuccuccgcgcccucuacgacgccgagcucucccagaugcagacccacaucuccgacaccuccgucguccucuccauggacaacaaccgcaaccucgaccucgacuccaucaucgccgaggucaaggcccaguacgaggagaucgcccagcgcucccgcgccgaggccgaguccugguaccagaccaaguacgaggagcuccaggucaccgccggccgccacggcgacgaccuccgcaacaccaagcaggagaucgccgagaucaaccgcaugauccagcgccuccgcuccgagaucgaccacgucaagaagcagugcgccucccuccaggccgccaucgccgacgccgagcagcgcggcgagauggcccucaaggacgccaagaacaagcucgagggccucgaggacgcccuccagaaggccaagcaggaccucgcccgccuccucaaggaguaccaggagcucaugaacgucaagcucgcccucgacgucgagaucgccaccuaccgcaagcuccucgagggcgaggagugccgccucaacggcgagggcgucggccaggucaacgucuccgucguccaguccaccaucuccuccggcuacggcggcgccuccggcgucggcuccggccucggccucggcggcggcuccuccuacuccuacggcuccggccucggcaucggcggcggcuucuccuccuccuccggccgcgccaucggcggcggccucuccuccgucggcggcggcuccuccaccaucaaguacaccaccaccuccuccuccucccgcaaguccuacaagcacuga

SEQ ID NO: 45207 - RNA, 1572 nt, Artificial Sequence
  derived and/or modified sequence opt2 from KRT71__Homo_sapiens__NP_258259
augucccgccaguucaccugcaaguccggcgccgccgccaagggcggcuucuccggcugcuccgccguccucuccggcggcuccuccuccuccuuccgcgccggcuccaagggccucuccggcggcuucggcucccgcucccucuacucccucggcggcguccgcucccucaacgucgccuccggcuccggcaaguccggcggcuacggcuucggccgcggccgcgccuccggcuucgccggcuccauguucggcuccgucgcccucggccccgucugccccaccgucugcccccccggcggcauccaccaggucaccgucaacgagucccuccucgccccccucaacgucgagcucgaccccgagauccagaagguccgcgcccaggagcgcgagcagaucaaggcccucaacaacaaguucgccuccuucaucgacaagguccgcuuccucgagcagcagaaccagguccucgagaccaagugggagcuccuccagcagcucgaccucaacaacugcaagaacaaccucgagcccauccucgagggcuacaucuccaaccuccgcaagcagcucgagacccucuccggcgaccgcguccgccucgacuccgagcuccgcaacguccgcgacgucgucgaggacuacaagaagcgcuacgaggaggagaucaacaagcgcaccgccgccgagaacgaguucguccuccucaagaaggacgucgacgccgccuacgccaacaaggucgagcuccaggccaaggucgaguccauggaccaggagaucaaguucuuccgcugccucuucgaggccgagaucacccagauccagucccacaucuccgacauguccgucauccucuccauggacaacaaccgcaaccucgaccucgacuccaucaucgacgagguccgcacccaguacgaggagaucgcccucaaguccaaggccgaggccgaggcccucuaccagaccaaguuccaggagcuccagcucgccgccggccgccacggcgacgaccucaagaacaccaagaacgagaucuccgagcucacccgccucauccagcgcauccgcuccgagaucgagaacgucaagaagcaggccuccaaccucgagaccgccaucgccgacgccgagcagcgcggcgacaacgcccucaaggacgcccgcgccaagcucgacgagcucgagggcgcccuccaccaggccaaggaggagcucgcccgcaugcuccgcgaguaccaggagcucaugucccucaagcucgcccucgacauggagaucgccaccuaccgcaagcuccucgaguccgaggagugccgcauguccggcgaguuccccucccccgucuccaucuccaucaucuccuccaccuccggcggcuccgucuacggcuuccgccccuccauggucuccggcggcuacgucgccaacuccuccaacugcaucuccggcgucugcuccguccgcggcggcgagggccgcucccgcggcuccgccaacgacuacaaggacacccucggcaagggcuccucccucuccgcccccuccaagaagaccucccgcuga

SEQ ID NO: 45208 - RNA, 1410 nt, Artificial Sequence
  derived and/or modified sequence opt2 from KRT72__Homo_sapiens__NP_001139698
augucccgccagcucacccacuucccccgcggcgagcgccucggcuucuccggcugcuccgccguccucuccggcggcaucggcuccuccuccgccuccuuccgcgcccgcgucaagggcuccgccuccuucggcuccaagucccucuccugccucggcggcucccgcucccucgcccucuccgccgccgcccgccgcggcggcggccgccucggcggcuucgucggcaccgccuucggcuccgccggccucggccccaagugccccuccgucugcccccccggcggcaucccccaggucaccgucaacaagucccuccucgccccccucaacgucgagauggaccccgagauccagcgcguccgcgcccaggagcgcgagcagaucaaggcccucaacaacaaguucgccuccuucaucgacaagguccgcuuccucgagcagcagaaccagguccucgagaccaaguggaaccuccuccagcagcucgaccucaacaacugccgcaagaaccucgagcccaucuacgagggcuacaucuccaaccuccagaagcagcucgagaugcucuccggcgacggcguccgccucgacuccgagcuccgcaacaugcaggaccucgucgaggacuacaagaagcgcuacgaggucgagaucaaccgccgcaccgccgccgagaacgaguucgucguccucaagaaggacgucgacgccgccuacaugaacaaggucgagcuccaggccaaggucgacucccucaccgacgagaucaaguucuucaagugccucuacgagggcgagaucacccagauccagucccacaucuccgacaccuccaucguccucuccauggacaacaaccgcgaccucgaccucgacuccaucaucgccgagguccgcgcccaguacgaggagaucgcccucaaguccaaggccgaggccgagacccucuaccagaccaagugcgccgaccucgagaccgccaucgccgacgccgagcagcgcggcgacugcgcccucaaggacgcccgcgccaagcucgacgagcucgagggcgcccuccaccaggccaaggaggagcucgcccgcaugcuccgcgaguaccaggagcucgucucccucaagcucgcccucgacauggagaucgccaccuaccgcaagcuccucgaguccgaggagugccgcauguccggcgaguaccccaacuccgucuccaucuccgucaucuccuccaccaacgccggcgccggcggcgccggcuucuccaugggcuucggcgccuccuccuccuacuccuacaagaccgccgccgccgacgucaagaccaagggcuccugcggcuccgagcucaaggacccccucgccaagaccuccggcuccuccugcgccaccaagaaggccucccgcuga

SEQ ID NO: 45209 - RNA, 1590 nt, Artificial Sequence
  derived and/or modified sequence opt2 from KRT74__Homo_sapiens__XP_011536204
augucccgccagcucaacaucaaguccuccggcgacaagggcaacuucuccguccacuccgccgucgucccccgcaaggccgucggcucccucgccuccuacugcgccgccggccgcggcgccggcgccggcuucggcucccgcucccucuacucccucggcggcaaccgccgcaucuccuucaacgucgccggcggcggcguccgcgccggcggcuacggcuuccgccccggcuccggcuacggcggcggccgcgccuccggcuucgccggcuccauguucggcuccgucgcccucggccccgccugccucuccgucugcccccccggcggcauccaccaggucaccgucaacaagucccuccucgccccccucaacgucgagcucgaccccgagauccagaagguccgcgcccaggagcgcgagcagaucaagguccucaacgacaaguucgccuccuucaucgacaagguccgcuuccucgagcagcagaaccagguccucgagaccaagugggagcuccuccagcagcucgaccucaacaacugcaagaagaaccucgagcccauccucgagggcuacaucuccaaccuccgcaagcagcucgagacccucuccggcgaccgcguccgccucgacuccgagcuccgcuccaugcgcgaccucgucgaggacuacaagaagcgcuacgaggucgagaucaaccgccgcaccaccgccgagaacgaguucgucguccucaagaaggacgccgacgccgccuacgccgucaaggucgagcuccaggccaaggucgacucccucgacaaggagaucaaguuccucaagugccucuacgacgccgagaucgcccagauccagacccacgccuccgagaccuccgucauccucuccauggacaacaaccgcgaccucgaccucgacuccaucaucgccgagguccgcaugcacuacgaggagaucgcccucaaguccaaggccgaggccgaggcccucuaccagaccaagauccaggagcuccagcucgccgccucccgccacggcgacgaccucaagcacacccgcuccgagauggucgagcucaaccgccucauccagcgcauccgcugcgagaucggcaacgucaagaagcagcgcgccucccucgagaccgccaucgccgacgccgagcagcgcggcgacaacgcccucaaggacgcccaggccaagcucgacgagcucgagggcgcccuccaccaggccaaggaggagcucgcccgcaugcuccgcgaguaccaggagcucaugucccucaagcucgcccucgacauggagaucgccaccuaccgcaagcuccucgagggcgaggagugccgcauguccggcgagaaccccuccuccgucuccaucuccgucaucuccuccuccuccuacuccuaccaccaccccuccuccgccggcgucgaccucggcgccuccgccgucgccggcuccuccggcuccacccaguccggccagaccaagaccaccgaggcccgcggcggcgaccucaaggacacccagggcaaguccacccccgccuccauccccgcccgcaaggccacccgcuga

SEQ ID NO: 45210 - RNA, 1656 nt, Artificial Sequence
  derived and/or modified sequence opt2 from KRT75__Homo_sapiens__NP_004684
augucccgccaguccuccaucaccuuccaguccggcucccgccgcggcuucuccaccaccuccgccaucacccccgccgccggccgcucccgcuucuccuccgucuccgucgcccgcuccgccgccggcuccggcggccucggccgcaucuccuccgccggcgccuccuucggcucccgcucccucuacaaccucggcggcgccaagcgcgucuccaucaacggcugcggcuccuccugccgcuccggcuucggcggccgcgccuccaaccgcuucggcgucaacuccggcuucggcuacggcggcggcgucggcggcggcuucuccggccccuccuuccccgucugcccccccggcggcauccaggaggucaccgucaaccagucccuccucaccccccuccaccuccagaucgaccccaccauccagcgcguccgcgccgaggagcgcgagcagaucaagacccucaacaacaaguucgccuccuucaucgacaagguccgcuuccucgagcagcagaacaagguccucgagaccaagugggcccuccuccaggagcagggcucccgcaccguccgccagaaccucgagccccucuucgacuccuacaccuccgagcuccgccgccagcucgaguccaucaccaccgagcgcggccgccucgaggccgagcuccgcaacaugcaggacgucgucgaggacuucaagguccgcuacgaggacgagaucaacaagcgcaccgccgccgagaacgaguucgucgcccucaagaaggacgucgacgccgccuacaugaacaaggucgagcucgaggccaaggucaagucccuccccgaggagaucaacuucauccacuccgucuucgacgccgagcucucccagcuccagacccaggucggcgacaccuccgucguccucuccauggacaacaaccgcaaccucgaccucgacuccaucaucgccgaggucaaggcccaguacgaggacaucgccaaccgcucccgcgccgaggccgaguccugguaccagaccaaguacgaggagcuccaggucaccgccggccgccacggcgacgaccuccgcaacaccaagcaggagaucuccgagaugaaccgcaugauccagcgccuccgcgccgagaucgacuccgucaagaagcagugcuccucccuccagaccgccaucgccgacgccgagcagcgcggcgagcucgcccucaaggacgcccgcgccaagcucgucgaccucgaggaggcccuccagaaggccaagcaggacauggcccgccuccuccgcgaguaccaggagcucaugaacaucaagcucgcccucgacgucgagaucgccaccuaccgcaagcuccucgagggcgaggagugccgccucuccggcgagggcgucucccccgucaacaucuccgucgucaccuccacccucuccuccggcuacggcuccggcuccuccaucggcggcggcaaccucggccucggcggcggcuccggcuacuccuucaccaccuccggcggccacucccucggcgccggccucggcggcuccggcuucuccgccaccuccaaccgcggccucggcggcuccggcuccuccgucaaguucgucuccaccaccuccuccucccagaaguccuacacccacuga

SEQ ID NO: 45211 - RNA, 1917 nt, Artificial Sequence
  derived and/or modified sequence opt2 from KRT76__Homo_sapiens__NP_056932
augaaccgccaggucugcaagaaguccuucuccggccgcucccagggcuucuccggccgcuccgccgucgucuccggcuccucccgcauguccugcgucgcccgcuccggcggcgccggcggcggcgccugcggcuuccgcuccggcgccggcuccuucggcucccgcucccucuacaaccucggcuccaacaaguccaucuccaucuccgucgccgccggcuccucccgcgccggcggcuucggcggcggccgcuccuccugcggcuucgccggcggcuacggcggcggcuucggcggcuccuacggcggcggcuucggcggcggccgcggcgucggcuccggcuucggcggcgccggcggcuucggcggcgccggcggcuucggcggccccggcgucuucggcggccccggcuccuucggcggccccggcggcuucggccccggcggcuuccccggcggcauccaggaggucaucgucaaccagucccuccuccagccccucaacgucgagaucgacccccagaucggccaggucaaggcccaggagcgcgagcagaucaagacccucaacaacaaguucgccuccuucaucgacaagguccgcuuccucgagcagcagaacaagguccucgagaccaagugggagcuccuccagcagcagaccaccggcuccggccccuccucccucgagcccugcuucgaguccuacaucuccuuccucugcaagcagcucgacucccuccucggcgagcgcggcaaccucgagggcgagcucaaguccaugcaggaccucgucgaggacuucaagaagaaguacgaggacgagaucaacaagcgcaccgccgccgagaacgaguucgucggccucaagaaggacgucgacgccgccuucaugaacaaggucgagcuccaggccaaggucgacucccucaccgacgaggucuccuuccuccgcacccucuacgagauggagcucucccagaugcagucccacgccuccgacaccuccgucguccucuccauggacaacaaccgcugccucgaccucggcuccaucaucgccgagguccgcgcccaguacgaggagaucgcccagcgcuccaaguccgaggccgaggcccucuaccagaccaagcucggcgagcuccagaccaccgccggccgccacggcgacgaccuccgcaacaccaaguccgagaucauggagcucaaccgcaugauccagcgccuccgcgccgagaucgagaacgucaagaagcagaacgccaaccuccagaccgccaucgccgaggccgagcagcgcggcgagauggcccucaaggacgccaacgccaagcuccaggaccuccagaccgcccuccagaaggccaaggacgaccucgcccgccuccuccgcgacuaccaggagcucaugaacgucaagcucgcccucgacgucgagaucgccaccuaccgcaagcuccucgagggcgaggagugccgcauguccggcgagugccaguccgccgucugcaucuccgucgucuccaacgucaccuccaccuccggcuccuccggcuccucccgcggcgucuucggcggcgucuccggcuccggcuccggcggcuacaagggcggcuccuccuccuccuccuccuccggcuacggcgucuccggcggcuccggcuccggcuacggcggcgucuccuccggcuccaccggcggccgcggcuccuccggcuccuaccaguccuccuccuccggcucccgccucggcggcgccggcuccaucuccgucucccacuccggcaugggcuccuccuccggcuccauccagaccuccggcggcuccggcuacaaguccggcggcggcggcuccaccuccauccgcuucucccagaccaccuccuccucccagcacuccuccaccaaguga

SEQ ID NO: 45212 - RNA, 1233 nt, Artificial Sequence
  derived and/or modified sequence opt2 from KRT78__Homo_sapiens__NP_001287743
auggagggccacgaggccucccccgcccaggucggccagggcgaccgcggcaagguccgcuuccucgagcagcagaacaagguccucgagaccaaguggcaccuccuccagcagcagggccucuccggcucccagcagggccucgagcccgucuucgaggccugccucgaccagcuccgcaagcagcucgagcagcuccagggcgagcgcggcgcccucgacgccgagcucaaggccugccgcgaccaggaggaggaguacaaguccaaguacgaggaggaggcccaccgccgcgccacccucgagaacgacuucgucguccucaagaaggacgucgacggcgucuuccucuccaagauggagcucgagggcaagcucgaggcccuccgcgaguaccucuacuuccucaagcaccucaacgaggaggagcucggccagcuccagacccaggccuccgacaccuccgucguccucuccauggacaacaaccgcuaccucgacuucuccuccaucaucaccgagguccgcgcccgcuacgaggagaucgcccgcuccuccaaggccgaggccgaggcccucuaccagaccaaguaccaggagcuccaggucuccgcccagcuccacggcgaccgcaugcaggagaccaagguccagaucucccagcuccaccaggagauccagcgccuccagucccagaccgagaaccucaagaagcagaacgccucccuccaggccgccaucaccgacgccgagcagcgcggcgagcucgcccucaaggacgcccaggccaaggucgacgagcucgaggccgcccuccgcauggccaagcagaaccucgcccgccuccucugcgaguaccaggagcucaccuccaccaagcucucccucgacgucgagaucgccaccuaccgccgccuccucgagggcgaggagugccgcauguccggcgagugcaccucccaggucaccaucuccuccgucggcggcuccgccgucauguccggcggcgucggcggcggccucggcuccaccugcggccucggcuccggcaagggcucccccggcuccugcugcaccuccaucgucaccggcggcuccaacaucauccucggcuccggcaaggaccccguccucgacuccugcuccgucuccggcuccuccgccggcuccuccugccacaccauccucaagaagaccgucgaguccucccucaagaccuccaucaccuacuga

SEQ ID NO: 45213 - RNA, 1410 nt, Artificial Sequence
  derived and/or modified sequence opt2 from KRT7__Homo_sapiens__NP_005547
auguccauccacuucuccucccccgucuucaccucccgcuccgccgccuucuccggccgcggcgcccagguccgccucuccuccgcccgccccggcggccucggcuccuccucccucuacggccucggcgccucccgcccccgcgucgccguccgcuccgccuacggcggccccgucggcgccggcauccgcgaggucaccaucaaccagucccuccucgccccccuccgccucgacgccgaccccucccuccagcgcguccgccaggaggaguccgagcagaucaagacccucaacaacaaguucgccuccuucaucgacaagguccgcuuccucgagcagcagaacaagcuccucgagaccaaguggacccuccuccaggagcagaaguccgccaaguccucccgccuccccgacaucuucgaggcccagaucgccggccuccgcggccagcucgaggcccuccaggucgacggcggccgccucgaggccgagcuccgcuccaugcaggacgucgucgaggacuucaagaacaaguacgaggacgagaucaaccaccgcaccgccgccgagaacgaguucgucguccucaagaaggacgucgacgccgccuacauguccaaggucgagcucgaggccaaggucgacgcccucaacgacgagaucaacuuccuccgcacccucaacgagaccgagcucaccgagcuccagucccagaucuccgacaccuccgucguccucuccauggacaacucccgcucccucgaccucgacggcaucaucgccgaggucaaggcccaguacgaggagauggccaagugcucccgcgccgaggccgaggccugguaccagaccaaguucgagacccuccaggcccaggccggcaagcacggcgacgaccuccgcaacacccgcaacgagaucuccgagaugaaccgcgccauccagcgccuccaggccgagaucgacaacaucaagaaccagcgcgccaagcucgaggccgccaucgccgaggccgaggagcgcggcgagcucgcccucaaggacgcccgcgccaagcaggaggagcucgaggccgcccuccagcgcggcaagcaggacauggcccgccagcuccgcgaguaccaggagcucauguccgucaagcucgcccucgacaucgagaucgccaccuaccgcaagcuccucgagggcgaggagucccgccucgccggcgacggcgucggcgccgucaacaucuccgucaugaacuccaccggcggcuccuccuccggcggcggcaucggccucacccucggcggcaccaugggcuccaacgcccucuccuucuccuccuccgccggccccggccuccucaaggccuacuccauccgcaccgccuccgccucccgccgcuccgcccgcgacuga

SEQ ID NO: 45214 - RNA, 1269 nt, Artificial Sequence
  derived and/or modified sequence opt2 from KRT80__Homo_sapiens__NP_001074961
auggccugccgcuccugcgucgucggcuucuccucccucuccuccugcgaggucacccccgucggcuccccccgccccggcaccuccggcugggacuccugccgcgcccccggccccggcuucuccucccgcucccucaccggcugcugguccgccggcaccaucuccaaggucaccgucaaccccggccuccucgucccccucgacgucaagcucgaccccgccguccagcagcucaagaaccaggagaaggaggagaugaaggcccucaacgacaaguucgccucccucaucggcaagguccaggcccucgagcagcgcaaccagcuccucgagacccgcugguccuuccuccagggccaggacuccgccaucuucgaccucggccaccucuacgaggaguaccagggccgccuccaggaggagcuccgcaaggucucccaggagcgcggccagcucgaggccaaccuccuccagguccucgagaaggucgaggaguuccgcauccgcuacgaggacgagaucuccaagcgcaccgacauggaguucaccuucguccagcucaagaaggaccucgacgccgagugccuccaccgcaccgagcucgagaccaagcucaagucccucgaguccuucgucgagcucaugaagaccaucuacgagcaggagcucaaggaccucgccgcccaggucaaggacgucuccgucaccgucggcauggacucccgcugccacaucgaccucuccggcaucgucgaggaggucaaggcccaguacgacgccgucgccgcccgcucccucgaggaggccgaggccuacucccgcucccagcucgaggagcaggccgcccgcuccgccgaguacggcuccucccuccaguccucccgcuccgagaucgccgaccucaacguccgcauccagaagcuccgcucccagauccucuccgucaagucccacugccucaagcucgaggagaacaucaagaccgccgaggagcagggcgagcucgccuuccaggacgccaagaccaagcucgcccagcucgaggccgcccuccagcaggccaagcaggacauggcccgccagcuccgcaaguaccaggagcucaugaacgucaagcucgcccucgacaucgagaucgccaccuaccgcaagcucgucgagggcgaggagggccgcauggacucccccuccgccaccgucgucuccgccguccagucccgcugcaagaccgcccccucccuccccuacccccucugcucccucuga

SEQ ID NO: 45215 - RNA, 1518 nt, Artificial Sequence
  derived and/or modified sequence opt2 from KRT81__Homo_sapiens__XP_011536636
augaccugcggcuccggcuucggcggccgcgccuucuccugcaucuccgccugcggcccccgccccggccgcugcugcaucaccgccgcccccuaccgcggcaucuccugcuaccgcggccucaccggcggcuucggcucccacuccgucugcggcggcuuccgcgccggcuccugcggccgcuccuucggcuaccgcuccggcggcgucugcggccccuccccccccugcaucaccaccgucuccgucaacgagucccuccucaccccccucaaccucgagaucgaccccaacgcccagugcgucaagcaggaggagaaggagcagaucaagucccucaacucccgcuucgccgccuucaucgacaagguccgcuuccucgagcagcagaacaagcuccucgagaccaagcuccaguucuaccagaaccgcgagugcugccaguccaaccucgagccccucuucgagggcuacaucgagacccuccgccgcgaggccgagugcgucgaggccgacuccggccgccucgccuccgagcucaaccacguccaggagguccucgagggcuacaagaagaaguacgaggaggaggucucccuccgcgccaccgccgagaacgaguucgucgcccucaagaaggacgucgacugcgccuaccuccgcaaguccgaccucgaggccaacgucgaggcccucauccaggagaucgacuuccuccgccgccucuacgaggaggagauccucauccuccagucccacaucuccgacaccuccgucgucgucaagcucgacaacucccgcgaccucaacauggacugcaucaucgccgagaucaaggcccaguacgacgacaucgucacccgcucccgcgccgaggccgaguccugguaccgcuccaagugcgaggagaugaaggccaccgucauccgccacggcgagacccuccgccgcaccaaggaggagaucaacgagcucaaccgcaugauccagcgccucaccgccgaggucgagaacgccaagugccagaacuccaagcucgaggccgccgucgcccaguccgagcagcagggcgaggccgcccucuccgacgcccgcugcaagcucgccgagcucgagggcgcccuccagaaggccaagcaggacauggccugccucauccgcgaguaccaggaggucaugaacuccaagcucggccucgacaucgagaucgccaccuaccgccgccuccucgagggcgaggagcagcgccucugcgagggcaucggcgccgucaacgucugcgucuccuccucccgcggcggcgucgucugcggcgaccucugcgucuccggcucccgccccgucaccggcuccgucugcuccgcccccugcaacggcaacgucgccgucuccaccggccucugcgcccccugcggccagcucaacaccaccugcggcggcggcuccugcggcgucggcuccugcggcaucuccucccucggcgucggcuccugcggcuccuccugccgcaagugcuga

SEQ ID NO: 45216 - RNA, 1542 nt, Artificial Sequence
  derived and/or modified sequence opt2 from KRT82__Homo_sapiens__NP_149022
auguccuaccacuccuuccagcccggcucccgcugcggcucccaguccuucuccuccuacuccgccgucaugccccgcauggucacccacuacgccgucuccaagggccccugccgccccggcggcggccgcggccuccgcgcccucggcugccucggcucccgcucccucugcaacgucggcuucggccgcccccgcgucgccucccgcugcggcggcacccuccccggcuucggcuaccgccucggcgccaccugcggccccuccgccugcaucacccccgucaccaucaacgagucccuccucgucccccucgcccucgagaucgaccccaccguccagcgcgucaagcgcgacgagaaggagcagaucaagugccucaacaaccgcuucgccuccuucaucaacaagguccgcuuccucgagcagaagaacaagcuccucgagaccaaguggaacuucaugcagcagcagcgcugcugccagaccaacaucgagcccaucuucgagggcuacaucuccgcccuccgccgccagcucgacugcgucuccggcgaccgcguccgccucgaguccgagcucugcucccuccaggccgcccucgagggcuacaagaagaaguacgaggaggagcucucccuccgccccugcgucgagaacgaguucgucgcccucaagaaggacgucgacaccgccuuccucaugaaggccgaccucgagaccaacgccgaggcccucguccaggagaucgacuuccucaagucccucuacgaggaggagaucugccuccuccagucccagaucuccgagaccuccgucaucgucaagauggacaacucccgcgagcucgacgucgacggcaucaucgccgagaucaaggcccaguacgacgacaucgccucccgcuccaaggccgaggccgaggccugguaccagugccgcuacgaggagcuccgcgucaccgccggcaaccacugcgacaaccuccgcaaccgcaagaacgagauccucgagaugaacaagcucauccagcgccuccagcaggagaccgagaacgucaaggcccagcgcugcaagcucgagggcgccaucgccgaggccgagcagcagggcgaggccgcccucaacgacgccaagugcaagcucgccggccucgaggaggcccuccagaaggccaagcaggacauggccugccuccucaaggaguaccaggaggucaugaacuccaagcucggccucgacaucgagaucgccaccuaccgccgccuccucgagggcgaggagcaccgccucugcgagggcaucggccccgucaacaucuccgucuccuccuccaagggcgccuuccucuacgagcccugcggcgucuccacccccguccucuccaccggcguccuccgcuccaacggcggcugcuccaucgucggcaccggcgagcucuacguccccugcgagccccagggccuccucuccugcggcuccggccgcaaguccuccaugacccucggcgccggcggcuccucccccucccacaagcacuga

SEQ ID NO: 45217 - RNA, 1482 nt, Artificial Sequence
  derived and/or modified sequence opt2 from KRT83__Homo_sapiens__NP_002273
augaccugcggcuucaacuccaucggcugcggcuuccgccccggcaacuucuccugcgucuccgccugcggcccccgccccucccgcugcugcaucaccgccgcccccuaccgcggcaucuccugcuaccgcggccucaccggcggcuucggcucccacuccgucugcggcggcuuccgcgccggcuccugcggccgcuccuucggcuaccgcuccggcggcgucugcggccccuccccccccugcaucaccaccgucuccgucaacgagucccuccucaccccccucaaccucgagaucgaccccaacgcccagugcgucaagcaggaggagaaggagcagaucaagucccucaacucccgcuucgccgccuucaucgacaagguccgcuuccucgagcagcagaacaagcuccucgagaccaagcuccaguucuaccagaaccgcgagugcugccaguccaaccucgagccccucuucgccggcuacaucgagacccuccgccgcgaggccgagugcgucgaggccgacuccggccgccucgccuccgagcucaaccacguccaggagguccucgagggcuacaagaagaaguacgaggaggaggucgcccuccgcgccaccgccgagaacgaguucgucgcccucaagaaggacgucgacugcgccuaccuccgcaaguccgaccucgaggccaacgucgaggcccucauccaggagaucgacuuccuccgccgccucuacgaggaggagauccgcauccuccagucccacaucuccgacaccuccgucgucgucaagcucgacaacucccgcgaccucaacauggacugcaucgucgccgagaucaaggcccaguacgacgacaucgccacccgcucccgcgccgaggccgaguccugguaccgcuccaagugcgaggagaugaaggccaccgucauccgccacggcgagacccuccgccgcaccaaggaggagaucaacgagcucaaccgcaugauccagcgccucaccgccgaggucgagaacgccaagugccagaacuccaagcucgaggccgccgucgcccaguccgagcagcagggcgaggccgcccucuccgacgcccgcugcaagcucgccgagcucgagggcgcccuccagaaggccaagcaggacauggccugccucauccgcgaguaccaggaggucaugaacuccaagcucggccucgacaucgagaucgccaccuaccgccgccuccucgagggcgaggagcagcgccucugcgagggcgucgaggccgucaacgucugcgucuccuccucccgcggcggcgucgucugcggcgaccucugcgucuccggcucccgccccgucaccggcuccgucugcuccgcccccugcaacggcaaccucgucgucuccaccggccucugcaagcccugcggccagcucaacaccaccugcggcggcggcuccugcggccagggccgccacuga

SEQ ID NO: 45218 - RNA, 888 nt, Artificial Sequence
  derived and/or modified sequence opt2 from KRT85__Homo_sapiens__NP_001287739
auggucuucaagguccaguuccucuccucccgccccucccucucccacacccaggacgucgacugcgccuaccuccgcaaguccgaccucgaggccaacgucgaggcccucgucgaggaguccuccuuccuccgccgccucuacgaggaggagauccgcguccuccaggcccacaucuccgacaccuccgucaucgucaagauggacaacucccgcgaccucaacauggacugcaucaucgccgagaucaaggcccaguacgacgacgucgccucccgcucccgcgccgaggccgaguccugguaccgcuccaagugcgaggagaugaaggccaccgucauccgccacggcgagacccuccgccgcaccaaggaggagaucaacgagcucaaccgcaugauccagcgccucaccgccgagaucgagaacgccaagugccagcgcgccaagcucgaggccgccgucgccgaggccgagcagcagggcgaggccgcccucuccgacgcccgcugcaagcucgccgagcucgagggcgcccuccagaaggccaagcaggacauggccugccuccucaaggaguaccaggaggucaugaacuccaagcucggccucgacaucgagaucgccaccuaccgccgccuccucgagggcgaggagcaccgccucugcgagggcgucggcuccgucaacgucugcgucuccuccucccgcggcggcgucuccugcggcggccucuccuacuccaccacccccggccgccagaucaccuccggccccuccgccaucggcggcuccaucaccgucgucgcccccgacuccugcgcccccugccagccccgcuccuccuccuucuccugcggcuccucccgcuccguccgcuucgccuga

SEQ ID NO: 45219 - RNA, 1692 nt, Artificial Sequence
  derived and/or modified sequence opt2 from KRT86__Homo_sapiens__XP_005268923
augugcgaggagcucaaggccaccguccagaagcacacccagucccucaagcccuccaaggaggaccucaaccgccucaaccaggccauccaguggcucaccgucgaggucggcuccgccgagucccaggccuaccgcggcgccuccuccgagcgccucaccccccgcccccucugcucccccuucggccgccuccacccccagaaccuccucuccucccccaaguccaccaugaccugcggcuccuacugcggcggccgcgccuucuccugcaucuccgccugcggcccccgccccggccgcugcugcaucaccgccgcccccuaccgcggcaucuccugcuaccgcggccucaccggcggcuucggcucccacuccgucugcggcggcuuccgcgccggcuccugcggccgcuccuucggcuaccgcuccggcggcgucugcggccccuccccccccugcaucaccaccgucuccgucaacgagucccuccucaccccccucaaccucgagaucgaccccaacgcccagugcgucaagcaggaggagaaggagcagaucaagucccucaacucccgcuucgccgccuucaucgacaagguccgcuuccucgagcagcagaacaagcuccucgagaccaagcuccaguucuaccagaaccgcgagugcugccaguccaaccucgagccccucuucgagggcuacaucgagacccuccgccgcgaggccgagugcgucgaggccgacuccggccgccucgccuccgagcucaaccacguccaggagguccucgagggcuacaagaagaaguacgaggaggaggucucccuccgcgccaccgccgagaacgaguucgucgcccucaagaaggacgucgacugcgccuaccuccgcaaguccgaccucgaggccaacgucgaggcccucauccaggagaucgacuuccuccgccgccucuacgaggaggagauccgcguccuccagucccacaucuccgacaccuccgucgucgucaagcucgacaacucccgcgaccucaacauggacugcaucaucgccgagaucaaggcccaguacgacgacaucgucacccgcucccgcgccgaggccgaguccugguaccgcuccaagugcgaggagaugaaggccaccgucauccgccacggcgagacccuccgccgcaccaaggaggagaucaacgagcucaaccgcaugauccagcgccucaccgccgaggucgagaacgccaagugccagaacuccaagcucgaggccgccgucgcccaguccgagcagcagggcgaggccgcccucuccgacgcccgcugcaagcucgccgagcucgagggcgcccuccagaaggccaagcaggacauggccugccucauccgcgaguaccaggaggucaugaacuccaagcucggccucgacaucgagaucgccaccuaccgccgccuccucgagggcgaggagcagcgccucugcgagggcgucggcuccgucaacgucugcgucuccuccucccgcggcggcgucgucugcggcgaccucugcgccuccaccaccgcccccgucgucuccacccgcgucuccuccguccccuccaacuccaacgucgucgucggcaccaccaacgccugcgcccccuccgcccgcgucggcgucugcggcggcuccugcaagcgcugcuga

SEQ ID NO: 45220 - RNA, 1536 nt, Artificial Sequence
  derived and/or modified sequence opt2 from KRT8__Homo_sapiens__NP_001243211
augaacggcgucuccuggucccaggaccuccaggagggcaucuccgccugguucggcccccccgccuccacccccgccuccaccauguccauccgcgucacccagaaguccuacaaggucuccaccuccggcccccgcgccuucuccucccgcuccuacaccuccggccccggcucccgcaucuccuccuccuccuucucccgcgucggcuccuccaacuuccgcggcggccucggcggcggcuacggcggcgccuccggcaugggcggcaucaccgccgucaccgucaaccagucccuccucuccccccucguccucgaggucgaccccaacauccaggccguccgcacccaggagaaggagcagaucaagacccucaacaacaaguucgccuccuucaucgacaagguccgcuuccucgagcagcagaacaagaugcucgagaccaaguggucccuccuccagcagcagaagaccgcccgcuccaacauggacaacauguucgaguccuacaucaacaaccuccgccgccagcucgagacccucggccaggagaagcucaagcucgaggccgagcucggcaacaugcagggccucgucgaggacuucaagaacaaguacgaggacgagaucaacaagcgcaccgagauggagaacgaguucguccucaucaagaaggacgucgacgaggccuacaugaacaaggucgagcucgagucccgccucgagggccucaccgacgagaucaacuuccuccgccagcucuacgaggaggagauccgcgagcuccagucccagaucuccgacaccuccgucguccucuccauggacaacucccgcucccucgacauggacuccaucaucgccgaggucaaggcccaguacgaggacaucgccaaccgcucccgcgccgaggccgaguccauguaccagaucaaguacgaggagcuccagucccucgccggcaagcacggcgacgaccuccgccgcaccaagaccgagaucuccgagaugaaccgcaacaucucccgccuccaggccgagaucgagggccucaagggccagcgcgccucccucgaggccgccaucgccgacgccgagcagcgcggcgagcucgccaucaaggacgccaacgccaagcucuccgagcucgaggccgcccuccagcgcgccaagcaggacauggcccgccagcuccgcgaguaccaggagcucaugaacgucaagcucgcccucgacaucgagaucgccaccuaccgcaagcuccucgagggcgaggagucccgccucgaguccggcaugcagaacauguccauccacaccaagaccaccuccggcuacgccggcggccucuccuccgccuacggcggccucaccucccccggccucuccuacucccucggcuccuccuucggcuccggcgccggcuccuccuccuucucccgcaccuccuccucccgcgccgucgucgucaagaagaucgagacccgcgacggcaagcucgucuccgaguccuccgacguccuccccaaguga

SEQ ID NO: 45221 - RNA, 1872 nt, Artificial Sequence
  derived and/or modified sequence opt2 from KRT9__Homo_sapiens__NP_000217
auguccugccgccaguucuccuccuccuaccucucccgcuccggcggcggcggcggcggcggccucggcuccggcggcuccauccgcuccuccuacucccgcuucuccuccuccggcggcggcggcggcggcggccgcuucuccuccuccuccggcuacggcggcggcuccucccgcgucugcggccgcggcggcggcggcuccuucggcuacuccuacggcggcggcuccggcggcggcuucuccgccuccucccucggcggcggcuucggcggcggcucccgcggcuucggcggcgccuccggcggcggcuacuccuccuccggcggcuucggcggcggcuucggcggcggcuccggcggcggcuucggcggcggcuacggcuccggcuucggcggcuucggcggcuucggcggcggcgccggcggcggcgacggcggcauccucaccgccaacgagaaguccaccaugcaggagcucaacucccgccucgccuccuaccucgacaagguccaggcccucgaggaggccaacaacgaccucgagaacaagauccaggacugguacgacaagaagggccccgccgccauccagaagaacuacucccccuacuacaacaccaucgacgaccucaaggaccagaucgucgaccucaccgucggcaacaacaagacccuccucgacaucgacaacacccgcaugacccucgacgacuuccgcaucaaguucgagauggagcagaaccuccgccagggcgucgacgccgacaucaacggccuccgccagguccucgacaaccucaccauggagaaguccgaccucgagaugcaguacgagacccuccaggaggagcucauggcccucaagaagaaccacaaggaggagaugucccagcucaccggccagaacuccggcgacgucaacgucgagaucaacgucgcccccggcaaggaccucaccaagacccucaacgacaugcgccaggaguacgagcagcucaucgccaagaaccgcaaggacaucgagaaccaguacgagacccagaucacccagaucgagcacgaggucuccuccuccggccaggagguccaguccuccgccaaggaggucacccagcuccgccacggcguccaggagcucgagaucgagcuccagucccagcucuccaagaaggccgcccucgagaagucccucgaggacaccaagaaccgcuacugcggccagcuccagaugauccaggagcagaucuccaaccucgaggcccagaucaccgacguccgccaggagaucgagugccagaaccaggaguacucccuccuccucuccaucaagaugcgccucgagaaggagaucgagaccuaccacaaccuccucgagggcggccaggaggacuucgaguccuccggcgccggcaagaucggccucggcggccgcggcggcuccggcggcuccuacggccgcggcucccgcggcggcuccggcggcuccuacggcggcggcggcuccggcggcggcuacggcggcggcuccggcucccgcggcggcuccggcggcuccuacggcggcggcuccggcuccggcggcggcuccggcggcggcuacggcggcggcuccggcggcggccacuccggcggcuccggcggcggccacuccggcggcuccggcggcaacuacggcggcggcuccggcuccggcggcggcuccggcggcggcuacggcggcggcuccggcucccgcggcggcuccggcggcucccacggcggcggcuccggcuucggcggcgaguccggcggcuccuacggcggcggcgaggaggccuccggcuccggcggcggcuacggcggcggcuccggcaaguccucccacuccuga

SEQ ID NO: 45222 - RNA, 492 nt, Artificial Sequence
  derived and/or modified sequence opt2 from KRTAP11-1__Homo_sapiens__NP_787054
auguccuucaacugcuccacccgcaacugcuccucccgccccaucggcggccgcugcaucguccccgucgcccaggucaccaccaccuccaccaccgacgccgacugccucggcggcaucugccuccccuccuccuuccagaccggcuccuggcuccucgaccacugccaggagaccugcugcgagcccaccgccugccagcccaccugcuaccgccgcaccuccugcgucuccaaccccugccaggucaccugcucccgccagaccaccugcaucuccaaccccugcuccaccaccuacucccgcccccucaccuucgucuccuccggcugccagccccucggcggcaucuccuccgucugccagcccgucggcggcaucuccaccgucugccagcccgucggcggcgucuccaccgucugccagcccgccugcggcgucucccgcaccuaccagcaguccugcgucuccuccugccgccgcaccugcuga

SEQ ID NO: 45223 - RNA, 837 nt, Artificial Sequence
  derived and/or modified sequence opt2 from KRTAP5-1__Homo_sapiens__NP_001005922
augggcugcugcggcugcuccggcggcugcggcuccuccugcggcggcugcggcuccggcugcggcggcugcggcuccggcugcggcggcugcggcuccggcugcggcggcuccggcuccuccugcugcguccccgucugcugcugcaagcccgucugcugccgcguccccaccugcuccugcuccuccugcggcaagggcggcugcggcuccuccggcggcuccaagggcggcugcggcuccugcggcggcugcaagggcggcugcggcuccugcggcggcuccaagggcggcugcggcuccugcggcggcuccaagggcggcugcggcuccugcggcggcuccaagggcggcugcggcuccggcugcggcggcugcggcuccuccugcugcguccccgucugcugcugcaagcccaugugcugcugcguccccgccugcuccugcuccuccugcggcaagggcggcugcggcuccugcggcugcuccaagggcgccugcggcuccugcggcggcuccaagggcggcugcggcuccugcggcggcugcaagggcggcugcggcuccugcggcggcuccaagggcggcugcggcuccggcugcggcggcugcggcuccggcugcggcguccccgucugcugcugcuccugcuccuccugcggcuccugcgccggcuccaagggcggcugcggcuccuccugcucccagugcuccugcugcaagcccugcugcugcuccuccggcugcggcuccuccugcugccaguccuccugcugcaagcccugcugcucccaguccuccugcugcguccccgucugcugccagugcaagaucuga

SEQ ID NO: 45224 - RNA, 510 nt, Artificial Sequence
  derived and/or modified sequence opt2 from KRTAP5-9__Homo_sapiens__NP_005544
augggcugcugcggcugcuccggcggcugcggcuccuccugcggcggcugcgacuccuccugcggcuccugcggcuccggcugccgcggcugcggccccuccugcugcgcccccgucuacugcugcaagcccgucugcugcugcguccccgccugcuccugcuccuccugcggcaagcgcggcugcggcuccugcggcggcuccaagggcggcugcggcuccugcggcugcucccagugcuccugcugcaagcccugcugcugcuccuccggcugcggcuccuccugcugccagugcuccugcugcaagcccuacugcucccagugcuccugcugcaagcccugcugcuccuccuccggccgcggcuccuccugcugccaguccuccugcugcaagcccugcugcuccuccuccggcugcggcuccuccugcugccaguccuccugcugcaagcccugcugcucccagucccgcugcugcguccccgucugcuaccagugcaagaucuga

SEQ ID NO: 45225 - RNA, 2787 nt, Artificial Sequence
  derived and/or modified sequence opt2 from KSR1__Homo_sapiens__XP_006722214
auggaccgcgccgcccuccgcgccgccgccaugggcgagaagaaggagggcggcggcggcggcgacgccgccgccgccgagggcggcgccggcgccgccgccucccgcgcccuccagcagugcggccagcuccagaagcucaucgacaucuccaucggcucccuccgcggccuccgcaccaagugcgccgucuccaacgaccucacccagcaggagauccgcacccucgaggccaagcucguccgcuacaucugcaagcagcgccagugcaagcucuccgucgcccccggcgagcgcacccccgagcucaacuccuacccccgcuucuccgacuggcucuacaccuucaacguccgccccgaggucguccaggagaucccccgcgaccucacccucgacgcccuccucgagaugaacgaggccaaggucaaggagacccuccgccgcugcggcgccuccggcgacgagugcggccgccuccaguacgcccucaccugccuccgcaaggucaccggccucggcggcgagcacaaggaggacuccuccugguccucccucgacgcccgccgcgaguccggcuccggccccuccaccgacacccucuccgccgccucccuccccuggccccccggcuccucccagcucggccgcgccggcaacuccgcccagggcccccgcuccaucuccgucuccgcccuccccgccuccgacucccccacccccuccuucuccgagggccucuccgacaccugcaucccccuccacgccuccggccgccucaccccccgcgcccuccacuccuucaucaccccccccaccaccccccagcuccgccgccacaccaagcucaagcccccccgcaccccccccccccccucccgcaaggucuuccagcuccuccccuccuuccccacccucacccgcuccaagucccacgagucccagcucggcaaccgcaucgacgacgucuccuccaugcgcuucgaccucucccacggcuccccccagaugguccgccgcgacaucggccucuccgucacccaccgcuucuccaccaaguccuggcucucccaggucugccacgucugccagaaguccaugaucuucggcgucaagugcaagcacugccgccucaagugccacaacaagugcaccaaggaggcccccgccugccgcaucuccuuccucccccucacccgccuccgccgcaccgaguccguccccuccgacaucaacaaccccgucgaccgcgccgccgagccccacuucggcacccuccccaaggcccucaccaagaaggagcacccccccgccaugaaccaccucgacuccuccuccaaccccuccuccaccaccuccuccacccccuccucccccgcccccuuccccaccuccuccaaccccuccuccgccaccaccccccccaaccccucccccggccagcgcgacucccgcuucaacuuccccgccgccuacuucauccaccaccgccagcaguucaucuuccccgacaucuccgccuucgcccacgccgccccccuccccgaggccgccgacggcacccgccucgacgaccagcccaaggccgacguccucgaggcccacgaggccgaggccgaggagcccgaggccggcaaguccgaggccgaggacgacgaggacgaggucgacgaccuccccuccucccgccgccccuggcgcggccccaucucccgcaaggccucccagaccuccgucuaccuccaggagugggacauccccuucgagcaggucgagcucggcgagcccaucggccagggccgcuggggccgcguccaccgcggccgcuggcacggcgaggucgccauccgccuccucgagauggacggccacaaccaggaccaccucaagcucuucaagaaggaggucaugaacuaccgccagacccgccacgagaacgucguccucuucaugggcgccugcaugaaccccccccaccucgccaucaucaccuccuucugcaagggccgcacccuccacuccuucguccgcgaccccaagaccucccucgacaucaacaagacccgccagaucgcccaggagaucaucaagggcaugggcuaccuccacgccaagggcaucguccacaaggaccucaaguccaagaacgucuucuacgacaacggcaaggucgucaucaccgacuucggccucuucggcaucuccggcgucguccgcgagggccgccgcgagaaccagcucaagcucucccacgacuggcucugcuaccucgcccccgagaucguccgcgagaugacccccggcaaggacgaggaccagcuccccuucuccaaggccgccgacgucuacgccuucggcaccgucugguacgagcuccaggcccgcgacuggccccucaagaaccaggccgccgaggccuccaucuggcagaucggcuccggcgagggcaugaagcgcguccucaccuccgucucccucggcaaggaggucuccgagauccucuccgccugcugggccuucgaccuccaggagcgccccuccuucucccuccucauggacaugcucgagaagcuccccaagcucaaccgccgccucucccaccccggccacuucuggaaguccgccgaccgcuggcgcucccgcuacuacggcaagggccgcuacggccaccccgacuucaaguccuccugccccauccucgaggaguacaucaacuccuccaaggucgucccccgcuucgagcgcuucggccucggcguccucgaguccuccaaccccaagauguga

SEQ ID NO: 45226 - RNA, 2766 nt, Artificial Sequence
  derived and/or modified sequence opt2 from KSR2__Homo_sapiens__NP_775869
augaucgaccucuccaucuccaaccucgagggccuccgcaccaagugcgccaccuccaacgaccucacccagaaggagauccgcacccucgaguccaagcucgucaaguacuucucccgccagcucuccugcaagaagaaggucgcccuccaggagcgcaacgccgagcucgacggcuucccccagcuccgccacugguuccgcaucgucgacguccgcaaggagguccucgaggagaucucccccggccagcucucccucgaggaccuccucgagaugaccgacgagcaggucugcgagaccgucgagaaguacggcgccaaccgcgaggagugcgcccgccucaacgccucccucuccugccuccgcaacguccacauguccggcggcaaccucuccaagcaggacuggaccauccaguggcccaccaccgagaccggcaaggagaacaaccccgucugcccccccgagcccacccccuggauccgcacccaccucucccaguccccccgcguccccuccaagugcguccagcacuacugccacaccucccccacccccggcgcccccgucuacacccacgucgaccgccucaccgucgacgccuaccccggccucugccccccccccccccucgaguccggccaccgcucccucccccccuccccccgccagcgccacgccguccgcacccccccccgcacccccaacaucgucaccaccgucaccccccccggcaccccccccaugcgcaagaagaacaagcucaagccccccggcacccccccccccuccucccgcaagcucauccaccucauccccggcuucaccgcccuccaccgcuccaagucccacgaguuccagcucggccaccgcgucgacgaggcccacacccccaaggccaagaagaaguccaagccccucaaccucaagauccacuccuccgucggcuccugcgagaacauccccucccagcagcgcuccccccuccucuccgagcgcucccuccgcuccuucuucgucggccacgcccccuuccuccccuccaccccccccguccacaccgaggccaacuucuccgccaacacccucuccgucccccgcugguccccccagaucccccgccgcgaccucggcaacuccaucaagcaccgcuucuccaccaaguacuggaugucccagaccugcaccgucugcggcaagggcaugcucuucggccucaagugcaagaacugcaagcucaagugccacaacaagugcaccaaggaggccccccccugccaccuccucaucauccaccgcggcgaccccgcccgccucguccgcaccgaguccguccccugcgacaucaacaacccccuccgcaagcccccccgcuacuccgaccuccacaucucccagacccuccccaagaccaacaagaucaacaaggaccacauccccguccccuaccagcccgacuccuccuccaaccccuccuccaccaccuccuccacccccuccucccccgcccccccccucccccccuccgccaccccccccuccccccuccaccccuccccccagugcacccgccagcagaagaacuucaaccuccccgccucccacuacuacaaguacaagcagcaguucaucuuccccgacgucguccccguccccgagacccccacccgcgccccccaggucauccuccaccccgucaccuccaaccccauccucgagggcaacccccuccuccagaucgaggucgagcccaccuccgagaacgaggagguccacgacgaggccgaggaguccgaggacgacuucgaggagaugaaccucucccuccucuccgcccgcuccuucccccgcaaggccucccagaccuccaucuuccuccaggagugggacauccccuucgagcagcucgagaucggcgagcucaucggcaagggccgcuucggccaggucuaccacggccgcuggcacggcgaggucgccauccgccucaucgacaucgagcgcgacaacgaggaccagcucaaggccuucaagcgcgaggucauggccuaccgccagacccgccacgagaacgucguccucuucaugggcgccugcaugucccccccccaccucgccaucaucaccucccucugcaagggccgcacccucuacuccgucguccgcgacgccaagaucguccucgacgucaacaagacccgccagaucgcccaggagaucgucaagggcaugggcuaccuccacgccaagggcauccuccacaaggaccucaaguccaagaacgucuucuacgacaacggcaaggucgucaucaccgacuucggccucuucuccaucuccggcguccuccaggccggccgccgcgaggacaagcuccgcauccagaacggcuggcucugccaccucgcccccgagaucauccgccagcucucccccgacaccgaggaggacaagcuccccuucuccaagcacuccgacgucuucgcccucggcaccaucugguacgagcuccacgcccgcgaguggcccuucaagacccagcccgccgaggccaucaucuggcagaugggcaccggcaugaagcccaaccucucccagaucggcaugggcaaggagaucuccgacauccuccucuucugcugggccuucgagcaggaggagcgccccaccuucaccaagcucauggacaugcucgagaagcuccccaagcgcaaccgccgccucucccaccccggccacuucuggaaguccgccgagcucuga

SEQ ID NO: 45227 - RNA, 4074 nt, Artificial Sequence
  derived and/or modified sequence opt2 from KTN1__Homo_sapiens__NP_001072989
auggaguucuacgaguccgccuacuucaucguccucauccccuccaucgucaucaccgucaucuuccucuucuucuggcucuucaugaaggagacccucuacgacgagguccucgccaagcagaagcgcgagcagaagcucauccccaccaagaccgacaagaagaaggccgagaagaagaagaacaagaagaaggagauccagaacggcaaccuccacgaguccgacuccgaguccgucccccgcgacuucaagcucuccgacgcccucgccgucgaggacgaccaggucgcccccgucccccucaacgucgucgagaccuccuccuccguccgcgagcgcaagaagaaggagaagaagcagaagcccguccucgaggagcaggucaucaaggaguccgacgccuccaagauccccggcaagaaggucgagcccguccccgucaccaagcagcccaccccccccuccgaggccgccgccuccaagaagaagcccggccagaagaaguccaagaacggcuccgacgaccaggacaagaaggucgagacccucaugguccccuccaagcgccaggaggcccucccccuccaccaggagaccaagcaggaguccggcuccggcaagaagaaggccuccuccaagaagcagaagaccgagaacgucuucgucgacgagccccucauccacgccaccaccuacaucccccucauggacaacgccgacuccucccccgucgucgacaagcgcgaggucaucgaccuccucaagcccgaccaggucgagggcauccagaaguccggcaccaagaagcucaagaccgagaccgacaaggagaacgccgaggucaaguucaaggacuuccuccucucccucaagaccaugauguucuccgaggacgaggcccucugcgucgucgaccuccucaaggagaaguccggcgucauccaggacgcccucaagaaguccuccaagggcgagcucaccacccucauccaccagcuccaggagaaggacaagcuccucgccgccgucaaggaggacgccgccgccaccaaggaccgcugcaagcagcucacccaggagaugaugaccgagaaggagcgcuccaacgucgucaucacccgcaugaaggaccgcaucggcacccucgagaaggagcacaacgucuuccagaacaagauccacgucuccuaccaggagacccagcagaugcagaugaaguuccagcagguccgcgagcagauggaggccgagaucgcccaccucaagcaggagaacggcauccuccgcgacgccgucuccaacaccaccaaccagcucgaguccaagcaguccgccgagcucaacaagcuccgccaggacuacgcccgccucgucaacgagcucaccgagaagaccggcaagcuccagcaggaggagguccagaagaagaacgccgagcaggccgccacccagcucaagguccagcuccaggaggccgagcgccgcugggaggagguccaguccuacauccgcaagcgcaccgccgagcacgaggccgcccagcaggaccuccaguccaaguucgucgccaaggagaacgagguccagucccuccacuccaagcucaccgacacccucgucuccaagcagcagcucgagcagcgccucaugcagcucauggaguccgagcagaagcgcgucaacaaggaggagucccuccagaugcagguccaggacauccucgagcagaacgaggcccucaaggcccagauccagcaguuccacucccagaucgccgcccagaccuccgccuccguccucgccgaggagcuccacaaggucaucgccgagaaggacaagcagaucaagcagaccgaggacucccucgccuccgagcgcgaccgccucaccuccaaggaggaggagcucaaggacauccagaacaugaacuuccuccucaaggccgagguccagaagcuccaggcccucgccaacgagcaggccgccgccgcccacgagcucgagaagaugcagcaguccgucuacgucaaggacgacaagauccgccuccucgaggagcagcuccagcacgagaucuccaacaagauggaggaguucaagauccucaacgaccagaacaaggcccucaaguccgagguccagaagcuccagacccucgucuccgagcagcccaacaaggacgucgucgagcagauggagaagugcauccaggagaaggacgagaagcucaagaccgucgaggagcuccucgagaccggccucauccaggucgccaccaaggaggaggagcucaacgccauccgcaccgagaacuccucccucaccaaggagguccaggaccucaaggccaagcagaacgaccaggucuccuucgccucccucgucgaggagcucaagaaggucauccacgagaaggacggcaagaucaaguccgucgaggagcuccucgaggccgagcuccucaaggucgccaacaaggagaagaccguccaggaccucaagcaggagaucaaggcccucaaggaggagaucggcaacguccagcucgagaaggcccagcagcucuccaucaccuccaagguccaggagcuccagaaccuccucaagggcaaggaggagcagaugaacaccaugaaggccguccucgaggagaaggagaaggaccucgccaacaccggcaaguggcuccaggaccuccaggaggagaacgagucccucaaggcccacguccaggaggucgcccagcacaaccucaaggaggccuccuccgccucccaguucgaggagcucgagaucguccucaaggagaaggagaacgagcucaagcgccucgaggccaugcucaaggagcgcgaguccgaccucuccuccaagacccagcuccuccaggacguccaggacgagaacaagcucuucaagucccagaucgagcagcucaagcagcagaacuaccagcaggccuccuccuuccccccccacgaggagcuccucaaggucaucuccgagcgcgagaaggagaucuccggccucuggaacgagcucgacucccucaaggacgccgucgagcaccagcgcaagaagaacaacgaccuccgcgagaagaacugggaggccauggaggcccucgccuccaccgagaagaugcuccaggacaaggucaacaagaccuccaaggagcgccagcagcaggucgaggccgucgagcucgaggccaaggagguccucaagaagcucuuccccaaggucuccguccccuccaaccucuccuacggcgaguggcuccacggcuucgagaagaaggccaaggagugcauggccggcaccuccggcuccgaggaggucaagguccucgagcacaagcucaaggaggccgacgagaugcacacccuccuccagcucgagugcgagaaguacaaguccguccucgccgagaccgagggcauccuccagaagcuccagcgcuccgucgagcaggaggagaacaaguggaaggucaaggucgacgagucccacaagaccaucaagcagaugcaguccuccuucaccuccuccgagcaggagcucgagcgccuccgcuccgagaacaaggacaucgagaaccuccgccgcgagcgcgagcaccucgagauggagcucgagaaggccgagauggagcgcuccaccuacgucaccgagguccgcgagcucaaggaccuccucaccgagcuccagaagaagcucgacgacuccuacuccgaggccguccgccagaacgaggagcucaaccuccucaaggcccagcucaacgagacccucaccaagcuccgcaccgagcagaacgagcgccagaaggucgccggcgaccuccacaaggcccagcagucccucgagcucauccaguccaagaucgucaaggccgccggcgacaccaccgucaucgagaacuccgacgucucccccgagaccgaguccuccgagaaggagaccauguccgucucccucaaccagaccgucacccagcuccagcagcuccuccaggccgucaaccagcagcucaccaaggagaaggagcacuaccagguccucgaguga

SEQ ID NO: 45228 - RNA, 924 nt, Artificial Sequence
  derived and/or modified sequence opt2 from KYNU__Homo_sapiens__NP_001028170
auggagcccuccucccucgagcuccccgccgacaccguccagcgcaucgccgccgagcucaagugccaccccaccgacgagcgcgucgcccuccaccucgacgaggaggacaagcuccgccacuuccgcgagugcuucuacauccccaagauccaggaccucccccccgucgaccucucccucgucaacaaggacgagaacgccaucuacuuccucggcaacucccucggccuccagcccaagauggucaagaccuaccucgaggaggagcucgacaagugggccaagaucgccgccuacggccacgaggucggcaagcgccccuggaucaccggcgacgaguccaucgucggccucaugaaggacaucgucggcgccaacgagaaggagaucgcccucaugaacgcccucaccgucaaccuccaccuccucaugcucuccuucuucaagcccacccccaagcgcuacaagauccuccucgaggccaaggccuuccccuccgaccacuacgccaucgagucccagcuccagcuccacggccucaacaucgaggaguccaugcgcaugaucaagccccgcgagggcgaggagacccuccgcaucgaggacauccucgaggucaucgagaaggagggcgacuccaucgccgucauccucuucuccggcguccacuucuacaccggccagcacuucaacauccccgccaucaccaaggccggccaggccaagggcugcuacgucggcuucgaccucgcccacgccgucggcaacgucgagcucuaccuccacgacuggggcgucgacuucgccugcuggugcuccuacaaguaccucaacgccggcgccggcggcaucgccggcgccuucauccacgagaagcacgcccacaccaucaagcccgcccgcuccgaguucuucaacuga

SEQ ID NO: 45229 - RNA, 3774 nt, Artificial Sequence
  derived and/or modified sequence opt2 from L1CAM__Homo_sapiens__NP_000416
auggucgucgcccuccgcuacgucuggccccuccuccucugcucccccugccuccucauccagauccccgaggaguacgagggccaccacgucauggagccccccgucaucaccgagcaguccccccgccgccucgucgucuuccccaccgacgacaucucccucaagugcgaggccuccggcaagcccgagguccaguuccgcuggacccgcgacggcguccacuucaagcccaaggaggagcucggcgucaccgucuaccaguccccccacuccggcuccuucaccaucaccggcaacaacuccaacuucgcccagcgcuuccagggcaucuaccgcugcuucgccuccaacaagcucggcaccgccaugucccacgagauccgccucauggccgagggcgcccccaaguggcccaaggagaccgucaagcccgucgaggucgaggagggcgaguccgucguccuccccugcaaccccccccccuccgccgagccccuccgcaucuacuggaugaacuccaagauccuccacaucaagcaggacgagcgcgucaccaugggccagaacggcaaccucuacuucgccaacguccucaccuccgacaaccacuccgacuacaucugccacgcccacuuccccggcacccgcaccaucauccagaaggagcccaucgaccuccgcgucaaggccaccaacuccaugaucgaccgcaagccccgccuccucuuccccaccaacuccuccucccaccucgucgcccuccagggccagccccucguccucgagugcaucgccgagggcuuccccacccccaccaucaaguggcuccgccccuccggccccaugcccgccgaccgcgucaccuaccagaaccacaacaagacccuccagcuccucaaggucggcgaggaggacgacggcgaguaccgcugccucgccgagaacucccucggcuccgcccgccacgccuacuacgucaccgucgaggccgcccccuacuggcuccacaagccccagucccaccucuacggccccggcgagaccgcccgccucgacugccagguccagggccgcccccagcccgaggucaccuggcgcaucaacggcauccccgucgaggagcucgccaaggaccagaaguaccgcauccagcgcggcgcccucauccucuccaacguccagcccuccgacaccauggucacccagugcgaggcccgcaaccgccacggccuccuccucgccaacgccuacaucuacgucguccagcuccccgccaagauccucaccgccgacaaccagaccuacauggccguccagggcuccaccgccuaccuccucugcaaggccuucggcgcccccguccccuccguccaguggcucgacgaggacggcaccaccguccuccaggacgagcgcuucuuccccuacgccaacggcacccucggcauccgcgaccuccaggccaacgacaccggccgcuacuucugccucgccgccaacgaccagaacaacgucaccaucauggccaaccucaaggucaaggacgccacccagaucacccagggcccccgcuccaccaucgagaagaagggcucccgcgucaccuucaccugccaggccuccuucgaccccucccuccagcccuccaucaccuggcgcggcgacggccgcgaccuccaggagcucggcgacuccgacaaguacuucaucgaggacggccgccucgucauccacucccucgacuacuccgaccagggcaacuacuccugcgucgccuccaccgagcucgacgucgucgagucccgcgcccagcuccucgucgucggcucccccggccccgucccccgccucguccucuccgaccuccaccuccucacccagucccagguccgcgucuccuggucccccgccgaggaccacaacgcccccaucgagaaguacgacaucgaguucgaggacaaggagauggcccccgagaagugguacucccucggcaagguccccggcaaccagaccuccaccacccucaagcucucccccuacguccacuacaccuuccgcgucaccgccaucaacaaguacggccccggcgagcccucccccgucuccgagaccgucgucacccccgaggccgcccccgagaagaaccccgucgacgucaagggcgagggcaacgagaccaccaacauggucaucaccuggaagccccuccgcuggauggacuggaacgccccccagguccaguaccgcguccaguggcgcccccagggcacccgcggccccuggcaggagcagaucgucuccgaccccuuccucgucgucuccaacaccuccaccuucguccccuacgagaucaagguccaggccgucaacucccagggcaagggccccgagccccaggucaccaucggcuacuccggcgaggacuacccccaggccauccccgagcucgagggcaucgagauccucaacuccuccgccguccucgucaaguggcgccccgucgaccucgcccaggucaagggccaccuccgcggcuacaacgucaccuacuggcgcgagggcucccagcgcaagcacuccaagcgccacauccacaaggaccacgucgucguccccgccaacaccaccuccgucauccucuccggccuccgccccuacuccuccuaccaccucgagguccaggccuucaacggccgcggcuccggccccgccuccgaguucaccuucuccacccccgagggcguccccggccaccccgaggcccuccaccucgagugccaguccaacaccucccuccuccuccgcuggcagcccccccucucccacaacggcguccucaccggcuacguccucuccuaccacccccucgacgagggcggcaagggccagcucuccuucaaccuccgcgaccccgagcuccgcacccacaaccucaccgaccucuccccccaccuccgcuaccgcuuccagcuccaggccaccaccaaggagggccccggcgaggccaucguccgcgagggcggcaccauggcccucuccggcaucuccgacuucggcaacaucuccgccaccgccggcgagaacuacuccgucgucuccuggguccccaaggagggccagugcaacuuccgcuuccacauccucuucaaggcccucggcgaggagaagggcggcgccucccucuccccccaguacgucuccuacaaccaguccuccuacacccagugggaccuccagcccgacaccgacuacgagauccaccucuucaaggagcgcauguuccgccaccagauggccgucaagaccaacggcaccggccgcguccgccucccccccgccggcuucgccaccgagggcugguucaucggcuucgucuccgccaucauccuccuccuccucguccuccucauccucugcuucaucaagcgcuccaagggcggcaaguacuccgucaaggacaaggaggacacccaggucgacuccgaggcccgccccaugaaggacgagaccuucggcgaguaccgcucccucgaguccgacaacgaggagaaggccuucggcuccucccagcccucccucaacggcgacaucaagccccucggcuccgacgacucccucgccgacuacggcggcuccgucgacguccaguucaacgaggacggcuccuucaucggccaguacuccggcaagaaggagaaggaggccgccggcggcaacgacuccuccggcgccaccucccccaucaaccccgccgucgcccucgaguga

SEQ ID NO: 45230 - RNA, 1392 nt, Artificial Sequence
  derived and/or modified sequence opt2 from L2HGDH__Homo_sapiens__XP_005268132
augguccccgcccuccgcuaccucgucggcgccugcggccgcgcccgcggccucuucgccggcggcucccccggcgccugcggcuucgccuccggccgcccccgcccccucugcggcggcucccgcuccgccuccaccuccuccuucgacaucgucaucgucggcggcggcaucgucggccucgccuccgcccgcgcccucauccuccgccaccccucccucuccaucggcguccucgagaaggagaaggaccucgccguccaccagaccggccacaacuccggcgucauccacuccggcaucuacuacaagcccgagucccucaaggccaagcucugcguccagggcgccgcccuccucuacgaguacugccagcagaagggcaucuccuacaagcagugcggcaagcucaucgucgccgucgagcaggaggagaucccccgccuccaggcccucuacgagaagggccuccagaacggcguccccggccuccgccucauccagcaggaggacaucaagaagaaggagcccuacugccgcggccucauggccaucgacugcccccacaccggcaucgucgacuaccgccaggucgcccucuccuucgcccaggacuuccaggaggccggcggcuccguccucaccaacuucgaggucaagggcaucgagauggccaaggagucccccucccgcuccaucgacggcaugcaguaccccaucgucaucaagaacaccaagggcgaggagauccgcugccaguacgucgucaccugcgccggccucuacuccgaccgcaucuccgagcucuccggcugcacccccgacccccgcaucguccccuuccgcggcgacuaccuccuccucaagcccgagaagugcuaccucgucaagggcaacaucuaccccguccccgacucccgcuuccccuuccucggcguccacuucaccccccgcauggacggcuccaucuggcucggccccaacgccguccucgccuucaagcgcgagggcuaccgccccuucgacuucuccgccaccgacgucauggacaucaucaucaacuccggccucaucaagcucgccucccagaacuucuccuacggcgucaccgagauguacaaggccugcuuccucggcgccaccgucaaguaccuccagaaguucauccccgagaucaccaucuccgacauccuccgcggccccgccggcguccgcgcccaggcccucgaccgcgacggcaaccucgucgaggacuucgucuucgacgccggcgucggcgacaucggcaaccgcauccuccacguccgcaacgcccccucccccgccgccaccuccuccaucgccaucuccggcaugaucgccgacgagguccagcagcgcuucgagcucuga

SEQ ID NO: 45231 - RNA, 2319 nt, Artificial Sequence
  derived and/or modified sequence opt2 from L3MBTL1__Homo_sapiens__NP_056293
augcgccgccgcgagggccacggcaccgacuccgagaugggccagggccccguccgcgagucccaguccuccgacccccccgcccuccaguuccgcaucuccgaguacaagccccucaacauggccggcgucgagcagccccccucccccgagcuccgccaggagggcgucaccgaguacgaggacggcggcgcccccgccggcgacggcgaggccggcccccagcaggccgaggaccacccccagaacccccccgaggaccccaaccaggacccccccgaggacgacuccaccugccagugccaggccugcggcccccaccaggccgccggccccgaccucggcuccuccaacgacggcugcccccagcucuuccaggagcgcuccgucaucgucgagaacuccuccggcuccaccuccgccuccgagcuccucaagcccaugaagaagcgcaagcgccgcgaguaccagucccccuccgaggaggaguccgagcccgaggccauggagaagcaggaggagggcaaggaccccgagggccagcccaccgccuccacccccgaguccgaggagugguccuccucccagcccgccaccggcgagaagaaggagugcugguccugggaguccuaccucgaggagcagaaggccaucaccgcccccgucucccucuuccaggacucccaggccgucacccacaacaagaacggcuucaagcucggcaugaagcucgagggcaucgacccccagcaccccuccauguacuucauccucaccgucgccgaggucugcggcuaccgccuccgccuccacuucgacggcuacuccgagugccacgacuucugggucaacgccaacucccccgacauccaccccgccggcugguucgagaagaccggccacaagcuccagccccccaagggcuacaaggaggaggaguucuccuggucccaguaccuccgcuccacccgcgcccaggccgcccccaagcaccucuucgucucccagucccacuccccccccccccucggcuuccaggucggcaugaagcucgaggccgucgaccgcaugaaccccucccucgucugcgucgccuccgucaccgacgucgucgacucccgcuuccucguccacuucgacaacugggacgacaccuacgacuacuggugcgaccccuccucccccuacauccaccccgucggcuggugccagaagcagggcaagccccucacccccccccaggacuaccccgaccccgacaacuucugcugggagaaguaccucgaggagaccggcgccuccgccguccccaccugggccuucaagguccgccccccccacuccuuccucgucaacaugaagcucgaggccgucgaccgccgcaaccccgcccucauccgcgucgccuccgucgaggacgucgaggaccaccgcaucaagauccacuucgacggcuggucccacggcuacgacuucuggaucgacgccgaccaccccgacauccaccccgccggcuggugcuccaagaccggccacccccuccagcccccccucggcccccgcgagcccuccuccgccucccccggcggcugccccccccucuccuaccgcucccucccccacacccgcaccuccaaguacuccuuccaccaccgcaagugccccacccccggcugcgacggcuccggccacgucaccggcaaguucaccgcccaccacugccucuccggcugcccccucgccgagcgcaaccagucccgccucaaggccgagcucuccgacuccgaggccuccgcccgcaagaagaaccucuccggcuucuccccccgcaagaagccccgccaccacggccgcaucggccgcccccccaaguaccgcaagaucccccaggaggacuuccagacccucacccccgacgucguccaccagucccucuucauguccgcccucuccgcccaccccgaccgcucccucuccgucugcugggagcagcacugcaagcuccuccccggcgucgccggcaucuccgccuccaccgucgccaaguggaccaucgacgaggucuucggcuucguccagacccucaccggcugcgaggaccaggcccgccucuucaaggacgaggcccgcaucguccgcgucacccacgucuccggcaagacccucgucuggaccgucgcccagcucggcgaccucgucugcuccgaccaccuccaggagggcaagggcauccucgagaccggcguccacucccuccucugcucccuccccacccaccuccucgccaagcucuccuucgccuccgacucccaguacuga

SEQ ID NO: 45232 - RNA, 2118 nt, Artificial Sequence
  derived and/or modified sequence opt2 from L3MBTL2__Homo_sapiens__NP_113676
auggagaagccccgcuccaucgaggagacccccuccuccgagcccauggaggaggaggaggacgacgaccucgagcucuucggcggcuacgacuccuuccgcuccuacaacuccuccgucggcuccgaguccuccuccuaccucgaggaguccuccgaggccgagaacgaggaccgcgaggccggcgagcuccccaccuccccccuccaccuccucucccccggcaccccccgcucccucgacggcuccggcuccgagcccgccgucugcgagaugugcggcaucgucggcacccgcgaggccuucuucuccaagaccaagcgcuucugcuccgucuccugcucccgcuccuacuccuccaacuccaagaaggccuccauccucgcccgccuccagggcaagccccccaccaagaaggccaagguccuccacaaggccgccugguccgccaagaucggcgccuuccuccacucccagggcaccggccagcucgccgacggcacccccaccggccaggacgcccucguccucggcuucgacuggggcaaguuccucaaggaccacuccuacaaggccgcccccgucuccugcuucaagcacgucccccucuacgaccagugggaggacgucaugaagggcaugaaggucgagguccucaacuccgacgccguccuccccucccgcgucuacuggaucgccuccgucauccagaccgccggcuaccgcguccuccuccgcuacgagggcuucgagaacgacgccucccacgacuucuggugcaaccucggcaccgucgacguccaccccaucggcuggugcgccaucaacuccaagauccucguccccccccgcaccauccacgccaaguucaccgacuggaagggcuaccucaugaagcgccucgucggcucccgcacccuccccgucgacuuccacaucaagauggucgaguccaugaaguaccccuuccgccagggcaugcgccucgaggucgucgacaagucccaggucucccgcacccgcauggccgucgucgacaccgucaucggcggccgccuccgccuccucuacgaggacggcgacuccgacgacgacuucuggugccacaugugguccccccucauccaccccgucggcuggucccgccgcgucggccacggcaucaagauguccgagcgccgcuccgacauggcccaccaccccaccuuccgcaagaucuacugcgacgccguccccuaccucuucaagaagguccgcgccgucuacaccgagggcggcugguucgaggagggcaugaagcucgaggccaucgacccccucaaccucggcaacaucugcgucgccaccgucugcaagguccuccucgacggcuaccucaugaucugcgucgacggcggccccuccaccgacggccucgacugguucugcuaccacgccuccucccacgccaucuuccccgccaccuucugccagaagaacgacaucgagcucaccccccccaagggcuacgaggcccagaccuucaacugggagaacuaccucgagaagaccaaguccaaggccgcccccucccgccucuucaacauggacugccccaaccacggcuucaaggucggcaugaagcucgaggccgucgaccucauggagccccgccucaucugcgucgccaccgucaagcgcgucguccaccgccuccucuccauccacuucgacggcugggacuccgaguacgaccagugggucgacugcgagucccccgacaucuaccccgucggcuggugcgagcucaccggcuaccagcuccagccccccgucgccgccgagcccgccaccccccucaaggccaaggaggccaccaagaagaagaagaagcaguucggcaagaagcgcaagcgcaucccccccaccaagacccgcccccuccgccagggcuccaagaagccccuccucgaggacgacccccagggcgcccgcaagaucuccuccgagcccguccccggcgagaucaucgccguccgcgucaaggaggagcaccucgacgucgccucccccgacaaggccuccucccccgagcuccccgucuccgucgagaacaucaagcaggagaccgacgacuga

SEQ ID NO: 45233 - RNA, 2268 nt, Artificial Sequence
  derived and/or modified sequence opt2 from L3MBTL3__Homo_sapiens__NP_001007103
augaccgaguccgccuccuccaccuccggccaggaguucgacgucuucuccgucauggacuggaaggacggcgucggcacccuccccggcuccgaccucaaguuccgcgucaacgaguucggcgcccucgaggucaucaccgacgagaacgagauggagaacgucaagaaggccaccgccaccaccaccuggaugguccccaccgcccaggaggucuucuccgagaagaccggcaugcccuuccgccucaaggaccccgucaaggucgagggccuccaguucugcgagaacugcugccaguacggcaacgucgacgagugccucuccggcggcaacuacugcucccagaacugcgcccgccacaucaaggacaaggaccagaaggaggagcgcgacgucgaggaggacaacgaggaggaggaccccaagugcucccgcaagaagaagcccaagcucucccucaaggccgacaccaaggaggacggcgaggagcgcgacgacgagauggagaacaagcaggacguccgcauccuccgcggcucccagcgcgcccgccgcaagcgccgcggcgacuccgccguccucaagcagggccucccccccaagggcaagaaggccuggugcugggccuccuaccucgaggaggagaaggccgucgccguccccgccaagcucuucaaggagcaccaguccuuccccuacaacaagaacggcuucaaggucggcaugaagcucgagggcgucgaccccgagcaccaguccgucuacugcguccucaccgucgccgaggucugcggcuaccgcaucaagcuccacuucgacggcuacuccgacugcuacgacuucugggucaacgccgacgcccucgacauccaccccgucggcuggugcgagaagaccggccacaagcuccacccccccaagggcuacaaggaggaggaguucaacuggcagaccuaccucaagaccugcaaggcccaggccgcccccaagucccucuucgagaaccagaacaucaccgucauccccuccggcuuccgcgucggcaugaagcucgaggccgucgacaagaagaaccccuccuucaucugcgucgccaccgucaccgacauggucgacaaccgcuuccucguccacuucgacaacugggacgaguccuacgacuacuggugcgaggccuccuccccccacauccaccccgucggcuggugcaaggagcaccgccgcacccucaucaccccccccggcuaccccaacgucaagcacuucuccugggacaaguaccucgaggagaccaacucccuccccgcccccgcccgcgccuucaaggucaagcccccccacggcuuccagaagaagaugaagcucgaggucgucgacaagcgcaaccccauguucauccgcgucgccaccgucgccgacaccgacgaccaccgcgucaagguccacuucgacggcuggaacaacugcuacgacuacuggaucgacgccgacucccccgacauccaccccgucggcuggugcuccaagaccggccacccccuccagcccccccucuccccccucgagcucauggaggccuccgagcacggcggcugcuccacccccggcugcaagggcaucggccacuucaagcgcgcccgccaccucggcccccacuccgccgccaacugccccuacuccgagaucaaccucaacaaggaccgcaucuuccccgaccgccucuccggcgagaugccccccgccucccccuccuucccccgcaacaagcgcaccgacgccaacgaguccuccuccucccccgagauccgcgaccagcacgccgacgacgucaaggaggacuucgaggagcgcaccgaguccgagaugcgcaccucccacgaggcccgcggcgcccgcgaggagcccaccguccagcaggcccagcgccgcuccgccgucuuccucuccuucaagucccccauccccugccucccccuccgcugggagcagcaguccaagcuccuccccaccgucgccggcauccccgccuccaaggucuccaagugguccaccgacgaggucuccgaguucauccagucccuccccggcugcgaggagcacggcaaggucuucaaggacgagcagaucgacggcgaggccuuccuccucaugacccagaccgacaucgucaagaucauguccaucaagcucggccccgcccucaagaucuucaacuccauccucauguucaaggccgccgagaagaacucccacaacgagcucuga

SEQ ID NO: 45234 - RNA, 1872 nt, Artificial Sequence
  derived and/or modified sequence opt2 from L3MBTL4__Homo_sapiens__NP_775735
augaagcagcccaaccgcaagcgcaagcucaacauggacuccaaggagcgccucgaccaggacggccgccucgagcaggccgaggaggagaagaagcccaaggacuccaccaccccccucucccacguccccuccgccgccgcccagggcgccugguccugggagugguaccucaaggagcagaaggccgucgccgcccccgucgagcucuucuccaaggaccaguccuuccccgagcacgagaacggcuuccagaucggcaugcgccucgagggcaucgacccccgccaccccuccgucuucugcguccucuccgucgccgaggucugcggcuaccgccuccgccuccacuucgacggcuaccucuccugcuacgacuucuggaccaacgccggcucccccgacauccaccccgucggcuggugcgagaagaccaagcacgagcuccacauccccaagggcuaccgcaaggacaaguucgucuggauggacuaccucaaggccugcaagcuccagaacgcccccaagaagcucuuccgcaaccgcucccccaacggccccauguccaaggaguuccaggucggcaugaagcucgaggccgucgaccgcaagaaccccucccucgucugcgucgccaccaucgccgacaucgucgaggaccgccuccucguccacuucgacaacugggacgacuccuacgacuacuggugcgacgucaacucccccuacguccagcccgucggcuggugccaggagaacggccgcacccucaucgccccccagggcuaccccaaccccgagaacuucuccuggaccgaguaccucgaggccacccagaccaacgccguccccgccaaggucuucaagaugcgccucccccacggcuuccuccccaacaugaagcucgaggucgucgacaagcgcaacccccgccucauccgcgucgccaccaucgucgacgucgacgaccagcgcgucaagguccacuucgacggcugggaccacaaguacgacuacugggucgaggccgacucccccgacauccaccccaucggcuggugcgacgucaccggccacccccucgaggucccccagcgcaccaacgaccucaagauccuccccggccaggccgucugccccacccccggcugccgcggcaucggccacauccgcggcccccgcuacuccggccaccacuccgccuucggcugccccuacuccgacaugaaccucaagaaggaggccacccuccacgaccgccuccgcgagcagacccaggccaaccucgaguccgacuccucccacuccaaguccaagucccucugcucccucaacuucaacggcaagcacgagaaggucaacucccagccccgccucguccagcaggccaagugccucaagaucaagggcaaggaggacaucgaccucgacaaccucuuccgcguccucguccuccacccccgcggccucgaguacuccgucgagcaggcccagcagguccuccaccaguccgucuccauguccaccgucuccgcccaccccuuccgcgaccucccccucggccgcgagcagcacugcaagcuccuccccggcgucgccgacauccgcgccucccaggucgcccgcuggaccgucgacgaggucgccgaguucguccagucccuccucggcugcgaggagcacgccaagugcuucaagaaggagcagaucgacggcaaggccuuccuccuccucacccagaccgacaucgucaaggucaugaagaucaagcucggccccgcccucaagaucuacaacuccauccucauguuccgccacucccaggagcuccccgaggaggacaucgccuccggccaggagguccgcggcuga

SEQ ID NO: 45235 - RNA, 1293 nt, Artificial Sequence
  derived and/or modified sequence opt2 from LACC1__Homo_sapiens__XP_006719829
auggccgaggccguccucaucgaccucuucggccucaagcucaacucccagaagaacugccaccagacccuccucaagacccucaacgccguccaguaccaccacgccgccaaggccaaguuccucugcaucaugugcugcuccaacaucuccuacgagcgcgacggcgagcaggacaacugcgagaucgagaccuccaacggccucuccgcccuccucgaggaguucgagaucgucuccugccccuccauggccgccacccucuacaccaucaagcagaagaucgacgagaagaaccucuccuccaucaaggucaucgucccccgccaccgcaagacccucaugaaggccuucaucgaccagcucuucaccgacgucuacaacuucgaguucgaggaccuccaggucaccuuccgcggcggccucuucaagcaguccaucgagaucaacgucaucaccgcccaggagcuccgcggcauccagaacgagaucgagaccuuccuccgcucccuccccgcccuccgcggcaagcucaccaucaucaccuccucccucauccccgacaucuucauccacggcuucaccacccgcaccggcggcaucuccuacauccccacccucuccuccuucaaccucuucuccuccuccaagcgccgcgaccccaaggucgucguccaggagaaccuccgccgccucgccaacgccgccggcuucaacgucgagaaguucuaccgcaucaagacccaccacuccaacgacaucuggaucaugggccgcaaggagcccgacuccuacgacggcaucaccaccaaccagcgcggcgucaccaucgccgcccucggcgccgacugcauccccaucgucuucgccgaccccgucaagaaggccugcggcgucgcccacgccggcuggaagggcacccuccucggcgucgccauggccaccgucaacgccaugaucgccgaguacggcugcucccucgaggacaucgucgucguccucggccccuccgucggccccugcugcuucacccucccccgcgaguccgccgaggccuuccacaaccuccaccccgccugcguccagcucuucgacucccccaaccccugcaucgacauccgcaaggccacccgcauccuccucgagcagggcggcauccucccccagaacauccaggaccagaaccaggaccucaaccucugcaccuccugccaccccgacaaguucuucucccacguccgcgacggccucaacuucggcacccagaucggcuucaucuccaucaaggaguga

SEQ ID NO: 45236 - RNA, 1446 nt, Artificial Sequence
  derived and/or modified sequence opt2 from LACE1__Homo_sapiens__NP_660358
auggccgccuccuggucccuccucgucacccuccgcccccucgcccaguccccccuccgcggccgcugcgucggcugcggcgccugggccgccgcccucgccccccucgccaccgcccccggcaagcccuucuggaaggccuacaccguccagaccuccgaguccaugacccccaccgccaccuccgagaccuaccucaaggcccucgccgucugccacggcccccucgaccacuacgacuuccucaucaaggcccacgagcucaaggacgacgagcaccagcgccgcgucauccagugccuccagaagcuccacgaggaccucaagggcuacaacaucgaggccgagggccucuucuccaagcucuucucccgcuccaagcccccccgcggccucuacgucuacggcgacgucggcaccggcaagaccauggucauggacauguucuacgccuacgucgagaugaagcgcaagaagcgcguccacuuccacggcuucaugcucgacguccacaagcgcauccaccgccucaagcagucccuccccaagcgcaagcccggcuucauggccaaguccuacgaccccaucgcccccaucgccgaggagaucuccgaggaggccugccuccucugcuucgacgaguuccaggucaccgacaucgccgacgccaugauccucaagcagcucuucgagaaccucuucaagaacggcgucgucgucgucgccaccuccaaccgcccccccgaggaccucuacaagaacggccuccagcgcgccaacuucguccccuucaucgccguccucaaggaguacugcaacaccguccagcucgacuccggcaucgacuaccgcaagcgcgagcuccccgccgccggcaagcucuacuaccucaccuccgaggccgacgucgaggccgucauggacaagcucuucgacgagcucgcccagaagcagaacgaccucacccgcccccgcauccucaagguccagggccgcgagcuccgccucaacaaggccugcggcaccgucgccgacugcaccuucgaggagcucugcgagcgcccccucggcgccuccgacuaccucgagcucuccaagaacuucgacaccaucuuccuccgcaacaucccccaguucacccucgccaaccgcacccagggccgccgcuucaucacccucaucgacaacuucuacgaccucaagguccgcaucaucugcuccgccuccacccccaucuccucccucuuccuccaccagcaccacgacuccgagcucgagcagucccgcauccucauggacgaccucggccucucccaggacuccgccgagggccucuccauguucaccggcgaggaggagaucuucgccuuccagcgcaccaucucccgccucaccgagaugcagaccgagcaguacuggaacgagggcgaccgcaccaagaaguga

SEQ ID NO: 45237 - RNA, 417 nt, Artificial Sequence
  derived and/or modified sequence opt2 from LACRT__Homo_sapiens__NP_150593
augaaguucaccacccuccucuuccucgccgccgucgccggcgcccucgucuacgccgaggacgccuccuccgacuccaccggcgccgaccccgcccaggaggccggcaccuccaagcccaacgaggagaucuccggccccgccgagcccgccuccccccccgagaccaccaccaccgcccaggagaccuccgccgccgccguccagggcaccgccaaggucaccuccucccgccaggagcucaacccccucaaguccaucgucgagaaguccauccuccucaccgagcaggcccucgccaaggccggcaagggcaugcacggcggcguccccggcggcaagcaguucaucgagaacggcuccgaguucgcccagaagcuccucaagaaguucucccuccucaagcccugggccuga

SEQ ID NO: 45238 - RNA, 1644 nt, Artificial Sequence
  derived and/or modified sequence opt2 from LACTB__Homo_sapiens__NP_116246
auguaccgccucauguccgccgucaccgcccgcgccgccgcccccggcggccucgccuccuccugcggccgccgcggcguccaccagcgcgccggccuccccccccucggccacggcugggucggcggccucggccucggccucggccucgcccucggcgucaagcucgccggcggccuccgcggcgccgcccccgcccagucccccgccgcccccgaccccgaggccuccccccucgccgagcccccccaggagcagucccucgcccccugguccccccagacccccgccccccccugcucccgcugcuucgcccgcgccaucgaguccucccgcgaccuccuccaccgcaucaaggacgaggucggcgcccccggcaucgucgucggcgucuccgucgacggcaaggaggucugguccgagggccucggcuacgccgacgucgagaaccgcguccccugcaagcccgagaccgucaugcgcaucgccuccaucuccaagucccucaccauggucgcccucgccaagcucugggaggccggcaagcucgaccucgacauccccguccagcacuacguccccgaguuccccgagaaggaguacgagggcgagaaggucuccgucaccacccgccuccucaucucccaccucuccggcauccgccacuacgagaaggacaucaagaaggucaaggaggagaaggccuacaaggcccucaagaugaugaaggagaacgucgccuucgagcaggagaaggagggcaaguccaacgagaagaacgacuucaccaaguucaagaccgagcaggagaacgaggccaagugccgcaacuccaagcccggcaagaagaagaacgacuucgagcagggcgagcucuaccuccgcgagaaguucgagaacuccaucgagucccuccgccucuucaagaacgacccccucuucuucaagcccggcucccaguuccucuacuccaccuucggcuacacccuccucgccgccaucgucgagcgcgccuccggcugcaaguaccucgacuacaugcagaagaucuuccacgaccucgacaugcucaccaccguccaggaggagaacgagcccgucaucuacaaccgcgcccgcuucuacgucuacaacaagaagaagcgccucgucaacacccccuacgucgacaacuccuacaagugggccggcggcggcuuccucuccaccgucggcgaccuccucaaguucggcaacgccaugcucuacggcuaccaggucggccucuucaagaacuccaacgagaaccuccuccccggcuaccucaagcccgagaccauggucaugauguggacccccguccccaacaccgagauguccugggacaaggagggcaaguacgccauggccuggggcgucgucgagcgcaagcagaccuacggcuccugccgcaagcagcgccacuacgccucccacaccggcggcgccgucggcgccuccuccguccuccucguccuccccgaggagcucgacaccgagaccaucaacaacaagguccccccccgcggcaucaucgucuccaucaucugcaacaugcaguccgucggccucaacuccaccgcccucaagaucgcccucgaguucgacaaggaccgcuccgacuga

SEQ ID NO: 45239 - RNA, 1554 nt, Artificial Sequence
  derived and/or modified sequence opt2 from LAD1__Homo_sapiens__NP_005549
auggccgucucccgcaaggacugguccgcccucuccucccucgcccgccagcgcacccucgaggacgaggaggagcaggagcgcgagcgccgccgccgccaccgcaaccucuccuccaccaccgacgacgaggccccccgccucucccagaacggcgaccgccaggccuccgccuccgagcgccuccccuccgucgaggaggccgagguccccaagccccucccccccgccuccaaggacgaggacgaggacauccaguccauccuccgcacccgccaggagcgccgccagcgccgccaggucgucgaggccgcccaggcccccauccaggagcgccucgaggccgaggagggccgcaacucccucucccccguccaggccacccagaagccccucgucuccaagaaggagcucgagauccccccccgccgccgccucucccgcgagcagcgcggccccugggcccucgaggaggagucccucgucggccgcgagcccgaggagcgcaagaagggcguccccgagaagucccccguccucgagaaguccuccaugcccaagaagaccgcccccgagaagucccucgucuccgacaagaccuccaucuccgagaagguccucgccuccgagaagaccucccucuccgagaagaucgccgucuccgagaagcgcaacuccuccgagaagaaguccguccucgagaagaccuccgucuccgagaagucccucgcccccggcauggcccucggcuccggccgccgccucgucuccgagaaggccuccaucuucgagaaggcccucgccuccgagaagucccccaccgccgacgccaagcccgcccccaagcgcgccaccgccuccgagcagccccucgcccaggagccccccgccuccggcggcucccccgccaccaccaaggagcagcgcggccgcgcccuccccggcaagaaccuccccucccucgccaagcagggcgccuccgacccccccaccgucgccucccgccucccccccgucacccuccaggucaagauccccuccaaggaggaggaggccgacauguccucccccacccagcgcaccuacuccuccucccucaagcgcuccuccccccgcaccaucuccuuccgcaugaagcccaagaaggagaacuccgagaccacccucacccgcuccgccuccaugaagcuccccgacaacaccgucaagcucggcgagaagcucgagcgcuaccacaccgccauccgccgcuccgaguccgucaagucccgcggccuccccugcaccgagcucuucgucgcccccgucggcgucgccuccaagcgccaccucuucgagaaggagcucgccggccagucccgcgccgagcccgccuccucccgcaaggagaaccuccgccucuccggcgucgucaccucccgccucaaccucuggaucucccgcacccaggaguccggcgaccaggacccccaggaggcccagaaggccuccuccgccaccgagcgcacccaguggggccagaaguccgacuccucccucgacgccgaggucuga

SEQ ID NO: 45240 - RNA, 1578 nt, Artificial Sequence
  derived and/or modified sequence opt2 from LAG3__Homo_sapiens__NP_002277
augugggaggcccaguuccucggccuccucuuccuccagccccucugggucgcccccgucaagccccuccagcccggcgccgagguccccgucgucugggcccaggagggcgcccccgcccagcuccccugcucccccaccaucccccuccaggaccucucccuccuccgccgcgccggcgucaccuggcagcaccagcccgacuccggcccccccgccgccgcccccggccacccccucgcccccggcccccaccccgccgcccccuccuccuggggcccccgcccccgccgcuacaccguccucuccgucggccccggcggccuccgcuccggccgccucccccuccagccccgcguccagcucgacgagcgcggccgccagcgcggcgacuucucccucuggcuccgccccgcccgccgcgccgacgccggcgaguaccgcgccgccguccaccuccgcgaccgcgcccucuccugccgccuccgccuccgccucggccaggccuccaugaccgccuccccccccggcucccuccgcgccuccgacugggucauccucaacugcuccuucucccgccccgaccgccccgccuccguccacugguuccgcaaccgcggccagggccgcguccccguccgcgaguccccccaccaccaccucgccgaguccuuccucuuccucccccaggucucccccauggacuccggccccuggggcugcauccucaccuaccgcgacggcuucaacgucuccaucauguacaaccucaccguccucggccucgagccccccaccccccucaccgucuacgccggcgccggcucccgcgucggccuccccugccgccuccccgccggcgucggcacccgcuccuuccucaccgccaaguggaccccccccggcggcggccccgaccuccucgucaccggcgacaacggcgacuucacccuccgccucgaggacgucucccaggcccaggccggcaccuacaccugccacauccaccuccaggagcagcagcucaacgccaccgucacccucgccaucaucaccgucacccccaaguccuucggcucccccggcucccucggcaagcuccucugcgaggucacccccgucuccggccaggagcgcuucgucugguccucccucgacacccccucccagcgcuccuucuccggccccuggcucgaggcccaggaggcccagcuccucucccagcccuggcagugccagcucuaccagggcgagcgccuccucggcgccgccgucuacuucaccgagcucuccucccccggcgcccagcgcuccggccgcgcccccggcgcccuccccgccggccaccuccuccucuuccucauccucggcguccucucccuccuccuccucgucaccggcgccuucggcuuccaccucuggcgccgccaguggcgcccccgccgcuucuccgcccucgagcagggcauccaccccccccaggcccaguccaagaucgaggagcucgagcaggagcccgagcccgagcccgagcccgagcccgagcccgagcccgagcccgagcccgagcagcucuga

SEQ ID NO: 45241 - RNA, 843 nt, Artificial Sequence
  derived and/or modified sequence opt2 from LAIR1__Homo_sapiens__NP_001275955
auggagcgcgagaugguccucugccucgcccagaccauccacacccaggaggaccucccccgccccuccaucuccgccgagcccggcaccgucaucccccucggcucccacgucaccuucgucugccgcggccccgucggcguccagaccuuccgccucgagcgcgacucccgcuccaccuacaacgacaccgaggacgucucccaggccucccccuccgaguccgaggcccgcuuccgcaucgacuccguccgcgagggcaacgccggccucuaccgcugcaucuacuacaagccccccaagugguccgagcaguccgacuaccucgagcuccucgucaaggaguccuccggcggccccgacucccccgacaccgagcccggcuccuccgccggccccacccagcgccccuccgacaacucccacaacgagcacgcccccgccucccagggccucaaggccgagcaccucuacauccucaucggcgucuccgucgucuuccucuucugccuccuccuccucguccucuucugccuccaccgccagaaccagaucaagcagggccccccccgcuccaaggacgaggagcagaagccccagcagcgccccgaccucgccgucgacguccucgagcgcaccgccgacaaggccaccgucaacggccuccccgagaaggaccgcgagaccgacaccuccgcccucgccgccggcuccucccaggaggucaccuacgcccagcucgaccacugggcccucacccagcgcaccgcccgcgccgucuccccccaguccaccaagcccauggccgaguccaucaccuacgccgccgucgcccgccacuga

SEQ ID NO: 45242 - RNA, 459 nt, Artificial Sequence
  derived and/or modified sequence opt2 from LAIR2__Homo_sapiens__NP_002279
auguccccccaccucaccgcccuccucggccucguccucugccucgcccagaccauccacacccaggagggcgcccucccccgccccuccaucuccgccgagcccggcaccgucaucucccccggcucccacgucaccuucaugugccgcggccccgucggcguccagaccuuccgccucgagcgcgaggaccgcgccaaguacaaggacuccuacaacgucuuccgccucggccccuccgaguccgaggcccgcuuccacaucgacuccgucuccgagggcaacgccggccucuaccgcugccucuacuacaagccccccggcugguccgagcacuccgacuuccucgagcuccucgucaaggaguccuccggcggccccgacucccccgacaccgagcccggcuccuccgccggcaccguccccggcaccgaggccuccggcuucgacgcccccuga

SEQ ID NO: 45243 - RNA, 462 nt, Artificial Sequence
  derived and/or modified sequence opt2 from LALBA__Homo_sapiens__XP_011536644
auggaggaccuccaguuccucggcgucgccaagaugcgcuucuucgucccccucuuccucgucggcauccucuuccccgccauccucgccaagcaguucaccaagugcgagcucucccagcuccucaaggacaucgacggcuacggcggcaucgcccuccccgagcucaucugcaccauguuccacaccuccggcuacgacacccaggccaucgucgagaacaacgaguccaccgaguacggccucuuccagaucuccaacaagcucuggugcaaguccucccaggucccccagucccgcaacaucugcgacaucuccugcgacaaguuccucgacgacgacaucaccgacgacaucaugugcgccaagaagauccucgacaucaagggcaucgacuacuggcucgcccacaaggcccucugcaccgagaagcucgagcaguggcucugcgagaagcucuga

SEQ ID NO: 45244 - RNA, 9228 nt, Artificial Sequence
  derived and/or modified sequence opt2 from LAMA1__Homo_sapiens__NP_005550
augcgcggcggcguccuccucguccuccuccucugcgucgccgcccagugccgccagcgcggccucuuccccgccauccucaaccucgccuccaacgcccacaucuccaccaacgccaccugcggcgagaagggccccgagauguucugcaagcucgucgagcacguccccggccgccccguccgcaacccccagugccgcaucugcgacggcaacuccgccaacccccgcgagcgccaccccaucucccacgccaucgacggcaccaacaacugguggcagucccccuccauccagaacggccgcgaguaccacugggucaccaucacccucgaccuccgccaggucuuccaggucgccuacgucaucaucaaggccgccaacgccccccgccccggcaacuggauccucgagcgcucccucgacggcaccaccuucucccccuggcaguacuacgccgucuccgacuccgagugccucucccgcuacaacaucaccccccgccgcggcccccccaccuaccgcgccgacgacgaggucaucugcaccuccuacuacucccgccucgucccccucgagcacggcgagauccacaccucccucaucaacggccgccccuccgccgacgaccucucccccaagcuccucgaguucaccuccgcccgcuacauccgccuccgccuccagcgcauccgcacccucaacgccgaccucaugacccucucccaccgcgagcccaaggagcucgaccccaucgucacccgccgcuacuacuacuccaucaaggacaucuccgucggcggcaugugcaucugcuacggccacgccuccuccugccccugggacgagaccaccaagaagcuccagugccagugcgagcacaacaccugcggcgaguccugcaaccgcugcugccccggcuaccaccagcagcccuggcgccccggcaccgucuccuccggcaacaccugcgaggccugcaacugccacaacaaggccaaggacugcuacuacgacgaguccgucgccaagcagaagaagucccucaacaccgccggccaguuccgcggcggcggcgucugcaucaacugccuccagaacaccaugggcaucaacugcgagaccugcaucgacggcuacuaccgcccccacaaggucucccccuacgaggacgagcccugccgccccugcaacugcgaccccgucggcucccucuccuccgucugcaucaaggacgaccuccacuccgaccuccacaacggcaagcagcccggccagugccccugcaaggagggcuacaccggcgagaagugcgaccgcugccagcucggcuacaaggacuaccccaccugcgucuccugcggcugcaaccccgucggcuccgccuccgacgagcccugcaccggccccugcgucugcaaggagaacgucgagggcaaggccugcgaccgcugcaagcccggcuucuacaaccucaaggagaagaacccccgcggcugcuccgagugcuucugcuucggcgucuccgacgucugcuccucccucuccuggcccgucggccaggucaacuccauguccggcuggcucgucaccgaccucaucuccccccgcaagauccccucccagcaggacgcccucggcggccgccaccaggucuccaucaacaacaccgccgucaugcagcgccucgcccccaaguacuacugggccgcccccgaggccuaccucggcaacaagcucaccgccuucggcggcuuccucaaguacaccgucuccuacgacauccccgucgagaccgucgacuccaaccucaugucccacgccgacgucaucaucaagggcaacggccucacccucuccacccaggccgagggccucucccuccagcccuacgaggaguaccucaacgucguccgccucguccccgagaacuuccaggacuuccacuccaagcgccagaucgaccgcgaccagcucaugaccguccucgccaacgucacccaccuccucauccgcgccaacuacaacuccgccaagauggcccucuaccgccucgaguccgucucccucgacaucgccuccuccaacgccaucgaccucgucgucgccgccgacgucgagcacugcgagugcccccagggcuacaccggcaccuccugcgaguccugccucuccggcuacuaccgcgucgacggcauccucuucggcggcaucugccagcccugcgagugccacggccacgccgccgagugcaacguccacggcgucugcaucgccugcgcccacaacaccaccggcguccacugcgagcagugccuccccggcuucuacggcgagcccucccgcggcacccccggcgacugccagcccugcgccugcccccucaccaucgccuccaacaacuucucccccaccugccaccucaacgacggcgacgaggucgucugcgacuggugcgcccccggcuacuccggcgccuggugcgagcgcugcgccgacggcuacuacggcaaccccaccguccccggcgaguccugcguccccugcgacugcuccggcaacgucgaccccuccgaggccggccacugcgacuccgucaccggcgagugccucaagugccucggcaacaccgacggcgcccacugcgagcgcugcgccgacggcuucuacggcgacgccgucaccgccaagaacugccgcgccugcgagugccacgucaagggcucccacuccgccgucugccaccucgagaccggccucugcgacugcaagcccaacgucaccggccagcagugcgaccagugccuccacggcuacuacggccucgacuccggccacggcugccgccccugcaacugcuccgucgccggcuccgucuccgacggcugcaccgacgagggccagugccacugcguccccggcgucgccggcaagcgcugcgaccgcugcgcccacggcuucuacgccuaccaggacggcuccugcacccccugcgacugcccccacacccagaacaccugcgaccccgagaccggcgagugcgucugccccccccacacccagggcgucaagugcgaggagugcgaggacggccacuggggcuacgacgccgaggucggcugccaggccugcaacugcucccucgucggcuccacccaccaccgcugcgacgucgucaccggccacugccagugcaaguccaaguucggcggccgcgccugcgaccagugcucccucggcuaccgcgacuuccccgacugcguccccugcgacugcgaccuccgcggcaccuccggcgacgccugcaaccucgagcagggccucugcggcugcgucgaggagaccggcgccugccccugcaaggagaacgucuucggcccccagugcaacgagugccgcgagggcaccuucgcccuccgcgccgacaacccccucggcugcucccccugcuucugcuccggccucucccaccucugcuccgagcucgaggacuacguccgcacccccgucacccucggcuccgaccagccccuccuccgcgucgucucccaguccaaccuccgcggcaccaccgagggcgucuacuaccaggcccccgacuuccuccucgacgccgccaccguccgccagcacauccgcgccgagcccuucuacuggcgccucccccagcaguuccagggcgaccagcucauggccuacggcggcaagcucaaguacuccgucgccuucuacucccucgacggcgucggcaccuccaacuucgagccccagguccucaucaagggcggccgcauccgcaagcaggucaucuacauggacgcccccgcccccgagaacggcguccgccaggagcaggaggucgccaugcgcgagaacuucuggaaguacuucaacuccgucuccgagaagcccgucacccgcgaggacuucauguccguccucuccgacaucgaguacauccucaucaaggccuccuacggccagggccuccagcagucccgcaucuccgacaucuccauggaggucggccgcaaggccgagaagcuccaccccgaggaggaggucgccucccuccucgagaacugcgucugcccccccggcaccgucggcuucuccugccaggacugcgcccccggcuaccaccgcggcaagcuccccgccggcuccgaccgcggcccccgcccccucgucgcccccugcguccccugcuccugcaacaaccacuccgacaccugcgaccccaacaccggcaagugccucaacugcggcgacaacaccgccggcgaccacugcgacgucugcaccuccggcuacuacggcaaggucaccggcuccgccuccgacugcgcccucugcgccugcccccacuccccccccgccuccuucucccccaccugcguccucgagggcgaccacgacuuccgcugcgacgccugccuccucggcuacgagggcaagcacugcgagcgcugcuccuccuccuacuacggcaacccccagacccccggcggcuccugccagaagugcgacugcaacccccacggcuccguccacggcgacugcgaccgcaccuccggccagugcgucugccgccucggcgccuccggccuccgcugcgacgagugcgagccccgccacauccucauggagaccgacugcgucuccugcgacgacgagugcgucggcguccuccucaacgaccucgacgagaucggcgacgccguccucucccucaaccucaccggcaucauccccguccccuacggcauccucuccaaccucgagaacaccaccaaguaccuccaggagucccuccucaaggagaacaugcagaaggaccucggcaagaucaagcucgagggcgucgccgaggagaccgacaaccuccagaagaagcucacccgcaugcucgccuccacccagaaggucaaccgcgccaccgagcgcaucuucaaggagucccaggaccucgccaucgccaucgagcgccuccagauguccaucaccgagaucauggagaagaccacccucaaccagacccucgacgaggacuuccuccuccccaacuccacccuccagaacaugcagcagaacggcaccucccuccucgagaucaugcagauccgcgacuucacccagcuccaccagaacgccacccucgagcucaaggccgccgaggaccuccucucccagauccaggagaacuaccagaagccccucgaggagcucgagguccucaaggaggccgccucccacguccucuccaagcacaacaacgagcucaaggccgccgaggcccucguccgcgaggccgaggccaagaugcaggaguccaaccaccuccuccucauggucaacgccaaccuccgcgaguucuccgacaagaagcuccacguccaggaggagcagaaccucaccuccgagcucaucguccagggccgcggccucaucgacgccgccgccgcccagaccgacgccguccaggacgcccucgagcaccucgaggaccaccaggacaagcuccuccucugguccgccaagauccgccaccacaucgacgaccucgucaugcacaugucccagcgcaacgccgucgaccucgucuaccgcgccgaggaccacgccgccgaguuccagcgccucgccgacguccucuacuccggccucgagaacauccgcaacgucucccucaacgccaccuccgccgccuacguccacuacaacauccagucccucaucgaggaguccgaggagcucgcccgcgacgcccaccgcaccgucaccgagaccucccuccucuccgagucccucgucuccaacggcaaggccgccguccagcgcuccucccgcuuccucaaggagggcaacaaccucucccgcaagcuccccggcaucgcccucgagcucuccgagcuccgcaacaagaccaaccgcuuccaggagaacgccgucgagaucacccgccagaccaacgagucccuccucauccuccgcgccauccccaagggcauccgcgacaagggcgccaagaccaaggagcucgccaccuccgccucccaguccgccgucuccacccuccgcgacgucgccggccucucccaggagcuccucaacaccuccgccucccucucccgcgucaacaccacccuccgcgagacccaccagcuccuccaggacuccaccauggccacccuccucgccggccgcaaggucaaggacgucgagauccaggccaaccuccucuucgaccgccucaagccccucaagaugcucgaggagaaccucucccgcaaccucuccgagaucaagcuccucaucucccaggcccgcaagcaggccgccuccaucaaggucgccgucuccgccgaccgcgacugcauccgcgccuaccagccccagaucuccuccaccaacuacaacacccucacccucaacgucaagacccaggagcccgacaaccuccucuucuaccucggcuccuccaccgccuccgacuuccucgccgucgagaugcgccgcggccgcgucgccuuccucugggaccucggcuccggcuccacccgccucgaguuccccgacuuccccaucgacgacaaccgcuggcacuccauccacgucgcccgcuucggcaacaucggcucccucuccgucaaggagauguccuccaaccagaagucccccaccaagaccuccaagucccccggcaccgccaacguccucgacgucaacaacuccacccucauguucgucggcggccucggcggccagaucaagaagucccccgccgucaaggucacccacuucaagggcugccucggcgaggccuuccucaacggcaaguccaucggccucuggaacuacaucgagcgcgagggcaagugccgcggcugcuucggcuccucccagaacgaggaccccuccuuccacuucgacggcuccggcuacuccgucgucgagaagucccuccccgccaccgucacccagaucaucaugcucuucaacaccuucucccccaacggccuccuccucuaccucggcuccuacggcaccaaggacuuccucuccaucgagcucuuccgcggccgcgucaaggucaugaccgaccucggcuccggccccaucacccuccucaccgaccgccgcuacaacaacggcaccugguacaagaucgccuuccagcgcaaccgcaagcagggcguccucgccgucaucgacgccuacaacaccuccaacaaggagaccaagcagggcgagacccccggcgccuccuccgaccucaaccgccucgacaaggaccccaucuacgucggcggccucccccgcucccgcgucguccgccgcggcgucaccaccaaguccuucgucggcugcaucaagaaccucgagaucucccgcuccaccuucgaccuccuccgcaacuccuacggcguccgcaagggcugccuccucgagcccauccgcuccgucuccuuccucaagggcggcuacaucgagcucccccccaagucccucucccccgaguccgaguggcucgucaccuucgccaccaccaacuccuccggcaucauccucgccgcccucggcggcgacgucgagaagcgcggcgaccgcgaggaggcccacguccccuucuucuccgucaugcucaucggcggcaacaucgagguccacgucaaccccggcgacggcaccggccuccgcaaggcccuccuccacgcccccaccggcaccugcuccgacggccaggcccacuccaucucccucguccgcaaccgccgcaucaucaccguccagcucgacgagaacaaccccgucgagaugaagcucggcacccucgucgagucccgcaccaucaacgucuccaaccucuacgucggcggcauccccgagggcgagggcaccucccuccucaccaugcgccgcuccuuccacggcugcaucaagaaccucaucuucaaccucgagcuccucgacuucaacuccgccgucggccacgagcaggucgaccucgacaccugcuggcucuccgagcgccccaagcucgcccccgacgccgaggacuccaagcuccuccccgagccccgcgccuuccccgagcagugcgucgucgacgccgcccucgaguacguccccggcgcccaccaguucggccucacccagaacucccacuucauccuccccuucaaccaguccgccguccgcaagaagcucuccgucgagcucuccauccgcaccuucgccuccuccggccucaucuacuacauggcccaccagaaccaggccgacuacgccguccuccagcuccacggcggccgccuccacuucauguucgaccucggcaagggccgcaccaaggucucccaccccgcccuccucuccgacggcaaguggcacaccgucaagaccgacuacgucaagcgcaagggcuucaucaccgucgacggccgcgagucccccauggucaccgucgucggcgacggcaccaugcucgacgucgagggccucuucuaccucggcggccuccccucccaguaccaggcccgcaagaucggcaacaucacccacuccauccccgccugcaucggcgacgucaccgucaacuccaagcagcucgacaaggacucccccgucuccgccuucaccgucaaccgcugcuacgccgucgcccaggagggcaccuacuucgacggcuccggcuacgccgcccucgucaaggagggcuacaagguccaguccgacgucaacaucacccucgaguuccgcaccuccucccagaacggcguccuccucggcaucuccaccgccaaggucgacgccaucggccucgagcucgucgacggcaagguccucuuccacgucaacaacggcgccggccgcaucaccgccgccuacgagcccaagaccgccaccguccucugcgacggcaaguggcacacccuccaggccaacaaguccaagcaccgcaucacccucaucgucgacggcaacgccgucggcgccgaguccccccacacccaguccaccuccgucgacaccaacaaccccaucuacgucggcggcuaccccgccggcgucaagcagaagugccuccgcucccagaccuccuuccgcggcugccuccgcaagcucgcccucaucaaguccccccagguccaguccuucgacuucucccgcgccuucgagcuccacggcgucuuccuccacuccugccccggcaccgaguccuga

SEQ ID NO: 45245 - RNA, 9369 nt, Artificial Sequence
  derived and/or modified sequence opt2 from LAMA2__Homo_sapiens__NP_000417
augcccggcgccgccggcguccuccuccuccuccuccucuccggcggccucggcggcguccaggcccagcgcccccagcagcagcgccagucccaggcccaccagcagcgcggccucuuccccgccguccucaaccucgccuccaacgcccucaucaccaccaacgccaccugcggcgagaagggccccgagauguacugcaagcucgucgagcacguccccggccagcccguccgcaacccccagugccgcaucugcaaccagaacuccuccaaccccaaccagcgccaccccaucaccaacgccaucgacggcaagaacaccugguggcagucccccuccaucaagaacggcaucgaguaccacuacgucaccaucacccucgaccuccagcaggucuuccagaucgccuacgucaucgucaaggccgccaacuccccccgccccggcaacuggauccucgagcgcucccucgacgacgucgaguacaagcccuggcaguaccacgccgucaccgacaccgagugccucacccucuacaacaucuacccccgcaccggcccccccuccuacgccaaggacgacgaggucaucugcaccuccuucuacuccaagauccacccccucgagaacggcgagauccacaucucccucaucaacggccgccccuccgccgacgaccccucccccgagcuccucgaguucaccuccgcccgcuacauccgccuccgcuuccagcgcauccgcacccucaacgccgaccucaugauguucgcccacaaggacccccgcgagaucgaccccaucgucacccgccgcuacuacuacuccgucaaggacaucuccgucggcggcaugugcaucugcuacggccacgcccgcgccugcccccucgaccccgccaccaacaagucccgcugcgagugcgagcacaacaccugcggcgacuccugcgaccagugcugccccggcuuccaccagaagcccuggcgcgccggcaccuuccucaccaagaccgagugcgaggccugcaacugccacggcaaggccgaggagugcuacuacgacgagaacgucgcccgccgcaaccucucccucaacauccgcggcaaguacaucggcggcggcgucugcaucaacugcacccagaacaccgccggcaucaacugcgagaccugcaccgacggcuucuuccgccccaagggcgucucccccaacuacccccgccccugccagcccugccacugcgaccccaucggcucccucaacgaggucugcgucaaggacgagaagcacgcccgccgcggccucgcccccggcuccugccacugcaagaccggcuucggcggcgucuccugcgaccgcugcgcccgcggcuacaccggcuaccccgacugcaaggccugcaacugcuccggccucggcuccaagaacgaggaccccugcuucggccccugcaucugcaaggagaacgucgagggcggcgacugcucccgcugcaaguccggcuucuucaaccuccaggaggacaacuggaagggcugcgacgagugcuucugcuccggcgucuccaaccgcugccaguccuccuacuggaccuacggcaagauccaggacauguccggcugguaccucaccgaccuccccggccgcauccgcgucgccccccagcaggacgaccucgacuccccccagcagaucuccaucuccaacgccgaggcccgccaggcccucccccacuccuacuacugguccgcccccgcccccuaccucggcaacaagcuccccgccgucggcggccagcucaccuucaccaucuccuacgaccucgaggaggaggaggaggacaccgagcgcguccuccagcucaugaucauccucgagggcaacgaccucuccaucuccaccgcccaggacgaggucuaccuccaccccuccgaggagcacaccaacguccuccuccucaaggaggaguccuucaccauccacggcacccacuuccccguccgccgcaaggaguucaugaccguccucgccaaccucaagcgcguccuccuccagaucaccuacuccuucggcauggacgccaucuuccgccucuccuccgucaaccucgaguccgccgucuccuaccccaccgacggcuccaucgccgccgccgucgaggucugccagugcccccccggcuacaccggcuccuccugcgaguccugcuggccccgccaccgccgcgucaacggcaccaucuucggcggcaucugcgagcccugccagugcuucggccacgccgaguccugcgacgacgucaccggcgagugccucaacugcaaggaccacaccggcggccccuacugcgacaagugccuccccggcuucuacggcgagcccaccaagggcaccuccgaggacugccagcccugcgccugcccccucaacauccccuccaacaacuucucccccaccugccaccucgaccgcucccucggccucaucugcgacggcugccccgucggcuacaccggcccccgcugcgagcgcugcgccgagggcuacuucggccagcccuccguccccggcggcuccugccagcccugccagugcaacgacaaccucgacuucuccauccccggcuccugcgacucccucuccggcuccugccucaucugcaagcccggcaccaccggccgcuacugcgagcucugcgccgacggcuacuucggcgacgccgucgacgccaagaacugccagcccugccgcugcaacgccggcggcuccuucuccgaggucugccacucccagaccggccagugcgagugccgcgccaacguccagggccagcgcugcgacaagugcaaggccggcaccuucggccuccaguccgcccgcggcugcguccccugcaacugcaacuccuucggcuccaaguccuucgacugcgaggaguccggccagugcuggugccagcccggcgucaccggcaagaagugcgaccgcugcgcccacggcuacuucaacuuccaggagggcggcugcaccgccugcgagugcucccaccucggcaacaacugcgaccccaagaccggccgcugcaucugcccccccaacaccaucggcgagaagugcuccaagugcgcccccaacaccuggggccacuccaucaccaccggcugcaaggccugcaacugcuccaccgucggcucccucgacuuccagugcaacgucaacaccggccagugcaacugccaccccaaguucuccggcgccaagugcaccgagugcucccgcggccacuggaacuacccccgcugcaaccucugcgacugcuuccuccccggcaccgacgccaccaccugcgacuccgagaccaagaagugcuccugcuccgaccagaccggccagugcaccugcaaggucaacgucgagggcauccacugcgaccgcugccgccccggcaaguucggccucgacgccaagaacccccucggcugcuccuccugcuacugcuucggcaccaccacccagugcuccgaggccaagggccucauccgcaccugggucacccucaaggccgagcagaccauccucccccucgucgacgaggcccuccagcacaccaccaccaagggcaucgucuuccagcaccccgagaucgucgcccacauggaccucaugcgcgaggaccuccaccucgagcccuucuacuggaagcuccccgagcaguucgagggcaagaagcucauggccuacggcggcaagcucaaguacgccaucuacuucgaggcccgcgaggagaccggcuucuccaccuacaacccccaggucaucauccgcggcggcacccccacccacgcccgcaucaucguccgccacauggccgccccccucaucggccagcucacccgccacgagaucgagaugaccgagaaggaguggaaguacuacggcgacgacccccgcguccaccgcaccgucacccgcgaggacuuccucgacauccucuacgacauccacuacauccucaucaaggccaccuacggcaacuucaugcgccagucccgcaucuccgagaucuccauggaggucgccgagcagggccgcggcaccaccaugaccccccccgccgaccucaucgagaagugcgacugcccccucggcuacuccggccucuccugcgaggccugccuccccggcuucuaccgccuccgcucccagcccggcggccgcacccccggccccacccucggcaccugcguccccugccagugcaacggccacuccucccucugcgaccccgagaccuccaucugccagaacugccagcaccacaccgccggcgacuucugcgagcgcugcgcccucggcuacuacggcaucgucaagggccuccccaacgacugccagcagugcgccugcccccucaucuccuccuccaacaacuucucccccuccugcgucgccgagggccucgacgacuaccgcugcaccgccugcccccgcggcuacgagggccaguacugcgagcgcugcgcccccggcuacaccggcucccccggcaaccccggcggcuccugccaggagugcgagugcgaccccuacggcucccuccccguccccugcgaccccgucaccggcuucugcaccugccgccccggcgccaccggccgcaagugcgacggcugcaagcacuggcacgcccgcgagggcugggagugcgucuucugcggcgacgagugcaccggccuccuccucggcgaccucgcccgccucgagcagauggucauguccaucaaccucaccggcccccuccccgcccccuacaagaugcucuacggccucgagaacaugacccaggagcucaagcaccuccucuccccccagcgcgcccccgagcgccucauccagcucgccgagggcaaccucaacacccucgucaccgagaugaacgagcuccucacccgcgccaccaaggucaccgccgacggcgagcagaccggccaggacgccgagcgcaccaacacccgcgccaagucccucggcgaguucaucaaggagcucgcccgcgacgccgaggccgucaacgagaaggccaucaagcucaacgagacccucggcacccgcgacgaggccuucgagcgcaaccucgagggccuccagaaggagaucgaccagaugaucaaggagcuccgccgcaagaaccucgagacccagaaggagaucgccgaggacgagcucgucgccgccgaggcccuccucaagaaggucaagaagcucuucggcgagucccgcggcgagaacgaggagauggagaaggaccuccgcgagaagcucgccgacuacaagaacaaggucgacgacgccugggaccuccuccgcgaggccaccgacaagauccgcgaggccaaccgccucuucgccgucaaccagaagaacaugaccgcccucgagaagaagaaggaggccgucgaguccggcaagcgccagaucgagaacacccucaaggagggcaacgacauccucgacgaggccaaccgccucgccgacgagaucaacuccaucaucgacuacgucgaggacauccagaccaagcucccccccauguccgaggagcucaacgacaagaucgacgaccucucccaggagaucaaggaccgcaagcucgccgagaaggucucccaggccgagucccacgccgcccagcucaacgacuccuccgccguccucgacggcauccucgacgaggccaagaacaucuccuucaacgccaccgccgccuucaaggccuacuccaacaucaaggacuacaucgacgaggccgagaaggucgccaaggaggccaaggaccucgcccacgaggccaccaagcucgccaccggcccccgcggccuccucaaggaggacgccaagggcugccuccagaaguccuuccgcauccucaacgaggccaagaagcucgccaacgacgucaaggagaacgaggaccaccucaacggccucaagacccgcaucgagaacgccgacgcccgcaacggcgaccuccuccgcacccucaacgacacccucggcaagcucuccgccauccccaacgacaccgccgccaagcuccaggccgucaaggacaaggcccgccaggccaacgacaccgccaaggacguccucgcccagaucaccgagcuccaccagaaccucgacggccucaagaagaacuacaacaagcucgccgacuccgucgccaagaccaacgccgucgucaaggaccccuccaagaacaagaucaucgccgacgccgacgccaccgucaagaaccucgagcaggaggccgaccgccucaucgacaagcucaagcccaucaaggagcucgaggacaaccucaagaagaacaucuccgagaucaaggagcucaucaaccaggcccgcaagcaggccaacuccaucaaggucuccgucuccuccggcggcgacugcauccgcaccuacaagcccgagaucaagaagggcuccuacaacaacaucgucgucaacgucaagaccgccgucgccgacaaccuccucuucuaccucggcuccgccaaguucaucgacuuccucgccaucgagaugcgcaagggcaaggucuccuuccucugggacgucggcuccggcgucggccgcgucgaguaccccgaccucaccaucgacgacuccuacugguaccgcaucgucgccucccgcaccggccgcaacggcaccaucuccguccgcgcccucgacggccccaaggccuccaucguccccuccacccaccacuccaccuccccccccggcuacaccauccucgacgucgacgccaacgccaugcucuucgucggcggccucaccggcaagcucaagaaggccgacgccguccgcgucaucaccuucaccggcugcaugggcgagaccuacuucgacaacaagcccaucggccucuggaacuuccgcgagaaggagggcgacugcaagggcugcaccgucuccccccaggucgaggacuccgagggcaccauccaguucgacggcgagggcuacgcccucgucucccgccccauccgcugguaccccaacaucuccaccgucauguucaaguuccgcaccuucuccuccuccgcccuccucauguaccucgccacccgcgaccuccgcgacuucauguccgucgagcucaccgacggccacaucaaggucuccuacgaccucggcuccggcauggccuccgucgucuccaaccagaaccacaacgacggcaaguggaaguccuucacccucucccgcauccagaagcaggccaacaucuccaucgucgacaucgacaccaaccaggaggagaacaucgccaccuccuccuccggcaacaacuucggccucgaccucaaggccgacgacaagaucuacuucggcggccuccccacccuccgcaaccucuccaugaaggcccgccccgaggucaaccucaagaaguacuccggcugccucaaggacaucgagaucucccgcacccccuacaacauccucuccucccccgacuacgucggcgucaccaagggcugcucccucgagaacgucuacaccgucuccuuccccaagcccggcuucgucgagcucucccccguccccaucgacgucggcaccgagaucaaccucuccuucuccaccaagaacgaguccggcaucauccuccucggcuccggcggcacccccgcccccccccgccgcaagcgccgccagaccggccaggccuacuacgucauccuccucaaccgcggccgccucgagguccaccucuccaccggcgcccgcaccaugcgcaagaucgucauccgccccgagcccaaccucuuccacgacggccgcgagcacuccguccacgucgagcgcacccgcggcaucuucaccguccaggucgacgagaaccgccgcuacaugcagaaccucaccgucgagcagcccaucgaggucaagaagcucuucgucggcggcgccccccccgaguuccagcccuccccccuccgcaacaucccccccuucgagggcugcaucuggaaccucgucaucaacuccguccccauggacuucgcccgccccgucuccuucaagaacgccgacaucggccgcugcgcccaccagaagcuccgcgaggacgaggacggcgccgcccccgccgagaucgucauccagcccgagcccguccccacccccgccuuccccacccccacccccguccucacccacggccccugcgccgccgaguccgagcccgcccuccucaucggcuccaagcaguucggccucucccgcaacucccacaucgccaucgccuucgacgacaccaaggucaagaaccgccucaccaucgagcucgagguccgcaccgaggccgaguccggccuccucuucuacauggcccgcaucaaccacgccgacuucgccaccguccagcuccgcaacggccuccccuacuucuccuacgaccucggcuccggcgacacccacaccaugauccccaccaagaucaacgacggccaguggcacaagaucaagaucaugcgcuccaagcaggagggcauccucuacgucgacggcgccuccaaccgcaccaucucccccaagaaggccgacauccucgacgucgucggcaugcucuacgucggcggccuccccaucaacuacaccacccgccgcaucggccccgucaccuacuccaucgacggcugcguccgcaaccuccacauggccgaggcccccgccgaccucgagcagcccaccuccuccuuccacgucggcaccugcuucgccaacgcccagcgcggcaccuacuucgacggcaccggcuucgccaaggccgucggcggcuucaaggucggccucgaccuccucgucgaguucgaguuccgcaccaccaccaccaccggcguccuccucggcaucuccucccagaagauggacggcaugggcaucgagaugaucgacgagaagcucauguuccacgucgacaacggcgccggccgcuucaccgccgucuacgacgccggcguccccggccaccucugcgacggccaguggcacaaggucaccgccaacaagaucaagcaccgcaucgagcucaccgucgacggcaaccaggucgaggcccagucccccaaccccgccuccaccuccgccgacaccaacgaccccgucuucgucggcggcuuccccgacgaccucaagcaguucggccucaccaccuccauccccuuccgcggcugcauccgcucccucaagcucaccaagggcaccggcaagccccucgaggucaacuucgccaaggcccucgagcuccgcggcguccagcccgucuccugccccgccaacuga
